United States Patent 9,328,346 (POLYCOMB-ASSOCIATED NON-CODING RNAS) - sequence listing, part 10

SEQ ID NO: 1396 - RNA, 189932 nt, Mus musculus
gccuugacgugauacgcugccaguugacgcagcugcggugccgcuggccuccacuccugccucggcucuacuccuccgccccauggguguccgaggcggcgggccgagcuggacgugcuacaggcugaggguguaagcaucagcggaggucccgacucggggcuguugugcugucaagugagaggagcucgagaggcugcgcgcggugagggcugggagguggcgaggugggcagcgccuuuccgggugagucuggaagguuugcggggucgcggcuguggcgcgggccugggggucggaggucggaggucggagguuaagguggaggccuagcaggcccugacagccgggugcugggguugcgggcggggggggcgggcgcgcggaccuggcggggugggcagggccgagcgccccggguuggcucggcccucgucugguagggcauaccugaguggacaccucuccugccagaggaagguccacaaggguuaucuuccauccggggaauauuagauuucuuccuuccucgccccaucgguugugguguugacagugggauguccgguaaaggggacgaauucuuguaaauuuccucugagcagucauggguucuggaacggagaaaguagguuucaggugguuucgcguugcugcuuucaucccgugcaugacaacgaagcagauuuaaucugacaaguauaaaaguggaugaguuagucagaauauuugacuuagcaaugacugcuaugugcuauuuuaauaugcgcucauacaguuuguaacaaaaaggugaagccuuuccccacuuuguagcugagaaccuuggaacagaacuguuucaaaccugacuuucucacuuuauggccccucaguuagcaugccaccccccccccauuacucaaaugccuuaaaaguuugcaaggcaagugcccugugauaaaaugugccaggugcccagaguagagaggaaaugaaggcacaguucuuuccagcagacucggugucaguagaaacauucuuucaaggcugcacuuuuaagugugccucgcagguagaacgucaccauuagcauccugacuccuaccucguggacuccuauguuucuuuuacauauaaagugguucuuaaauuauuuuagucuuauuugagguguaggaauguaacauuggaccaaauacugaagaguuuccugguguguuuaaauaauuuaguuugaaacgguugcucuaccaacaaaguuaggauaccuuuucuaauugauugauaugcuggucuuuucagacuuguuaagaugaagcgcugcagaaggaccuucagaagaggaaagauaaacaacauugaagauuaaaaaacuaaacaaaauaaaacaagaaaucuuguguaaguauuucugccuaagauuuaaaaaaaaucuaauuucuuauuaaaguccagauagagaaaaguuaacuuuaugcuucauuugugauucaguccaucugugacccacaaaucauuccaucugcauuuuggacugcugauaccuggauaccugauugauaauuaacucaagugcuuaacuuuugcauuggcauaggaacgcccaggggagggaccaaccaucgccgggugccaguuugcuuuucuuuugcuugcucuauuauuugcucauguuuacaaaaugcuuagaaaagaauauuuauaugucucugugugcgcuuguuauuguuguaguaauuugccuuuuaaguacagauaaagaucucugcagccaaggcuugccuggaacuagagauucuccugccucagcuucuugguauagguuugcaacaauuacccaacuugaaauguuuucuuccuuucucucucuuucuuucuuucucucucuuuuuuuuaaauuuuggguucuaaagagaauaguaaaagacauggauaaaaacgauugaauucauuuaauagauauuuauaaaguacuauauagcagagaccauuuugagcuucugguaaagaaugaaauaguagaggaagagaaaagaagugccucuguuucucuugaauuauuugcugugugaagauuauucagcagguucuuacauuagcuuucagcuucucuucaugaugcaguugguguacaaugaguuguggcugagcuggauagccauagaucuguggauacucuguggccuugauccauugccuuaugccagaauaugcucuuccuauuaaagacuguauuaguuuccuuucagugcugugauaagaccccaugaccaaggcaacauaaaggacaguuuaauuuggcuuaugguccuagaggguuagagucuaugaugguggaacaaaggcaugguggcaguggcuagagcagcagccaagcgcuucgaucuugauccauaaucaggaggcagagugcauucuaggaauggcacuaguuuaugaaaucuuaaggccuaccuccacugacacacccauuucaaggcuacacuuccuaagccuugccaaacaguuuuaccaacuuugaguauucaaaccaccacauuucacucccuggccucaccaacuuguggccauaucauacugcauaaugcauaaugcuucuaguccaacuucaaaaauaccuuuugguauuaaacuguuuaaaaaaaucuaaaguuuuaagucucuucugggacucaaagaaaucucacaauuguaagccugugugaaaucaaaaaaauuuaaauauuuucaauauucaauggcuuagaauauggauuccaauuuuaaggggggggggagaauaggcuauaguaaggaaauacuggcccagaagaaagacugaaacccaguagggaaaaccccaaauccugagcuccaugucugaggucaaagggcuuggauggcucucuccauucagcuuucugccugcagcacacuccucauucuugggcugauuccauuuccucuguucuacucucucuggcagauaucccauggcucuggcaccucuaaaaucuugagaucuccuagacaauucuggcuuaauuuacagagcuucagacgauggccucuuagggucuccaugcagagacucgccugucagcugcuugccugcagugguucuucuuaaccgcugagggguuucugucauccuuuuacucuuuuauccuucgugacuccacauugugcugcucacuggggauggagccuggccucacauuuacugcagcuuuaauuuguuguugccuuuaaauuccuugggcuuuuucuuuucacaacuuggaggcuuauuugacugaggucuuaccucagugugccuccuguaugccagugcuugaucuccuuaucuccuucagaacaagccuugauuccagcacuacauuuccggguuucccuucaaguuguacauuuuguauuucauuugcccuacuugaucuuuuucauuguagaccugcauaagagugauuaugaauaacuaugugacagagucaauaugaggcugucuugaaaucuucacugccaaagaaauuagucuauuacuuuucaacuuagccucaggcugaguuuuaggacaagguuuaaaggcagccacguuauuuauuuauuuauuugccaaaauuccaugaaaguagucugagaugagcugcuaauauuuuuuccccucuaaaacuucuugagcuggggcuccauaauccacauuuuucucaguacgucugccuucuuuuuauguuccugcuuagaaaauaggagcuuaagcuuugcuuauagcauucaacugcuuuucucauccaauguccugaagucuuccacaucuucccaaaacaaaaacaacaaaaauggcauggucaggcuugucacagcaauagcucauuuccugauagcagcugcuauauuaguuuuuuuccugaugcuauaauaaagacaucaugaccaaggcaacuuguaaaaggaagacuuuaguuuggcuuuauggauccagacaguuaguuugggugguuaguaugaugacagagcaaaugagaacaaauggcuggagcagcagcugagagcucacagauucucaagcgggaggcagagaggggcacacuggcaaugaggagguugcuuugaaaccacaaagcccuugcccagugacacaucuccuccaacaaagccacaccucccaagucuuuaccaaccaacgccaccaacuggggaccaaguaguuaaacauaugggccuauggaggucauucucuggucuuuacuagcucaagauguguuuguuuguuuguuuguuuguuuuuuccuuuuuuuccuuuuuuugggggguuuuucgagacaggguuucucuguguagcccuggcuguccuggaacucacuuuguagagcaggcuggccucgaacucagaaauccaccugccucugccucccaagugcugggaucaaagacacgcgccaccacgcccggcuucaagauguguuuuaacacuggguuuuugucugaugacuuuucuuagguguuuugcauuaaucuuauauugaggagaaugcugguagauacugaucccgcagacuuaugcugugcagccucaacacccucuuccuucauuccuuugauaagaaucauggguuguuauaauggaagaugguggugauguuguauggggauucuguguucuuuuguggaugggucacuauuucucgggaaacaaaguaucuuuuauguggagauuugacugucagaacauaucucucaguuaaugucaguaguaaacucugccuccuuaaguauauaaucauuugacauuucuaagaugauaaaaauuagcauaaauagguacauggcauuuuaucacauguaauucauuauaaaauauguggauauuuauuuguaccuuuuuuuuuuuugagaugcauuuaacuagccuuaaauucaggcucuaggcuuagcuaccggaggaaguaagacuauaggaguaauuacauuaacauuaucuuacuguauuacuggagucacuauggcuguguauguuccuggccuuuuuucuucuuuggugucaauucugcguccucacauauuuguauuuuuuugacuaugggucuuuucaaagugugugucuccuauauuuaaauuaaaaaauuguugaacaaaaaagaguggacgagaauagaauguucauguauuguaaagugaucccuuccuucuaaaauuuaagcuggugacagguuuugcagugccuugagagauguaacaacaugucuuacucaguuuguagacaguggggaaaauguaaauguaaaaaccccuuucccauuauuuucucuagcuuuucuguuguuucauagcaugcucacugucuguuguucuauacccccucauuuuacuuuaacagauguuaacuucuuuaugcuaugcuaauauuacacacacacacacacacacacagaguacacaaacagaguacacacacacacacagaguacacacuuggaaaauuaugauuuguugucauccucaaagugagaguugugcugaacaaucaaaauauauuuagaaaguuaacaagucauauauuuugaauuucagugaaaaaguuaucuucaucauucuuuguccauuuugaaaagauuuacugucauguuuuccccagacuuaccugugcuacuuggucaaaggaauauuaacaaugcaguucucuuuaugacucuuuucuccacuuuucuuugacuuuuuuuuuaaaaauuggauuauuacuggauucuuuuugcuguaagugagcugggcuaauugugugaauuguguauuuaaaaggaaauaccugucuugucuuuuaauuagaguauaagaacuuuauuuuuauucauucuuuauauauagaauaaucauaauuaugcuacuugugugaauaugaauauugucuuaggcaauacccaagacacccaauguugcuauuaaaagacacuaugacuaaaguaauucuuauaaaagaaaucauuuaauugggugcuugauuacaguaucagagauuuaguuugucaucaucaugauggagaaguaguugagaguuuuauccugaucuacagagagggggcgggggaagagaggagacagggagacagagagacagagagagacagccagacacuggcaugggcuuuugaaaucucaaagcccacccucagugacacccuucauacaaggccauaccuccuaauccuucuaauccugucaaggaguccuacuccuugcugacuaaccauucaaauauaugagccuauggggcuaucuuauucaaaccaucauguguauauaucuauauacauauuuaucuauacaauuggcuacaucugcucauaguuugacauuuuauuauaauuuauccugaacaucugaagacaaaaggucauuuaacuauucacaaacuaccuagagugaacuugacuuggaaaucuugucaaauauagagaaaugauggagauuaugaagacuuguuuaauuuauaaauauuaaguggcaacuuuuggagaaaaucuagaugaguaauuauguagaugcuuaauauuccauauuaaaauaggcuuuuauuuugagcuuuaauaguaaccacgcuucucuuaguaacuacuccuuuuuuuuuuuuuuuuuuuuuucuugagacaggguaucucuauguaauucuggcuacccuggaacuuucuguggaugaggcuugccuugaacucccagagauuugccugcccugaaugauaaaaucaauauauuacuaaugugaaccauggccuuauauuuagauagaaauauguacacaguucauuuguuguuuacuugcauugccagugaaagaaguagaaggcaacuuaucaagccuuguuaauucaccuuuuaucccuuuacaugauuuuuuguugcagcuuugugaaucuuugauuucaaguuuguuaaucuccuuuaggccuuuagauguucuggaauaacaccagugauggaucaaaggaagaaugacagcauuguccccaguaucacucaauuagaagauuuccuuacagaacacaauuccaauguuguuuggcuucuuguugguaaguagacuguguauuuucugcaugcauuaacaacggccagauuuuaggcaguggcugacugaaccuggagugcuauagcagcauccguuuaucuuuaggaaagggaguuuguguaugucguuugaauauuugcucuggaaauugcucuguauuuuccccucuuaggcugccuaguuauaugucuuaagagaggugggggagaaaaaacauugauugucuuuagcuuauuuugcauguuuuaaauuaccuuccacaucccugcuccaacacauacacaaacauuuuuauuauaaguguaauaaauguccacgguaaacauuuuauagugaaacaacauauauuuaauacuuuauuuucuucucaguugggggaaaauggcaguggcuuaugcuaucuauaccuuuuuuauauaaugguauagaaguuuucuagguaugcacauaguucauucaaacagugcauaauuaaauguuagagaagggaagggaggaaaugagugaaugaguggcuaacugauuaugaaggagaaaagguagaaaaauaauacuagugaaaagaggcuguuacugugcacaaaucgacaugaaauugugcuguuuaaguugaguagaaacuugaagcguagaagggaaaauagggaggguagaaaggaaaaggagacuuaccugauacgcuuccgaucuuugcuauacugagugcaauaggaaguuugcauguguuguuucaacacacaaagcaguuuuaugaagauaggcuuuaauuuuuuccauuuuaaucuguuggaccacugugguccauggaccuuaaauaagguccauggauugcauagcuccuuucccugcgugcaugcuuuugccucuuucaugauuugaugccauaugcuauaaggcagggguauggguggaagugacacauauaccgaaggaauaaugauguuucauaauuuguagguaggauugaauuacaguuuagacuuugaguucuguauuuuccauuugacaaaacuacuguaaauucuuaaugaaagccaaaaacuaaaaugaauauuuucagugcccuguacucuuggguccuagaauccuaaugagguaaggugaggaaaugaagacagacacacauacagaaggagucaggugagcacacuaugaugaaguggcacccacugccucaugacccaaaaccucaguguauuuauuaaggacagcacuggggaggggcuggcuagucucagugagaggucucuguagagcagucucaggcugugaaucaauauuagaggaggaggaaagcuguagcugcuggcuuguuauguaccugguuacucaucuguacucucaccccugagggaagcuuugcauucuucugagcuucaccugggcaagacuugcaacucccauggggcugagacuuaguccccaacauggcugugcuuaugucaaccuucacucugucaggcuuccucuauuuccuacaaauacugacuauuuguaugaaauagaacucaaauauuagugugaaauucauaaaagcagcauuggaaaugaccugaguuugauuaaguugcagaauuuuuccuuauuucagauuuguuccauuccugucauguacagcuccugucuauauaaacuuuuuuuuuuuuuuuggaaauaaaacaguagcaauaaaaagagaauuuuucuaagaacaguuuuuguggugaaauuguaguacuuauguaacaaagcugacagagcuguuguggcuggugcguuuaagaaauaugguguucucuuaggacuugcuuacuguucuaaaaacucugcaacgaaaguuugaacaaacuuaagauuuuacugugauguugguaggucacaucuuaaccuacacauugcuuucaccuuuuuuagaaagacuuacacauuaaaagcaaagggcaacucauuacuuuuuguauuuuuccuuuuguguauucaugaauaaggugucuuaaaaauauaaaucuuguagaugacuauucauaacuaacuagacuaucauuugcucuaccauaaucagugacauucuucaaaaguaggguauugucauaacaguuacuauagauauuuagaauaaggcagccuauuuaauguuccuuuugacaaaaaguccuguuuuacugauuuuuauuuuguaugugcauaugcacaugauggugugugugugugaugucuguguuuuguggagacuagaguugacaucaggugcuuuccucagucucucuucugucuuauaucuuaagacaggguccuugaacaaaguuggagcucauugcuuccacuaggcugguuagccgaugaacucuggggauccuacucuuucuagcuccccaggucuguuuuacaauugcauggugccauaccuaucuuuuauagggguacuggagauccaagcucagugcuucaugcaagcacuauaccagcuaagccauuucccuggcccugcuuaucuaaaaguagagauuguugauucauaauuuuuaacaaugauuuuuucuaaguugaaaaaacucauuaagaaggauggcugaggucuaaacuggagugacuugauuguuguggcagcagcucuuaagcagcuuaccugucucuuaagcugagccauuguuccuuacuggcuccuugcagcaggcuucugcugggcagggcagggcagggcauacugagaggaauagagaugcuguuagaaucuuuggggauuaaacuggguauggauacccaguaagccauggauggaagaaaaacaguagcuucaguagugaaaggacaaaaaaauuggaaaacaagucuuugggacuauguggagggggagguggcauugugcucugggcuuuuuccuucacuguuacugacuauugccuuguugcacacuguguuuuguacucauucaaaauuauuagggucggaacaacuguuaauuaaagauuauucuguuuucauaauagauugccuugcagucaguagugacuuguucucagagcugagucaaguccaauggggaaaaugacaccuuaaccauauuacaauauaguuccacuugaacagugcacauacuugcauugaaaaaaaaugugggugauuaaaaaugaccuaauuucagaugcuuauaucccaacacagaccugcaagaaacauaaaaaagcaagguuguacuaugcauuugaaaauuccuguguguggggaaguuauagggaacuuuugggauagcauuugaaauguauauaaagaaaauaucuaauaaaaaaagagaaaauuccuaauuagauaauaagagacuccagugagagcaaauuagaugaaaucucaaggaaguuaaaaaagaauaauaaaggauguucagugaaaggagaggacaugaauaaacugagcaaauuaaaaaagcaugaacaauugaaugaaauuaagaugucaauacauagauaagaaagagguguucauuagagacacuggaagugcugaaaauaaauugguuuggaaauuuggaaaugaaaaugccaauaaauuaaaaauaaaaaaucuuagagaaagucucaccaauaaaauaaauagaucaaaugaaaagugaauuccagggcuugaagagaugauagaugaauagaauaucccgagaguaaucaaggugaaauaguaagacaguaugaagagaacacacaggauuuguggaguaccauuggauggaucaacuuggaauccgugggcagagaagaggggguaaacgguaugcagagcagaggaagaguggugcaggcugugacacacauaacggcagauaccugucagaagaacuccuuccuuauuuuaguuuuuuuaaccaaaaaugaaggcagaggcauggagcaaugccuacaaguucuugaaacguuccacuuuaaucugaucagaaccuacauuuaaaauuuuuuaauuauaauuuuuuguuuggcagguaacuaggaaaauaaaauuuauguaggaaagaagcaauccaugauuuuuaagauugcaaguauugucagaguacagauuacuauaugauaguacauuuuguuuuuacugacuuguuuuuccucucaacagcuaccauuuugucuuguggauggauuauuuaucuuacauacuacaauucucggaauguuggucuuauuuuaacacugguucuuaacagauuguauaaacauggcuauauccauauugguaaguguguauaacacuauuucuuccauguaauuauaagauaauauauuauaaauuuauaguuuacaaacaaauaguagcuuuagaacaucaccauguguuugaagaaaucagucuauguggccuuuccuguaacauuucuuagacagaaaugagcugccauuugguuauuuuuacccugcucuuauccuauuugcuccuuauuuuuuuuuaauaaaauguacuuacuagaaauauuugagaaacuuaaaauacuuaaaguuuccuuagaaucugccuggacuuugaauagucauuauagguuuuccccuuuuuuauaagguugauacuuuaaaaauuuauaaguugguauaauuuuguguauucuauuuuguggucacuuguugucaguuucuuacuaucaggagaaaauuuguaaguggauggaaauuuguauuaggaagccagguuccuugggaauccuaaugguuauuuggcagaaugggcagugagguggcuggauagaguccuccagcaguccucauauucagaugcuucuuaaugaguacaagaaaaucuucucugaaauaugaaucaucuucuguuaauuaggggaaaugacugaugcagacaggcuaauggagaaagaugaugaauuagauaccuuuuggguaguguaguagcuguuuauaauuaaacaauuuacucauaugaaguaguuacauauuauggcuauuuaguaguucaguccguagugguuugauccuuuuguuuucauuggugaaagaaagaugagcaauuuauaagaauuccaagggggcuggagagauggcucagugguuaagagcacugauugcucuucccaagguccugaguucaauucccagcaaccacaugauggcucacaaccaucuguaaugggaucugaugcccucuucuggugugucugagagagcacugguguacucauagacauaaaauaaauaaguaaaucuuaaaaaaaaauuagcuaaaaaaaagaauugcaaguauauggagaauagaaugggaaaagauuaauuauuuauuaaaggcuaggauucaucuaaguucuuaauccucuagugugcauuaaaagaauugcuguauuuaauuaucauuguguuuuuccuaacagguucuuucucuuucucuguucuuucuggaaaagucaugguucgugaaauauauuacauuacagaagacaugucuauuagguaaugaaaagugaaaagagacccaaacaaaugugaaauauaaaaaugauuuuauuuaaugacuuauacauucaaauaagccauaaaagguuuuuuuucaguaauguuuaaaaauuauuuuugccaaugaguuaauuugguuuaguuaauuuagacuaggaaaaauuuuucuuagcuggcaguuuauagaagugaauaauugcauuugauuuguagcugaaaaauugaaccauugauggaccugccauuucaauggugguuacaugaaauauguguuaggaauauugguaguucuuaucaacuagcuccuuauucaagguaagcauauacaaguauugagcauguauuagcaacuaaaauuuugcuguaagaauauaaacuaauaugaauauaauaggaaaugacauaauuaaaguguuuucuguaagcuuugaagaaaaccuuacuuuauuuuuuccaaacgugagguguagagagaugauggacuaauucagacguacuaugauuuggcauuguuuauaccucauuuaaaacuugcaaacaauuucugugguuguuuauaguuacuucuaaaucaaaaaauaauauuuaugaagcugagagugaaaguugauucuuuuaaggcacgaaguuauaggucauuguuagauaugaaagacuaucuuugaaaguuuucuuugaguuuauuaguacccucuuuaauuaaagauuugccuuuuaaaauaguacucuuuauacuuuaaaaauuuuuauuaaaauaugaaauuuucuguuaacucuuuuacuguaaauauaaccuauuuacguuuuaucuaauuagaagaguuguuugaguaguuuauauuuguuauacaugauaagccuauacaauuuuuaucaaucagauaaguuuuucuaauuuggauuaggcagucuuucuuuuuuuaacugaacggugaugaaacaagaacgaguugaguagagcuaggugugauaggccacgcccauaaucccaacacuuggaaguggaggcagaacgaucucaaagaaguuuauaaagucaucauuggcuuuaaaacaaguuuguccauuugccuaggaauuucauaaauucauucuuuuuaauagcugaguaguacuccauuguguagauguaccacauuuucuguauccauuccucuguggaggggcaucuggguucuuuccagcuucuggcuauuauaaauaaggcugcuaugaacauaguggagcauguguccuucuuaccaguuggagcaucuucuggauauaugcccaggagagguauugcuggauccucugguaguacuagagggcauuauccugagugagguaacacauucaaaaaggaacucacacaauauguacucacugauaaguggauauuagccccaauccuaggauacccaagauauaagauacaauuugcuaaacacaugaaacucaagaagaauaaagacugaaguguggacacuaugccccuccuuagaauugggaacaaagcacccauggaaggaguuacaaagacaaaguuuggagcugagaugaaaggauggaccuuguagagacugccauauccagggauccaccccauagucagcauccaaacgcugacaccauugcauauacuagcaagauuuuaucgaaaggacccagauguagcugucucuugugagacuaugccggggccuagcaaacacagaaguggaugcucacagucagcuaauggauggaucacagggcucccaauggaggagcuagagaaaguagccaaggagcuaaagggaacugcaacccuauagguggaacaacauuaugaacuaaccaguaccccggagcucuugacucuagcugcauauguaucaaaagauggccuagucggccaucacuggaagagaggcccauuggacuugcaaacuuuauaugccccaguacaggggaacgccagggccaaaaagggggaguggguggguaggggaguggggguggguggguaugggggacucuugguauagcauuggaaauguaaaugagcuaaauaccuaauaaaaaauggaaaaaaaaauaaaacaaguuugaagccgaccuggguuuuaaaaagugaguagguaaauuguuuucuuauuuuucuaaucugucuucccucaggauucaggaugguuuuaucauuuuucggugguggaaaauguauaacccaaagcagaaacaacaugguaaguucucauuuuuacauguauaaaagguauuugaucauauagucagaaauuuccuuuauauguauuuaaauguuuuacauuauaguuuuugugacggcauuuaaaaagcuguuuuuuaugucucgcuuaaguuaauuuuucauuuuaccguauuacucagucauauuaucaaucucuaucuauguuucuaacaucuguugaauauguagaccugaccauauucugaauaaaagggcuuccuaccacucuaaucuuuguaagacacucuucagcuccucuuuauucauacuuguuauguuacccaacuuugucuugaauuccuggacucuuaagagauccuguguuucagccucuuuaguaacuggacuauaaguaugugcugcuauaccgcaaaugauuauugcuguuaauuacuuguuuaucagcauucauauggcuucuuuuauuaggucucuuguucauuucuuuuuuuggauauguuuauuuauuuauuuuuuuaaauuuaauuuuauuuguaauucauuuuuuagucuccauauuccauucaccaccccuccccauccaccuuccgacugcuccacaucccauaccuccuccccaccccacccugucuccacgugaauguccccaccucccaccucacuugaccucuaaacucccuggaaccuccagucucuugaggguuaggugcaucaucucuggaugaaggcagacccagaaguccucuacuguguguguguugggggccucauaucagcugguguuugcugucuguuuggugguccaguguuugagagaucucggaggcucaaauuaauugagacugcuggacucuacaggaucacccuucuccucagcuucucacagcuuuucccuaauucaacaacaggggucagcugcuucuguucauugguugggugcagauaucugcaucugacucuuugagcugcuuguugggucuuucggagggcagucaugcuaggucccuuuuugugagugcuccauaaccucaguaauagugucaggccuugggaccuccccuugagcuggaucccacuuugggccugugacuggaccuucuucuccucaggcuccucuccauuuccaucccuguaauucuuccagauagaaauuacggguuagaggugugacuguggaaugacaaccccaucccucacuugauguccugucuuccugcuggaggugggcucuguaaguucccucucccuacuguugggcauuuuaucaaaugaaaagcuagaaaagagucucuuaccuccccaggucucuggaucauucugguguguguguggggggucccuacaacuuccuauuuccugagguugccuguuuacaaucuuucugcaggaccucacccaauacuaggucagauuccccuccccccccaccacuaucccccacccuguccacuuucucucccaauucccucccucccucccuacuuguuauugcuuucuucucucucuuguucauuucuuaagcaauuguuuucuuccuguggaguaguuugaguuucuuaaauauucuguguaucacuuuuaucagaggaauuuuuuuauuaguuguaugguuugaagauauuuguccccaaaugguuuguauuuucuguuaacuauuuccuuuguuaugaauauacuuuuauuuugacauaaucucacuggucuuuuuugcuuacguuuuuugggucaagcauaaauaucaguacauggaccaaggugauauuuaguuauuacucuuuuguuauuuuuuuuuccugguguuuuaugaucuggggcuucacaagucuuucaaacuauucucuuguguuuugugguccauuuuucuccuuugcaucaguuuuaaacuuugugucuaguuuagcauugaauacguggccuaucucucaugauuuggggugagaguuuuaaagcuauguuuuugugcucaugauuuccuuggcaguucugguucuucuuuaguuccacaugaacuuuaggacuguuuuccauuuaguugcuaucuuggucaguguucucuugcugugaagagacucagugacaucaccaacacuuaaaauggaaagcauuuaauugagguuugcuuacagugcuuacagagguuuaguccauugucaucaugccagggaguaugguagcaugccaggagacauugugcuggaaaaggagcugaggugucuacauccagaucugcaggcagcaggaagaaagcaacucuggccuuggaaugggcuuuuugaaaccucaaagccagugacauacuuccuccaacaauguucaccuucuaauucuuucugguagugccucucccugguaaccagguauucaugagccuacggggcguucucaugcaaaccaccacagcuaugagagaaugggguucugaggugacuucacugacucugaagacccucucuaguaaaauuuuacagugucccagcccagugaacaugaaauauauuucuccuaauucaaucucuuuccuucauguuuuacaguuuuaacuguuuaggacuuuaacuccuuugguuaauuuaaucuuaaauacuuuuuacuuuuauuuuugguaacuauucuugggauuguucucuugaaaacuugcuauuaguguggagaaauguuaaugauuuuugaauguuugauuauuuuuaaucuuguaacuuugcugaguucacuuuuucaguuuuaagaguuucugguagaauauugaggauuuuuuaaacuagaaaaucguguugccagcaaacacuuugaugucuuccuuuucuauucaugccuuauuuauuucucuugacuuacuacuuggacaaagaauuacaaguuugaaaugacgugaggguggauauucuugucuucauugggucuuagagaaagaauuccacuuuucacuacagaguuaauguuagcuaugaacuuacuguauauuccacccaccuuuuaaaggaauucgcuaauuuggaaguuaauguucuuagcaaugugcucauaaccauaccugucagaaguaaaaaaagaugugaaauggcaauguagaaugcacuguccaaucuguguguauuauccaguaauuuagaguaaaguacauugaguggugauaugcuggaacauaucauugacaaaaucuaagcacucaguagauuauguaauuauuuauaacaguauuauaauagugacuguauuuccauucucuagaaggacuuuauaacugagauauucuuucuugcugacuuaagggcagauucauguguuuugacaauuauccauucaguauagaugguuugcauuccuugauggaaaacuuaggagucagguuggagcaugggcuugaaaacaguggaagcuuuucagacuuccaaggagauaaagacagacucuucauaggacuaagauuuucauuacaguuguuugauuggaagaaaagaaugguguucagguccacaauuuuuuuugcuguaaauguugguuggaauaauuuuaaccauuaacacauugaaauuuguugguuguucaugaucuuucuaggaagaaagaaagagagaaagaaagaaagaaagaagaaaagagagaaggaaaaaagcgagggagggagacagacauauuuaaugcuucuuagccauagaauuugguauuaaauauucucuagguuauaacauuaguucuuugcaauagauaguuacaugucuguagaaagacauuugucauuguuuuaguagguguacguguaugaccuuagaguaugugccugugggugcuugucuuugcauacuucuaagucuuuauaugagcacaccugugauauacaucuuuguguaucuauuucuuuaauagguauaguauucauuguuucucugugucuaugagugugcuuuuacaacacgugucucuacguauguauugggguagggaugaaggauggagggaugaguuuugcucuauagaguacuucugggaauuuuaggcuuagauuuuuaaaaaccuacuuuuaauaagguuucuaaaaugcuucagugccccugcccuucuaacccaccaucaaaaaagaaaauguggaaaaaagaugguaaauaggauaaggggauguagaucuguuuaaaaguaguuccuuagggugguucuauuugucagaauaccagcaguccaguuuaguagugccaggauaccaaacagaaauuagcagcaguggcacgauccaacaaaaacugacaggccuaggccaaauagguaugaguuagggagugaccaggacccaccaggauuccaggagaaguuuucuguugugcgucuuucaaaaaagcaaagaucagcaaagaugaagaugcuagaccaacacaaagcuagguauacaggcuugccaucacucccuguugaguccuauuuauacuaucuccaaauaucauguauucucccaugggucuugccucagcaaaauaccauaugaaucugucuuagcaaaacaccacaugagucugcaucacaugauauauccaacaacguccacuucagagaauuauagcaggcugguaacaaugauaaaaaauaaugacagaaacccugaagaacuacauggaugucaaccaaucaaucaggcuuaggaauuugauuuacuguuggcacucuggaugaaauauugucagugcaggcaaaacgaauagaaacaauagggcacagaaaaaaggacaugaacuuagcuaaauguuucuuuaaaaaaauagguaaaaacaugcuuuuacaaacuuuaaaaacuugcuauuuaauacuucucauaagugauuuuuagaaggaaaagauaaucucuaggcugauaauuguucaauauaaccuaaauuuuauucaaucuuauuuaaaauuuagacccauuacuauuuuuguacagugauucaaguaugaauuggguuccuuccuaucuuuugggcauauaguaggugccagcgauacuaugguaggcuuaaugagcaagcauuuucuucuaauaggagaggcaguaaugaacagugugaaaaaccagggcguggaagaaggaauuaggggaucuugcaguguuugguauuguguacuuagaauuuaagaggguuauuaaauauauuuagaaauuaauaaauauaucuuuauaccuuggcaucuuuaauaccuuaaugcagguauguuauaauaucagcuuuauugaaaggagagaaccuuaugaauauuuugcauaauagagaugaaguugaggguaauccugcuucauuuuaugcaguccucauuuguuuagucauuacugcugcucccauuagggacaaauccucauugccuuuauugcauaaaccuaaugcgcaggacauuugggcuaaagagucauuacuaaacugccagguuaauuaaguaugaaggcgaguaucuuaguaaguuuugaguugaguuguuuaugacuugaaaaauuguauaauaauuucuacuuguacugcuucaugugagauuauaaacauucuacuuuauauuuaguauaaauaaauauuuaaacagcauaagaucucauuguagauuuuuccuuuccuagaaguaugacuuacuaggaagauacucugcuugcuugcuuucucucucuuucuuucucucucucucuuuuucuuuucuuuucuuuucuuuuucuuuuuuuuuuuuucucaagacaggguuucucuguguaguccuggcuguccuagaacucacucuguagaccaggcuggccuugaacucagaaauccgucugccucugccucccgagugcugggaucaaaggcgugcgccaccacguccggcuucuuuucuuucuuuuuguacaaaugagcucuucuguauagcauucuucuaggcacuagcaaucagcaaaauggucccauuguucacugagcuuccuacauucuugaugggaagauucagauaaucagcaaauaaugagaaaauacauugaggagaaaaaguauaaaagcaggcacaguugaguguggaguacuuuuugguaaaguugcuccugggaaaucaggagagucuccauuggcagaggggaguuaaagagagcaauucagcauuaagagagugcauguccgucagugucucagggagaacuuucugugguucuucuguuccucucauugccaacaccaccgggccaguuuacuuagaguuaggguagaaagcagaauuaccaagugagaggguagacuauauagggcuuacauauuucaaaggccauauuauuuuucugaacaagguaggaaaccauuagaaaauuagagaagagaggaugagaagaucuugaguuuuaaauagucuguuagaguguuaagcacaggcacaaggaagaacacaacagaagcugagacuauuacaggaaguagaaagugauggugacuugaaccagagcauuaaaaagggcuuggauuucgaauguuuugugaaaagcagacaugaaagagcaaucgaagcuuuugagcuuuagcaauggaaaagacaagcuuucuguugaugagggacacuccguauuggguuuggguaggaaaaucagguguugguaaaccuuacuucagagaagucggacacauugagugcugccacuugcccuuggaguccugggcaccacuguugauuacuaagcacagguuuaaaccugaugcaugauugaauuugauucacuuguuuaaaauggguaauuucacuuauucguuucaagaauugugguacuuuauguauauuaauaaaacacugccuauguaucaucugcuuuuaagaauuugauaugcaguaaggaggaaugguggaaugguugauguaauagggauugucuuagcucuuagucgugguaaaccuggagaaacagcagagaaucaaggucaaauaacuacuuaaauaacaggaaguacaguucauggacgcggaguacuuggaguuaauauauauuuuauuuuaguaccauugauuuuuuuuuuuuaaggacugaauuuguuccucucuacccaauuguccuagaaaggaaugagaaaauaccuccagauugaacuaauaggauuacuaugcuaaaaauaaauguuuaugauuuguuugucuucguuucuuuuaaaaaauugaauggcagugcauuuuguuaguuaaaaauuuauauuugcuuauaguuuucaauauuucauuuugaugucuacagaaaggauagauacuuguuuaaauuauagcuucaucuacuauuaagaugagaguuaacauguuuuuuucacucauuuuuaaaaaugaaaguuuuuuauaacugauuauccaauuuuaaagaauaugcaauaugaucauuuagguggaagugaaaaauagacuauguuacaaagauguuaagaaaauguaacauuuuauuuuagaacaaaagaaauuuuugauaaguuuauucuaauaugguugacaugaccauggcuugaaacuuucuccauagaaacuaauguccuuucucuuauaaguuggguuguuuuacuuugugaaacaaguuuugauaaaaaguacugugauuaaaauccuugaaaguugacuaaauccuuucuuuccauucugcuguuuguuuuauucauucuuuuuuuuucuuuuucuguaacuuguaucuuuagauccaaaggcagaaaccagauuauauaucacaguuaaugacuuugaauuucaugucuacaaucggucugaucuuuauggacgccuucaagaauuguuugguuuggaaccaacuauaauuccacccaagaaagaugaugauaaaacccgggaaaaugggagaacaagaacgcaguccaaaauugaaagguucaguuuaauacuugaaucuuacacauuucuaauguuuaaacucuuuuuuaguagaauaucauuaacauuguucaccuaaacagaauauaaucucuuuguuuuauauagcuauauaaucuuucaaaaacugaaguaauguaagauuaguuuauauaaaaagcccugucucuuuucuuuucucuauauuacuuuucuccagauucagacaguuauuaauuugcccuuuaucuuuuaauauguguauguaaauauauaccauauuuauguauuugaaguacacagguaaauauuguguuuaugaaaaucauguguggucucuugucuaaugucauuuuucuuugauuugcacucucucuuucucucuuucuuguggugcuagagauuagccagggccuuggucaugcuaagugagcacucuaccauuugcuaauccccagcccugugaucugcuauuauuuuggaaauauauauugaaaucuuucuguaucuguguaccuuaaauauauaacaauuuuacaaaggaaaauagaauauguucuaugugcuauaaaaauguguauuacugucacuuaucuuuguuuauauauauguuguuaaaguugagagucagaacaggacuagagaaaagaaaaucuauuguagaaagacagauaaaacuuuaagaaggcacuuaaaauaauacucagagucaguacaauguucagugcauaguaauuuagucugagucuuggaaaauaagccauaauuagaaaguuauuaguaaaugaaaugacucauauacccuuucuagugaaaugaaaguuucuuaaauuaaaaauuuuauucaaaaggauuguuuuugucaaacuauuauuuucaaaugcagcucauuuuaauuuuaauuguuauauuuuagagacacucuuauuuauauuuuuuagucugaaagauguuccauuguaugaaauauuauucugauuuuuuuuaagagaagaaaaucuuguuauugaaacaaaaugcauaugauaaaacaagccagugcuagaaaggcaaauauuauauaaucuuguuuacauguugaguuuaaaaaauaaauuuguuuuuacucagcuaggcauggauacaaaugugaguuuuagaucagcuaauagugagacccuuucuuaaaaaaaguaaaaaauaaaaagaaacucccaaagaauaaaauauuguuuaaaaauaaguagagaauagauagccaacaacacaggcucccucccccugagucuuaaacucagagaaaccggguagaauugugguuccuaggggccagaggugaugagggccauccugacuuacaucuugauggcauacgucaccugguugcuguaauaucuuagcuguguuauaaaguagggugaugggaugggugccacaguacaaaaaaaugucauguucuacuuuagaguguucuucuagaaagguaguuuuucacuguagcuucaaaaauaaaccagaaugaaaaaguacaggcuaagaaauccuuuuagggaccaugcugucuucauguggugguuguuuuguuuacuugaauacucuuuagauguauuuggaaaaugcagcuggcauuagugauguaugaugugagguaguuuaauuuuguacucucagguauuuaagauuuucuucaugucaguuuuauuuuucucaucagaguuaaaguaaaaacagaaucucaagaccccacaucuucauggagaucacuuaucccagucauuaaggucaaugugagcacaguaaguaaauuauguugcgucauguuuggcagguuaaugcaaaucaaagucuauguaagaaaagaaagcaauuuuuuguacauuuuuuguuccuauuucuuuagcaugugaaugagcuguuuuaacaccagcucuacauuuggaugcuuauuaaaucugaagggauauuuacaaauguuuaaauuacucuaaacuuaucucuagauuuuuuuaaauguugguuuaaauggaugaugauuauuuuaaauaaugauuuaaguagcauauacagcuaaaguggaaucauuuaguuguugcauaaaaauguuccuaguucagcuaaggaaaacaaugacuagacuauguugguauaauaucucuuuuuauguuuuuagggacguuuggccuuugggaaucauuaucaaccucagacucuaugcaucaacuuugaugaugcguucuuaacguauacuacaaaaccaccuucaagucaucuugaccaguucaugcacauugugaaaggaaagcuugaaaauguucgagucaugcuuguuccuaguccaagauauguuggccuacaaaaugaugaguaaguaaacaucaugaaagugguagcuucuuuccccuggagccuauagcagccuucucauuucuaugguagaaguuguacaguaaguacaaggcuuuccaguuguuaaagucuuugugcuaagaagugauagucauacuucucaguguguuucuguguaguuaguaguauaauuauuuuacucucuuuugcucacuuauuuuuguuuaaauuaagcuuugauguuguuaggauaugcccauuaaagguguauuuuucugucuagaaaguuuagauaaauaauaaaaugaagagauuaauuuauaguggauuuagugaaaguugaaaauugacuaauuuuuuuuuuuuuuggaaaauuugguuagaauggucuaauuuugagacaaccauuuaaguuuucuuugaaccucaaagaguuuuucuaucugcaugcuaauguuuccccaugcugaaauagcuguucuaguuagaagauagguugccugagaaugcacagcagacccacuacuuaggugagaugcuugcagcaggaagggaccaggucugaggagacagcccugccagacaccgggucuugucuuuaccucuggaauaacgguccccauuccucauauuuuuucagucucuucuuuuuuaugaugaguacucuggcugaaguuguguaauuuuaaauaauauauauauggaaacuuucuauugugauauuucagcuuuuucuuuguuuuaucagccauguaaguuuuuaugaaauuauggaaagcagcuuuuaacucuuggcugauaugcugcuaaaauaaaaucuccaggaucagcuaguaugguagagagguuccccuauauuaguucuaggugacuauggucuacuucaccuaacucuuagagacuugacuaaagauguucuggaauuugguagaugaacaaaacuuuguguuaauaggucaaguguaaugaacagaacuguaguuuuaaauaacuagagagauaagaaaguguucuccuauuaauauuuuauauaacauuauuuaaaauuguauuuuucaaaaauguagauacuggaugccaugccuuucauuuuagcacuuaagaggaagggguaggcagauaaggaguucaaggucccacgugguuagugagucucaggccuuaggcuacaugaaauuauauuuaaaaacaaagcaaaacaaaacaaaaacucccaccagauuggcuuaccuuuuguggcuuucuaaagccuuuauuuugugguauuuagaagaaaauuauugcauucauauaugcugcuaucuaaugauugaaagauggauuuuuauguaguagacaauaauaugggauauggcagagaagcuguuaacucuaaaguuugagagaaggaaacuuagagaagcauucaugucaaauuuuaaauucaggauaauuguuguacauuuauuaaucagugaaauacucuuagagaaaaguaauuaaauuguuauagauaaaaugacaauucuuuuguuucugaaugacuauaguacauuuuucugguugauuagcuauuacuuaggauuauaaugauaguaauauaauuauuuaaauuuugccauaaaagcagaauuugauuauuauuauuauuugauuauuucaguaauuauuguuguguuuaaccuccauuuuaauuaaauauauuucuuuucaaacuuaaagugaagucucuaagccaauuguuuucuucuuaaacuaauuuaccaauaaaauuuaagucauuuuaucauuuaaccugauguaaaauacaacuagaguaacuuuguauagugcuugucugugugaaagauguucuuuuccuuuuaagauagaaccugucaugugcuuuguagguucccccuucuuuguuuucacucuugcucacugucugcuagacugcagagcacuuuguaguguaagauguaccucgugugccucauccuuguuuccuuagacccccgagacugaugggagaaggguuuguggugcugcagucaaaugauguugaucucuacuauuacauggaugagccagguauguccucuuugaaagucguacaggaauggcucuguuucuucccugaaggacuguugccuacacauuggaaaucuucugaaaguuagcaucaguaaguuagaaauuugacuaugagaguguuaaauuucuuuaaaaagagaugucaugucuuaagaguugaguuauuacauuacuauuuuauaaaauaacucauuucuacagauaccuuaaaaauugaugcagguaauucuaaagaaaauccuuagggaauguggaaccgggucguucgucuuagcuuaaaggagaaaaucacaauuguuagacuugaacuuuaaaacuuaaaaauugagaccuagcuacuuugaguguuugauagauggcuuccauuugagaaaaguaccuaauauuggauuguuucagcuucuguucuuuuugccaccaagggauuuguguggucacacacccuaauuuuucaguauaggaccaggauuuuacuugccuuuuuaucaugacauugcagaaacaauggugcucucaagggcccuccccugacuccuugaucacuaauugaggaaaugccuuacagcuggaucucauggaggcacuuccucaagggaggcgccuuucucugugauaauuccaggcugugucaaauugacacacaaaaccagccaguacaauuacuaaagcuauucuuuauauagguaaauaguaaguuuauuauuuaauugaaaucauggaauuuuaauucgaacacacuaaauuuaauauauaacauacaaacaaaacaagacaaaaacguuuuagggacuuacaaaauuuuaaguguaagguuuccugagacuaaaacauuugaacugcuaguguguagugguuuuaacuaauugccuuuaacuguucugggauacaggacuuguuccagaagaaacagaagagaguacagaaggggacauaagcagugaagacuguaaauuacaagacuuaccuccaugcugggggcuagacaucguuugugguaaagggacagacuuuaacuauggacccugggcugacaggcagagguacuugagugauuauauuucuaauaaucuuucaagugcauugagaucuuauuuuuauacaauacuagcuuaauguuuuaaacuauuuuuauuauuuuuuaauuauguguauucauaugugacugugggugugugcacaugagcucacguauccauagaggccagaggaucuccuggagcuggaauuacagucagguuugauaugcucaucauaggugccaggaaccaaacucagguccucuggaagagcagcugagccaucgcucuacuacccccacccccaaccccacuccugcucggcuuaguuuuuguaacuuauuuauauuguggcaaaauaaguuuucacugaacacuuugauccaaauauuaacuuguuuauggagaaaccacaaacaagcugcagugagcagccuacuuacugguucuuuuguuuuauuuuugcauuucauugaugauuuauuuauugacccucugagagccuggggcuuuggggguauauagauucauaaaugaaagacuugguaaaauggaagacauagcuuuggugaggcuuuaauucaugagggaagggucuuagugacaggcuagaaaacaguagugguuuccuagcacugaauagcaaagcaucucuggguauacauucaacaguggagacuugucuaauuaaguucuggaggccaagaaucccacuuggaaguauuagcaguguugguucccucuggccaucaugagaggaggauaugucccaggccucuuuuugaagcugaggcaacaugugaugucucuguaaccauauacagucauguucuaaacgcugggcuuaggauuuaaauaugaauuguuuuagagcacagguuagcuuguaacaaacuauuuugcauuaugguuauuacagugaaugaaaaaggccuuauuaaaugauguguggcuguaguuuaugaaggaaguagagauuuucuaggggaagaaaaauggugugaaucaucaaggaaaaaugaguagggauaguagaaaauuguccugagggucucauagguagaucagaguucuauaauaaagacauuucaacucuccagaggccuagguaggagaauugugaauuggaggccagacugagcuaugaagugagaccccaacuaaaugccaugagcugagguucugaguaaaugguaccuugucuaccuaauugcgagggcuaaagaaaauaaguaaguaaguaaauaaauaaauaauaauugcuuguauggauuuuacaguaaugaggauuaucugaaaggcuugcuuauuugaggcaggggcucuuguucaaccugaccuuacacucuggauucaagugagccuuuugcuuuagucucuugacugucuggaacuugucuugaguaucauaccugucuaccuggaagauucuuuuaaauuauucaucuguuaauuuaaguaacuuuuauuuguaauagauuaugaccgauuuacuacguuugaagaauuuuaaaggcaacauuuagcacuguguuuuuuuaaguggcauuuuacauugcuuagaauuaguuuaguuuugaauuugugcucaagcuuucuuguagagagaaaagccaagucccucacugaaucgggaauuauuaaccuguugaaagaguggugauauuucugucaaugcugucuuaguuaggguuucccuugcugugcacagacaccaugaccaaggcaccuccuacaaggacaacauuuaauuggggcuggcuuacagguuccgagguucaguccauuaucaucagucauggcaggaagcaugacaguguuuaggcaggcacggugcaguggagcugagaguucuauaucuucaucugaaggcauacaggagaagacuggcauccucagguagcuaggaggaagcucuuuaaagcccacacccacagugacacacuucuuccaacaaggccacagcccuaauaguccuauugcggcagaggccaagcuuauucaaaccacaacagaugcauugauucuuuuuauacuuuuuuaguuucaaaaaaacuuccuaccuucuguuguuggaauaauuacacacuuugucaaguaauaugggauuuguucuuacuuuuuaaaaaauggcauuagauuaugggauagacccccggguggggcagucucuggaugguccauccuuucgucuuagcuccagacuuugucucugcaacuucuuccauggauauuuuauucccuauucuagggaggaaugaaguauccacgaguuggucuuccuucuugauuuucuuguguuuuggaaguuguaucuuggguauucuagguuucugggcuaauauccauuuaucagugagugcauaucaagugacuugugauuggguuaccucacucaggaugauacucuccagauacauccauuugcccaagaauuucauaaauucauuguuuuuaauagcugaguaguacuccauuggguaaaaguaccacaucuucuguauccauuccccuguugagggacaucuggguucuuuccagcuucuggcuauuauaaauagggcugcuaugaacauaguggagcauguuuccuucauaccgguugggacaucuucuugauauaugcccaggagagguauugcuggauccucauacgagacagcuauacuuuucuuuuuauaguaauuuuuuuuagguuuaaugaugcuguggucacugugccaucaguugaaaaugagaggcuucuauuaaguaauaagcuaaaucuauuuggacuguauucagaaaucuuagaagaacuuaaaguguuuuuuguuuuuuaaaucuguugaacaauucuauuaaaaaugaaauguuuuuguauuuuuauuagucaaauaaugcaugauuaaguuauaauuaauauugcuauaauuaaaauauuagcacauauuuacucaaaagcacaaguuaaaauuuugauaauauaguuuuuuaaaaaagauauuucuacuauauauacuguguguauauaugccugcaggccagaagagggcaccagaucugguuaugagccaccaugggguuacugggaauugaacucaggaccucuggaaggagacagugcuuuuaauuucuaagccaucuaucucuccagcuccaguuuuugaguuuugagacaaggucucucuacauagcucuccaugcccuagaccucaccguguagaccaggguaaccuaaaacuuagaaagcgaccugucucuuccugagagcugggaugaaaggucuacuacaccaauccuggcauauaaauucacuuuagagacuggcugaucuuuguauuauuuagaaaaaugauacuacaguuaaugugcgacagaacuucacuuucauaaccuccucuagcagguuuuuccuuuguugcgagagaaucccagugcauuuuucauuuagucucagagccauucauguucauaaaaaucacaaggcuuaauuuucagugugcuuuuauucaugugaguaguguuugcuucccuauuuuuguggaagauggcuugugugaugggggaagguauuauacauuccuuagguuuuuuucaucuuugucaagugauacaaggagauguacacucagcaucuaaauacuuguucacuuuuuagaacauacuguuguuuguccuuucauugauacuauguugauaaaagagauugcaaacaguuggagugacggcuuggugguuaagagagcuuauuggucuugcagaggaccuugauuuuauggccagcacccacagcugucugcaacucugguuccagaggucugacaacccuuuuguccuucacacguggugcaugcauguucugcacagauauauaugccugcaaaauacucauacauauaauguaaaaauaaagguuacauuuuuuugagugauuaugaaaauaauagaaaacucuuccaugugugcaugauuaacguaauccucagugccacuccaugagauaaguuauucuuauagagaagggagcagaccagguuuccucaggaagauuaggucacuugcuccgggaagaaugauaaauuaagcuauacucuuucaguucuuucuugauaguuguacaccugauaugcuugcagcauuuauuauaacucacauacacuuagauugaacccugcucaugucucacucgauaauauuauaauguuagguguucaaagcucauuaauaagauguggaaaaauaguuugucaaaugagauagcaaugauaauguaagguuaaaauaugauuucggacccuuaucaaagacaguuguauuugacuaaaacacuguuucucuuuuuccuuuuuauguagagauuguuuauggaaguuuuucuuuccaccugauuaucaaguucugaaagucucugagauugcacagccuggaagaccaagacaaauccuugcauuugaacuccgaaugaauauuauuacagaugcuaccauugacuugcuguuuaccaaaaacaggguauccauuauaagauuguagagaauaguauuaaaaaucugaaaaugacuuugcagauuuuuuguggguccuauuucuauguuuagcuucauuucugugggcuccccauuccuccuuaauuuuaacuuuuugcuuuuauaguccuuuauuuaaaguguuaaauaaugauuaauauuaauaacaauggacuuuaaaguuaucuucuaguuucucuauuauauuuuguuaaauugcuuuaaguauaauuuuuauauaaauuugaaucuugauuuguacagaguuuuaguaguucauauuaauagugauuauauuucuuugauaauuuaaaaguaaaugauaagaacauaaguacaauaaaugucauguaacucaaucuuguucuuuugguaggaaacaaaugcugugcauguaaauguaggggcuggcucauauuuagaaauuaauauuccgaugacaguugacgaaaaugguaagcuaucauuauuuugccugaaauuauuagugacauaauuuauauauuauuauaguuuguuaguccuuccagaguaacaguaguaguguuucauuuuuauuuuuugucuuuuaauuuaaauauaguuaguuuuuuacugauacauaaaagaguaccuauuuaugggauacuaugugauacuuaaacccauguauauagacguagaauguucaaaucaaaguaaauaugucuguuuuuacauuuguaacuucugugugguaaaauucauuuaaaauuuuguuuaguucugcacuuauugagauagugucucacuguagagcccaugcauaccaaagaggugcuguguaacuuaggcuuguccccagcuugagauaacucuugucucagacucccaauugcugucuaugaucacagcucgguaccaccaugcugacaggcuuuccuugaacuuugaaaaguauacugcauauucucauuaucugcagguuagucugcacuuuugucuguaacuuaguaguccuuguucacucacucccacccuucuuucuccuuauucgccccagccauuaugcucucaguuucugugagaucagcuuuuguuauuguuguuugucuuguuuuugaucuuagguugcaugcuuuagugagaucauuaauaucuuagguugcaugcuuuagugagaucauuaauaagaucacaucauuuuuuuguuuugcuuauugcacuugacaaaaugauauucauuuugagccauugugucacagaugauaggauuuuaucuguuuuuuuuuaauacagcuagcuuuccauuucauauauguaucauauuucuuguccauucaucaguugauggauaucuucuuagcuuguuuucaugucuuggcuuuuaugaauggcacugcagugaaugugggcacucagguggucuccagccuucuuauuucauugucuuuggagauagacccuguaauggaguuucuggguaacaugaugguucuauuuauaauuuuuuggaaguauuuacgagcagaugaggaauaguuuuaauuuuuauguucuuguggcuuaaacuuauauaauuauuugauaucuagacagaacaauuuucuacuuuuuagguguuugcuguauuuuuauuauauuguguuuaucucuucuaggacuguacaugauuugcuuaauauuuccuaguuagacucugguacuguaagaauagauacugugcagcucauauugaacucagauucugggauuuaagcaauaauuggaugaauaacaggcuuaaauguuuuucuuuuuugagaggaaagaguuuauuucaucuuauaucuuauaguacauuaugaauguuagucaggacaggaaaucaaacaugaacuuggagacauacacugaagaagagaucaugaaggaauagaaugacuaucuugugcagacugauuucuuauucagcugcucauggauggcacuugcaguaguaaaucaucagucaagaaaauagucaaugaucuuuugccuacuaaacagucugauggagacauuuucucaacugaaguuuccuuuuuucaguuugacuccuguuagacuauauuugauacaaaagaaagaacaaaagaagaaaagaagaaagaaaggaaaggaaggaaggaaggagagaaagaaagauuuucucaaaaaaaccagcuccugguuuuguugauucuuuguauaguucuuuuuguuucuacuugguugauuuuagccccgaguuugauuauuuccugccaucuauuccucuuggguaaauuugcuuccuuuuguucuagagcuuucaggugugcuguuaaagcuucuaguguauucucucuccaguuucauuuuggaggcacucagagcuaugaguuuuccucuuaggacugcuuucauugugucccauaaguuuggguauguuguacuuucauuuucauugaauucuaaaaagucuuuaauuucuuuucuuuauuucuuucuugaccaaguuaucaccgaguagggcauuagucagcuuccauguauaugugggcuuucuguuguuuuuguuguucauggugaucucaaugaaugggauuauuucaaucuucuuguauuuauugaggccuguuuuuggaccaaugauauguucaaauuuggagaagguaccaugagguucugagaagaagguauauccuuuucuuuuaggaugaaauauucuguagauaccuuuuaaauccauuugguccaucacuucuguuaguuucagugugucucuguauaauuuguguuucaaugaucuguccauugauaagagugggguguugaagucucccacuauuauugugugcagugcaaugugugcuuuaagguugauaugguggauaauuaucauuacuuuuauuuauuccuauuuuauuuuauuuuauuuuauuuagcucuccuaucuugucuuugucaccuguauuggugauacuauauggagagagaaaauagagagguugaauuguuuauuuuuacaauaaaagcuauagcauuugggcuauuccaacuaguuaauccauugaaacagugacugaggauggcaucauauccaccaucaccuaacugugauuucuugugaagaacucacaagaaauuauauuugcugguuuuaaaauaauagucaugugaggccaugaaggagauagcugauucuuuaacacugccuaauucaaaggagguauuuguauuugguaagaaaagucuaaggagugccuugauuauagucugucacaggggagaauggaaguuagagguuguacaaaauuaauagugguucagauauggcagugccuuuucccuuaaauuucauaauguagggucuagagagaugguucuacaguuaaaagcacuuucuguccuacaaacgaccagcacuucuuggugccuacaaccaucuauaacauucuuuucuggccucugaggcaccaugaacacaucuauguguucacauguauaugcacauacccaaggcuggcaaaauauucauaaaauaauaucuuuaaguuaauaauuguguuauuuaagguuucugcugcugugaugaaacgggauggccaaaaagcaaguuggggaggaaaggguuuauuuggcuuacacuucauguuacugaucaucaucagaggaagucaggauagaaacucagacaugacaggaaccuggaggcaggagcugacgcagaggccauggaaggaugcugcuuacugguucucggcccauggcuugcucagucugcuuucuuauaggaccuaggaccaccagcccagagauggcauccaaccacagugggcuggaccuuuccccacccagccaucaugaauuaagaaaauauuuuacaacuagaucuuuuuuuuuuuuuuccauuuuuuauuagguauuuagcucauuuacauuuccaaugcuauaccaaaagucacccauauccacccacccccacuccccugcccacccacucccccuuuuuggcccugguguuccccuguacuggggcauauaaaguuugcaaguccaaugggccucucuuuccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcccuaugauccauccauuagcugacugugagcauccacuucuguguuugcuaggccccagcauagucucacaagagacagcuacauuuggguccuuucaauaaaaucuugcuaguauaugcaauggugucagcguuuggaugcugauuaugggguggaucccuggauauggcagucucuacaugguccauccuuucaucucagcuccaaacuuugucucuguaacuccuuccauggguguuuuguucccaaaucuaaggaggggcauaguguccacacuucagucuucauucuucuugaguuucauguguuuagcaaauuauaucuuauaucuuggguauccuaaguuuggagcuaauauccacuuaucagugaguacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggauucuuuccagcuucuggcuauuauaaauaaggcugcuaugaacauaguggagcauguguccuucuuaccaguuggggcaucuucuggauauaugcccaggagagguauugcuggauccuccgguaguacuauguccaauuuucugaggaaccgccagacugauuuccagagugguuguacaagccugcaccacccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuuacagaaacuuuggaguuucauuaggucccauuugucaauucucgaucuuacagcacaagccauugcuguucuguucaggaauuuuuccccugugaccauaucuucaaggcuuuuccccacuuucuccucuauaaguuucagugucucugguuuuaugugaaguuccuugauccacuuagauuugaccuuaguauaaggagauaaguauggaucaauucgcauucuucuacacaauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaucacaauugcucuguaguaaagcuuuaggucuggcauggugauuccgccagaaguucuuuuaugcuugagaagacuuuuugcuauccuagguuuuuuguuauuccagacaaauuugcaaauugcuccuuccaauuuggugaaaaauugaguuggaauuuugauggggauugcauugaaucuguagauugcuuuuggcaagauagccauuuuuacaauguugauccugccaauccaugagcaugggauaucuuuccaucuucugagaucuuccuuaauuucuuucuucagagauuugaaguuuuuaucauacagaucuuucacuuccuuagagucacgccaagauauuuuauauuauuugugacuauugagaaggguguuguuucccuaauuucuuucucagccuguuuauucuuuguauagagaaaggccauugccuuuuuugaguuuauuuuauauccagcuacuucaccgaagcuguuuaucagguuuaggaguucucugguagaauuuuuaggaucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaaggagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguuggaucuuucugugguuuagguaucagaguaauaguggcuucauagaaugaguuggguagaguaccuucuacuucuauuuugugaaauaguuugugcagaauuggaauuagaucuucuuugaaggucugauagaacucugcacuaaacccaucugguccugggcuuuuuuugguugggagacuauuaauaacugcuucuauuucuuuaggugauaugggacuguuuagauggucaacuugauccugauucaacuuugguaccugguaucuguccagaaauuuguccauuucguccagguuuuccaguuuuguugaguauagccuuuuguagaaggaucugaugguguuuuggauuucgucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagggcuuuuagauguguugucaagcugcuaguaugugcugucucccguuucuucuuggaggcacucagagcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuauucaguuuccacgugaauguuggcuuuccauuauuuauguuguuauugaagaucagucuuaggccaugguggucugauaggauacaugggacaauuucaauauuuuuguauuuauugaggccuguuuugugaccaauuauauggucaauuuuggagaaggucccgugaggugcugagaagaagguauauccuuuuguuuuaggauaaaauguucuguagauaucugucagguccauuuguuucauaacuucuguuaguuucacugugucccuguuuaguuucuguuuccacgaucuguccuuugaagaaagugguguguugaagucucccacuauuauugugugagguguaauguaugcuuugaucuuuacuaaagugucucuaaugaauguggcugcccuugcauuuggugcguagauauucagaauugagaguuccucuuggaggauuuuaccuuugaugaguaugaagugucccuucuugucuuuuuugauaacuuuggguuggaagucgauuuuauccgauauuaaaauggcuacuccagcuuguuucuucaguccauuugcuuggaaaauuguuuuccagccuuucacucugagguagugucugucuuuuucccugagauggguuuccuguaagcagcagaauguuggguccuguuuguguagccagucuguuagucuaugucuuuuuauuggggaauugaguccauugauauuaagagauauuaaggaaaaguaauuguugcuuccuuuuauuuuuguuguuagaguuggcauucuguucuuguggcugucuucuuuuugguuuguugaaugauuacuuucuuguuuguucuagggcgugauuucuguccuuguauugcuucuuuucuguuauuauccuuugaaggccuggauuuguggaaagauauugugugaauuuguuuuugucguggaauacuuugguuucuccaucuaugguaauugagaguuuggccggguauaguagccugggcuggcauuuguguucucuuagugucuguauaacaucuguccaggcucuucuggcuuucauagucucuggugaaaagucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaggcuucuuguaugaucaugggcaucucuuuuuuuauguuugggaaguuuucuucuauaauuuuguugaagauauuagcuggcccuuuaaguugaaaaucuucauucucaucaauuccuauuauccguagguuuggucuucucauuguguccuggauuaccuggauguuuugaguuaggauccuuuugcauuuuguauuuucuuugacuguugugucgauguucucuauggaaucuucugcaccugagauucucucuuccauuucuuguauucuguugcugaugcucgcaucuaugguuccagaucucuuuccuaggguuucuaucuccagcguugccucgcuuuggguuuucuuuauugugucuacuuccccuuuuaguucuaguaugguuuuguucauuuccaucaccuguuuggauguguuuuccuguuuuucuuuaaugauuucuaccuguuuggcuguguuuuccugcuuuucuuuaagggccuguaacucuuuagcagugcucuccuguaauucuuuaagugacuuaugaaaguccuucuugauguccucuaucaucaucaugagaaauguuuuuaaaucuggaucuagauuuucgguuguguuggggugcccaggacuagguggggugggagugcugcguucugaugauggugaguggucuugauuucuguuaguaggauucuuacguuugccuuucgccaucugguaaucucugaagcuagcuguuuuaguugucacuguuaagagcuuguucuucaggugacucuguuagccucuauaagcagaccuggaggguagcacucuccuaguuucaguggggagaguauucucugcaggcaagcucucuucuugcagggcagguacccagauaucugguguucgaaccagacuccuggcagaaguuguguaccacucacuagaggucuuaggaucucguguggaauccugugugggcccuugcgggagucaggcgacuccgcuggcaagguagcccggggcucaaguggaguggaagggguuugugccccagaucaagcccggguagccugcuucccuauguacagcagucucagguucugcgcgauuggauuggggcaggcgcuauguuccacucaccagaggucuuaggaucccguggggagucccgugugggcccuugcggguguugggcaagacucugcuggcaagguagccccuacaacuggaucuuauggaagcuauuucucaauugggauucccuccuuucagauaacucuagcuugugucaaguugacauagacuagccaggguaguaauucacauaguaaauaucccugugucauucuacagugcaaacuuguucaaauguuggcacacugagauaaggggccacuugaagacugagaaaucaguaucucagauccccauauaguagaaagagagaacuaacucucauagguuaucuauccucugaccuccacacacacaucuaccugacugaauaaaauguaaaagauuauuaaaagaauuugguagauuuaagauaauuuuauggaccugcgauuccaaauacacagaagccugaaauauuuuucauauucagauguuugggaugaaaaagaaagccuacaucagggcacaugccaggguaguuauaaaacuuuuagaauaauaacauguagcugugaucuuugaaaaagaagccaguuaaaagaggaaauggcacuucaaacuucugcuuaugccgagaauggccuguauugaugugagacugucauuacaggagacauauauaauauuuggcaacuguuuuuauauagggaauacuugaaaaaucauaaaaaauauauauacuugaaucaguagcuaaagaaaaaguauaggacuugugcuuauaguugaaaaguuuugcuuagaaguaaacauguacaacguucucacauucauaagcuuugcauccauagacuaaagcaguuaugauauggaaauauuuaagaagaguugcacuuguaguauguauuuucccuuguuaucuucuaaacaauacuguucagugguuacugcauagcauuuauauuauauuaaauauauaaguaaugugagauaauuuggcauaugugggagauacauguaacaauuggaauauuuugauauuucacauaaaagucuugaacgucuguagauuuuaauuuaaauguagcauuuuagaaccauuguauauggauauugagaggccacuauggguuugcucucaaaagcaaaccaggauagauaccaugugguggugauguuuacucauuguugucuuagaugaggaggaucccuuguuacauuagcaagcuucccgucacugaagcuguguuucaaggauuucaguuuugaagugguagaaggaguugguucuacugcaaaaauuuaaauuguguacuuuuuauucuggcucuuacauuuuauguuuuuauuuauuagguuauaccccugcuauuaaaggacaacuauuacauguugaugcuacuaccaguaugcaauaucggacccuuuuagaagcagagauguuagcaguaagucuaaauauaugauauacauuuguuuaguagguauagacuuaguuuuaauuuucuaauguaaaauuucuaaaacuugucuguauucuuauuugagaacuaccaacuagguacucugguuauaccaagcuugggaagaguggcagauuacucguacugugugcugccuuugacauccuuuauacuguuccacuucuaauacauaggaagugcuaggagcucacaaacuguuaggauguaauuuuuaaauuccacguauuuuuccaaaauuguaaauaaaguaauuuuugauugcauguucugacccuauugggcuucucucaggacuuaauuaauuuuauucuuugaccuaagucagugacuaaguuuuaaagaaaaaagucuugaugguacccugaauauuuggaaguggccaugguuuaaauuucagauuagguucucauuaauauguuacuuuaaaaaaagggcaguaacaacaacaacaacaacaacaacaacucuguaggaugguugguauucacagaagauucauuuacaucagaugaugucauaagguucuuaguuacuuguuuuaagccaacaucuuauacauucagauguguaagaugaaauuugauaauuaguaagaaaagccccccccaacacucagauuauaaucaucuaugagagcaugcacaaauagucagguauguuuuagccucaaagucucugugcagucuuuucucuugguguggguuaagucaauuccacuguaguugaaauaaaaaacaacuuauuucuuagaguaugaguauaaaaacauguagucaguauaugaauaauguaaaauuacuauauaaaaucuauuauuacauaaaaauauaguauuaaacuuaucaaauuuaacauucauuacaguucugcacuugauggaacucucaagcuguugcugauaagugggaccauguaaaacagugcuaguccucggcaggcagcuguuuccugugcagcaaugccaaggccaggcuguaggauaguacccaugauaguccgccuuccuuccuuuaacagaggaggaauuagggacuugggcuguuuguuaccugcuacguuagcugguguguguugcugaaacuagagaauauuucuuuccccucagagaauuuugaccacaucaaagcuuaauaucucaaagaucuggguauugaccauagacacugaccuuuuacagcaguuuuaaaagucucaaagacacuuucuguucaucucagugggaaaauaaguuuuaauuacucuccagauuauaugacuucauucccaaugcuguuagcauugucacauuuuaaccucuaacauuuguuuugcaguuccacaucaaugccagcuaccccagaauuuggaacaugccacagacauggcaaugugaauuggaaguauauaaagccacauaccacuucaucuuugcacagaagaacuucuuuacagguaauuucugguaaauaucgacaguuacuuguguggugagcuuauuuauauucuguagguuuuacuuuuacauuuaauauaggggugugcugacaugacaugauaugugugcuuuccuuuuuuccuauaauuuuuccauuuauuauucucccauauauuguaucccaaacugcaguuuccccuucguccucuccucccaguccaucccucuaccuccucuuucccuggauccacaucuaccccuucaccuuuuccucagaaaagaacaggccuuccugagacaucaaccaaauauaguauaaaaaucuaccauaagacuaagcauguauucuagcaucaaggcuggaugagguaacccgguaagaggaaaaggcuccuaaaagcaggcaaaagagucaagagacauccccugcgcacacuguuaacaaucccauaaaaccaccaagcgacagaaauauaacauauaugcagaggaccuaggucaggcuguacaggcucccugaucucugugagcccauuugagucccagucuguugauucugugugcuuuguucuuaugguguccuugauccuguggauccuccagucuuuccuaccccucucaggacuccauaagcucucccugaauuuggcugugggacucugcaucugcucccaucuguugcuggaugaagucucucugguuucucugaugacaguuauucuaggcucuggucccagcauauccugcagggaugacaaacgguagguuggagauuucuguggcuggguuggugucccagucucuccacuugagaccugguuagaggggauggccaguucagacuccaugccaaccagagguucuuucauccuugagaagaguuuuugcuuuccuagguuuuuuguuauuccagaugaauuugcagauugcccuuucuaauuuguugaagaauugaguuggaauuuuugauggggauugcauugaaucuguagauugcuuuuggcaagauagccauuuuuacuauauugauccugcccauccaugagcuugggagaucuuuccaucuucugagaucuucuuuaauuucuuucuucagagacuugaaguucuuaccauacagaucuuucacuuccuuaguuagaguuaugccaagguauuuuauauuauuugugacuauugagaaggguguuguuucccuaauuucucucucagccuguuuauccuuuguguagagaaaggccauugacuuguuugaguuaauuuuauauccugcuacuucacugaagcuguccauguccgcccguuucuaggagucuuugcuaguguagauuccaaggagauuccauugcaccaaguuuuuaccuuacuucugcaauguuuuccaguucucucccaauauucucucccucagucaccccacccuauccuuccucuuccuguucgcacucacccccagugcacccucgaaauugauucuauuuccccuuccuaggaagauccuuaccccucucccguccccuccccaagcccuuccuguucauuacccucucugggucuguggacacuagcauggcuauccuuuacuuuauagcugauacccaccuacaagugagcaccagccaugcuuguuuuuacucuggauguuuuuuucugguuucauccauuugcuagcaaauuuuaugaugccauuuuuuuuuaacagcuaaguaaaacuccaauguaucaaugucccauuuuuuuuuuaauccauucuuugguuacacaucuaaguuguuuccaguuucuggcuauuaugaauaaauuugcucugaacauaauugaucaaaaguguccuuguggucuaguggggcaccuuuugaauauaugucuaggggugguauggcuggguguugagauagguaaauccccaguuucugaagagcacuguguugauuucuaagaugacuauacaaguuagcauucccacuggcaauuuaugaguguucuugcucuauauccuggccagcaugagcaguuucuuguguuuuugaucuuagucauucugacugguguaagaauuucagagucguuuugauuugcauuccauugauggcuaaggaugcugaacauuucuuuaagguuuuuuuuuuucagcaauuugagaauccucugaugagaauucuguuuauaucuguacccauuuuuuaauuggauuaugugguuuguugaugucuaguuucuugaguucuuuuuauauuuuggauauuagcccugugucagauguggaguugguaaaaaucuuuuccauucuguaggcugcuguuuagcuagaugaaauauuuucuuaauuuguuuuagauuggaacuaucaaagguaagggacugguuuucguuguuuuuuuauuuuuguuuuuuuuuuaacuuuuuuuaaaaaauuaaauuauuuuauuuauuuacauuccaaaaguuaaccccuuccuaggccccccucccugaauuuuucaccccaucaguccccuccccauacaaggcaguccucugcuaccuaugugcccugguccacaaacccgccgcccguguauguuccuuugguuuugacuuagucucugggagcucugagggguccagguuaguugucaauguugcucuuccuauggggauugcaauccccuucagcuccuucaguccuuccucuaacuguugcauaggggcuccucaaucuaauggucagcugugagcaucugcaucugucuuaguuagaugcugguagauccucucagagggauagucacgccagacuccuguuugccucaguaauagugucaggauucggugugugcacaugggauggauccccaguugggcaggucacugggugagcuuucuuucaaucucugcuucguuuuugucccugcauuuucuuuagacaggaacaauuuaaaacaauuuugaagauuggugaauggcccccuaccucagcugggggccauguuuaucuacuggaggugauaucuucucguuucaucuccucacuguugggaguuuccgcuaagguuguccccauugaguucuggaagccucucauauuccaggucucugagacuuucuagagguucccacugcccccuacccucaacugcuguauauuucaauucuguuuuuauuuacuccaaauaaugacaauaaaaauauuaauccaguuuugaucuuagaagcaaauggaagaacucaguucaggcuguugcuuuuaucaggcuaguguaaaaaguaaagauugcauugaucaaucaguuguucccucuuccagcuugauuauuucauuuugauuauugucaucuaugagaguauacuuaaguagucaaguauguuauucuaggcucagaguuccuguucagucuuuucuguuaguaugacaagucagugccaucacaguugaaaaagaaaguaacaacuucuuagcauauucauauuucaugacuauaaaaauauagucugggucuaugaauaauauaaauauuacuaaaucaaauauaguagcuuuuauugauucaggcucuagaaguuuagucccacagagucgauuugauuuauuagaauaaacagcugcuccaugaaaauauaacguuugcuuuacuauguucuacuauauaaaucuuuuuuuauuggauauuuucuuuauuuacauuucaaauguuauccccuuucccaguccccucgcacccccagaaauccccuauccuaucccccuccccuugcuucuauuagaguguuuccucacccacccacccacuccuaccuccccacccuagcauuccccuacacuggggcauugggccuucacaggaccaagggccucuccauuguugcccgacaaggccauccuuuucuacauauucggcuggagccaugggucccuccguguguacucuuuggugauuuagucccugggaacucugguugauugauauuguuuuucuuccuaugggguugcaaaccccuucagcaacuuucucuaacuccuccauuggggacuccgugcucaguccaaugguuggcugccucuguacuugucagguucuggcagagccucucaggagacagcuauaucaggcuccugucagcaagcacuucuuggcaucuacaauagugucugguuuugguaacuguauauaggaugaauccccaaguggggcagccucuggauggccuuuccuucagucucugcuccacacuuuucuccauauuugcgccugugaguacuuuguucucccuucuaaaaaggaccaaugcauccacacuuuggucuuuguucuugagcaucauguguguuuuggguauuccgagcuuuugggcuaauauccacuuaucagugagugcacaccauguguguucuuuugugacuggguuaccucaaucagaugauguuuucuagauccauccauuuguuuaagaauuucgugaagucauaguuuuuuguuuuuuguuuuuucuuuuugauacuagcugauaauuggaguuuaauagacacuucagggauuccagcauuuuugauuaagaacaaagaauuuaacagagaugcauaauaguagcaauaagcugagagaauauaauaauaaaaauauauugccaagaggaaaaccaggucaaagcaaagagauaaaguuuaguaacacaaauuggggcuuuuauuuccacuucucugguuuucuaguucauuugcuuaauaaaaacauuuucacacgugcucuguuacauguagauaaacauagaauuuauucaagucauuucuuguuaccaccuugaauccccacccagaaguguuguuucagugguuuuguucauuuccaucaccuguuuggauguguuuuccuguuuuucuuuaaggacuucuaccuguuugguuguguuuuccugcuuuucuuuaagggccuguaacucuuuagcagugcucuccuguaauucuuuaagugacuuaugaaaguccuucuugauguccucuaucaucaucaugagaaauguuuuuaaaucugggucuagauuuucgguuguguuggggugcccaggacuagguggggugggagugcugcguucugaugauggugaguggucuugauuucuguuaguaggauucuucuuacguuugccuuucgccaucugguaaucucugaagcuagcuguuauaguugucucuguuaagagcuugcucuucaggugacucuguuagccucuaucagcagaccugggaggguagcucucuccuuaguuugagugggcagaguauucucugcaggcaagcucucuucuugcagggaagguacccagauaugugguguucgaaccggacuccuggcaggaguuguguuccacucacuagacaaaacaaacaaagaaaaaaaacacuucaauuuucuaaucacaguauuuaacaaguccaucugguaaugugagcagcuuuuggccuaaggaaaaaaaugucauugaaguaccacaaauguuugacacagaagcuaauaaaaauauuuuuggcagucacuuguuagacucauaauuauacuuuuggcuucuguagaguugcuuccuguuaugugaccgccaacauucacauuagaucacuugccguagccgucuuccuuggccuacuaccaauauggugguagguggucagugauguugaaagacccacaacgugaugacucccccacguucugacucaggagaggcgacaccccaaaaucaccaacgagaaacggucuugcugcaaauugcaagaggauuuuuauucaagagcgcucucgggcccacggucauacaccacgcagggguagaggacuguggcgcccagaguagcuggauaaggggguauuuaaaggaaggaaccaggugggaagggcguuguuggaaaauaccaaaaauaccaguuaagagucacaaggaaguacaaagucacaggugucacaaggaauaccugguaauuguuaacucucaagacaguuucuaagagccccuaacgauagcacauuugcauugcagguuccagcaauggucagggugggucagggugacuuucuuugaaugaacacuccuugaacccaggaagcggguggguggaggaaugucacuaucuguuuuaugacuagcauaccuuggagcacugaguuuacuacucuuucauugucauagggcuuuuugauuaagcauuuaauuuucaucuuucuagauucauuuagcuucucaauugaacagagauuucugguaaacaguuuggaguuauuguuucuuguaguggaaacuuaguagugucuguuauguaugcaaaacuauuuuucaugcuaauuuuuaacauuuaucaguaaagauauuguagaaguugguggggaaaaauuauuugaugauauaaaauuuuaaguaagauuuuaaaaucuuuauuaaaauagaaguuagcuauuugcaccauuucaguuacuacugaagaaaaacauaaaauuuguuaaaaucagaauuggcaaaugaguuuauuuacaaacuacauugacuuccugauaaauauaucauuugauuuugguuuuauacaaauuucaucucugccuucuaaccaauuuaaguauaugguagauaaugcuucuaauagauaucucaagcuucauaauaauucagaacaaauacuaaauaugauuucugccuacagagaacuuguagacauaucacuuuuuucccccuuguuuuccauuacuagucucaaguacacugacagacacacuagacauaaaaugaaacaauggcaaacaguaucuauggugagcuagcuuugaacuguggugcuuagacugcaucuaaguugggagaacauccgaaauuauuacugucugaagccauucagagaaaaugugggaggauuuuuaaugguagaaauggucuuuauaaaauugaguuugauguaauauguuaggcaugauuuauauaacaguugccauuuauaaagcuuauuaauuuguaucuuuugcguauucuaaaaaagcaaacuuauuauuaucucugaguuaacaauuaggaacuugcagcacagaauuauggaggccgaguuagaggauacauuuaagcucaguauuuggacugcaguccuugugcuuccuguagcaccuaccauuaauaaugguuguuucucuucaucagaaaggcugugaauggcaggaguaauugauauccauacgucauucguucugugguagauagaugcuuucuaugaaaugguauaguucuugcauauagauuguauaaccuucuguacaucuucauuaaucuguagaugacuuaaaauacuuaucauaguguagauauuucauaaaaauaguaguaauauuugagauauaacgacagggaaagcuucugcauguucguauacaaauaaaaauauuuucaacccaugguagugcgaaacugugguuagggagagaugacuauauuaguuucaaacaggauauguaguuugagaaggaaugcugagccaugaagaguuuauuaaggagaaaagcagucagccuggaaaaugaugaauuccuuuguuagaaaauaaaacacacacucuuucucccucccccuccccccucaccuuuccccuccuccucuuccuccccucuucccccucucugugaauguguguguguuuaaaggcaaguguagauguaauaaggggugucuacccacuguaauauuuaaaugaaauaaagauauauuuaaaguaaauuugauauacuaagauuucccuuuucuauuaauagaaaagguuaauagucauauacuuuuuauuuauuucuguccuauuaauggagucaguuacaguuaagauugcauuucauuaagucucuuuaacguauguggaugguuauauguacauggcagcugauuuuuaaaugaaagccuacauuuacaccugcuuucuguaauuauucuaacuugcauuuuuuuaacucaaagauccucuuuaaaaugacauuuaauagccuguaauuuuccuugcaguauucucaaugauaaauguuuucuauuuacaaagggcuuaccuggugccauuuauuuguuaaaauaucacauaaaucaucucaguucuucuaguaaguuagggaaauuguucuuuuauacaggagaaaauaacacaaauuacauugcuaauaaauaaagccaaagcuugaaguuacuauggucugauaucaaaguccaaaacacauaccuaauuuuguacauauagcaucaagguuucuauguacuaugaauguacaaagaugaacuugacaccuuuaagacuagagcuauuacugaaagguguuggugaguauauacaauacauacaagugauaggaagacagaagaaacauuugugggaagugcugucaauagagcuaguaucauuagucagagccuuuguuucuaaguuuaaaagaaaauuaagauaccagaaagaaauacuacauguaugaacacaaauuuaaaagcagcaguuaggggccagugaaaugguucaguauguaacaaugcuuguugcauaagucuggugauuugaguuugaucccuguaaccuauguaaaggugagaggagaaaacugacuccacaaaauuacccuuauauacgcugugacaugauuguggccugacacauacaucacacacaauuuuaauagucauaauaauaauaaaauaaaaauuuauauaaccuuuuaagcaacaauuuaaacauaacacauaagcaaagauuuuuuuuuuuuuuuacuuuuaagaugaccacuuuuuuguuuguuuguuuguuuuguuuuuuugagacaggguuucucuguauagcccuagcugcuuuuuuuuuguuuuuuuguuuuugacacugcuuauuucauuguagucccagaaucuagaacaggcugccacacacuaggcacuuaguaggauuuuguuucaugaacagaaugugaaaaagguucaucugaaacuugagaagaaacauuaguaguaguucuuuucuuucuuucuauuauauauauaauuuucauauuuuuaagcaucucacuuauauguuggcuggccucgaauucacagagauguucugccucugccuccugggugcugagauuaaauggguucaccacuaugcuuagcuauauuuauuauuaagguaauuuauuaaagugagacaguguucacuuacaaaauaggaagccccucauguuuucuuccccauuaaaauagguagaaauaaacauaauaagaagaggauucaaagaaauagguguacaaguauaaagauucuuuuucuuuaaugugcaaaagaauuuuugagaaauuagaaaaaaguguauguguguacacaugugcacaugcguguucaguuaauuuugcuuuuuguuuucuacucuuauauuuuuagaucuaauucaagacuggucuagugauaaugcuccagacauuuucucauuuguuccauacacauggaauuuuaaaaucauguuucaucaguuugagaugauuugggcugccaaucaacauaacuggaucgacuguuccacuaaacaacaggagaacgguaagagugcuagaaacucggcucaucuacucauuaagaugugccaacaaaaauaguguucaaguucaguggauucccuuccucccuucuucccucugucccagaaaucagauguguccuuguagucugucuguuccuuaagccaaaaauuugauagccuguggugaucgagcaaucaggccuuugcagaaaaaguaagcucccuucuagccacaagauagguuuuuguuccuguuagugccugccuccucaguaggucagucaggucaaauuauguaaguggcacaaagguugccuaccugcaaaaacuuacgaaucagaaaucccuuuuuuucuuaguauugaaagcucuucucuucaccccauugucccuauccauccccauccaguguuacacauggugaguaucucuccuaugucagguucuucuucagagccacaccaacugaagaucuucuacaggguuagcucacauuagugccuuuccuugagaaugcuucucucuucauucacuuauaacaacuagaguugauuuuccuguauuaucuuagacuacuugagaauuggcuuagauuuucaugcuuccauacaguuaaucuuaucuauguguauauuuacuguaguuuucccauuuaaauuuuguugacacuaaagcagaucuacuuucucuguuuacaguguaucuggcagccuguggagaaacacugaacauugacuuuucuuugccuuuuacggacuuuguuccagcuacgugcaauaccagauucuccuuaagaguacguacaguuaauccuguuguuuaucccacagguuacuaguaaguuuaaucucccaguacuugugugugcuccuguccaucugucucuccccugagcguguagcaucugccagggaccaggagcuuuagcauuaguuaucuccucuguccuucuuguuaacagcccccaauaaauugcccuaaaauacaaacuauuuucuuagaaaucauuugugaucucuuuuaucuuuuuguaauuguugguagagccccuucuaccagaaaugugcuauaagcaaauuuucuguuuccuucuauuugauuccuaguuaaaccguaaauucagagaacagccauaaguccuuuuuuuuuaguuuaucuaaaaggcagcaauuaugaauuuuuaaguucaaaauuuuugugacauaucuaauauuaauguauggguaagcauuaccaaucacaauacuauuugaauuauaguaguaaaaacacaaucacaauacuauuugaauuauaguaguaaaaacaacaguaaugauaggaucaguuaauaucuauuaacccuuuuauaaaugagccagaugcuguucugagugauguaugcauaguaacucauuuaguuuuaacaaagccuuuugauguaguuaccugcauuuguauguuagcaaacugagauguauucgggcaugauccuauaauguuaguauucaggaucuagaggcaggaagaugauagagaauuugagcuacauugaccuauaggaaagaggaugcauaaaaauuggggaacaguuuauguaaaauuuuaugcaguuagugaguugccuaguuggauuuugaaccuugacaauguagcuuaggguguagcauucuuuaaccacccuauucuacuguguuuccugcugagaaacaagacauuaaaaugagagacgaauaggggacccauaagaaaaagugacauucagcuaaggucaaguucagaaauuguagagcauauucuaccugauccuauauuagagaaguuuugauuuucuuaaauugacuacgaucuugaaacaaccaucaaauauagucaucgaauugcuauugggaaauucugcauugcuuucuauaauaucuggucuauauuuuucuagaauaauuuaauuuuagucauuguuaaaucuuauuccugguauuuaucuggcuuuucaguguaaauaugguauuuaaaauuuauugcuugauuuucaguuccuuuucaagauuauauagguugauuuaaguguauauaguaugcuaacacauuuauguauugauuauucuuauaaauuauuuuuuagggagaagauguugaucuucauuuauuucuaccagauugccacccuaguaaauauucauuauuuaugcugguaaagaauugucacccaaauaagaugguuccugaaacugguauuccugccgagugucagaguggccagaaaacaguuaaaccaaaguggcgcaacguuacucaggaaaaguaagggcauagcauaguggucugaggauuuugugcucauagguagagaaauuccuuucaacaaauaagcuuuaucuguaacuaguuuccuauagaaguaaagauuaagugucugaacagaucuuauugucguuuuuauuuugaagggcugguuggguugaaugcuggacugucccaagugucaugcucaccauugauuauaccuggcauccaauuuauccacaaaaagcagaugaacagcuaaaacagucauguaaguguuuugaauaucauuuguguuuucaaauaacugcuauuuuaaugauucuuuauuggagauacaaaagauaaaauuaauuaacauauguguauucucaaauaccuacaaauuuguauccuuuaaguauuuuggaguaauuauagguaauuuuaauugggcauuuacucuguaucaaagcugaaucaagcaguuuucuuacugauauuaugccauuugauccuuauuagcucucugugacauggauaauauaauaauuauccuuaauuauguacuuuuagaguuacagagauauauuuuucaaagcaaaaguagcaaagaugaacuauaaaauauaguguguuauauaguauauuuaugaugauuaauugagugaaauguuaguuuuuaauacaccuucacaacugucaugcaguuuuuagauuaucaaagauaauguguugccuuccugaguguagagaaagaauucaggaguucagugauuuuuaucuuuguauuuucuaauuuguuauguuucuaaggacaguuuuuauaguuauucauacuuaugguauuuaauaaugucacacauauguaaaugacuauuuauaugaagacaaauuuaauuuaaugccuaaauagaguuggugccugcugugaccugaauuucuauuucagggacuuagaauguuauauguagugggagcuuuccauugagucuuuucccaaauuguaauuuaugcuuucuuuauuguuggucuuugcuuucuucauuauuggucuuucagguuuuuuuuuuguuguuguuguuaaauauugcagauacuguauuaugauuauuugauuuuauauaaaugcagugaaauuguauauaacuucuuugaagaccuucuaaacaguuuauuuuuuccuggcacacuaaucuuuucaccucuaucuauuuauuccagugucagaaauggaagaaacaaugcuaucuguauuaaggccagcccagaagacaucagagagaguuguuucuucuccaucuaugucaccacgcccuccuguugaucccucagagcuuccaccugacaaacuucauguagagauggaacucuccccagacucucaaauaacucucuauggaccucugcuaaaugccuucuuauguaucaagguauuauuguaggaaaaacuuaaauuuuuaaacauaugcuaaguagugauaauagaaaauuagggccauaaggacuaucuaguuggaugauuuaaauacuuguuuagcuauuuuauguauacaauuggauucuauccuaccgccauccacccaaugaucagauuuuuuuaagaaaauauuuuuuuguguguuuuucucucccuaacuccuuuccuucccuagauccucccuucuuccuuacaaacccaacuuuacauguuuccucccucuaucucuuucaaaagaaaaaaaaacaacaacaaauaaacaaaaguaguaacaaaagaaaaaccacaaauagaagaaacacagcugauucugucguauaaauucaucacauuuuaauuauucguauaacacuuuauggauaucuaggcuguuccaauuucugguuauuauuaauagagcagccaugccaugaaugaacaaguaucuguguaguaggaucuugagcucuuuggguauaugcccaagaguuguauagccugaucuugagguagauauauucccagcuccuugaauaaccaccguauugauuuccauagugggucuacaaguuugcacuccaccaacaauggauggguguuucccucauuccauaucuuucccagcauaagcugucauuugcuuuauucauuuuggucauucugacugggguaagaugaaaucucaaauagauuuaauuuguauuuccuugauggcuaagaauguugcaaauguuuaaaguguuucucagccauuuguguuucaucauucgagaacuuacuguuuaguccuauaccucauuuuuaaauugaguuuucuugauuuucagcuuuuauacuucuuuauaaucuagauacuaagccucuaucagauguucaauugguaaggaccuuuucccacucuguaagcuggugcuuugucugagugauuguguccuuugccauacagaagcuuuucagguucacgugguuccauuuauucauuguuggucucguugacugugcuauccuugucuuguucaggaagucuuuuccuaugccagugaguucauucuaaccucacuuucucuucuauuagauucaggguauauggccuuauguugagauccuuaauuuacuuggaguugaguuuugugcagggugauugacauggaucuuugcauucuucuacaugcagacauccaguuaguaauaguugcuagaggaauagaugcuaaaggaagaaaucgaagaagacagaucuauggguaaauuuuaauuguuauaauuuauauaacagaaguaacacuuaauauuugaguauaauuagcaaagauuucuuuuuuuuuuuaauuuauuuuuuuuauuagguauuuuccucauuuacauuuucaaugcuaucccaaaagucccccauacccacccccccaauccccuacccacccacucccccuuuuuggcccugggguuccccuguacuggggcauauaaaguuugcaaguccaaugggccucucuuugcaguaauggccgacuaggccaucuuuugauacauaugcagcuaaagacaagagcucucggguacugguuaguucauauuguuguuccaccuauaggguugcaguucccuuuaguuccuuggguaauuucucuagcuccuccauugggggccgugugacccauccaauagcugacugugaucauccacuucuguguuugcuaggccccagcauagucucacaagagacagcuauaucuggguucuuauaagcuauaccuuacaaauaaaaacugauuuaucucagaguaauccaaauuauuuucaucaaauuaaguuuuaaguggguguggaccauauuuuggaaugaggcaugaauacaggucugcuuccuuuuggccuaacuuucccacugauguugauuagcugcauaguaggcuagcacuuccagguuagugccugaaguaugggcagucacuuauauuccaggggcuguuucuggaaaaauauuugagaacugacuguccuagagauauuuuuacuccuuuuauauucaaauuauauuuuuaaaaugccuccuguaagucaucaucaagucuuacuaauuuauuaauuauuucuaauaaaugcuauaauccaucagauccucuugcauagcaaacagucuugcuuaugguuagagcagcuuugugacaucaguucuaugaacuccaugaaacuguuuucuuaggaguuugcaaccuugcuuuuauuuuucuguuagauguaaacuguaucugacuaaacagggauucuuuucaacaggaguagauuacuugugacaaagauguuuuuugugguuaugauuuuauagugcuauccccuuucaguuuuaccacugccgggauuuaauuauugaaagcauaguugaguaggaauuucuuauauuacuuuuucuaggaagacauaaugacuccagcuauagagggcaccaucagaccgaagaaaagauugcauaaaacucuggcuuggugagccagugggcuuacugggguuacucaauagaagcaugaggaaccuuuaagguagcuucacaacuaugaagucuccccucaagcaguuuccauaaugaaaagcugcaucacuaaagucucacuaccgcacugcccugccuucuguagcacccuccagaaccacaugcagcuggagcaggaucuuaggcgagggucucguaacacccuccacccuucaucaccaucaccacaggcuaugaguuguacccugcuuauuugguuacuguggcuguagaucucuuguaggucaccacagccacucuguuucgugagugcaugcccaaagaaguagcugcacaguguccugacacaucaucuagucagaaagcagaacgagaggaaugcuagagcucuuggauguucauaggguggcgucacccacacccaggguaguucuuuuccacccaguuaaacuuuccuagaaagaacccaaaaguauauauguuuaugguauuuauaaauuucaucagguugaaaugagguuaaccaucacaggagucuuccaaaauuacagcucaaugagcugcuaaggaaucagugagaccaugagguagcuucugagaugcuuagaucugauuguagcugaugagauaaaaccacaggugccacagacuaggcagaguuaagauuaaaaacaacaagacuaugacggguauuuacaguccuaucagugaaaugccuauaaaauuauugguuuacaugugggaaaugaguaagucaguauagauuuuugccucaaauauauuguguugcuuuuuaaacauuuuuauuugaaauauuuuuaggucagggaauauuucuauguagguaaucuuuguagcacauguuaauugugcuaucauucuugacucucuucuggugagaaguuucagccagucuccaggaugacugauucuucuuucuacuccaaaaauuugcccuguugcuauaugauguuuugauggaauucuuuuuuugugguaccaaaaguuugucuuccacugaaaaaaauuuuaaaaucugaaugaucuaauaacuuagagcuucuuugaaauauuuaaagcaaguuauaaaauauaugacuugauaucaaauauguaaaaaaauuaggcaaaaguuugucuaguuuagugagugaauucagugcuucuuuuuguaauucauuaaauuucugacuugugaacuacaaaacagaguaccaugcugguaagagggugcuguccugucucaaguguccuuaccuucuguucugucgcugucuuguccaugagagaacuuuaaaacuuuucaggggaggcguuaucugucucgguauaauuuauguacugaacaugccaaguuuacauauauagaugaaaaguauaaagauucauuuaauuuauaaauaauauacaaaacaaaucucucuauacuugguuguuuuugaaaaagggaugucaaauccacaaaaaacacugguccuagcuuuaucaccaugguaaggaacucuaagaagaacacagggugugcaugcuuuauagucucugaagcugcuuuauagaguaggagauauagaguuggcugacacaacuauaugaacccaaaguaauuucagucauugaaaccccacuucuauaaguacugugucauuaaaaaauaaauaaauaaacagaagcuucaaguuauuuuguuaagacauaugguuguauaauagcacuauuaacauacuuagcucuguuuacucuuucauuuuucauuagugaggaagacaaucuuguucuuuauagucaugucauuuuagugguagcaauuagucacuuggaugaaaguuuuauguaauacauauguucuuuauuucaaauaguuuuaauggucuuggguagaaaucacuccuacuguugauuuuguucuuguucuuuguuuuggcaggagagggacuuuuguuuguuuuguuuguuuguuuguuuguucuugugagaaaaggucuuuuguacuccaggcuggcuugaaacuaguuuuguagcuuaagcuggccuuguacucauagcaauccuccugccaccgucuccggaguacuuagauuacugucugaaccaaaauuugccgacuuccucuuucucucuuuuuugaaauuaguaucugucucuuuccuuucaucccucuaaaccuucccagaaccccuccuugcucuuuaaaauucauggccucauuuuauuguuauuguauguauacacacacgcacacacacacuccuaugcauacacauauacauuccuaaauauaaccaguugguguacucuucucuggaaaagacaacugcucucagcauuucucaguacuuccaguuguauguggaguuuugcagccucgugggcuuuuccugucuauuuuugcaggucaguugguaucaucccuguuuagcucauguucagggagucguguugguaaaacauugaguguggauauagucucacaacaaacuuccucaucuucugguucuuacaguauuucugucccccuucugcaauauucccuuagccauuaaguaugggaacauuuugcagauguguuuauugggacuaggcuccacaucucuucauuuuggucacuuguaguuuucuguagugguuaccaucuguugcagagcccaguuuccuugacgaaaguugaagccugcacuucuaugugggaauaagggggaauguuuagauuguuagggauuaugcuaguuuaguagugguuauagauuaccuucuaauauccaugacuuuacagcacugaauaauuagcuagguuuccaguacuaggcauaauuucuucuuguugggcagguuugaaguccaggucaguagcuauugguuaccacuaaggcaugcaugcuacugcugaacccuuagaacuaacuacugugccaugcugcuucuuaggguucaucgguggcaucacugaguaggauggaugguuggcugguugguugguuuguaggaaaguaaggcucagcuguuugggcuagaaaaucguuuauagauaaaaggaccugaaggacuuuuaucuacuucauacuugucuggacuccauaccugcugccauauaccugcugagcuugacuccaagacugggaugguguguguuuugagaacagaaaacuaaugguuugaauuuuuuaaguuugaacaguaaacacaucugucuuuauaaauguaauguuauagagccuggggaaaugauccagucagugcaagcauaagcaccugaauggaguccugagcacccggcacauaagaagucaugugcgauuguguguggguucuggaaacacacuggccaagcagccuaguugaauggugauccugcagaucaguaagacuguucucaaagaguaaggauagcagcaauggaagacacucaguaucuuccccuggccucugcaugugccugcaccaaauauucauauacuauacauaucuagaacacaugcauacccaugaaauuuaauguuggaauuaagauagaacgguguuuauuuuuuauucaugcuuuuuauccuguuuuacaaggacauugaucaagguuuuagauuguaucugggcuauuuauagguggacaggacuagagaagagagggaaaguuacugguuuagucaauaguaguaggauuuucauuagucuuucuauuaauuauauaagccaaaagaauauccuuuccuaggagaauguucuauggccugaccuuuacaauauagccuaaucauaaaauaaauuugucaguaaccagcaguacaaaauaagccaaaauaccaacuugguucucauacuuaacaauauaacuaacaauggugauacuuaacagauuuucuuucauacucacagaucaaguagguaaaaugaaaguuuauagucaaugggaaaagagaacuucaaucaaaacuaaauuuguuuaagacaauaaauuuuauuuacaaauauaaggaaaucagaauaauaauacuuuaaauacuuggauauaaaauaaaagucaaugaacuaugugaaagaaauuugaucauuguuuaauuaugcuuuauuuuauuaauaauauaaguuguauucuaagagcuuuugaauauuucugauaaauauucuaacuggaauauauaauuacauauuuaucuaauuggacuuagccaaguuaguucucggugaauggaucugcuuugcucugaaaacuucccugggauuaucuuauaauuuugagaagcaaagacugaaaaccauugagcccuucagaccuucagagguaucuuugaggaccuaaauauuuguaaauugucuaggagcuuuacuauauugcauauuuuaauauagaauauuuauuuacaaagagaaauguacuuuuucauauggcuuaaguagaccugauacuuuuagcuaaauaccgcaguuuagcgagaugcauauuguauaacguaggguucagagacucaucucuuauuaaugauagcuuguuuuaaauuuuacaggaaaacuacuuuggagaagaugacauguacauggacuuugaagagguaauuucaagcccuguccugucacugucaacauccuccaguucuggguggaccgcuguuggaauggacaaugacaaaagggaaaaugaaaguucagccaagucaauccauccacuugccuugcggcccugggauaucacuguacuuguuaauuuguacaagguucaugggcgccuuccugugguaagugugauacauauauauuaugauauuugucuagcacaggaagguguguaucuuggaacuuuacauuuucuuuaacuuuuuuuuuuaagcaaugaaaauauuaaguuuuaauggucauaauggaacaagagauuuugaaauaauaauaaaagauguuucauaaaguauuuauuacaauuucauaaaauaaaaggauaauacauuuacaagagcacugcauggaguaaauuagaacuuacacaaaaauguugcaacuagaauaaugaaccagaaccuauaucugagaaaaucacaaauaaauauauugaauguuaaauauugauuacuaguucaagguauucuaauauauucuuuaacuuuuuuuuaauuuacuuuuuauuuauucacuuuaccucccacucacugccuaccuccugaucacccccucacacaauucuucccccuuccaccccucuccuucuccucugagcagguuggggacgcccuggguaucccaccacccuagcacuucaagucucugugagucuaggcacuuccucucgcacuagagccagacaagacagcccagcuagaagaauauaucccacauauaggccacagcuuuugggauagcccccaguccaguuguuuggggcccacaugaagaccaagcuauacaucugcuacauauguguggggaggccuaaguccagccuguguauguucuuugguuggugguccagucucugagagcccccaggguccagguuaguugauucuguuggucuuugggggcccgcaguccuaccugugcuuccauaagagucccuaaacuccagccacugucuggcucuggguuuugcaucugugugagucaguggguggguggagcuucucagagaacagccaugcuauauuccugugugcaggcauaacagaauaagugguauuugucuaugggaugggucuccaguugggccuauugguugguuauugccucagucucugcuccaucugcauuucuuauagacagaguaaguuuugugggaggguuggugucccuauuguuccauuggguaucugccuagucacaggagccagacuccccaggcucuauaaccccaaugcugugaguuucagcuaaagauacccccauugauuuuuaggugccucccuuaucccaggucuccauuucuucuuggagaugcccccuaccaguccucacccucaaucaguugcagauucauuccauggucauccagcuaucuucccugccccuucccacacccuacccuaagaccccaaauucccuuccugaucucucccacccaauucccucccuccaucugccuuccaugaccauuccauucccccuucgaagugagauucaaacauccuugcuuuugccucuuuccuguccagccuucuucagucgguggagcauagcauagacauucuguaguuuaugguuaauaucuacuuauaagugaauucaaacuaugcaugucuuuuugggacuggguuaccucacucaaguugauauuuucuuguucuauuugccugcagauuucaugauguucuuguuuuuaauagcugaauagcauuugauuguauagauguaccacauuuucuuuaucuauucuucaguugagggacaucuagauuauuucuaguuucuggcuauuaugaauaaaguuucuaugaacauaaauugaacaacuguccuugugggaugguagagcaccuuuuguauauaugcccaggggugguauagaugggucuugagguagaacuauucccaguuuucugagaaaccaccaaauugauuuccacaguacuuguauaaguuugaccuuccaccagcaauggaggaguguuccccuugcuccacauccucaccuuacauuuuuuaacuuuuauugugagaccacgaaccaguuuggagcauucuggaaaaaaggaaaggaaagaacgaaagagguucagguuugaccuuaaagguugaauuguguaauagguuuggauuuaggauuuauuuugguuuugcuucaguuugaagccuguccuugagccuguugaggcugaucugaccugacacggggagccaggcacuucagacccauacaaggagaggagacucuggagcacuauguugcagucugacuccaggucauguaugccaccagugcauagcagaggucaccucuaguucuuauguuguucaaaaggggacagaauaauuuuuuugguucauuuucacuauuauucucuuugaagaaucaaaaucucuuaaucaugauaauugugaugucugaacuuuguguuuugauggugguguuuuguuuaacucuagcacggaaccaccgaugguccugagugcccaacagcauuuuuggagagacuauguuuugaaaugaaaaagggauucagagagaccauguugcaacucgucuugucaccccugaauguguuugucagugauaauuaucagguaaugucaaaugacauaugauaaagauuuaagauauuuaucaucaacauauauauuaccaaaauaauguagcuuccauguguuauucuuuuuuuuaaaauagauuuucguuucacuguaccacuguguuuuauauauguggacauagaauagcuguuuguagaguucaucauuuuguuguuagcgcuaguccuuauuuaugugauccuaauuauguuuuacuuuuuuuuuuuuuuuuuugcuuuuagaaauggaaugaaauaguuuaugacuuucugauauguuuauagaagggaaugauuucuguuaacuaguaccauaaaauacacaugucaaugauuuaauucccaguuaccuaauaaacuuagacaauaucuggaaaguucccucaccauacuuuuugggacucuuuuggaagagaacuagugacucuaaccaaaugaagacacuacaauuauuuuuuaaaugucaaacaguuucgguugcuaucuguuacuacaagugugugugaugucaaaauacaauuggagcuuaauguaagccaaauacaugaaaauaaaaauguacaucuccagaccaguaguagaugaucaguuucaauggaucaugcgcaguaacugaugacuuuauuuugaaaaaagaauagccauuuuuaccuuuuguuuuaaccacagcugauuauauuuuuaucuguagacuuuuaauuuaugugaaccagugucauuuaaaggauccaggcuugcuuugaacuuguaauuuucugucucagccuguugagugcugaaauucuaggcaugagucaacauuauggcuaguuuguuaauuuuauuucuuuauuuuuaaguugaaguuuuuucuuugucuuuauugaaaauagauuuuuuuucauacaacacguccugaccacguuuccccuccuuuuacuucucccagcucccccuagucuacccaacauccacucccccuccauuuugucuucaaagaagaguaggccuccaagaaaaaacagccagacaggguaaaacaagauagaauaagaaaagguaaaagccuuccuauagaggcuggacaaggaaacccaaaaggagaaagagagcucugagagaggaggcaggcaaaugagucagagaaacaccuguucccacacucaggagucccauaaaaaacaccaagcuaauagccauaagauacacuuggaggaccuggcacagacccaugccggccccauuuuugccacuuuagucuaugugaacccauaugagaccugcuuaguugacuugguaggccauuuucuuuuggugucugucauucccacugaauccuauacucuuuccucccucccuuccaaggaauguuucccugaucaccaaggguacccaauggagccauacaauuuagauucucugucugcauaaugcuugguuuugggucucuguacuuggcuccuauuggcuauuggaggaacccucucugaugauuacuggacagggcaccaagcuaugaggauagcagauugacuauuaguaauuauuucauugaauuuuucuccaguuguauuggguucuacccuaggucuaugagcuauacauuguccagguccuggccagccaugcaguguagggcaugggcucuuucauggcaugaaccuaaagucuaaccaaacauucguuggccacuccccacaaguucugugcuaccagugccccagcacaucuugcagcagaacagauuauagguacaggguuuugugguugguuggugucuagguuucucuuucuaugacauguagaguaucuucuugugccaaagagucgagaauguaggcucaguguaacagcucugccucucuacacucacuaaagugcacaaauguuguccucaucagugaggcuccugcugucaguuuucagaaagugaccuucuguccuagcaucugccugaguuguuuugggaucuucaugggaugucuuuggcuaauagacaacugaauguaacucaguuccauuaccagaagccuugccugauauacagaagaugaccaguucagacucuguauccuccaagccuagaggaccucccuaggguuaguuacccccacugcauuagguuuccacuuauuuauagaauuuuauuuuuuguauuuguuuaucugaugucaugaucauaacaguugaaaucaguaauaguugcuauacaauguucuuauuuuccuuuuugaaauguucaguuugagauauagaucuuuaugaaauaacuaaaauuuuugaaaaggcuuuugaauauaccaguccauccaaauccuuuuauaggauaagacuuuaauauauuacaguuuagauucagacauguaugguguguguucauaguucagcauaauuuuuuuaaacaauuuuuuuauuagauauuuucuugauuuacauuucaaauguuacccugaaaguccccuauacccuccacccgcccugcuuccuggcccugacauuccccuguacuggggaauauaaucuuugcaagacuaagagccucucuucccaacgauggccgacuaggccacauaugcagcuagagacaugagcucuggggguacugguuaguucauauugcuguuccuccuguaggguugcagaccccuucagcuccuuggguacuuucucuagcuccuccuuugguggcccuguguuccaucuaauagaugacuaugagcauccacuucuguauuugccaggcacuggcauagccucacgggagacagcuauaucagggucacuucaucaaaaucuugcuggcauauguaauagugucuguguuuguggcugauuaugguauggaucccuggguagggcagucuagggaugguccuuccuucugucucagccccaaacuuugucccugcaacuccuuccauggguauuuuguuccccuuucuaaggagggacgaaguaaccacacuggucuuccuucuucuugaguuucauguguuuugcaaauuguaucuuggguauucucaguuucuggacuuauauccacuugucagugagugcguaucauguguucuuugugauuccgcaucauuuuuauuacauguguguucagacacuaaaggaagacacagagcugucacuacagaagucucauguguacaaagcuuuagcuugucauagaauuugaaaaaaaaaacauuggaccucuuuuuugugauuaguggguugcuacaguuauuuuguguucugggauauguguguguggaaaggaaaggaacgcuaucuuuuuuuuaagccuugauauuaauaaaggggaaauuauuuuuguaugggugaauucugagaaucuuagaugaauuuccaguuucuucagaucacagaaucaugcuucaacuuuuaauuacgucauucacaaaaggcuuuacuagauuuaaaauaaaaacauuuuauuaagcucauuaugaaguuuuguauuaacccauauuauugagguacaugaguuuauagagagaugaaauuuuaaaauauuuuuggagaauuagaaaaauaauucaugggaaggagaugugaagguaguuguuguuuuguuuccuugguuauuugcacuuuauauuucuucccaaacaugagggugcuguauccaugcuccuggaauuugccuaccugcuuaccuugcucacauucuguuagaguaagaaagcauuggaucauuugucuacacuguuaacgugcuuuugugauaggaaacuucacaguguggcuucucccaagcgacacugaugcgccauucagucugccacuauuacuccugguggcauuacucuuaacguggugcucuaauguaaagggucugaagucaaguacugguugcugugcacaauuauacaguagcacaccuuuuuacuuauggucaugucugaucuuauuaguugccuaaagcuauccuaauaaaguauauggacuggguugcuuaaaauggcaagacauuuauccucugccagcucuggguguccacagguaagauguuaguggggcuguuaucacugaagacacucauuuucuugguugcugggagucucagcagcccuugguauuucugaguuuguagaugccuuucucagauuacugccucaguucucaacgacauccucccugugcaccuuuuuguccuaacuuuucucuuccuguauguacacuggucauauuaggguccauucuaauauagcacaagcucaucuuaaagugauuauaccuguaaaacuguauuuucaaauuuucauaugcauacgguucaggacuaaaccuauuuuuuaggaguuacgauucaacuugauacaguaugauacaaggcauaacauucaaaauacaguauucauuuugauaaaucagauaaguugaaaauucugaaguuuuuuuuucagaagagacuuuuauugucuauuuucugcauucuuucuaauaaaagaaguuaaggcauagagaauagguaaaguuuuauaugaagucauacaguuaauguaaaauaaaaauuguagaagagcuucuagagcuauugcaguuauaauuugaaguuuucuuuaaaaaauugacagauuuaguccucaucuuuaaagaauguuuuaaaaagugcauuuucauaaauuuauuucaaggcaggaacacuaaccucaugauaggaccuauacacauaugcaaaaagaaagagcauaguuguaacagcuuacuaaauaucugugaacuaucuuaguauugauuguuauauugaaggucccaacaaaacaaaucuguccagcuaguuaguagcuaguuaguagcuuccacuuuuuucuuagguaaagugagauucuuggugaacaaaacagcaaugguccucacuugauucaguggagaagauuauagggagcaaauugaaauuagauaaucucaaguauaaaaaguacuaggagaagacauauguugugcuuucguagcauauaauagggucuggagguaagauuaugaccauauuugcauuuuugaacagucuguuuuauuguugguagaguggaacaaaaagauugaaagugcaugcugggaggcugugugaugcucuuacaggaggucacaguaaaugaacagagguaauagagaggauggagacaugucuauguguuuaaggguguuucuaaacuaaccugugugaguguguucauguguguauguguuagugggaaucaaacccaggguuucauguaugcuaagcaaacauucugucauugagcaaggguacaucuccaggccuguaaguauucugaaugcuuugugaagccuguguaucaaggaauacuuuguuuugggauauaauaugucuuaaacacuuaaucuuagccgaaaggcuuagaaaugauuuggaaugucuuaauuucucucuauaauccuuccuuuuugguaguaaguauauaagucuaugagauaaaauuauccuuuuauuuguaaaaaucguccucaagaucuguauggguauugguucuccauuccucccuccaccuucuuaauuuuacagucuuuuuucaguuuucuuuguuuuaguauuuuaauaguaugauuccuagccuccuaacaagaccgacccuuacauucucugucagaguacuaacuuguuuucauucauguuaccagcaguuaccagucugagaucuggauacuuucaggauauagugucuuuccuuguggugggccucacguguagaugcucuaccacaucagcugaacagauucugaugucuuacuuuccagacagcauaauuuuaucguucauauccauggggaauuaggccaguagaaauuauugugugcuuucuuggacuucuuaccaucuuguuguuguuuucagcagcgacccccuguggaugaaguacucagggaaggucacaucaauuugucaggucuccaguugagagcacaugccauguucucagcugaaggucuucccuuaggaagugacuccuuagaauaugcauggcugaucgaugugcaggcuggaagccuuacagcuaaagucacagcaccacagguagguuucacagcgccaucuccuagguuuguucuuacaguacugucuccuaucaucugcuuuguuucugucucucuguugccugccauuggauccccuuucccuagcucaacugccuugucuggccucaguaggagagggugcacuuaguccugcuauaacuugauguccgaaggaggggugguacccaaggggggcuuccccuucuccucaguggguauaaugaggggagggauuugugaaggcaagacugggagaagaaggagagugugcugcaauuagauguaaaaugaauaaauaaguaaaaacauuaaaaaaaaauagagucacuguaagucagccugauguuuauugcaucccaguaaugccauucuagugggauccauucuugacucucagaauuagcgacagaaaagccauugccaaauuuuacuuuucuuggccauauaugauugacugauacauaguuccauauaauacaugaauuuuagauuuguuuuuuggggaaaagaugcuccaauauuugaaggccaacuaauucagcuuuaauaauacuuauagaacaguucucaucaucuuguuuuuuuucuccaucuuauguguuauauggaacuauacuaaaccauagauaauuuuauguuuauuguguuaacuaaaauuauaugaucuuaauuguugaaauuauauauuuggaaugacauuauauguaucugucucucaauauguuuauuauuaacaacucuaaugcauuauaaaucaaggguaucagcuggacagugguagugcaucuuaguauuugaauuauucuguucacuuaagcugcuacauagacagaaauguuuucuuucaucuucaaaguaccuauuuuuuuaaauuguaacucaguauuaucauaaauauuaucauaguuuuucaaaauuaaauaauaauuagaggauuuucagugccuuuuugugcaguuaccuguccaguggaucuaguuagcuuuagaaaacuaaaaguuuaacccuugauuuuaaaaaguauuuguuuuagaaguugaaguggaauuuuuaauugaaauuaguuuucuuuuaguaauguauuugauauucacaaauggaaagcaacaagcuuauaaaugauaucaagguagaauaucauugguuagccaguauuuauuaaguagcagcuacacaauuuugaguucuuucagucauguuagacuuuguaaacuuuugaauccuggauacuuguuuaggaggcuaauaauauugucacccuguuauuaccuguagcuggcaugucucuuggaaugggggcagacauuuguuuuccaugugguaugucgggaguaugaacuggaaagaccaaagucaguuauaguaugccaacauggaauugaucgccgguucugugaauccaagguaugucaacagguguacugucaauacuguaaccauucaugccauuuuuaaaaugaaacauugaugcuuagcuuuagaucaaauguauauagccaugaaguuaauagcucacuauuuucaauuaaugauuuuguaaauucuuauuuaguuguaucuaaaaugaggccaguaugaaaacaauucacaaauauaaauaauguaagaauuuuauauucauuuacauguuuauuguuaaaauuccuauuuuaucuuacuauuauacuaacuauccacuuguaauucaguuguguauagauagauagauagauagauagauagauagauagauagauagauagauuuagaaaucgaagcaauaaagccaaguaaguaccuuauguaacugaauucaugcagcauccugaaacuuaauuucaguauuggcauuugucagauuuuugacuccacagacuuaauguucuuuucagaauacugaguugccucaaguaaguaaaauuuuaguacccccacaagggucauagaguauagauaggagccucuacaaacuguuuacagugaugauuaaauaauguuacugucacuacgugcccuaugaguuugggcuaucuucucucaguuuuuuaaguaugcauacuucagaagacugagaaaucaugguacuuucaagcaaggaaaauaguguuaguugugugcagauaagaugucaacaguugacucuuucauucccuaacggugcuucccuguauguuuuugccauucaaauuguauuuguuuguuacaucacuaaaauucuacuuuaaaaacgcaguaaugccccagagaaauguuuaugucauuaaagguuuuauuaaucaaauuuauuacagcauaauauacauguauuauauccacucuuuuuaaguuguacaauauaaguuuuaauaugugugguuuacguguaaaaagcucuauacauuuguauauccauuagcaaaagugcagauaaagaacauuuguuuuuauaucagucagcccuuguccuauaaaaagugugccucuugccaggcgugguggcucacgucuuuaaucccagcacuugagaagcagaggcagguggauuucugaguucaaggccagcuuggucuacaaagugaguuccaggacagacagggcuacacagagaaacccugucucgaaaaaccaaaaaacaaaaacaaaacaaaaaaaaaacaaaacaaaaaagccaaacaaacagugugccuguuuugucaguucauauuauuuuguuucgcuccauuguaaacacuuuguuguuguuacguguguauuugaugcguguauaugggugcucaugugccucaguacuuguguggugguuggaggacaaccuuauggcuucuguucucucuuucuaccuuuguguaaguuguggaguugaauguauguuaagagcuuguauuggcaaaugcuuuuagcugcugagccaucucacaagcucuucuaauuuuuucuagaggaaauccauugguauagagcauugccuguucugaaaagcaacuguuucuucuugugccucuguuacuaaugugccacuucugcucuggccagacguguuuacucaugacuuccauuuccucagguucauucaagcgggaggaugucuguuuucuuccagucuaaacauuaccaaaucugcuuuagaaucaaagugaaauaaaguguguguguacuacuaauauauuuauaguugauuuccucgugcaugguauggaaccaugcacauaagacagaugugugccugugcaugugauuuuccuagggaaaucuuauacuagaagauucauacuuguaagugcuaugcagcuguauacuaagcuugugauguguuuacuucaucuauuuacucugacuaauuuuaagucucaguaauaaguaacauauauguuauguauacuguuuauauuacauaauauagucagagauugagaggcuugccaauuuuaaaauugguacaugguuacauaagguuagguuucuaguggguuauuuuuauuucugauuauuucugcugucauuauaaaacagugaaauuuaauugaauaaauaaugaucauauaacaagaaucuuacuuaaauagugagauuuagcuacgugucaaacaaugaauuaauaguuguacuauccuuuuuuuacuuuaguugaguuguauuccugggccuuguccaacaucagaugauuuaaaauacaccaugacucguuuagcaauagauggaucugauauuuauauuguggaacaugguugugcuacaaauauaaagguaaccauuuguuuauuucuuauccaauguaauucauuuucuuuuuacuaauguaaaucuuuauguuuugaaacauuugucccgugugaucucauagacuauuccuacuuaauacucauaucuauuuucuugaacaguauucuguuagugcuucuaccacuuuuucaccuugaauuaccguggauucaugaaaggauguaaaauuacagguuguaguuaugcccauaguauaguacucuuaaaaagauacuacugugagucacuuaauaagcuggacacacugacacacaucuaaagcacuccaaugggaagguggccgaagagccaugaggacugccuagaagccugcaggcaggccaguuagugcugcagaauagcagcagaagcaagagagaugcugccucagcaaggagcaaggggagaacuaacuucugaaaguugccuucugauguccaaguguauuccaggacacacagcgauguguccgucugaccuaccucccucccucccucccucucccuuucucccuucuucccucccucccucccucccucccucccucucucccuuucucccuucuucccucccucccuuccucccuucucucccucucucauuaaauaggguuuguuuugaaugucuguuggcuuuacccauuuauacuucccccuuggcuucugaaagcauuugcuuacuucccugcucuauguauuuuuauuuuaaaucaagcccugccauguuccugugguuucaauacucuaccuucccuuguccuuuuguaggcuccuuuacuugcacgugcucuuuagaaaucacucacuuacuuagugggggcggggagggggcggggacgccaugcuuguggcaggcagaggacagcaggcaggaguguccccuccuuuuaccacaugggcucugcugcucuaacucuaggacugacaacauacuucccuucccugcuucccagucccagcccugugugaacagauucauuuucuuacguuuauguauuuauuucuaguguauguguugagaaucagaggacaauguguagaguuuguuucuuuccauuuacuuucugguuguggggauccagcucagguggucaggaugguggcaaacucccuuaccuacugagccuuuccuccucuguucucucuuuuuguuucugccacuauguucuuuuacauuuauuuauuuauuuauuuauuuuuacuuuauuucagguagguaccaguucuguaguuucugcuaagauacuuaaaaauacugagcucacagcuuuguuuucuuuucugcuucaacucuagaugggugcaguucgaauugcaaacuguaaucuucacaaucagucagucggggaaggaauaagugcugcaauucaggacuuucaagugagacaguauauugagcaauuaaauaacugcaggauuggacuucagccagcagugcugcgcagagccuacuggcuggaagcuggaucagccaacuuaggucuuauuacaguugauauugcauuagcugccgaucaucauucuaaacacgaggcacagagacauuucuuggaaacucaugaugccagaacuaaaaggugggugaaaccuuuuaagaguagcaguauccguguccauugaaaauuauugguuaaguuuugaggaaauucuacaauugugguagaucaagaacauuuuaaauaaagauuuagugacugugcuccugucuguacauuggcuaauguaaagaaaccugauacuuauaaguaaaugcaucauuugagggucuguagugauggugugguuuggaaauaacauuuuuuaaauguuuuuaaagucuauacuaucuauuuuacauugauaauaauucaaguugugguuuccagaugacauaagacacuauucagucuuuaagcuccgugcuuucaguugauugcuccaggagacuaucauaucauuguguauagcagaaaacucuuuuggcaggccuucaaaacuugagggaugaguaagaacaccuuuuaaaacaguugucagagccugcugcuauucuuauuuucaucuuucuugcuauggcacagcuguguuuuuguuuugaaaggcaaauugauuaaaaagauauacugcaauauuaaauguuuuuuguauuuacuuugauuuuuauauauauuaacaauugaauuauaauugaauaccaauuuuccuaaugagcuuucuucuauguuguuuuguuuuauuuuguguuccauuuagauugugguuuuuguggccagaugauaccuugaagaauaagaggugcagaaacaaguguggcugucucgguggcugcagauuuuuugguggcacaguaacuggccuagauuucuuuaaacuugaagaguugacaccuuccaguagcucugcauuuucaagcacaagugcagagucugauauguauuauggccagucuuugcuacagccuggagaguggaucauuacuaaagaaauccccaagacuguagaugguaauaaaaauguguuguauguggugcugaccucuugccucucugucucugugccauucugagagaagcccuguuacuuaauucaauaaaauugauuuuuuuuagggguuaaaauaaucuauaugcauuuugcagguaauuuaagauaaauguaguguuuugcuaagguagaucuuuccaucccauauaugcaauggggugaaaugaaaacacaacacaguuaauaugauuacaugcugugcgccuagguugggcagaucuaccgcuacacuaccaucuuccacagcuuaugagacugcuuggaacuugcaguuucuccaggccuugugcuucugcucagcuuuucuucuuccuccuccuccccugcauccucuuuucucuccagcuccaccuucccuuuuaucugcccaaucaucagcucuccuuuauuuuacaaguuaaggugggaagcagguuuacaggaaaucacugagugcugacucauuccuuguucacaaccacucacaggagaacagauuuaacaucaaauauaguuggcccagggcuuuccacagcaguguuucuuuuggagagggguggcauagaaucaaagcaggugcacucuucagaccuccugcucuugagaaggagcagcuuucccugcaaggcuuagccuaagccuguccucauaaacccugauucccucuaucucacuucaguuuacuuuuauagaauauccuaucacuggcaacauuguuauuaaugcccccaugucagcaacucauuuuccaagauauuuuucuugcuaauaaaauugaacaugucacaaagagaggucugaucuucucugaguguauccaagauggugguguagacacacuggccugaaugagcaaugaagcugucacuuguugaguguguuagcuuuagauuuaaguguugccuuuucuucaaagauuucggaaauaaguuucccuucuuagaaauacauuucugcaauuaaguugaauguuuacugccuaaauuugcacauuacauagaugugaaauauaaagguaaguuuugauauuucaucaguauuuagcauuuucccuauagguuacucaaaaaaaauccuaacuuuguuuuucuuuugguagacuuuuaaaauaaaaaguaguaguuuuaaaaauucuuaucagauugauuuccuguacaaagaaggagacagggaggcuacaaugcuuaaucauuguauaaugguaaugccaaaaugugaaugugccauuuagggacauuuuauuucagaaauguuacuaucacauaaaacuuacaaguaacuacaauuucuugggauuuaaaaauaaaauggauauuagcacauagcucucuucuuguaaccuuauggguaaauaauguuuauuuaaaaguguuagcucuguuauucucauuucuuccucaagcugucaugcaagguagguauuaucccuguuauuuguauguauguuuguuuguguuuuuggaacauaaucuugcuguguagccacuuaaccuuuaaaucauaauuccucuacucuagaguuagacucuuuuguuuaucccugccuuacagggaggaaacugaggguuuuuuugagauuaaguguacuaagucauauagccaaguggaauauggguuaguaaagacacuuuaauguucuuucuugugucccugaguuagcacuaauaauggggacuucuugaguuucugucuagcagauugaaugaaacauaacuaccacaaacucaaaagaucuuguguggggaguuuaugcauggcgcaaagugggaagaacaauuuccaacaugugaacagagugagggcaaggcugauuauaauuuuuacaacauuuaaucuccuuguggauucuugagaacagauuauagauccuaaauuaccuaggauucauaugugggaagauuucaauuagcaccuacaguaugaguuucugauuguugagcuuuccuggagccaaguguagacauauaguguuaggauggaguaaacuaagcuuguacuggucgaauuaaggauucacuuagugccugaugucuggaaaugagucaaacuaaccuauuuuucuuuugacuuucauuguucuguuuuacuuuguuaaauucagagaaucuuugcccuccaugaauuccaccuggagcugcauucucauuaaagaauguguuuucugcuuagcagcaggggugcuuuuucuuuaguaguucagggaucucugcaggagaggggaaauugagcaaauuuuaugcuguggggacuaaaaggugcacuaucucuuagugccugcucuuucauuuucauaucacuucaaagggcucuuaugaaaugacauagggccugucuauuuuagcugugaauuuauuauucaucuguuuauugcuuuguguuugagguuguucuagacacuggaaguacaucaaucccuacuccgauucaauuuguacagaaaauguggaaaauguuuaaaacaaguaaucugagugcagugcaugaugcucuuguauuaaagucuugugauaaauaugaauugagugcauaaaugugcaugcacgcauaagugugcacacaugcgcauacaugcuggggauugaaccgcugguuuccacauccugaucaaauucucuaccacugauuggcccuuaggucucaaauucuuccaaaaagaaacagcaaaaguuugcacauuguagacuguggacccagaauuuuuuauacaacuuuuuauaguguguaauaucuuacuauguguaguuagauacuuguauuuuuuaaaaaggacaauacuuuaaaauguaguuauauugccauauuuucauauauuccuucaaaaauguuuacagucacuuaacccacguuuucuuugcuuaggaaaugugaacaguaugaagaggaaagaaugggaaaacaaaucagugggaauagaaggagagagaaaaacucagcaccuuagucuucaggugcccuuacggucucacaguucauccucuuccucggaggagaacagcagcuccagugcugcgcagcccuuacuggccggcgagaaggagagccccuccucugcugcugaugaccacuccguucagaaagacuuguuacauagugccagaagagaugauggccaagcaaggucagugugcacuuagacggggaaacacugguuauacuucccuaaaauaguagcacacgaacuucguuccucuccacuugcucauuuuagauuauuuuuccuuugaaccggaacauauagugucuuucgaaauaaaauuaauauacucugcagauauuagaaaaugcaaaaauguauuuauaaugggaauauuucacucagugaauuuuuguuacuauucauauacuauauuacuuuauugaauauuucuuagucuuagcauauaacgguugaacacucccuucuuuugaauuacccuugccuaacaguacccuucacaguuugcuuccaccuucuuggcuguaccuucuguguccaauaucaggcucuucacuuugcucuucuucuuuuguuuccuuuucuuauagcgugacauuuguagagaggugauguucuuuugaauucuguucugauguuucuccauuuauucugugcagcuucccuagccagucuaaauagauauuugacuuaauuaugaugauagccaacaucuuuuaaauauaaaaacuauagucaaaaccuuugucccucaaccuagguaccaugauauuuuuguuugaauguuucauggagaccuucaguuacauguuguuacaaugauuguuuuagucacaguucucuagagcaggguucucaaccuuccuuaaagcggcggcccuuuaauacaguuugucauguuguggugaucccaaccaccaauugcuacuucauaacugugauuuugcuacuauuuugaauuguauuauaaaauauuuuagagguagagauuugccaaagggguugugacccacagguugagaacagcugcuuuagaggaacagagcugauagaguggguaggaaaugaugccuuguccuuauguuuuccucaguaaagcacccuaaaucuauuuugcuugaugaaauuuagaagauguggaaagagaaaaagaaccuuaaauaugcuaagaauccuggauuucuuuaaauuuuuguaaugcuuaacauguuuugcuuuuguuuguggauuuuuuuauagcuuuaugagggauauaaacucaugcuguaauguuucacuauuuugaauuaauauuuuacuauaaaauucuggauauuuuauuuuuaguaauaucaacauuacuuaaaugauuuuauaaguauuuuauguuuagauuaugugaugugcugaaaauagaaacaguuuucuucucuuuuagugucccuacagaaaucucaggaaccaguccugugucuccuaacacccaagauaagucaguaggacagucuccucucagaucuccuuugaagcgucaagccuccgugugcuccacucgacuugguaguacuaagagucucacugcugcuuuuuauggagacaaacagccuguuacaguuggaguccaauuuaguagugaugucucucgaagugaugagaauguccuagacucuccaaaacagaggagaaguuuugguucauucccuuacacaccaucagcugauucuaauucauuucaucaguaucggucaauggauuccaguaugucaauggcugauagugaagccuacuucucugcagcugaagaauuugagcccauuagcagugaugaaggcccuggaacuuauccugguagaaaaaagaagaaaaagcaaaugcaacagauugauuacaguagggguuccauauaucacaguguagaaggaccccuugcuguccauggagaaggcauuacagacccucggacucucccauucaaaacucauccuucccaggcuuccuuugucucugcauuagguggugaagaugaagucauagaacauguguacauuguagaaggugagaaaagaggagagagugagcaggucacgucucagcagccugugaugaguugcuaucacacuuaccuuacucaguuucagguaauaaacuggucaguuaagcauccuaccaacaaaagaaccuccaaguccucauugcaucgcccccuugaccuagauacaccaaccagugaagaaaguuccucauccuucgaacagcuuuguguuccaacauucaagguacaaaucaaaucauuauuuuccaucaacauacugauauaguaaaaccaguuuuaaguuguuaagcugagucauuucaguucucuucugaaagauagacuuucuguuguaugcacuuagacuacaagauuauugcucaauauuauaaauugaaacaaauuaaaucaaggauaguauaagguuucaguguguuaauguaguaaauuacuauguagccuaaucuauauugccauuguuccuaagauuaggaucaaauuucuuugugaguucaugaagacugaaguaggcugucagaaaacuaacucgugaaaaagaacguacagaggaagggcauuugcaguuccuguuugagucaugucuuuucugauucuaccuucauaauucuugucacuuacuugaggaaaacacaaaguuacccauugaauaucuucuuuuaaauauuuauauuuaauauaucaagaucauaauaguaagauuacuuuggguacucacaaauaucacuuaucauaacaaucagaaauaauuaaaauuuuagacuauaagcaacauuuuuucuauucuaggucaucaaacagggacuuacugcuaauucuuuguuagauagagggaugcaacuuucaggaucaacuucaaaguaagaauuuuaugucuuuuuuucuuuucuuuccucuuucuuucuuucuuucuuucuuucuuucuuucuuucuuucuucuuucuuccucucucucucucucucucucucucucucucucucucuuucuuucuuucuuucuuucuuucuuucuuucuuucuuucuuuuaaggcauaugcucuuuuuauguugcacaacuugccuucaauucugggacuaaaagaaucuuucucccucagucuuccaagcagcuaggacuacaggugucaagaaaaugcacuuuuaaaguucagagucauaguccuuaauuaggagauuaguagacuuuauucugaguagcaaaucuuuuguagaccuuauuuuggguuuagaccuuauuuuaagaauaaauuaccccaaauaauuuuuugugcaggaguagauaaacauguuugcauauuuuaggacaguccuaucuaguaaauaaauauaucaaaaauacuuguugucaugugauauaauugccaucuuugaccaauauguauuuuaguaccucauucagccugguuuugaaaaguguuuagacuggaaauauuaguuucugugaauuuuuccacugaaauaaauguaauuuaaauguucacuuacuuuaacaaagcuucaacuucuauucuuguuuauauucuauuaaguagcaccccguauacuccacuggacaagaaaauuguugauaccacagaugaugaaacauuaacagaagaguggacccuagaucagccuguugcucagaccaagaccacagccauuguggaagugaaaggaacuguugauguuguucucacuccgcugguggccgaagccuuagacagguauuaccuuugucuaaaaauaagacuacuacuuuauacagugaugcauuuacaugacauaaguaaauggaauacagaguuuauuaacuagcuguuuuuaguagaaauagaaguagauuuuaaagugguugucuauuaguuaaucaucugauauguuuucaagcuaaauauauuguaguguuauaauaacuauaauauacuuugucuuuuacauuugacuaauaagcauaaaaugacaaacauguggggaguaauuauuuuauauucauacacauuaauugaagaaauaaagggaaaauaauaguuacuuacucuguccugcaagauauacauagucuaucaaagaagauaaaacugacccagguagaagccaaaaugacacagaauagagugugaauccuguagauaaugaagaagggaaggcucagugaggaccaguucucaugaaaacacuuuugcuggaaugguacaggguguuuucugauaaauuggcaagauucuuggaaggagucauacuaaugaaaaauauaggaaauuaucuuuaggagaaucaaaaagacuuuaggagaauaaaauacuacugguuuaugccauguuugguugauaucccugggaacacuacuuuuuucucaagggaaauggaggaggaauggauugggggagaggggaagaagaggagagggccugagaggagaaggaggggaaacuguaguugugaugcaguauaugagagaaaaauaaauaaaugaacuaacacaaaugugugcauaguggagagcuucgggacauuaacauguacgugguuuccucauuuuggggguggguggagcgugcaaaaccauugcgaaaaauaaguaaaugaaugggauuacaacaaauuaaaaguuuuagcagacauaagacauaguucauaggaugggaaaaauauuuaaaaagcaaauauuugacaaaggguagauaucuagaauauguuaggaauuccaaaaaucuguuagcaaaaauuaagaauagucaguagaccuaaguaaguagacuuuucucagcacacacauacaaaugucaauaggcauaugaaaaauuaguacugacuugggaaaugccaauuaaaacuauagugagauguuacccaguaagaaugaccguuguuaaaaggagaagggauuguuauacauuguucaugggaagguaagcuaguacauccuauacugaggcuuuucccaaagcaaaagacaagaacuacugugauucagcaacccuauuuguagguuuuuaugcaaagaaaauuaaauuauuauguugaagaaacaucuuucucccauauacaccagcauuauuuacaguaaguaagcaauguaagugacccaugcccaccaaaugacaacauuuuguacauuuacacacuggaauacuguuuagcuuuaaaacaauuaaauccugucauuuaugacaguacagcuggaacugaaggucaguagguuaagucaaauaagacaggcacagacaaacuguacaugauaucacucguggaaucucaaacaguuuuuuugucuuagaauuuuaaugguagaccaaagucuagugacagagagagaagagguagaggaauguugaucagcugauauugagauucaguuagaagcucugaugugcacugcugauguguuuagaaguuuuuaagguuuucacuuuaaauaaauaacauucauauuaccuacaugguaccuuguuagaauguacaauccuaaaguuuuuauguauaggguaaaaauauaaaaaauaaaguuuggauauacauuuaaggugcaagucuguagaaauuguugaacauuauuugugguaggugcaaauguuccugccuaaucugagauuuugggggucaaggcagggcuaaaauuucagaaauguuuuuuccuguagaauuucuaaagauguaauuuaggauuuugcuuuuugguauugaaaaauugugaauauucaaugguaaguuucaaugauuguuugguaaaauaaaucauaauauuaaauaaaauuuuaauuuuuuucuuuuucuuucaucagauauauugaagcuaugguucaccgugugaguacucgacacccagcugcgauuguagaugaucuucauacuaaaguccuuagagaagcugugcaaaauagcaagacuaccuucucagaaaauguaagaagucuuuuugauucaguugguauagcaaguugagucuuccccauguguuggaauaucuaaacuugaaaaacuuaaauauaucaaaaucuuaucacuaaguuaaauuggaauccaucugauauguucuaaaagccauuggcuucauaauaauaacuaccguggauuaguagcacuaauuaaaaaucacagcuuucuuuuuauucuuuuguuuugaaaguagcuuagaacuagccuuucuuuuuuuuuuuuuuaaauuggguauuuauuucauuuacauuuccaaugcuaucccaaaagucccccacacgcucccccacccacuccccuacccacccacucccacuucuuggcccuggcguucuccuguacugaggcauauaaaguuugcaagaccaaugggccucucuuuccacugauggccgacuaggccaucuucugauucauaugcagcuagagacaugagcuguggguuggggggggcuguauugguuaguucauaauguuguuccaccuauaggguugcagaucccuuuagcuccuugaguacuuucucuagcuccuccauugggggcccugugauccauccaauagcugacugugagcauccacuucugugcuugccaggccccggcauagucucacaagagagagcuauaucaguguccuuucagcaaaaucuugcuaguguaugcaauggugucagcguuuggaagcugauuaugggauggauccccggauaugguagucucuagaugguccauccuuucaucucagcuccagacuuugucucuguaacuccuucaauggguagaacuagccuuucuagcaaaccuuguccuuaaaugaugaaaaaaaaauuuaagauuuauauuaagaguguguguguguguguguguguguguguguguguguguguguguguguaguugugugcacaugauuacagaugccugucaaaaccaguagaggguauuagauucucuggagcuagagcuguggauaguugugaacugccuaaugaggaucacacacugguggucuuuugaugauucucuuuugauuuuuaaaauguaucuguaguguauuuagauuaagaacuaggauagagauaaaauugagccugaguuauuucugguaaacuagucauuauuauucauucuguguuauccuuucaugugaaauaccugaaauacauucagguauuucagguagaaugguaugaauaagggaaaauugagcuauuuccagccaauaaggagccaguuaucagaaaccaagucagccuucaagacuguggaguucaguuuuacuauuacuaccaccaauaauaauaauaauaauaacaauaaccuauuauaaaaauauacaauuaucauuuuguuuaucugugaauguuuuucauuuuaguacauaguacuuuuuuuucagucugguaagcuggccuauuugccagcuuuugccugaauuuaugaccgaguauuaggauaguuaugucaucuuggucuggggaguguuaacacaaugaauauauauguuguggaugauguagaacuugugaaaugcaugggaauuaauuuuguucaaugcuuuaguuaucccccaagcaggauauucgaggaacaaaaacugagcauccuaugauaggaacaacuaaccagggacaaauucagacaaaugucacaacgaagcaagauaaugugacaauuaaaggacuacaggcuaaugugagcauaccaaagguaaaguuaagcuuuucagaaauauuuucuugauguaagugggcauauuuaguuguuuugccuuuuacauuuaacaaagggaauguuuagugaaacaguuugcaguaucaaaagauauucuccguucucuugaugaucuuuugauuuaauuaauuuaauuuagcagacuacuacuaaguauuuaguaaaauguuccauauucaucuaguaaaaauuuaacuguguucuuuuguuugagaauuuuaugcauucauauaguguguuuugaucaaguccucccaguucccucccccugaacuccuacauauccaccucuaccacuuuccccucucccugaacuccucccgagccaccucuaccacuuuccucucccaauuuuaugucugcucuuucucuaaagccuuggagucaacacguagucucuuaggaugugcacaucacaucagggacuacauuccugaggaaacugagucucuccccugguagccaucaguugacuagagcuccucugacagccccuacuuuugcugauaguuuggcuaacuugauuuuuuuuuaaguauaauuuuuuuauugaaaaaacuucuucauaaaauauauuuugaucauguuuuucccuuccccaguucauuucagauugcuacccuccuccuuaccuacucaacuuuaugcucuuuuuuuccucucucuuuaaaauaagcaaaacagaaacacaaaaaaacaaaauaaacaagaccaaaaaagacaacaaaaacaaaacuaaacaaacaagaccaaaaagcaaaauacccccaaaacccaaauaaagcaaauuggggaggggggagucuacaaagauacaacucaguuuauuuuuguguuggccaacuacuucuuggaauggggccugcccuaaaaugugguuaauauacccagugaaacuccauuggaggaaaccaguuuuucuuuugccaguggauauaaguggcagauagcuucuggauucaccuggcguuaacuuguguggaucuucuuguucaugcugcuuacugucucugaacucguauguguaucaguccugcugaaagacuauuuccuuggagacacugucaucucugccugguacagaaccuugaucuuugaggggaagcgaucauugaagacaucccacuuaggaccuagagcuccaaauuguccacuugagaguuucuguguuaauuaccaucuacuauaaggagaaguuucucugaugaggcugaagugaagcucugaucuauggguguagcaguaugucauuuggaaccauuuuauuucuguguucauuuagcagaauaauacuagaaggcuuuuccccauagucccuucaucuauguaguuuuagguucuuggccccuuucacauugucagguauggauuccgucuugcagagugggcuuuaaauuuauucagaaaguguuugguuacucccauaacaauugcaccaauuuauccuacaggcaugucacuguugaggguuucgggguuuucaguauugaugauugcuuuucuccaguagugugcagaguaccuaccugccaguaucuaaaugcuagggucagcaugaucuugugugagucuuguacaguuguauauaaugccuugucauaucuagaagacauaguuucacagcaguuacucaccaucuuuggcucuuaagaucuuuccuggucucuuucucauucauaucugagacuugggaaugggggugugaugcagauguucuguuucugaaugaguacucuuauccuguauauguuaaguuguaaucuuuuuaauuaauugccaucaacuuuaaaaaggaacaucucaaaagaaaaaaagaaaugucucuguauuuuucuuuuaaaguguaguugaucaugcucuggugggggaacacacauccauaaguauugugugcagcacaaauuggucuugaaggguuuugguuuuuuuuucuuuugguuuuucaagacaggguuucucuguauagcccuggcuguccuggaacucacucuguagagcaggcuggccuggaacucagaaauccacuugccucugccuccugagugcugggauuaaaggugugugucaccacgccuggcucaagauuuuuuuuuuucuuuuuuuuaagacacaaaacuggguggguaggacaggaagggauggaucugggaauaguuggggaagagaacgaauacaaucaaaauuuucaacuaauaaaagagagagaaagauagagaacaacuucuugaguguugggagaaucauuaauggaugaguauaaagacauacuuaggaaaaaacuuaauacuaugucuauguagcagaacaauauuaguagguuuucuuccgagugugaccuaucaagccaucaguucuuggcccaguuaacaauuccaagcaugaauuguccugauuaggccuuaaaucuagucagaaaguauugauuacuagacaacauaacauuuuugccacuauuguacuagugagcauaucuugacaggaaucacagcuguuuugaaaacuuaacaacuuuugucuucauuacucucagaucuauauacuauuauuauugguuuguuuguauuugugaucuagguauaaaagacacuuuuuaacuuuacaauucugaaaucugugucauuuguguguuagguuaacuuaugcuuguugcaagcuucaguggaggagucuccagccacaguuccuaguagaagugugacucaugugucccugguggcuuugugcuuugacagaauugcuacacaaguucguaugaacaggugaaaagaucuuauuaauuugagcaaugauuguuggaagugaaaagucuuguucuauccuaauuauucauaauuauuuuauagaaacacuugggcaauauuacugauacugguuuaguuucauuuuaaacaauguagugaaauguuuuuauuggaugacauuuaaauguuaaccauuuuguacauuuucuguuuccauuaagaggugugguugaagagacugcaaauaauguagaugcugguaaaacaucaaauuuugauagauacguucaugccagcaagaugcagccucagucaucugggucucuuaggucaaaugcuggagcagagaaaggcaaagagauugcugccaaguuaaauauccaucgaguccaugggcaacuuagaggucuugacacuacagguaaacuucagacauuuuguuucuuugucauuuguaaaugugaaauuuuccaaaagaggacauuuuccuuugaacauugcugcaauuugauacuaucaggaagagaaaagcacuucuucguaugguguacucaugguauuuaacuauucuauauuagguucugugcaaaauggaaaguaaguuuuaggacuaucuguguucuaggucauucuaacugcuguggcuaucucaguguuugucuuagaguuucuguugccucaaugaaauaccaugaccaaaaagcaaauuuagggaagaaaggguuuauuuggcuuauacuucacaucauaguucaucaccaaggaagcccggacaggaacuuaagcaaggcaggaaccuggagguaggagcuaauguagaagccauggaggagugcugcuuaauagcuugcucuucaugguuugccuacagcacagucuugugggagcauuuucuuaauagguucucucuugucaggugacuuuagcuugugucaaguuguugucauucagcacaugcuuauuuuaccucuuuguauaauaccacagcaucggacuugaggcuuuaacaaaggaaaauuaauuuuuauaauuacccgcaaacuguagucuuaaaacugaggcaaagaacagugguuugaguuguaaaaggucuguagauuguaguggugaccaguuugcacuuauuuauuagaucauaagcauaacauuauauaacuugaaaccuaccagcuggaauaaaagcucauuacaaacaaaagucccuaugaauucccauaguauauuugcauaaaaaugcaggacacauguagauuuuuuguuuauacuuauguuugagauucucaguuucauggcauuugauagccacagggagacgagaucaguuuucugagugcaguacucugggcuuucuauuguguaugccuucauaugggaguagacugcuuacaaacuuaaacacauuucucaccuuauacccacacuuaaaacuaaguucaagagauuuaaagagaaaugcaaauaauuaaguaaucagaaugauuucagaaaauggagguucauuuuacugcauuguaugaguaagcaguggauucaugacaaugucuaauaaauuucaguuauaaaaaauuucaauguuaagcugucuuucaguaaaaguuaauacuuuuucuaggaaauaauguuuucccugaggccacauaauuaaaauaauuuuauuuuggaaaugaugaaagcuuuuugaaauacuuugccagaaggcuguauuauuuagacguuuguugacagaauucuuuaaucuuucaaaaaggaauugauaaauucauuguuaacucuagaaucgucuuacuacauuggagguagcauuauuuucuuuacauauuuuauuuauuuuucugccuuuucagaauaccaagaugccuuuuuaauacaacucauauauuaaugucugauuuuugguuuuuuucuuaaaaggauuuucauuguguucucucaauaauagacauugggaccugugccaucacugccauucccuuugaaaaguccaaaguuuuauuuacucuugaagaauuagaugaauuuacuuuuguagaugagacagaucaacaagcuaucccagauguaacacggauaggucccagccaagaaaaauggggcuggauaauguuugaauguggacuugaaaauuuaacuauaaaagguaaacuuuuaacuccugaguucugcuuugguggggauuuaaguguauuuaacaguuuuuacuuuuuuuagaguagagccuugccauauaagaaguaaacauuucaugugaauucuuccuuuaaugaaaacuacugauuuauacuuguuucuuauauaagacaaggggaggaaggaaagucugaucugguuaugaguaauacuuuaaagcaggaaaguugaauaguuguaagacuuucaggcuuaaucuuacaugauacaguaacuuaaaauacuaguagcucugucuccacaccuuuuaccugcaaagucauacauaacucucuuagauaaaggcaaagccuagugaggaagaacaugaucuugaugaaguucuauacagauauuuuagaguauaacagugaaacacaucuacuuuuuuuccuaacaaguggcucccuuuauuuuuauaggaggaagacaaucuggugcaguuuuauauaacaguuuuggaauuauggguaaaaauagugucacagaaagggguggagugcugacauccaauaauucuucugauucuccuacuggcaguggcuacaauacugaugucucugaugauaaccuaccgugugaccgaaccaguccuuccucugacauaaauggaaacucagugucagaugagcaaguuggugauuuucuaaugauacuacuaguuuggaaauagagaacuauauacucaauuuaaaaucaauuucuagagcauauuuccuugucauuuccuguuuuagaguuguaacauuuuguugacuauaguaugauuacaguauaguuccugaauggguauaagaauauauacuaauggugcacauuucugcccauuauacuaguuagcauaauauucugcauauguuauacacauaguaaacauuggcuaaauaaaugaauuuauagaauuuaagaaagguagggugugauuaguuaauuuuagaagucauuuuaugcuuauagguaauauuuuauauaaauuguaaauguuuuuauaaauaucugcuuauuuuagauaucauuuuaaauaauacuuuuuuuuuuuuugagucaggguuucucuguguagcccuggcuguccuggaacucacucuguagaccaggcuggccucgaacucagaaauccgccugccucugccucccgagugcugggaucaaaggcgugcgccaccacgcccggcuauucauuuauuauuuuauuaugguagaauuuaauugugaugaauacgguaacagcaaauuuauuuaaaauuguguauuguugaaaaguugggccacuaacuuuuuggugaccuuggacaaacaaucaaaaauuuagugaauguaugcacaucugcacauaaacuccugagaguaaacaauaaaagcauaagugagcacccuuucauuaagaaauaaauuguggguaccuagugcucaugauuauacuuaccucuggacuccauuuucuggggguuauuuauuuuuauuucucuguaugagagacagauguguauguggguauggaguaugccauaccuuacauguggcuguaagcccuuacccuaaccuugagacagguuccucuaaugccauauaaaccaaguuggcuggucuuugaacauuggagaucuucuguuacuaccucccauuuccuuguagguacacacugaaauacagacucauguuuugugggugauuugguuuggguuggguuggguuugguuucggguuuuuauuuuuaauuuuuuuuacacuuuuauuauuuuuuugauagauuuuuuucuaauuuacauuucaaauguuguccccuuuccugguuuccccucugaaaaccuccuaucuccucccacuuccccugcucaccaaccuacucacucccacuuccuggcccugguauuccccuacacuggggcaucaagccuucacaggaccaauggccucuccucccauugauguccaacaaggccauccucuucuacauaugcagcuggauccaugggucccuccauguguacucuuugguuggugguuuagucccugggaucucuggugguacugguuaguucauacuguuguuccuccuauggggcuguaaaugccuuuagcugcuuggguccuuuuucuaauuccuccauuagggauccugugcucaguccgaugguuggcugagagcauccaccucuguauuugucaggcacugguaaagccucuccggagacagguauaacaggcuucugucagcaagcacuuguuggcauccucaaaagugucucaguuuggugacuauauauggguuggauccccaggccuuuccuucagucucugcucuauacuuugucuuuguaacuccucccauggguauuuuguucccucuucuaagaaagaccaaaguaucuacacuuuggucuucccuauucuugagcuucaugugguauguaaauaguaucuuggauauucugagcuucuaugcuaauauacacuuaccagugagugcauaucauguguguucuuugugauuggguuaccucacucaggaugauauuuucuaguuccauccauuugccuaagaauuucauaaauucaucauuuuuaauaacugaguaguaaguacgccauuguguaaauguaccacauuuucuguauccauuccucugucgaggaacuucuggguucuuuccagcuucuagcuauuauaaauaaagaugcucugaacacaauggagcauguguccuuguuauauguuggaaaaucuucuggguauaugccuaggagugguauagcuggguucucagguaguacuauguccaauuuucugaggaacugccaaacugauuucgagagugguuguaccaauuugcaaucccaccaacaauggaggaguguuccucuuucuacacauccuugccgccaucugcugucaccugaguuuuugaucuuagccauucuaacuggugugagguggaaucucaggguuguuuugauuuguauuucccugauggcuaaagauguugaacauuucuuuaggugcuucucaaaaauuuaguauuccucaguugaacuggguucugaugaugccaaguagucuugguuucuguugcuuauguucuugugcuugccuuuuaccaucuguuuaucugugguguuagcuggucuugcuaucucugacuuuggcuuguccuuccugcaagccugugugucaguauuccugggggaaccaguucucucuuggaggaauuaggguauggagaacugugguacagggucagcucuggggugcagauagagaccagaaggauccuguccccagcugaucuugguucuuguguccugguggaucugugagggucccucuugggccaggaauuuggagaaaagugguggucuuaccuguucuggcaggcgugugucacuccugggagaccagcucucuccugacaguauuuguguauguagcucuguggcacaggaucagcucugggugcagauggaaacucgacgacuccugucccaggcagucccuugcuuccuguguccugaggguucuggguggguuccucugagcagcagugguaaucuuaccugugcucucaggccuguccgcacuccugggagacuugcucccuccagcgcuauuuugauaugguuuuuguuuguuuguuuguuuuuaauguggcuucuguugauauaaacucagguugucagguuuacugggcaagugcuuuuacucacugagccaucuccacauucccuaggaauuuauuugguguauauuuggagaguuuaucaauuuccauaauagucuaauggcccagcagguagaagcaauugcuagguguccagucuggcaaccagaguuugaucucuugaauccuuguaauaguaguaggagaaaacugacuccacaaaggucuucucugauccccauauauaccccaugguacucuuacaaccacacuuacacaucauguucacauaucccauaauaaucauaaauaaaauuuuaaguuaaucaguuucauuauucuuuaaaaguguuuggaggguuccauuagaauuuuaaugaagggaauuaagacauauguggcuaugcacuaaacaauuauuuuaguauucuuccuuaccuuuugaaaaacuacagaauauuucuuaaagauuuauuuuuauuuuacguggaggaguguuuuaccugcauuugcuucuguacaucauguaucugcuucaugccaacugagacgaaaagagguugcuggaucuccaccauguuggggcugggaauugcucucuggccucacauuacagaauuauaagagccuuucucccagaucuuuugcuccuuggauuuuguaacaauuuauccaggcucuguguuauuuuuuuuuccuuuuuuuuuacccaauuguuuuuccucaaacauggguauucccuggaaguuauauucaugacacuaauuuccuucacucucugauauuuucauuauauagugauacuuuccugugccucuuuuacaaaauuuaugaaucaugacauuaaaugugccauggccccagagacaagucagcuugcagucacuugcuugaccaugaauguugcugcaguaauaauguauuagucucccucuuuuuuucaaaagucaaauucuacaucuuuauauaucuaaguucuuggccuauagcuucuugagaaaucaauguuucaaauuuauuuauuauguuuuaugauacugaggauuaaacucaggaccuuacaacaugcugugcgagaacuagcucuaccucuccagcuauauugauugguuuuguuguugcugguuuguuuugguucuguuuuuuuuuuucucauuaauuuguuuauccacuuaacauccugaucauagccccauuaccuccucuccucccagccccaucuucauaaguccuuccccccaucaucccuuuuccuucuccucagagaaggagaaguccuucuugucuaccucucugcccugggaaaucaaguuccagcggaacuaagugcaucuucucccaccaggcaguuagacuagggggaggggauccaguggcaggcaacagaauuagagacagccucuguucuaauuguuaagggacccacaugaagaccaagcuguacaucugcuucauauauguagagggccuaggacuagccccggcacucucuuugguuggugguucagucucugugagucucuauuaaucuaagucauuagguuuggcagcaaggcaguaaauaccuuuccuugcugagccaucuuacuggacuccaaauacuuuacuuugaaaaaaccaaaagcuaaaccuguaguguuagauaaucaggaugcuaaaacagggggaucucuuaaaagcccaggaggucaauacuagucuaggcaacauagcaaaguuuucucuuuuaaaacagaaacaaugcaucugaaaaacuuguguaaggcuaaggacaucaucaauaggacaaaauggcaaucuacacaaugggaaaagauauucaccaacccuucauccauucagaggacuaauauccaauagauacaaagaaaucaagaaguuagacuacaaaaaaccaaauaacccaauuaaaaaugggguacagagcuaaacagaauucucaacagaggaaucucuaauggcugaaaagcacauaaagaaauauucaaaguccuuaaucaucagggaaauacaaaucaaaguaacucuugagauucugucucauuucagucagauggauaguauaaaacaguucaagugacaucacaugcuggugaggauguggaauaggagaaacacuccuacauugcuugugggaaugcaaaccucuauagcuauuuuaagcaacauccacaggucaagguucuauguaaggagcagucugcuaagccugaugaaugaaaagguuuugugcuuaaagugcuaauaagucugucugacugguucuggaggaucaauauugguuuuggcuuuuuuauauaggaugaaggaguugaaucugaugauuugaaaaaagaucuaccucuaaugccaccaccuccagauucauguagcaugaaguugacuauuaaagagauuugguuuaguuuugcagcucccaccaaugugagaucuccugcacaugcauuuucuagguaagaaauuucaaaguguaauuuuguccauugacaguuccuccauguuucagacagcuuaccguucuguucugaguacuuccugaauuauuuuucuggcauaucuaauaccauaugagugauagaauggcuauucuuacuaucuuucucauugaauauuuucuauagauacuauauuucucuauuuagcccaauuucuuuccuaggauuuuggcuguauuugcucagcuugcugccuuagacuuuuguuuuauauuucacuucaaacaaguuucccgcuaauucauuuccaaguauuaauuuuuuauuuagauguugauaauuugucagugaccaaaagggaaaaauauugucaggauaaaguagcauuuagugcuagauauauaaaguuuaaucuuaacacuuguuuguuugugugugugugugugugugugugugugugugugugugugugugugucugugucuguguguguguguguguguguuuuaaaggcagcuaaaccucuuaagcacugcaaccccagcuguuggagcauggcugguuccuauugaucaacucaagucauccuuaaacaaauuagagacugagggaaccuugcgaauuugugcuguuaugggaugcauaaugacggaagcauuagagguaugucuuuuaaucauauaagguaucagauauacuuuguuacuguaaauuauucauuacuauuaguaguuguuggaaguuacuagaacuacaaguuccuaauuacuaaauaucuuugacuauagaaauuuuuauacauauaauucuaagucuuuuuguuugguuuucagaauaaaaguguacauuuuccucuaagaaguaaauacaauagacuuacaaaaguugcucgcuuucuucaagaaaauccuucuuguuuauuauguaauauucuccaccacuaccugcaccaagcaaauuacuccaucauugaugaugccacgauggugaguguucaaggaagcugcuauucuguggaaauaguacuagaugggcauauugagaaaugguuagaaauacagguuagugaaugccauuuugcucugacugacagcuuguauauagaagcugucgacauggauaaaauuucucagcuugauagguuuaaugagaaauugucaaagaugaaauuuugaaaaguuccaaacuucaagaagguuagagagguuguguaaagcuaaauugagugcucagaaggaaaguaaagaccuagaacugaaagguuguauucuagaagcuaaaagcauacauuucaagucaggaaguaaucccuagaaccauuaugguuuaauaaaauagagauuaaucacagagggaacauacauaauuguacaauucauccccacucauagaaaaucaauuuguaauugugguuuuagaauuuugaggacauugcuugauuucuccuagcuuccaaauaguagagcauacacaacaauauuuauccaaauuaggcaccuguguaucaguauuauuaauggcuguccaaaccuuucacuaggcaagugaagaaucuauauuaaauaguggguuuuacaaagauguuuuuaucuaagacugaaauaguauuuuguacuauccuggaauugaucacaaaguugcacuaugugagccugacaugcccauccuaguuguggucagagaaacuaguacagaggaauuugaacgcauuagccacgugugguuggaugcucuacauaccaagacaggaagccagaggcugugaagguaguggucuugcucuuuaauaacugcccauauacagauuaaucaggucucgccaaaauggcuguaaugaauuuuaagaccacuguccuccacgaucuucacuagaucgccucuuaaaauaacccucccuuucaaacauuuccacacugagaaccaaacuuuuaaaguacaugaacccuugagggacauucucaauauaugcguagcuguagcagguuuuguugucaacuugaaaaucuggguaacauugaacaaauuaaagaucuaaauuuuuguuccuucaucucuaagugggcauuuugagauuaaaguuaguucuucauuguuauuacagagugauggucuuccugcacugguaacuuuaaagaaaggauugguugcuuuggcacggcaguggaugaaguucauugugguaacaccugccuuuaaaggaguuagcuuacacagaccagcucagccccugaaaccuccagcuacuguggaccaggagcaugaagagggacuuggccuggauaauggagguggucuacaaagugauacuagugcugauggugcagaauuugaguuugaugcagguaacuuuuguucagggagcuuuucuuuccucaguguaaacacucuguguucuuguagaaaugucuucacaucaauaauaugccucuuuaaaagauaccaaccaagaccuuuugccuguaauuauuacaaaauuaguaauaggaaaauauucugacuguuauauacuugaucacaugguacucaauaauuuuaauaauuuuugucccuaauuugaaaauguuguaguugaacuaugcaguugugaauuuuauuaauccaaauucacggugacuuuggaauuuuuuuacugaacaaauuuuauaauuuaguuuugugagauacaguagaccaaugaauguaucaaauaguuuaaauaacuuuaaacaaaaaccugccuuuuaaaauuuguauuugcuuauuagucuguuuuuaaaggaguuuucuuuuaucaccugugucgugguaaaucuccaacccaaauaugcccuggcaaugaaaacacaacucaauuaauaugaauacaugcuaugcgccuagauugggcagaucuaccacuauacuaccgucuuccccaucuaugggaccccuuagaacuugagguuucuccaggccuugugcuucugcucugcuuuucuccuucuuccuccuccuccucugcauccucucccucuuccauuuuuuccuucuuucucuccaccucugcuccaccuccucuuuaucugccccauuaucagcucuucuuuauuuuacaaauuaagggggggaagcagguuuacaggaaaucaccugagugcugacucauuccuaguugcaacccuucaccagagaguggaauuaacaucaaauauaauuagccccaaggcuauccacaacacaccuguuucuggaaauauuuaaaaaaugaacccaccaacacucagcaggaccaggccaugcuccugcacuccugcugcaaauacucucuagagcuagccccugugccaggugaucuuacuugcucagucucucugcccaccaacucgccaacccugcaaggccacauggcucccacugggccuccauucugguucucuuucuccuccugagaccucucucucugucuccucaacuccucacucugccuaaugugauugaacaggaaaaauccugcaacaaccacuuguuacauauauuuuuacuuuaaauaaauuuggaggccugagcugagaauacaauuguauauauaggauauguugcaucugaacaagguagauauacuuuuuuaaaauaaauguauguuuuuacuuuaacuuuuugccaaagacuaauuucguauuaugaugauaaguugucuuacagugcuuugaaaaaaaaauuaaaaguacuuugaggaagaaguacuguaagagaaaauuccuaaaauuaaagcuucuagaacacuuauuuagcuuaauuaaaaaacaugguuuuaauaaaugguuuauaagaaauagccugaguuuuauugcuuauuaucuagaauuuguuaugcacagagguugaauuaguucagugacuacaccuucuaaacaccaauggugccuguguucauuucugacacucugaauauucuagaaggugacugaauugguuguuggccacuaucaguuacauggcuaguguaaacucauacucagguuggauaguaaggaaacaaaaaauuaaaaaucauaaacauuguacaucuguuuagauuaugaaaauguauaguaauuuuacagacaagaauguuggugauguuuaagauaaauauguggucauauguguauaauucauuuaucuuuugaaccuuuacagccacagucagugaacauacaaugcugcuagaaggaacagcuaaccgaccacccccugggagcucuggaccugucacuggagcugaaauaaugaggaagcuuucuaaaacucacacccauagugacucugcauuaaaaauaaagguauggcauugcuagcacugauuagagcuuaaaacuuaaagagcugaccuaccuuuuuuuuuuuuuuaauuucaguguuaaaaaucuuagaugucuauucuaaauauuccaguaguuuguuagaauuaauaacuuuaugaugcuuaauaacuucaguguauagauuuccauuaaauuuguaccauuaauacuuaauauuuaaagaccacuaaacuuuuuuuuguuuuuuuuuucuaguuaucuccgaaaccuuuuuuucuuauugaaucuuacauguaauaaaguucaggguugaaaauguugauaaucuugucauuuaaguucuaguaagaagccguuuaggcuacacauuauugauacaaguuuagguugaguuuuuacaaauuauaaucuuaauuuauacuccauuguuuuaacaaguuuaaaggauucuugauaaagaaggaaagcagagccaaguaaguagacuagcauugggagcaguauccucacuagaauccugcccuguaacuuggacauuuucugacagaauuaugcaccagcuccuuuauuuauaagguguggacuuugauagcauccuccuuuggaagauuguggugagaaauaacugagugaagacaugauaaguuuaucugacacuuguauuguuuugcuuuauuguugcuguuguuaguuugcuauucuaagaacugaauacgaguuaauaguauuacuuucacucaaagucugcauauagacuuacacuggaauuuagaauaauuucgacauuaaaauuuaaaauuucugggggcuggauacauggcucaguggcuaagagcacugacugcucuuccagagguccugaguucaauucucagcaaccacaugguggcucacaaccaucuauaaugggaucugaugcucucuucuggaguaucugaggacagcuauaguguacucauauacauaaaauaaauaaaucauuaaaaaauuugaaauuucaaaaugaaaauuauaaccaaaaacacaugaaaagggcuaauauaucucaaacaacuacaaaagcauuuuuaaucacuaagaaaaagauaaaauauaaaaaggaaaaguuuuaaaaauagauaaaauuauuaaauaugucacagaaaaauauguauacaaauaugaagauguauucucucauaaggaaauauaaaauaaauugauauuuuuauuuuuauaagauuaggguaacaaaacuugauauuacauaugaagauaaaagaaaacagucauucucauacaauauuagaauauuguuguaugacagaauuuuucuugcagagauacuacacucaucuacuuacccccaaauauagaacuccugauaggccaaaguauagauagauaucgccagaauucaacuuggugaaccagugaguuuuauugggguuauguacagcaguaggaauggaaaguuucaaucuaggaggaaacuguuacauaagaaguuuacaugguuuugaaggaucaguguggcccuaaaguauaagugaaaacauuuacaugucaaggacuuucauucuggaaggaacuguaaaugaucagauagauucuagagcuuucuugaaaaaaauaguggaugugacauaaaagaauuaaacauuacagggccaauaaauuauguacacuguuauaauuaacuacuauauagucuuuccaaaaagggguugguuuaugugagacuauagaugccacuggaguuacauggauugaguuaauagcaaaauauagggguguuuguguuauguuucuacuguuguguagaaacaccuugaccaaggcaacuuauuaaacaaaauuuaaauggaagcuuccauagaauuucgggugauuauauuugugccaucauugugguaagcaugggagcagacagguaggcguggcaauggaguaguagcugagagcuuacuugucaagacaaucaggaggcagaaagaagagauauuacugggaauguuauagcuuuugaaaccucaaagccacaccuccuccaacaaguccacaccucuuaauuuuucacaaacaguuccaccaacugcaggaacaagcauccaaacauaggagcuuauugggggccauucacauucaaaccaccacuguguuugcuuuuauaacacaaauaauauaggaauaugagaaacuagaaaauucuuggggaaaaugaucuagaagauuagaacauaggacuuccuauugaaguuucuuaugcuuuuaacguuuuuauuuuguguacauaaugccuuucaaauuaaaguguauuuuaguuuuucgucuuaguauuguauuuuggcuuuauaauuuuuuuuuuuuacauuugauacccaacaauccuaguagacaaaaagcacugugaguuuaaaggauagaauaggguaaguauuuauauaaauaaaugguacuaaguguuauuaagugcuagaagugugaacauucuaguuucguuuuuguugcuaugacagauacucauaaagcagcacagggaagcacagguuuuaucauguuauauagcucaucauuuauggaaagucaaguuaggaacucaaguagcuagucauaucauauugauagucaaaggagacuauuugcucucagcuguguccucuuuuauacugugcaggaccccuuucccagggagugguacccacaucuguaagcaguuaaaacaaucuuccaaagacauggccauaggcuaauucaguauugacaguuccacauuagacugucuccccagugacucuuggcugugucaagaccggugacagucaaaaccagugagcaaagauagucuaauaucaagaauuguggaguggaaguaaggcauauggauuaaaacgucugacuuuucuugcuugguuauuuauaaaacugauuuuucuuuugugaaauaaacuuaaucaucuauacaaagaacauaucagggauaagauaugaaaugugcauaacacauguguaguauguuaaaaguucucuuucuuccuauagugaaaggcuucuuccucuuccccaucuaagugaaagcauguaaacgugaauggaccucccacuuuguccuaaaacuucaguggucuaaugcacucaaguccuuguguacuuguccuugcuuaguuuccuguccuuagucagaaagccucuaguuuccuuucuguugguugucuaugccuaccuccaauaaaaagacauacuuccuucuuuagauuugcucuguguuuuuuauguuucuuuuuuuuguuuauuuuggugaaggucuugcaucuccuuggcuggccuagaauuuacugguagauuaugcuggccuugaacucaugguggugcucuugccucauccuccuguuugcugagauuguguucaaugccauuguaucugaccugguagugauaacuuccuuuugauguugucagucauguaacaagugauucuuaguuuuaaauggaguaguuguauagggaaauuguuuuuugauaucaauuugcugauuccauaauuaagccauaacagaaauugcuucaggcuacuucuuauucuuuaaauagccauaaacauguucuuuaaauaccucaugacuugcuuacauccuggugccguggauacccacccuccuaccacugauauuaaccagcauuuauuuccuauauucugcuuaagaugcuguucuaugacucuuguuuagcuguagaaauuaaugauucauuguuaaauuacuucaaggaauauacuugaauaugauguguugcccuuaguauuguauuacagaguuauaaaaaaauuauuguuuuuacauuugacuuaauaauccuaguagccaaaaucgcugugaguauuaaaagauagaauagcagaaauaggaacaauuauggugguuguaauuauuagcagucaguuucacuacuucagaaaaaaccaacuguguguucauuuuguagggcauucacccauaucauucucugaguuauaccaguggggacacugcuacugauucuccaguacauguuggacgugcugggaugccgguaaaggagaguccaaggaaggagagccuucucagcuaucugacuggaagcuucccaagccugcacaaccuucuggaaggcacuccucagagaaguagugcagcugugaaaaguagcucccucacaagaacagguaccuagcccaguggauccaacacacuccucuggacuacaagcaacugcacuuccucacauauauacaaacacacacauacaauuuaaaauaaaaugcuucuuucaguuacauuuucuuuugugggaaaaauagaaaaccaguuuauuauauacuuugguugcaugacuaaaccuuuuacuuacuuuguuuuugaaaaaauauuuuagaacaaaauuguaaauuucucuucaugccuuuuauuuuuauuuucaaauuagugcugacuagugccaagcuacacauucugagucuaaagaaugcagaaucuucacuauugugauaacaaaaugaauuuuguacuaaugucuuaggauccccaugccaauaucaugagaguuuaaaaauacauggagagauggcuuaguaauuaagaguacuagcugcucuugaagaggaucuggguucaguucccagcaccaucauagcuacugacaaccaucuguaacuccaguuccagaggauccagauucccccucuggcccccacaggcauggcauacacuuuguacacaggcaaacucgggugaagcaccuguauauauaaaauaagaauaaaugaaucuuuaaaguuuuuuucaaagagagacauuuuaauccaacuuucugaaaguaugcaaguagcauuuuucuguuuuauaguauauaauaaucuuauucaccauaaacuuuuuuucagggaauacaguagccacugacaugcugucugaacauccuuuguuaucugagccaucaucugugaguuuuuauaauuggaugucaaaugcugugggaaaucguggaagugugguacaggaaucuccuguuacaaagucaggacauaacagucuuccaacagguaauacaguuaucauuuucauauuaaccgucuucagucguacauacaguuacagcaaaaccuuguuccucaaaggauaacuagacggucagcuguuaggaugaaguuggaccguuucagcaaaaagcuaauuaaacuuugacuugguguuauuauaauaucaaauacaagauuuaacgaauuuaaagcauuuaaugugguugguuaaacauucauaacacaaaaggaggcagguuaaaaaacauuaaguauaguuacaacaugauauaccuacaauacaggaaaauaucuugaaucugucuaguucccucugagacaucauaacuauuaauuauauacucuuuguaguuacuuaaauauuuaaucagaucuauggggauagaaaaguaagauuucuuuccuuaaggagagaaauaaauuagggccauuuauuaauuuuaaaagaucaugcauguauaaaaauauuuggcaagauguuccccaagaaagugguggcuguaucaaguguaaguauaucaaccuuccuuugccuauuuuugaaguuuuccauguuaguaaauauugaagaauauugaaguagacuuugguacugauuaauaaaggcagcuaaaaugaauuuucgaugcuguuuaagccauaugaguuauuuccugauggaaugagaagagugguugauuugugacugcccacuggguuguuucucgugugggugugaucugaauucuaaccacauguuagguuucugcauugacucuugacagaagaaaauagaaagauggcaucgcacaguucuugguucugauuucacuguuguucagaguggcuauaguuuaaauuuuaagacaacuucaguggacuaguuccucucuaucaaggguccuuugucuggaaggacaggauauaaagcuuggauguaauucuguuaacaccauggccuuuuccugcuguacuuccuuuucaaagauuuuccagucggaaaauucuacauuuuggauuggcuggcuugaauuccuguauaaacaucauggguauuuucugaauauuuaaugucauuuuauauuagucacaucuguaaauauuuaguauuccauauuauuggguuggguuuuuuuuuuuuuuguuuguuuguuuguuuuguuuuuccucuguugucugguaagggcauuacaacguaguugcuuuuaaauuugacuugauaugcguuuguuugguuuuuuguuucuaaaugauucauauuuacucuuaacauuuugcuguuaggaguugcacccaaucuuccuacaaucccgucagcuucagauuucaacaccgucuuaucuagugaccagaauacucuggaugggacacauucucagcacaguacuagucaagaugauguggcagguguagaagaagcaaaccaaggguuuccugcuguucagcuagcugaugcacaggugagugugccuggguuuccugagacugguuccuucagcaguagguaccugagguucaagugaaaucucuauucucugcuuguuggaaagacuuucaugcaaaauaggagagccuuuagaagcaaauuacccaauagguuaucauuaauugaaaguuucaucaucauauuuuuguuauggggaguggggguggguggguaugggggacuuuugguauagcauuggaaauguaaaugagcuaaauaccuaauaaaaaauggaaaggaaaaaaaauugaccaugauauguuuaacaaguuaaauuuuaucauauucuacagacucuuguacaguguuaagaauuuauuaagugaguaguugggagacaguggauuuagaauaaagaaaguaauucaaacauguagauaucuaugaguagcagugucuuaaaggacuagaaggagaaaguagaugugaaaugugaacuguugauguaguucauaccagugagcaugaaaucuaggaaaaguuguuguuugcaaaaauauagacagauacugugaaauuauuuggaauauauuuaaguuugaaugaauagaagguaagcuggagaaugggguaugggggauaaccaggguuuuaaauguggacaucggaaagcuguguauacacaacuggauaagaaaauuguuauauuucccccaguuguuucuucccuuuauauaauaauagaacagaacauuucaucccuuucccauaaacaaguuucugauaaacaaguuuuacagaaacaaaggcagcuguuaauaccucacagccuauuuccucuauccuauucuucuuuuaguuaaguaaguaauuaauuuuuuaacaucuugaccuugaccacaaguuuuuccucccuccuuuccuucuaauccuaccaagccccuaccucccccauccacucauuccucuugucuucaaaaacggguaggccuuucauggauaucagucagccauggagugucaaguugcaguaagauuaggcaccucucuuauuaagguuggauaaaacaacucaguggguugauaggggccccaaaacaggccaucaagucccgguccacccucugacuguuccacuuccauaccuccuaccuguaccccugucuccacaagaauguccccauagccccaucaccuaccccaccaaaccuccagacucccuggggccuccaaucucuugaggguuagaugcaucuucucugacggaaccaagagccagcaauccucuucuguauauguguuggggccucauaucagcugguguaugcuaccugguuggugguccagugucugggagaucucgguguccagguuaauugagauugcuggucuuccuacaggguugcccuccuccucagcuucuuccagcuuuuccccaauucaaccacaggggucagcaccuucuguccauuaguuggguguaaauaucugcaugagaaucuuucagcugcuuauugggucuuucggagggcagucaugauaggacacauuuugugagugcuccauagccucaguaauagugucaggucuuggggcuuccccuugagcuggaucccacuuuggaccugccucugggccuucuuuuccccaggcuccucuccauuuccauccuugcaguucuuucagacaggaacaauuacgggucagaguguugacugugggguagcaaucccaucccucacuugaugcccugccuuucuccuagagguaggcucgacaaguucccucuucccacuguagggcauuucauuuaaggucccucccuuugaguccugagagucucaccucugguacauucuggagggugccccuaaccuccuaccucccaagguugccuguuuccauucuuucuacuggcccucaggccuucaguccuuuuccccacacccaauaccagaucaugugucccccguccccccuccucccaucccaagucuccuuuuccuuccagguucucuccccaguugugguugcuuucuucucucuagugagacugagauguucucacuugggcccuucagcuuguugaacuuuuugguuugguuugguuugguuugguuuuuguuguuguuguuguuugagacaacaaaacaggguuucucuguauagccuuggcuguccuggaacucacucuguagaccaggcugaccucgaacucaauaaucugccuucgagauuaaaggccugugccaccaccacccggcuuguugaccuuuuugaauccuguggacuauaccuuggguauucuguugcugucugaaguucucuguugcuggcuggcagcagcaggagcggagaagcauguuuccugccccauggagaauuagcagguuuguuuguuuguuuguuuuuaauuauuuacagcaacauuuguggcuauuugugaauggaguuguuucccuacuuucuuucucaaccuguuuaucauuuguacaaaggaagacuacugauuuauuugaguuaguuuuauauccacccacugugcugaaguuguuuaucagcuagagaaguuaucugguagaacuuugggguugcuuauguauacuaucauaucaucugcaaauaaugacaccuuuauuucuucuuugccaauugguauucccuugaugucuuuuuguugucuuguucuagcuagcagggguacuauauuaacagggguacacuguugucuuguucuagcuagcuaguacuauauugaauagauauggggagaguggguauccuugucccguuuuuagugggauugcuuuuauuaugguuagguaugguccuugacuucuugaucucuacaguacuuuuaaaaugaagggcuguuguauuuucucaaaugcuuuuucugcaucuaaggagaugaucaugugauguuuucuuugaguuuguuucuauaguggauuauguuaauggauuuuuauauauugaaucaacccugcaucccuaggauaaagcuuacuuggucguggugaaugaugguuuugauguguucuuggauucacuuugcaagaauuuuauugaauauuuuuacaucgauauuuuaugcaagauuggucugaaguucucuuuuuugguugguuucuuguguaguuuagguaucagaguaauuguggauuuacagaaugaauuggguuucuguuucuauuuuaugcaauaguuugaggaauauugguaucaggucuucuuugaaggucugauagaauucuguacuaaauccaucuggcccugggcuuuuuugguaggaagguuuuuaaugacuucuucuauuuccuuaugggauauggaccuguuuagauaguuuagcuuguaggacccccgauauggggacccccacucuaguccagggauagggugcacccacgaacacacaagaauccuucuuguugcaauacacacgaggcuuuauuggcagagcugugggccgacacguaccucacacaggaggcaggggagucgacuccgaaucucaagagcucgggguuuuuauggaggaaaaagggauaggggugcaaggaauuucaacaaagguaugggauuggcucauucaaacauuaacaguaagauuacaugucagccaaagggcaucaggacuuuguuccugugggcugggggcucaucuuguucacauagcaaccaguugauguaugacuuuacccggcgucaaggggcaauagacagaggggagguucuggccagaugguguugacccagacaagauagcccugcuuguccuugcauuccuuuucaucuuuacagucaagcuguucuuaggaauguccaacagcccugcccuggcaugcaggcucauagacaacucuuuuacaugaaucacaaguuacaaaaucucauuuuccuucaagcuguucuugauuuaacuuugguauguguuuucugucuagaaaacuguccauuucaucuagauuuuccaguuuuguugaacauaggcuuuuguaguaggaucugauaauuuuuugaauuuccuucguuuugguuguuauaucuuucuuuucauuucugauuuuauuaauuuggaugcugccucugggcccuuuaguuaguuuggcuagggguuuaucuaucuuguugauucucucaaagaaacagcuuuugguuuuguugauucuuucuucucuuuguuucuacuugguugauuucagcccugaguuugacuauuuccugccuucuacuccucuugggugaguuuacuucuuuuuguucuagagcucucagguugcucuuaaguugcuacuguaacaucucuccaguuucuuuaccagagugcuuagugcuauucauuuuccuauuagcacugcuuucauugugucccauaaguuuggguaugaugugucaacauuuucauuaaauuccaggaagucuuuaauuucuuuguuuauuucuucccugaccaaguuaucauugaguagagaguuguucaguuccacuuuuaugugggauuuauguuauuuuugcuguuauugaagaccagccuuaggccauaguggucugauaggauacaugguauuauuucaguuuuuucguaucuguugaggguuguuuuuugacuaauuauauggucaauuuuggagacaguaccaugaggugcuaagaaaaagaugucuuccuuuguuuuaagguaaaauguucuauagauaucuguuaaauccauuugauucauaaccuuuauuaguuucacuguuucucuguuuaguuucuguuucaaugaccuguccaugggugagaguggagaguuguagucucugacuauuauugugugggguucaauguguuuguuuagcuuuauuaaagcuucuuuuauaacugugcaugcccuuguauuuggggcauagauguuuagaauugagacuuucucuugguggauuuucccuaugauauauaugugaaaugaccuuccucaucacacuugguaacuuuugguugaaugucuauuuuauuggauauuaggauggcaacuccagcuucuuaggaccauuugcuuugaagaccuuuuucuauccuuuuacuuugagauaguguuugucuuuguuauuaaaguguguuucuuguauguagcaaaauucugaaucauguuuguauauccagucuguuagcuuaugucuuuuuauaggugaguugaguccauuaauauugagagauauuaaagacagaugacuguuguucccugauauguuuguuuuuguggguggcuuuaugugcuugugguucucuccuuuugaauuuguuaugagaugcuuaauauuuugucuuuucuuugguguagguaucuuccuuguauuguaguuuuccuuuuaggauccucaguagggcuggauugguagauagauacugcuugaauuuggcuuuguccugggauauuuuaguuucucugucuauguugauuuagaguuuugcuggguaggguagccugggcuggcauuuguguucucuuaaaaucugcaugaccucugaccaggcucuucuggcuuuuagugucuccuuugagaagucugguguaauucugauagguuuaacuuuguauguuacuuggcacuuuucccuugcaguuuuuaauauucuuccuuuguucugugcauuuaguguuuugauuauugugugaugagaggauuuucuuuuuuuggucccauuuauuugguauucuauaggcuucuuggacauuuauggccaugccuuucuuuagguugggaaaguuuucuucugugacuuuguugaagacauuuucagguccuuuaagcugggaaucuucgaucuccucuauucugauuauucuuagauuugguccuuuuauugugcccugaauuuccuggaugcuuuggguuaggaguuuuuauguuucgaauuuucuuugacaguugugucaaucucuucuacgguaucuucuauaccugauauucucuucuaucucuuguauuauguuggugauacuuacaucuguaauuccuaaccucuuuccuagguuuuccauuuccaaguuugccuccauuuguguuuucuuuauuguuucuacuucuacuuuuaggucuuagaucacuuuauucaauuccuucaccuguuuacuuuuguuuucccauauuucuuucagugaguuauugauauccuccuuaaaggacucuauuaucuucaugagauagaauuuuagguccugauuuucagguguguuggugcauucaggguuuguuguggugaaagaacuggguucugaugaugcccauguauauuggcuuuuguugcucuucccucucagcaucuaguuaucuaucccugguacuugcuggucugagugacucuaucuguagucugccuuuuuugucccuugguugcuucuggucuccugguagaccugaagcccuggcuguaguaggccuccuguuggaccuuccaaacgguggggcaggguaggggggugggcuaggaaugggcguuuucagaggagcagaaaagcugcugaucuguugcccuggcugcaguagaucuucuggcaggccuuuagacuguugggucuucagaggagcagucaagcugcucuccuguaugaagcuggaccugggaggucuucagacugguaucuguuguccauuuaccuuguguagaggaacuccugggaugccuucaagcugugguguuuucaggagagcagacuagcuggagaucaguugcucuaugugcaguggauuuccugggaugccucaggauguaguaucuucaggggagcagacuagcuagcagucugccccagcagaaaggaccagguggaaggggaguguuauucagcaggccgggguuuuggaugugaugggaccugaguccacugggcuuccagaagcagcugugggacuucaggcggguuuuuaccaaaugcucugagugcagcggaucuccuaggauaccccaggaucuggugucuucugcggagcagacuagcuagcagaaggugucuuuaauaaaaauucgcuaauaaagcgaauugaguccauugauguugagagcuauuaaugaccaaugaguguuaauuccuguuauuuugauggugguggugguggugguggugguggugguggugguggugguggugguggugguggugguggugguggugguggagguggagguggggggugggggguggagggagguggagguggagguggugguagggagaguguguguguguaugugugugucuuuuuuuguuuguguuggugugaaauauauuuucuauguuuuuugggauaguuaacuuccuuggguuggauuuugcauucucauuucuuuugacuagcuucucuguuaguuaugauaauaggucuggugccagguuuuuuuuguuuuuguuuuuuuguuuuaauagaaauauacggguauccauagaccuuuaaaaagcacaaaugaauguaaucuaaauuauuuuacccucagagaaguuauagaguaauugauuuauuuuuuuaucaaaacaauuaugauaucuuuugguuuuguuucauuuugugguaauagauauuaugcguuaguauaagaacagaguuaucagugaacaauaaacuauguuaaugcuguuguuugauaucuuccagguuguuuuuaaaccucuucugagucauacagggauccagucacaggacacaaugccccuuuguuaccggauguacuucggagaacaccuuucauuuucaggaacuuuagacugccucagagcagauauuguagauucggacacagcuaaagacaggaaaggaaaaagagcaagaagguauuuuucauauuguauaaaauuuuauuuuaaaauuauaauuuuaguaacaaugagaagguaauuuccaguuauuaaauguaaugaucauauuuuauuaagaauaaaauuuugauuuuauuaauggaucagacaguauuuuaggccuauuuuuauagaaaguacaugagguauucuaaagaauaucuauugauauauugauaaauucacucagcacuauaugcuuaacuucacuaguaaaguuuuuaugucugugguuuuaaucuuugcaccgacaguuuauuccuaacauauguuuugaguugacuuuuaccauauuuguguagguguggcuguauuuauauaugugcaugucugugugauuguaugcaaacauauauguauagggaccagaagaggaugucggguguucucuaacauguucuaccuguucauaugagacagucucucccuaaccuaaggcuaaucauuucuuugcuaggcuggaagcuaacaaacccuagaaauccuccagccuccucuaccagcaaagcuggguuuuagguguucaugggaugcuuggcuuauuaaaugagugcugagaucuggacgccagucuucauaauugcauagcaacuagugagcuaccucuccagguccucagacaauauuuuuauccagggauagaguaaaauucacauugaaagcauagccauaagaaacaaauauacaggaagacauauguaacauaugacagauaaagcuaugagcuuucuguuacugccauucuguuuucauggguaaguuuuacauuucuuuacugcuugaauaagcacuuucaaaucuacuaacagguuugacucuuccuuugaaaguuggaauuuuacuuuggguaucuuguugacauggacagaaauccuaaaauauggucauagguaacauuucugauaauguuuucccaaaagucuuaguuuuuuuguuuugcuuuguuuuugauuuuuuuggguuuguuuuuuuguuguuuguuuguuuugguuuuuuugcaguuuugcaaguuguaagaguaaaagaucacuuauauucaauuuaaacuuaagaaaacuggaauuuuaguuugaauauucuguuuaaauuuuuuaaaaaugaaauuacauuuauuuuuuuguguguguccauguguauacucaugugugcaggcaugagacagcauuuguauggagguuuggggauacccucugagagucaguucuuuccagcuuguaggucccagaauugaagugauaccaucagacuuaaguagccagugccuucauccauuaagccaccuuaguggcccauauuuaaauuuuuaaauaaauuaauaaaauucauuuuuguaaacgaaucauguauagaauauagggcuuucuucaauuuaauugaggucaaauuaucugaggauuuucuaauaauacagaaacauagaaauaguauucucugucuguuaaacacagagaguucuuauaagcuguuuguaaaacuuaauggaaaaaucuuaaaaauguuugucaaaauauuuuauaaauguuuauguauguguguaggaacacacaugcaaguacaucauauauuucuucuaaguauauacaacuacauuguauaaucauuauauaaaauauauaagauauaagaaguugccuauagauauacagauuuuguggauaaacacauauguauaauuaaaaacaaguuacaaacuuuuacugguaucauaaaugccaugcggugguacauguaccaaaucccacccaccuagccacaguucccuuucugugauucucuagccaaacuuaauauuccucucucuauugcuucuggcagcacucugagugcucuacacucuuagaaccagcucauaggcagccugcucagagguuugcaguuuuacucuaaacucuugguuucuugaggucucacuacacuagacuuuccucagccacuaauuuuagucuuaauuucuuuguuuuauagcacacuauuuauucuucuauuuauuguacauuaauuuuggauuguaauuuuuuguauaaacauucacuuugacuuuaaagccuuggcaauaaaccauuuaacauagagauuaguaugcaguaucucuuagauguaguugacauguuaacuuguaaauuauuuguaaaaauuaguggaaaaauuacaaccuucaaauguuugucaaaauauuguauguaaauauguguguguguguguguguguguguguguguguguguguguaggaacauaguauguuuaagguucaauuguagcuuuggcuucauaguguccaugacaguccuuaacucaucugcugcuuuugcccuaaaggacugcuucagcauaugcccagaauucuuuucuccuuuucuugacuguccuaaacuuucuucuuccuuuuggucauccuuacauauaucagauuuuuuggguuguuuacuugcuuuuucucagagauuuguuaugucaccauucuguuugggauuauuuuuguaacauuuuauucuucugugaguucugggucuuaguauccaauguuuccuucggcaacaacaugcagaacauugaccaucagccccuugugaaugucugcaucugugcauauuauuacacuaucguguggcauacuuuuuauuuaauaauaaaugccauuauucaauaaggaauuacagcucuaguuauaaauucauauuugaguugagaauaucaaaguauuuucugauuuuuuguuuuuaaauagagauauggcccauguuuuauuugcccuuuguggcaguauauucacaauacauauggaacaaaagaagggacaugaugguuuacuugagauuuaucauuauuguugguagaaguugagugccuuuuaaaaauaaaauguuuaaauaacuguaauuuuuaccccaaaguuuuuagauaagucaggggauguaacaauaauuuuuguguaagauuuuagguauuuuuaaauguguuguuuuguuucaguugguuuuucuuuccacuuguaacuugguaaacgaagcugugaagauuuucauuccaauaacuaauaggauuauacuaaguuugaaauuuuaaguuuaguaugacgggcugguucuaauugaucuguggcuaauucuaaguuucuauacuauuacaugugauauuagauagcaagaaaaaaauguuuguuuuauuguuuuuuuuuaauagaagccaaaugauuuugacuucuuaguuaauauuagaggaaaaacuaaaggcuaucuacuagcccaugaacagacuagacuagugcaaacaugcaauguauugaaucucuugcuuaaugguacagugcaccuuggagguuauuauguuuauaaaugcauaagaauaugcuauguaguucuucacaaaaggaaguaacagcccuucccuuugaacauuuuaggcaaggccaugugaaccuucccccacuggaguucaagccggcauuaauguuggaaaccuucagcaucagugcuguuguaauggaaaagucagugugcacuccgcaaaacuccaccagugcccuuuccuuucaugaucucaacaagcgcuauuacaacaccuuccauugcaacuucacuauuuccugccagucaauaagucagcauguggauauggcucugguccgucuuauccaucaauucaguacaaugauagaugacaucaaagcaacucagacagacauuaaacuuaguagauacacagcuggaucagcuuccccuacgccuaccuucaaaaccagaaaacaucgggauuuccguucaucugacuucagccgcaguucgagagggagucucaaugguggcaacagaguaaauaaugccaagaacaaacgggccaacaaugagaacaauaaaaaggaaucccgaaacaaaaacucacuaggaaggucugaaagaagaaccucaaaaguaucuaggaaagguucaaaagauguaguggaucauaugacgauucauauggaugauuccgauuccaucacagugucagagcaaagugagccuucugcugaaugcuggcagaauauguauaaauugcuuaacuucuauucacuuaucucagauccaacagggauauuggaaaaguccucagaaacauuuggaccagcagguaacaagcauuguugugauuuacauuuuucugucuagaaaugcuaaagaagacuguucaccauauuaaugguauaaauuauuaaaaugcauagaaauugguagucaccaaagagaaaauagugcugacauucagauauucugucagcauacuuccuccuugacccugacauagacugcuuuuaaaggauucagacaaacuuaauuucaaguaucuagauugaucauuuacuucaguagguauuagagaagauguugaaaauuaauugagucaucuacgagggaaaagucuacuuuagacuuugaaaccaagaaagcuagcacaguauuuagaauguucuuugugcuguguuuuuucaaaucucaaaccauauaucuccauuuacuaaaaagguguucggaguccuacagagccaacauguagaguuguguuugagaaugaacaagacaacaacagcuugacuaaaacacagaggaaacguagucugguaaccucugaaccucagcauguaacauuaauuguguuugggauuggcauggugaaccgcacacaccuagaggcagauauugguggucugacaauggaaucagaacugaagaggauccauggcaguuucacccuuaaggaaaaaaugaaagguauaacacuuuucuaauacuuuaauguugcuuugcugaaagaaauguguuucuaauauuugaaaauucaagaaaaaugaaaguuguacaauauuugcuuuuccucauugccacuauagaaauuuauaaucuaguauucacuuuaguaccuuuuuuaaaaauuaagaacuucacaaaaauucuauuacuggauauaaaauuucccuaaaguaaucaaaaugugccauuuauuucuaaaauggucacagaaggugugauaguucaugaaaucuaggauagcaucuguuugaauacgcuccauagauauguaucacaagggaaauaaugcugucagaugaaauugcuuguaaaauauaccccaguuucagaaauuccaaaauaaaauuaaauguuuaagucgguggauaaagcaguauggaauucacuuucauaucaguguuguuuucuucaugguuguauuguacaagaaaaggaacuugugaauuaacauuuguucuuguuaacuuuaugauuauccaacauacaaagucuaaauuuuucauuaaauacucuucuuuagcuguuuuguuucauacccuaaguaugaaacagaaguuaagcacugauuuuuacaugaaaauuuaugugugauuaaagaaaauuauguaaagaagugaaaaacuauaaaaugcugagaaaaauacaaacacacgaauucucaaauacaaggcaaaagauggcuauauugaaguaaauuuuuaacuuuagucguuuuaagacuaccaauuuuuucuucuguuguuuuaguaaacauuaagaauuacauuggugcuuuugguuagaaucuggaaaaugggcauucacuucuaaaugaauagauuuaacauuugcaaaguuugauaggucuuaucaauagccucuaagcuauauuucuucuuuauuguagcaauucuaauucuacaaaccuagaaagaacagaaaaugacugauguuaaagagcuggugguuauuuuuauagccccaagacaguuuaagauuuacccauuccaaguuguaucauaggauuuauuuguaugaaaaaaaucuaaaagagaaaagcaggcagaaugacauauuuacuuuauuuagauuuacaaguaauaaauauauuaauuucauaagagguauauggaccaagaguaguaguuuaucugguuuccuuuuuuuucucucaaagcacauaugugguauagaccauuuaauuccaguaaauuauuuaaugcaugaagucauguuaaagugcauuucuccauauuucuacuuuuuagguauacucuguauacauauauuuaugcaaaauaguaagcugaggaaauuuucuuaagguagucugacaauaauugagcacauuuauuauaauuuauaguuaucauuugucaucaaauauauuguaaauaaaguaauuuuaauaucagauacaauuauuuucagaagucagauuacauuuuuuucauauuuaagauguuuugcaucaaaagaugaccgagaccugugcuacugcucacauuggugggguuaauauuguacuacuugaagggaucacaccaaauauacaguaagugugcuuauuuuuacuguuuucuuuuauuccuuguuacaacuuauaaauaacuuggaauuccuugaaugaagucauccuauguaaauuuugaggauuauacuguguuucuagauacaauuggaaaaaacaauugauuuuguuacuccugccuauccuaaauucacucccucucauuuaaauaaaugcuugauuuccaguaucuggugagauugucuuauaagaaaaaugaucaugguacaaauuucuauuuaguauauagguuguuaauuuuccugucauuuaaauaguuagcuaaaauuucaaagaauaagaacucucuuaauuuuaaguaaucauuauucaccuagacuucagauuugucauuuagcauuuaagaaagguaacaguaaagccuuugaaaucuguuacaguauaaacuaagccuuuuuaaagagaaaguaucaaaccaggugaaaucuguuacaguauaaacuaagccuuuuuaaagagacaguaucgagccaggugugguagcucaccuguaauuccagcacuugggagauugaagcaagacauuuguuacaaauuagaggccagcuuugacuguauauugcaucccaugcuacccuggauuacagaguaagaaucugucuaaacaaggaaacagcaucaacaacaaaaaucaaauuaaaaacaaaacucauauacucuauuuuaguucuuuguucuuaauuuuuuucuguaaguucuguacuugggucuguucugauuagaaugauucugauguugauaauauuuacucaugguauccauagcauuugcauagaggagugcaucuaaccauaugaccuuauauccuuaguaguauuugccuucauuucuaauuucuuuucaaugggccaguuuuguguuauaacuagaaguguuuuaauaguuaaggucauauuuugagacuuuguucuucuuugauaguauaauuaaugcuaugcuaauguccugaagcauaguccucaggcuagauaaccacuaaauaggagauuugaccccuucuuucaaaguuauuuuagaaaucuaaauaauacaaaaaccugucuugggcaauauuuuuuuuccauuuuuuauuagguauuuagcucauuuacauuuccaaugcuauaccaaaagucccccacacccucacccccacuccccuaccuacccacucccccuuuuuggcccuggcguuccccuguacuggggcauauaaaguuugcguguccaaugggccucucuuuccagugauggccgacuaggccaucuuuugauacauaugcagcuagagucaagagcuccgggguacugguuaguucauaauguuguuccaccuauaggguugcagaucucuuuagcuccuuggguacuuucucuagcuccuccauugggagcccugugauccauccauuagcugacugugagcauccacuucuguguuugcuaggccccggcauagucucacaagagacagcauauugauauugauaaacaagccagagccugguggaaagaagaucucagacuuaacucuugcccuaguggcuuaggaucauuuccuagaaucaucacugaucauuuauuucauaggcacuuccuaggcacgucccaucuuuuaaaaaaaaaaaaagaccaggaaauucccaugguuaaacagaucucucucauucauuauggacaaacaagaggauguaugaaacuccuguuguaggcuaggaacugaagaccuguucauuuacuuaauccaccuugcaauucugugagcccagguaauuuuuaucuccacuuuauggaauaaaagaagugagauuuagaaacaucaaaguauuagcauaaacuauuuuaaauggucuagucagaagaucuccauacuacacugcuucugucuuucuuguucaccuacagcaacccaucccagaaagcagacuggugauuguuccauugacucagagccaaguucccuuagaugccccaaaugcugacuuuuucuuauaucuucucgucuguuuuaccucuuaagagaauggcuucagucgcucagcuuguagaacuuaacauuuauaaaaugaaaauuuaaauaauauagaguugauauuucuuaucuuuccccuuuaucagcuuuuuuugaaauauaaaaguuacuccugggcuggugagauggcucagcagguaaaagcuccgacugcucuuccgaagguccugaguucaaaucccagcaaccacaugguggcucacaaccaucuguaaugagaucugacgcccucuucuggagugucugaagacagcuacaguguucuuagauauaauaauaaauaaaucuuuuuuuuuuuuuuuuuuuuuugguuuuucgagacaggguuucucuguguagcccuggcugucuuggaacucacucuauagaccaugcuggucucgaacucagaaaucugccugccucugccuccugagugcugggauuaaaggugugcgccaccacacccagcuaauaauaaauaaaucuuaaaaaaaaaaaaguuacuccuuuguuacugucaaaacucguagucuuaagacuuuuuguuaauacuauuuggauuuauucuuuagcauuuccaaaugcaauuaaaaugaaauagaaugcggaaaguaguuucaaaaagucauuugaaagaaacccuuaggagcugggcauucgugagcuuccugcuaugcaguccuauuguaaccaauguaccugugaaugcugauuugcuucccuuuuguuuuccugcuucucuugaaucugcguccguagauuggaagauuuuccuacaucuccuacaaguacagccaaacaagaauuucuguaugucauauucuuuuucauggcuugugauuaauacugacuaguauaguacuuauauuaccauugugggauguguauaguuagucaccaucucauguucuagucaagcuuaaguaagggcugucucuuagguaagacagacuuuguuuucuugugcuucugugggcauauuauuugauaucauaauggaauuuuucacuuggugaguuuuuguuaauuaaaaauuaauuuuaaaaaacuaacagugcaucagcauguuuuaacuuuauaauuuuguuuuaaugggaaauuuguuguuuuaucuauggcuuuuacucuaugugcauuuguguuuggaauauuugaauuuuaccauugcuguguuugcaguuagcuguacuugaggaauauguguaggcgcucaccacgugagccugucauuacagcgcgcuagcauuuaguuuagcauuaguuaugucuuuggacauuuuuaaaauaaauuuuaaauauauugaauaaguaggugaucuauauauuauguuuucugcugguauaaucaucauauuuuaugaaauuuguuucauuauuuauaacaagccauagauaaaacauuauuaguucaaagccauuuguugggauuauguucuauuucacuucaaugaucaacuaaaaguaauacaaauuuaauuuuauuacugaaaaauagccuguauaacauugucuuuuuaugaacagaaaagcaaaacaaccacaauuuaauuccaauuuucugaguucucuggguauuuaaccaaaaaauaaucaguauaaacuuuagagcgaauuguuuaguggccaaugaucaaaauuuuuuaugggcuugaauauuauguacuagaaaggcucugcgaaggcagcaauggaaaacuaucaggugauggucuuuguugugauaccaucacauuuggccaccucauuccagucccaaguuuucuguuaagagagacagucauguauaacacaauugccaagugggaaagaaaucuuuuaucauugacuaaauagcauauagccauucagcauauuccacauuucuauuguagaaaauuucaagcaaacugacuugagauagccagcacaaaacaaguuauguaaauuaaacuuuuccaccuuccuccgucuuuuaaguuuggagccaguucaaggcaggaaggccacgguagggccagggguguagagaugaagguaaugcuucuagauuuguauaagacugauaugguuauuccagaggaauuugcaaauugcccuuucugacucggugaagaauugagcuggaauuuugaugaagauugcauugaaucuguaaacugcuuucagcaagauagccauuuuuacuauauuaauuuucucuggaagaugacuaaacuuugcagcacgcuugguaugcccacuguauguuaaaaauucauggcagauguccauaaagacaggcugaagguucacaggcgugcaguuuacagagcucuccagauuuaccguacuuuacaaugcuggggccuauucccacgccuuuuccugugcuccagcacuuuccuuuauaaaguaggcccaugacuucaaucucaauaauuugguuuuuugaugccauuuuagaaguacauaaauggauuuuuuuuuuuguaugcaguuugucucucuuuagaucccaaaacuaaaauggaggggaaaagguuaugagugagaaaaaaaaaucaaaguaaaaaauuuuuugugugugcaaauguugcuaauguuuguagaauuguuaauguuugaagaauugagcuggaauuuuugagcuaauguuuguaaaauguugcuaauguuugugcuuuuacuuaauaucauauauucuaaagaaauaauagacuuuucaaugcaguauaagaugaguauaucuuaauaucuuuuagaauaacuuuucagacuauguuuugacaaaugaaugcucuccuccuaacucauugaauaagaauaucuuauauucuuguuauuuuucaaaaaauuuuucuuugcuucuguuuuaauagucuuccuccucuguuuuuagaacuguggucaaguguaguauagccaagucccaagcccucuacagugcccagagagggcugaagacaaacaacgcugcaguguucaaaguaggagcuaucagcaucaacauuccucagcacccugccacuuuacacagcaugaugguccgcaguucucaccagcuguccaagcagaucucagaccuuauuagacagccuuccacagcgugagcuauuuuauuuuuuauagccugugacuauacaguaagguaucuuuuauuuuugcugugauaacaaagguucguaacaaaugagcaguuccugugaacauugaguaucacaguaauggagcugguagagaguauucaaaugacaucuugggagaaucauaguauguaucauuaaaguauuauauuacaauggccaauaagguauuaauuauaucacauugaccaauacuaaauaugaaaugucaacagcaaguuuaagaaagagauucuagagauuuauuggcaucacaauaaauucuaauaaaaagcaaauuaaugaauucgagaacuuucagucauuguuuaaauuuaagaaauugcagcagucauuuauagcuugcauaauuuugcauauuccuuuauuaugaaauuacuauauauuuuuuaagacagucuacaugcuagauagcauuuuaaagggcaguaaaucagaccuuucacgguaaccuuagucucugugcauguuucacuauucauagcauaugcuuuucugaccugugugugugugugugugugugugucugugugucuguguguguaugugaguauguaugugagugaguguguauguaugugugugugugcaugcauguguguguaugugagugagugugugcauguuguaugugaguguguguaugcgaguauguguaugugcaugcgugcaugugugaguguguaugugagugaauguguguauguguguguguauguaugugagugugugugccugcauguguguguguguguauguguguguguguauucguguguguaugugagugugugugugcaugcaugcaugggugugcguaugugagugugugugugugcuuguguguauauguaagugugugugugagugugugugugagugugugugcgugcauauguauguguaugugaguguguaugugcaugcaugugugugugagugugugugugugcaugcaugggucugcauaugugagugugugugugugcaugcaugggugugcguaugugaguguguguguguguguaugcaccaugcauaugcacaugcuuacuuuccccauccuauaaagugaugaaacagugucuugaugucucagaaaccagugccuauuuuuccauaguuguuuuauccagguuuuuaguucuugugugauaaauuauggcucaaguuauuacucugcuuuucuaggucaucauuauuuguuagcucuguuccacugagaaaucuaguaauuuuaucaauaaaguaguaguuucuaauaguuuuaugggguguaugugcuuugguuuguagcccacagccuaugaaagaagauauugcaaccccacugccuucugaaaaaaccccaacaaguguuaaucaaacuccuauugaaacaaaugaauuuccucaacucccagaaggcuuagagaagaagccuauuguucucaaguucagcgcuauguuagauggcauagccauuggagcagcacucuuaccaucacugaaggcagaguacaagauggggagaaugagaagccaugggaugacagguaacauggaacuuuaaguucacccaugugaaauuacccucccaacaucuuuccauccuuuuuuccauuuauaaaauaguuuacucuucuuuauugguuuuuccuugucuuaauuccaguuuuuaagguguaauaauaauuuuauuaaugauuuuaauuauuaaaauuuuauuuaauuauuacaaaauuaaugauaacugcuuagguuuuucauagauuuccuuugucacauuuacaaaagggauuguuuucuuacucugcugugaaauuucuguaaaaaauaauuggugacuaaauacaaauacuuucuuccauaucuguuggaauaaaaaugucuuuuucucuuuuuuguuuuaacaugguaaauuacauuaauuuuuaaagcacuaauaaaccuacucaaauacaauguuguauuaaggauauauguauuccaacucuuuacauuucagaguuuguuuauuaaaauaguuuucugaacauuucaaucuuuauauuaccagaaauagaaacaagguaaauugagcuuuuggauuuggcaaaguaagaaaacauggacuuuccuguaucagagcccaguucuaacaauacacuggcuaauuugcucauuuugaagucuacuggaauccauaggcuucugggaaaagcaagccagauaggcacuuucaaggugaaaaaguagaauaucaaagaguggacaccuuguugaguagccaaacaagaacccagaauucuguaaaugaagaaaaaggacagagccaguaaaagaguggcacauucaugaauacugaugagugguaacugaggccuuggauugcuuugaucuggauguuuuuauuuagugauacuggcaaaagagguaguaggagaagacccuggcuccugcagcuuccaggagcuagucaaagauagccuugacuguaacagguguuagaggagcucaggguagucaggaccuuuguggcaucucaaagguaugauaguuggaguauagcauuuuucuguuuaugagaggaacuuggguguguauacauuaccuacguccugagcaauaauauaguugaugguaaucuucugccaauucaucauacccacguagcuggacaauaucagcaaaauaaugaaacuaacucuacauuaauauuuccuugaacaacccuuugccagauagaggacuuaaaaaaauaaacacauuaaauuaaacuguaacauauuacuuagucucuuaauaguuaagguuaaaggaauguguguuuaauguuuuagaauuugggacuuguuuuuagcuugaguuguuuuaucuuguuguaguauaagcuucucuacguaaagggcagugagugugucuuucuguucucccuucugugauaaugcagacucuguaagugucucugcaucugacacaauguugguucccaguaggcaucauaaaugcugcuagcuuaauaguacuugcugacuaauucuuuguacuaaguguacuuguuuaacgauauggaguaacucauguguaauuuuuaaauauuacuucuauaugaucaacauaaacugugggaugacaaaauguuuuuucguagacaucauuucuguaaaaguuuauucuuucagcucucuguuccuuacacuguucuuucaggugcacagacaagguuuacauuugaguuaccaaaucacagguugcgcuuuacuucaaaaguuucugcgacagauaugucaacuaucccuccuucugcaagucuuaaccuuccgccuguuaccaugucagggaaauacauuauggaagaacaugauaguuacucagaucaaguguggaguauagaugaacugccuucuaaacaaggguacuauuuacaagggaauuaucuacguuguguggcagaaguaaguuuacuuucaaauuacuuuuugcaguuuauaaguuuucaagauuucgauaccaaacuacauaaugguccaaacuuugaagauuaaauguuaaauuauuuguuccuacacaaggcuaaucuacugaauuucaagagaaagggugugugucugucucugacuaccucucuucucugucuuuuauugaaacaauguacuaaucaucuacuaauuuuuaucuuauauguuaaauuucaaggucauuuuggcaauauuuuuaugguuuacuuuauaaaagagaauaaaagcuaacaucaggagcuuuauauauuuacuucuguaguccuuaauuaacuuuaagauaaacguacucucuuuaaaguguuugugugugggugggagggggugauuuuuaauaagguuauauagaauugaauacuacuagucauuauugaaaggucacauggaaagguaaaauaaauuaacagacucauuuauuauuuaagauaaugcuaaaagcuggcacuccugacugccacauuauuuucacuucuguguauaacugucagaagcuuucaaagcaugauacaccuguuucauaugguuugaaaauacauaagaaagcucuuugagcuuuugauagaaauacuguaauuggaggagacacauuuaagucugauauaccuuuuucagauugggcuugcuuuaguaccuaagaguuauaaauucuuuuaguuuuuaauuuuaagagugaauguguguggcacugcuguguggcugaaggugagaugucacgauauacagggaaaucagaugacacccuuguggagcuugugcuuugcuucugcucuuaccuagguuuuuguagggacaaaucucaagaaucuagguuugcacgguaagcuucauugcccagcagcccaguucuuugcuggaagacuauucuuuguggggcuuugguuugguuaguuuucuuuuuucuuuuuuuuuuuuaauuagauauuuucuuuauuuacauuucaaauguuauccccuuuccuaguuuuccaucugaaaaucuucuauccccuccccgcucuuugcuccccaacccacccacucccacuucuugguccuggcauuccccuguacugggguauagagccuucacagaaccaagggccucuccucccauugaugacugacuaggccauucucugcuacauaugcagcuagagccaugagucccaccauguguuuucuaugauuggugguuuaguuccagggagcucuggggguacugguuaguucauauugauguuccuccuauagggcugcagacuccuucagcuccuuggguacuuucucuagcuccuucauuggggacccugugcucuauccuguggauggcugugagcauccacuucuguauuuggcaggcacuggcagagccucucaggaaacagcuuuaucagaauacuuuaaagcccauuuucauuguucuuauauaguauguauauaauuaucucuuuucccuaaaguuuuggaugauuggcuuuacagaaaagcagagcuaacauacucaacaguacaaucucauagucugauuuuguuuggcagguugguuccuuugaacacaaucucacaacagaucuucuaaaccacuugguguuuguacagaaaguguucaugaaggaagugaaugaaguaauacagaaggugucugguaaggcugucuggggcuaggaaugcaaguuucuauuuuuauuugucauaugagguuucaugaucuaaaauaagauguaagugacauaaaauuauauugauaacuagugugagugugugugagagagaaacagaaaggugagagggggggauggaugcacacucauaaagcaaaagagauaaucagcuaguuucuuuuauuuucuuuauauuauucccuuaagcuggggucucucauugaaccuggaacugaccaguuguuuaagacaguaggguccuuuauuucaagaaagaaaaucuguugcuauggcagauuggaggguuuugggggcaguucucuguaagaaucaaagcccaccauucacuuacaaucuggaguaauuauagggcagggagggaggaugaaguuuccuucuuggccagagaugggcgaaauaaauugugaguagcaaaugaaacaaugcggguggucacuggacaacucucaugaacagcuuugaggugugccauaugugccaggaaucuaguucggguucaaaaugaccaugauuaacagucuugacuuuuguuuccuuggguagauguuguucauguaauucucugcugucaagauuagcauccccaucacaguuugggggcaguuucugguguugaaaacuuuggaggaagacauuuuuaaggguugaguccuuccccagaagccuccaagccuguuaauaccuaucugucuaacauucucuccucacaaguggagacccugaaaccauuuagaauauggaaguugaauaagucuggcugcuuccaacaaggauugggagauuagagaggaaaaagaggggaauuagugagacucuugaugacuuucaaacauggaagaacagucaaagugaccaugagcuggaucaucucagaacugucugaaucaacugucaacgaguauagacaaaauuaagacagugacugaauacaccaugucuagagaagagcauuuacaacuaagauuauaguagauuuaagaggauuuugcugcagagaucuauauguaaagcuggucaccaaugaguuggcagucuuuggcauguuuuuacucuuauuuuguagagcuuguaaagcaaaggagacauaugcaaaauuaucaaguauacagaaaaaguauuuaugugauuuggaaaaauaugaguccuuuaauuugauuaagagccuuaauuugauuaagucauuguuuuaguauauuauuaccaacugcuuuaacuuugggacauaaguauggggauaagugaaaauuauacuagaaauggauauuuuuaacacaucacauuggaaagaccaaguuuuuauaagaguacaucaaggaaaaauugguaaaugagagcuaauaagaauaaggacuggagagauggcuuagugguuaagagcacugacugcccuuucagagguccugaguucaauucccagcaaccauaugguagcucccaaccauuuguaaugaucuagugcccuauuugggugugucuagagucagcuacagucugaagaugagcuacaguguacucauauacauaaaauauuuuucaaaaaaagaauaagaguaauuaugcuaauauguguagacuaaguugcguauauggcauauugcaugcacucaguaauucauucuccuugguacuagggucugcacagauaucuguuuaguugagaauguagcaaguaaaaaagaaaagaauacagauggagggccacaguugcuuaagaaaagguaauccagagaaugguaacaucaagagagcuauggcuuaaaauucaaaugaaaaaacaguaauggugauuuaacauuuuagaaauugcacugaaauguaauguaaacauccucuguuagaauuaguuagcaugagacuuucaaaugugacagcagaaaaggccuuacuugaagggaguaaagcuaucuaaaaaauauuaguaauuuaugucaccugaaacuuuggugguagcuggaugauacagacaggaagaaagauggaguauuugauagcuggcugcagauaagguaaucacuaauuaagauugguuaagaaaccuuauuguggguuucagauaugagguagaaauuaggaucugcugaugagcagaagaaggcaaaguaaugcuguaauuguagagcagcuguugagagagggaaagugcaagcauuuaaguaggcacucggauuuccaggaagcaucuagcuagcuagcuuacagaaagugucugcuuggcugcuguucacuaguccuaacgauugggguccugucucaucacacuacuguuccuuuuucucucucucaaacugaagauugauuugucauuaaagaaaaauguuuuacuggagguuuucuuuuuaauacacaaaauauagucagaauuuugugugauaaggaagcugucuagucuuucaggauuuaaccuuuucuagguggggagcagccuaucccucucuggaaugaacaugacggaacaacagauggagauaagccgaaaauucuccucuacucccugaauuuacaguuuaagguaaacuuccauaacacugaugcucuuaggaccagcuuucuaauuaauuaguguauauuuuauguggaaaauuugcaugaugcauaauugcaaaauagugaaaauaaacuguauucugcuuacucggggaaagcuuuaaugucugaaucuucuaucagugcuuuuuuucuccuuuucuuuuucauauugacacuccccuccccuccccucuccucuccuccccuccccuccccucuccuccccuccucuccccucuccuccccuccccuccccucccuuccucuccccuccccucuccuccccucuccuccucuccucuccucuccuuucaagacagaaucucaacuaugaaguccuaacuggcuugcuggaacucucucuauauaaacuaggcuagucuugaacucaaagauccaauuaccucugucucucuagugcugcgguuaaaggaaugcacaccaccaugcccaguccuucuaugacaacuacugcuacaauaauaguaauaaugauaauaauagcaacaacaguaacaacauuauuauuagcauguauuuugaaaaacuucuauaucuuucuauaucagauuauugagaucagcuuuaucuucugaaagcaguauuauauaauuuaaacaguuuguuuagcgauguuccagugaacacuugguauuucuaauuacuucuuuuguaauuuacucugcaagaacauuuugaauaucuguucaauuaauaauagucuuuuagggaggcgaugguagaaugcuugcccauguguacaauugccugagugaagcaaagcuaugggucuuccuugccgccaaaggugggagagcagggcauggccaaggagaaaaagaaagagcuguaauacuuuaaaucuuaauuaucuccuguaaaaaaguaaaagugcuaaaaugauauguauuaacuauagcauccuaguaauaacugauuuaaagaaugugugccuuagacaucuuauauaugcuaugacuucuuaucauauuucaaaagauugcauuucagugagucuauauugguucauuuucuuauuuuccuccuaacguguaaucugcuaggguauucagguaacagccaccacaccuucaaugagagcugugagauuugagacuggauugauugaauuggaacuuucaaaccgacuucaaaccaaagccucaccaggaagcagcagcuaucugaaauuauuugguaaaugccaaguggacuuaaaucuggcauuagggcaaauugucaaacaucagguuuguacagaauauaaugguauuggcacuauugucuguaaauuaacuuauguguuagaauuuuagaaauauuuuaaguuccuaaaauuuguauuguaaauucugaugaaaacuuacuuaggccuuuauaauuuuacuuugccauuucuugccauuuuugacuauauacucccuauuacaaguuugugcaagagcaaucucaugagacuuuauccaaaaucuguagaaacauuugcuuguaauauuucaguuucuuaagcauuaguuacaucgcacugucuugugcuuuuauuaguuaauauguaaaguguuaaguuuacaccuucccuauagaauguuugaaauuuucaaauguaaaguuuuaagaaaaagauagcaacuaguguaguucccuaaucagguuuacuguuuaucagagauacuuuuuuguuguucuaauuuaauuuugcuaaauaugucuuuuuaaugucccaccuaauuuugauuugaagagucauuuuuaauugccaguugugguuuuaaaaaaaaucaauggcuauauuaacuauuucaaauucuuacuagaguuagaaaaugaauuuuuuuucaaauggaaacauauuuugagagaaaucuuauuaauuucaaacacuuaauacauuacuaggccuaccucugcuggguaauugugcuugacagcuuuaucacagagcuacagcccagauccaaguuuaccuuuuacauaguucuucauaauuuauauuaauuuuuaaguacuuauguuacaaauaauaaagaaucuaccauuuaauggcuaaauuuggaaaguauacuguaggucuuuuggaaaacaaugguauauaauguuuaaaugauuuugguaaaauuuuccauugauuuuguugaguuuuaaauuuuauuuuagguuuaugaagaagcugguucugauuuucaucaaguugccuauuuuaaaacuagaauuggacuaaggaacgcccuucgagaggaaaucagugguucuucagauagggaagcugugcuuauuacucugaauagaccaauuguuuaugcacaaccuguggcuuuugauagagguaaguuuauaucagccaugacugucuucuaggcgguagucaugcucaguauguauauguauauauguauguauagguguguguguauauauguauguauguauguauguauguauguauguauguauguauguauguauguauauacauauguauauauguauauauaccuuggcuuuccagugcagauaccugacagcuaaaaugccuccuaaaucugaaaugugagcagagcaccuaagacgagucuugcuaacuacagcuuuuaaagucauuucauauuuuacaauuauuuugcuuuugacauaaauaggauuauuuuauuccaaguuccaaucuuaaaugcuaaguuuuuuaguuggauuaucuacccauuuguauuuacaacauacacugauucauuaauucugaaaaauguuuuacugugugcuggcuaaaagugggauacaauagauaacuggaucaggauuccugcccucaaguaauguagucugcugaaaaaaaaagaguucauauacacuugucaaugagucaaaaaucuuuuuuuccuagaucugaaagaauguguaucuuccuuugcucuuuugcucuuuagaggagaaacaaauucuucaguuucaacuuagaauguagaguucaccagggagauaagcacaugagaucagcugcuacucacuuucuuaaccuagggcuagacccguccuagcauacaguaguacauacaaacauuugcuaacugagagaauugaguguuugugagcacaguagucuaagagaagauagcaacagcuuuuagagaagaaugggaaagaaggcugacuggauggacaaacuaauguuuaaauuauuuuucagaggcaauaagaagauacuucugaaucuguguaaaauuucaguucucaguggucuuagauucaccauuaaauacuuugcuuuuggcagugcgccauagcugcuuuuuguuuuguuccugagcccuuuacucaugcucugcaucucccauuucaccagccuucccuuauccuucaccaggucuuagaacacucucaacugguguguggcaucauucuugauuuuucucuucuaguggcucuccauuuuuaccuucuuagacuuccauacugucuugaaaugaagauuuuccuuugcauguuuuucuuacuaacaaacucaaaugacuuugaccauuucaaauugcauucuuuaagauaaugugccuagcauugugucuuuguuuuuagaaauauuucaaagcaauaaguacauaauaguugauuuucugcugauaugaugaaguacugugaagaaagguaucuuguagauacaaaguuuauuugugcauagaggucaguaggauaguccauaauggcuguagaggcaugacaguauguagccccagcaagaagguaagagaagaagaagaagguaagagaagaagaaggucuaguccacacugaggaaagcccagucugaacucuaaugggguaaugcuacgaacucucauugguucugccuuucccauaacuucuccgaauaguaacaucaacugggaaacaaguguuuaaaugccugauccugugacauuucucagccaaaccaacacagaagguaaacuguacaguuaaggacaaggcuccuguuuuuucauguauuauuccaaccaagaccaaauuguguaauaggaauucuacaauauugaauggauaaguggaccuggguuuucuuucuguugucacuagacaguugcuugcuuucuguuucuuucuuuucuuucuuucucuuuuuuuuuucaugaaaaguauuaacuguaugacuuuaguaucauuauaauucuagccaaauuuuucugguaguaauuuuuacuagaaauuauuguuaaucaucagaauuuuacaguaguugggauuuacuaacuguaauaaaucacuuacaucauugacuuuaguuuucuuucugccuguucuuaauuugcaaaagcuguucuguuuuggcugaauuauaaagcugccuaugacaacuggaaugaacaacgaauggcuuuacauaaggauauucauauggcuacaaaggaagugguagacaugcucccugguauccagcagacaucagcccaggccuuugggacucucuuccuccagcuaacugugaaugaucuaggaauuugccucccuauaacaaauaccgcacagguacagaaaaucaaaacauacgaggcuuuauuccagaauugaaagcuagauauugcuacucaaccauuucugugaacauggauuauaaccauuuuaaguagagcuguuuauaacuugagcaaggaagaacuccuaauucuuaccuuugcaaauaagcuuuagaaucaucuuauugcuuuuuuuaaaguaagagcucuuaggauugaucuuuguauaaaguggaaacaggaauauuucaaaaugacuuuauuacccccacauguaacaugguagggaauuucaauuuucuuacaaaguguaguaugaauauuaaauaauuauuuaaaaacuugcaaguuauauauguacuuagaugaaaaaaagaugcuaucuucauaauuuagggccaguuuucagaaacguauuggaacuugaacuugugguuaaguaagaaaacgcugucugcacuugucagaccaagaagaaauugcccuaagaaucauaugcagagaucugucuuauuguuacagucuucuuucauugucacuuuuaauaguuugaauguuguggcaguuacuaacugaauggaguaaacuucuguugaggguucuguuugguugaacagggcuaagagaaacuuggcauucaacuguuguuggcgucuaaagacuugagauguggcagcuuuuuaaugacaugauaagacgguucaggaaagccacacacauaagaacuggccaucguagcccacgaaacaggggccagacaaacacagauauuagcucuugcauauuaaaaaggaaaaaguacacaggaaaauauauuucauuuacucaaaaugaaauuuuauucuuuaaaaaccuauuuugcuaauauugaggauuucuagacuuaaccauuucuagacuuuaauuaugaauauaaagauuucuaaaguuuagaagucaucuggucuggagaaaugacucagcagucaagaacacuuguugcucuugucgagaaccuggguuuaauuuccaacacccaugugguggcucacaaccaucugagccacucuaguucaguggaucugaagcccucuucugaugucugugggcaccagacaagcguguggugaacauaaguauaggcaggcaaaacauucaugcacagaaaauaaaucuuuaaaaaugcauucuaaauucaccuuugccucauuucccugugauuuuucuuuagucuaaccacacuggagaccuggacacuggcucugcucuagugcugaccauugaaaguacucucaucacugcaugcuccucagagucucugguuagcaaaggccauuucaagaacuuuuguauccguuuugcugauggcuuugagacaucaugggaugacuggaaaccagaaauccguggagaucuaguaaugaaugcuugugagucugauuuauuuucuauauaaggcuuauaauuguaaaaaaaaauuaaaaugucucuguugaaaauugaaggauguucagauauaggaaugcuuuagaaaugaaauaaggguuuuuuguaguuaaagguagcaaacuauaucuguaaaaacucuuaacuucaggcuucugguaaggcagaaagacuuacacauuugaagccugguuuuuccuguaguugaaugaccaaauaaauaauccuuguuccaugaucuguaagaaagugguaauugcaagacccaacuuaguaagcauagaauagauugugauucuccuggacuagaauuucagcuuuaauuauagcugacacaggaauaacccaacacacagcccaaguuucuaggauuugaaagacucauaguggacuccucuaauuccacucugauguaugugaugauuugaaaggagaaagguuuauaucacuuuuaauaucuuuagguaucacagcagagauaacuacagaauuacuucuuuauaacaaagcaguguacauauauauagaaucuuaaagauggugaacuaaaaucuucagucaauucuaugaugaaaauacucuuuagcaggugguuugccaucauuuauguaauuuucuccuuucugaaacaucacuauaacuuccaaauuaaaggcaaaaauuaauuuaaacaugauuuguuuugaguguggcaucuuuuuuauccaugcacuaauuaaaauagacuaugauuagaaagaaaacagaccauuuuccuaguaauuuggaaaaaaauaucucauagagaauauaagaaauaggccuagggcuuagaauuaaaacauaauuauuaaaaugaauacauuauuuaauaccuugguauauauucuuuuagcaguaaagaaccuugcuauucugauuucugauaugcagaauaacaagauuuagauuuugcagaaaauuuacuuuuguagcuuacuauuguuucugaggaagggaaucagaggaagaguaaaaagaguaauugucuuaauauguuauaugaauucaaaaugauaaaauggacacauugauugaguaauuuguaguuucuaaugggagagauacuaguauguaauuuuuauaucuagggguagaaaaagagaugauguucaaauuuuaaagaguuuucauuauaguauucuugaauuuggaagauuauuaauguaggcuuuguucugacugauauccuugacuaaaagguuagcagagccuaucuuaaccggaagccacaucuugccuuguuuuaauuuagaauugaccaguuagacauucauacuuuaugguugaaaaauaaauuuuucuaaguuacugccauuguauuuuuaagaccauaauagggcagggauguagcucagugagcagaguacuugccuaccauucagaacacccugauuuagaucucuagcaccacauacaauuggcaugguaggcaugucuggaaccccagccuuccacacaaagaggcagaaggaucuggaguuccagguuguccuucuaaucaucagcugaguagccagugugacgccagccugaacugcaccgugaggcacuaagagaggaacugauauuuacucauaaaagacagugcgccuacacugggaauauuuuucuuucuaggaaauuuucaaggaaagacaaaaaacacuccaaccuuaagugacaugugaauaccaauuuagaauucacacaaaguuauaaaaggacauuucauuuuagacuaaucaaauuuagauugauauuuaauuuccauuaaggcuuauugaaaguaaccuuaauucuuuuuuuuuacaacuuauuuugcuuagagaugauuuauuucaaagauagccuaaucuucacuaauuaaguuuaagguaccaaguuaaagguaccaggcguuagcaacauuuugcauuuaagaucaaauauguuucacauauacacauauguguauaugaguguguguguguguguauguguguguguguuguauauacacggugucacaaaaauugucauagaauccuagagguuaguagaaagcagucuagaaaugcccagauagugugucucuaauaauuacaugcuacaaguaaagccaaaacuuugagcuaaguugcuaaaaucauaaaauaaacacuucacuuuguauaacaagacuacugaauccaaaguuugcucuuuuguggggaggaauugaaaccuagaagagcuagaaauccuguuuacauuuauguaauugucuuugggaaaaaaagacauguuuaauaugagguacauguuuaaucauaagaacauuuuuauugacaacuauuuucggguucauucuugugcagguguaguuccagaugguaccuacgagguuuguucaaggacuacaggacaagcugcagcugguagguuugcuguuuacuuugaaacagaguuaggugaaaauacgaugggaagucucaaaugccacauuuaugaguugauuuauugaugacuagggagaguaguaaguauuuuugaguaagaaaucaaauggugauagcaucaaaggaacaccucauggcuguaaagcauaagaaaacagcugacaucacgugccuggaaagagcucauuucuguucucauuucaacaagauccagcucuucucaagcucagagaaugauuuugguuuuguaacuuugauguuuacugugacuacuuaguuacuuguaggugguggaugcagcuuauaacgguuucugcuguauccaugggaagguugagcucagagggaacggauagccgccaugcuguuauacagaagagguacauacacacuauaaacauggaaaccaacacucugucugguguuuggagcaggucuugcugugaauggcaguggguaucugauauggccaucauauaguucauaagugcuuauacuccuauuccuaggaccuugaaaaugccacuucuuuauuuaaacagaaaguaguagugccggaaccuggacacugaauguauuguggaaaaugugugggauugauguccacauggacccuaacauuggcaaaaggcuuaaugcucugggcaacacccuuacaacacugacaggagaggaagacauagaugacauugcugaccucaauucagugaacauagcugacuugucagaugaagaugaagucgauaccaugucuccuacaauccauacuguaagugcauucacugcuaggaauuucaagacuggguuuuccugagauagauaacugauuaacuugagguuauuucauguguugugguugcuguuguagaggaagggagaaggcggugauuucuaggucugcaguuuacaguacugauguguguuucaucauaaugccuuuaugaaaugugccuuaaccucaguguaauauaguaacauugaaaguaagguaaggucaaucuauaaacacagaaaguagaucaguggguuuugagucuggggcuggggaugagguuugagaacagggaagggaagaccugcucuuaugagaggagcuuuccuggcugguacuaagagugugguagugacugcuuagcucuggccauccuaaagcuaccgagcuguacauucuaaauggaugggucucauggucuauaaucguaucuuaggaaaggguuuuacaaauaagucuuucaaaaagccaaguguuuauacugugauauauacauuuaaaaugugcuuuuccaacuauacugcuuauucuguuguaucaaguuauuuaguagcaaaagagauagugacuuucagauuucauucugguuuugauuuguagagauuuuaaauacauugaucuguuguauuauuaaauaguuuugucuugaaaaguaauuuuaaauuaauaauacuguuuauuauuuagaguucagauggaaguucaguaaguggagauggucacaaacucaccauugggcagcgacuuguaaaucaccuacuaggccuggcaccuccaaaucagcgcuauucuguuccugcagaguaucugugugauucagagaugcggggcuccccucagucuagccagucccauuugaaagcaugcagagcacacucauggggaaacguaggucgcaacucaguagaugccuuaugaaaugaggggcuugaaucaguggagaauugcaaucaucuuaccugcuguagauggcuuugauucuugcaugcucucuuugaucgaggcauuaauuuuuguaguauagaugggcuguaggaacugaaagugguauuaacauauauacuuugauuuuuuuuuuuaaggaagcuguagauuaucgaagacaaggaacaucuucuagucagccaggagaacugagaggaaggaagauuaugaagcgcuuaguggacaucagagaacugaaugaacaggccaaaguaauagaugaccuuaaguaugucauuguuuuuuacuuacuguagcauucucuaguaauagaauaauaggaugcuaaagguggaagaaagcuuuuaguguaucagugaagacaucaguucuccaagaaguucaauaauuuuucugagauuauaaggaauaaagugaaggcugaaauccugauuuucugucuuuacaacccacuucugugcagugaguggcagaggagcucgguaugcauguucaugcuucacuguauucauaugcgugguugaaugugcguguuaauuugcuaacuuuguuuauagauuggagcuuuuuuugaggaguuaagaaucaguauuuaugaaaggcuguucuguugugacaugcaguaaaccucacaguguauuugugagguuaaauagcauguuccgaauggacucuuaagaaaacuggcucaggggucuagagagauggcucagugguuaagagcacugucugcucuuccggagguccugaguucaaaucccagcaaccacaugguggcucacaaccaucuguaaugagaucugacacucuauucuggugugucugaagacagcuacaguguacuuagauauaauaaauaaaucuuuaaaaaaaaacuggcucagaguaaagagcugagauuuguacuuauauaaauaugaauucaaagucucucucucucucucugucucugucucucucuguguguaagucuugauaguugauguuaacagguuuuuguuuuuuuagaaaaaaaguagggauaagacaguaagcauuaguaacuuuuuuaaaaaucucuugccagugguauuguaauuuuacuaaguacaucccauccaaggauaaauauucuucuugcuaaauuuugaaacuuugauuuucuuuaaguggccaugcuucaucuuuucuagucuucaaaugcuuauaacuggggauuuuguuguuauuauuugaucaggauuucccaaaauacaggaguuuugaaauauacaggguaugaccuuuaaguuucucuguaaauuuucauguaauaauucauauuuuccauuaauuugaguuuuauccucaaggagaaaaaugacuugagguaaaaauauaugacuuccaaaaaucauccuacauuuuucuguagagugaauguuugguuuucaugagauugcuuguaccuugagauacaucaguggguagagaguguaaggugugucccuaaauguuaguguguccuuuguaauuuaccagauaugagcauuaaguguacaggaguugggcuauccagaaaagacccugggcuuuccuaagugagagggcuggaagaagcacugagaagucacuuguacuuucuugcaucuuuacaauaacccccuauuuuggugggguuuuuguuuguuuuguuucauuuagaaaauugggugcaagugaaggaaccauaaaucaggaaauucagcguuaccagcaguuggagucuguggcugugaaugacauccgaagagauguccguaagaaguuacggcgguccaguaugcgaguaaguucgugcuucaggaugucgugagacuuuaaaauauauauauauauauauauauauauauauauauauauauauauauauauauucacacuauaauuuuauuccuuccucccugcccccguccacccucugacuguuccacaucccacaccuccuccccacaccccugucucccagugaaugccccugccccccucuccaccugaccucuaaacucccuggggccuccagucucuugagggugcauuaucucugaaugaacacagacccggaaguccucuacuguuuguguguuagggccucaaaucagcugguguaugcugccugguuggugguccaguguuugagagaucucgaggguccagauuaauuggaacugaugguccuccugcaggguugcccuccuccucagcuucuuccagcuuuucccuaauucaacaacaggagucagcugcuucuguccacugguugggugcagauaucugcaucugacucuugcagcugcucauugggccuuucagaaggcagucaugauagguaccuuuuugugaguguuccauagccucaguaaugaugucaggccuugggaccuccucuugaacuggaucccacuuugggcuucuguucccuaucucagauauuuguauuauuuucauuuaguugaaaauaauuuaaacguucucuugauuacuucuuugacacaugcuauuuagaaguguguuguuuaaucuugaaccauuuuuuccagauaauuuuuuaacacaaacauauacacaaucugguuaaauuacauugcagucugacagcagucauuauaugguuucagcccuuuaaauguuauagcaaaucuuagaaccuagaauguggcagccuguuugggggaguuuuccauguugacuugagaagacuuuguacgugcuguuaaugaacaaagucuugaguagauguugauuauauccaugugacagaugugcagcugaguuggaguauguccaaguggauuuucugugugcacuggguccauuucugaugaaaggucuccaccaugauagugaauccaucuuuuucucuuugcauuucuguuagguuuugccuuggguaguuuaaaucauugauagucaaacugauuguugauaucauuggauuaaacaucuaccuauuuuguguugcuucauauugcuuuuguucucuauucaugcuuucaucuuuuuucuugucuuuuguaguuuuaacuaaacauuuuaugauuccauuuucucuuuuuuuauuuguuuacuuauuuucuauuggguauuuauuuauauuucaaauguuauucccuuuccugguuuccuccccucucccggaaguccccuaugccauccucccuccccuugcuucugugaggguguuccuccacucacccacccacucucaccuccccaccucaauuccccuacacuggggcaucuauagagucuuuauaggaucaaggaccucuccucccauugaugccugacaaggccauccuacgcuacauaugcagcuggagccauguguacuccuugguugauggcuuagucucugggggggucuagcuaguugauauuguuguucuuccuaugggguugcaaaccccuucagcucauucaguccuuucucuaacuccucuguuggggaccccacacuccguccaaugguuggcugagagcauccgccucuguauuuguaaggcucuggcagggccucucagaagagagcuauaucaggcuccugucagcagguacuucuuggcauccacaauagugucuaggcuugguaacuguauaugggaugaauccccaggugggacagucucuggauggccuuuccuucagucucggcucuacauauuugcuccugggaguauuuuguuuuccuucuaagaaggacugaagcacccacacuuuggucuuccuccuucuugaacuucauguagucuguguuauuuggagcuuuggggcuaauauccacuuaccagugagugcauaccauguguguucuuuugugauucgguuaccucucucaggaugauauuuucuagaauugauuuggaauuuugauggggauugcauugagucuguagauugcuuucggcaagauggccauuuuuaauauauuaauccugccaauuaaugagcaugagagaucuuuccaucuucugagaucuuucucaucuucgauuucuuucuucagagacuuaaaguucuugucaugcagaucguucacuuguuugguuagagucacaccaagguauuuuauauuauuuguguauugugaagggugucauuucccuaauuucuuucucagccuguuuaucguuugagaagaggaaggcuacuaauuuauuugaguuaauuuuauaaccagccucugggccuguguaccagaggcuuuccacggagaucucuggcccgggcugguucaagaguucuggagaagggaagcaagugcgugcagggaagggaggucacuucuaccacuucugcugaugcacuuggccccaccuccaucucugcacugaguuggguggggcugagcagacuaaaggccaacuagccagugaggaguggaguggagcuuuaggcagcauauugggacagcagcucucuucccaaguguuacaacucuuuggacagaaggcucaguaguucucacacacuuuuaauccuucagaauaggauucuuauauacaguuuugggguggguaagggucugacaacagguacuucucauuggcuuggucugagagcuuuaaggaaacuuauuugcaugugggagggcuugaugaugguccuacaugacugauggccacacaccucucuucggggggggcugugggaagcugugggaagcuguagcuaugugacagaagucagggacccaggaggcauggccaaacaccugcugucccaugcaggugaaagucaccaccaagcaggucaccuaauuuccagaucuuugcucaacuaggguccaggcagucugugcacagccuacugccccacaccagacacuuugcugaaguuguuuaucggcuuuaggaguucucugguggaauuuugggggucacuuaaguauauggucauaucaucugcaaauagugauauuuuuacuucucccuuuccaauuuguaucccuuuaaccuccuuuuuuugucuaauugcucuagcuagaacuucaagaacuguagugaauagauagggagagaaugggcagccuugucuagucccugauuuuagugggauugcuucaaguuucucuccauucagucugauguugacuacugguuugcuguauauugcuuuuacuguguuuagggccuugaauuccugaucuuuccaagacuuuuaacaugaagggaugcugaauuuugucaaaugcuuuucagcaucuaaugacaugaucaugugguuuuuuucuuugaauuuguuuauguagugaauuacauugauggauuuccauauauugaacaaucccugcaucccugggaugaagcauacuugauuguggugaaugaucauuuugauguguucuuguauuugguuggcaagaauuuuauugaguauuuuugcaucaguauucauaaggaagauuggucucaaguucucuuucuuuguugggucuuugugugguuuagguguaaguguaauugugacuucauaaaaugaauuggguaaaauaccuucuguuucuauuuuguagaauauuuugaaggguauuggcauuaggucuucuuuagaggucugauagaauucuccaauaaaccaucugguccuggguguuugguuuuauuuuguuuguuuguuuguuugguugguugguuuguugguuuguugguuguuuuuggggggauuuuuuuugguugggagucuauuaaugacugcuucuauuucuuuagggguuaugggacuguuuagaugguuuauccgauccuguuuuaacuuggcauccuuguauaugucuagaaaauuguccauuucauccagauuuuccaauuuucuugaauauaagcuuuuguaggaucugauggcuuuuugaauuuucacgguuuccuuuguuaugucucccuuuucauuucugacuucauuaauuuggguacuaucucugugcccuuugguuaaucuggcuaaggguuuauguuaucuuguugauuuuuucaaagaaccagcuucugguuuuguugauucuuuguauaguucucuuuguuucuauucaguugauuucagcccugaguuugauuguuuccugcugucuacuucucuuggguguauuugcuucuuuuucuucuagagcuuucacguguacugucaagcuacuaguguaagcucucucuaguuucuuuuuggaggcacuuagagcuaugaguuuuccuccuaaccacugcuuuuacugugcuuuuauuguguccauagguauuguguuuugguaugaugugucuucauuuucauuaaauuuuaaaaagucuuuaauuucuuucuuuuuuucuugaccaaguuaucauugaguagaguguuguucaguguccuuguguauguguguuuuccguuguuuuuguuggaauuuaagacaagccuuaguccauggugaucugacagggugaauaggauuauuucaaucuucuuguauguguugaggccuguuuugugaccaauuacauggucaguuuuggacaagggaccaugaggugcugagaagaagguauauucuuuugcuuuuagaugaaauguucuauaaauguguuagauccguuugguucauucuguuaguuucacugugucuguguuuaguuucugucuccauaauuuguccauugccgagaaugggguauugaagugucucccacuauuauugugugggaugugauaugugguuugagccuuaguaaaguuucguuuaugaaugugggugcccuugcauuuggagcauagauguucagaauugagaguucaucuugguagauuuuuuccuuugaccaguaucaaguguccuuccuuaacuuuuuugauaacuuuugguugaaaguagauuuuauuugauauuagaauggcuaauccagcuuguuucuugggaccauuugcuuggaaaauuauuuuccaaccuuuuauucugagguagugucugucuuugucacugaggugugcuuccuguaugcagcaaaauucuggguccuguuuauguauccauucuguuaaucuaugucuuuuuggggaauugaguccauugauguugagauauuaaggaaaaaugacaauaucacccagaucagguugggcucuguccauuugguuucuguuaaggauaagccacauguaaaacagugcagcuguuagucuguauuuguggguuccgcaauccugagcuaagauagcaacagaucaaaaauauuuuuuaaaaugaauaaauaaagauaauugcaaaauaaaauuuuuuaaaauugcuucuguacugaacauguacauacuuuuuuuuguuacccccaaacaacaugcuguaauaacuuuaccucguguuuaugaucauacuagggauuuuaaguaaucuagacauucagacuaugcuagaaacuauguguugguuguauacgaguacuaaaccauuuuaguuuuuuccaugaccuaauuaucucuuuuaaauuuuauuuuuauuuuuuuaauuuagucuaaauucugguacuaacacauuuuaaauaagagacuugcacauacuaaaauuuggccauacuccauacaacuauacuugauuuucuuuucuucucuucucuuccuuuucucuuaguuauguuaauauauaaagcccuggaucugguccugagagauaucugagcugcucauuuccacauggucauguucucaugcccucagggacagcucaccaggaacccccucaaccagggccagcucuacccuugccaggcaggguguagggcguccucuucacaguguugcaguugguaaggaacauggcccauuuucccacucuccugagcccagggcaagcuguccugccugccauagguggcgaaggaugaggguagaagguaguaggaucucucuuacccuuacccaugcuccuacacagcagacaaguugcaaauccagcuuucucauucccaugcucaaacccgcagggucuucucuuaagugcugcaccuagugaggggcagggacagcucuccuguucgugugaccauggggcuagguguccugccugcugcagguggugaggggcaagcguggagaaagguaucucucccuuccccacaccauuguauaggagacaagugguaggggcaacuuucucaugcucauaucuucagagcuggcucaccagcaacucccacaagguguggugccuguucucccaagaauuucagcugggcuaggggcagggucagcccuccugcucucaagcucccagggccagaucucccguggugccuaagugagggggugggacaaguucuacauuaacauguccccaggcucaggcuauaguccaguccagggacuuacaacuggccuuuggugguaacagacuccugcuauuacagggcuacggacccucaaugggagcacagaccagggccccacugugguuccaggugucaucauggauccuggcauucacaucaagcuguuccucacuauccucaagucuccaguucugccucucuucauugugcucccauccuucuguuucucuuucucuuccauuucucccccacuuacuuguuccucuuaguggugucuggggucucugagugucuggaagcaugucagaaguagucucugagugcuaugugucacuugcgcguuaugccacugaggcagguuucccccacaucaguauacaauugccuugagucacuuuguuuuuccucuaccauuuuauuaggcugcuucccucaaggauaagugggguuuagguuacaaaccaaguuacagccgaucgaagagcauuucagcuucuggaagaccaccucuuaagagaauggaaagagcaagguaauacauauuuuaaccaaucaaccaagauucaauacuuuuuuugauaauauagaaaucacccuuauuaguaaaauagaaaucgcuaguuacuuucuguaaacaucauugguuuaauaaaagcucaaaccuucauuccucaguguaguaagaauauuuuaguaaggcaauuuuauuuagguaugcuuuauguauaaccuuacagacuauaugaaaaaaugaaaauuugaauacuguuguuuuuuucuagguaauuaaauaggaaagaugaugguacacauuaaauuuuuaauauuugaauauuaagucagcacuauaaaaauaacauguaugaauuccugagguggguucuagagugguugguagaguguuuuugccuggcauguaugaagcccuggcuuuaauuccuccuaccacacaaauuggguggugcauaccuguaaugcuagcuagcucuuaggauagauaaggggaucagaacucaagagcauucucugucucagcuacauaguggauucaaggauggccugggauacaugagaaaccuaucuccccaaaaaugaaaaagcauaacucuuuuuuauagguuuaauuuuagaaaauuggaaguuaauugagacaagacuuuucuacagauguugaagguuaauacauggaaugccaaaauuucaguuauuugauaagguuaauaguuagaaauagaauguuaaugucauuaauaagacauauaaagccaagauuuuuuuauagugaccauauugggguuuuguacuuuauuuuuguugcauauuuaugcuuauaucauaacugcuuuauuuuacuuauaguucucgaauaggagaaacugaugagcucccagaaauccguguggaugcagcaucuccuggacccagaguaaccuucaacauccaggauacaguaagaaagacagcacuuguuagaaauuuguguugcuaagugcuaaguauuuuuuaaaaauuacagacuugcaauauuauaauuuuaaagguagaucaccugcaaugacagguugcaacagcugaaguaucugcacuuccagcaagcaggugcagcccauaagagcuccauugcaugcacauggccaaguauaugcacagugacgaucccauaccugcaugcucuuagacgggauuggguuugguuuuuuguuagacaguuuuuguuaguaaggacccauguuaaacuguccucuaagcaguuguuacugugaaauaaauauuuguuuauguguuagugugcaugggauauaaauaguagaaggcauaaggaaggucagcuucagagcugcacaauacagcauguuaaaauuuauguuaaaauguuuauuuguggauuguucgcauugucuuuauuuuucacauuuuauuuucuuuucuuauuauuuuaauuaaguugaaaaacacaguguggggaaguucaccacaguccagaucuccaggggaaggguacuuucagguacuuaugaaaacaacacaaaauuugucuuuaaaacuaauaaacugcccugaaauuuugcuuuaaaaaugucuucuuuucaagcuaaacugagaccucagaaauacuuuauauaaauauuuaaguuuauuggaauuauauuuuaauguguauuuuauaauaccccauuuggguuuuauauuuacauguagcuuaauuuuacuuugaccuucaaaugugaggaauuuuaaucagcuuauaaaaucaacuaagccaaauuuaaacucuaaaacugcaguuuacuaaaucauuuacuauugauuuguugauccuaaaaucaaucucuuuuugauccugaaaucaaucucuuucccuuacauuuaacuauggaguaaaccauuuuaaaaucaacaucuuuguuaauugcuuuaaauacaagucaaaucuaacuccaaacaacaaacugauugauaauugacuacuaauucuuuuaagucacuguaguacauuaguguucauuacauauuacauucagaacugaaucugauggcauaugccuguaauuccagcuacuugacagacgaggcaaaaagaagugugaacccaaccuuuuauuuucaguuuuuuccaggcauguuuucauguggccuaggcuggcuuuaaacccacugugucgcugaagagugccuuaauuccugauccuccugccucugccucccaaggcugagauuauagucacgugccacuaagcucauucucaaccugaaaaacuuaucucuaaaucaaagcaguacuaaggauauugcuaucaugcauaaaacccuaauuuugaucucuagcaccaaaaaauaaaacuaaaaagauccauuuaaaaauuguuauguucugaacaguaugaaaaugugcugcauaauacuuauuaguacaauuaacauuuuaagcuagauuuuacccugaauguauuauuaaacuaaacauauaaacuauuaauauagguauguguauauguauauauucuacacauagcaccagacaucuaaucuugccuagaaauuuucuuuugcauuauaguuaaaaaacaaaaaaggaaaaggaaaagaaaacuggcaaucauuccaaauauguuucauugucuuuauucuuucagacuuaagucucauuauacaucccacaguugcacuguguuuacucaaacuguauuugaucucaaagcaauuagaauguaauacagggccuggagacauggcucagcaguuaagagcgcuugcugcucuuggggaaggccugagucuucccagcacccacauggugccucauuaccauauauaacuccacuuccagagaaucugcuaucuucuucuaaccucuguaggcuccugcacacauguguuacgcguaauauguaugcucaggcacauacacauaaaaauuuuuaaaaaaaaaugagugauauacuaaguuugacaaagauuuaccauuuuucaaaaaaaaaaaaccuugaaaauaaaucauguauaugaauuuuaaauggauuuaaaauuuaaauggauuuucuaguuaaaugacuuuuuggguuuggguuuuuuggguuuuuuuugugguacugaggauugaauccaaggccucgcacauaccaaacaaguguucuaccaguacuuuacaucuguaguuauaaucagagcauucuuacugguaccaauuuuuggugagccagagagauauuucaguaagggugcuugcuaccaagcuugucaacuuauuuuaauccuuaggauccacauaggagaaaaccagcuagcucaaacuguuuucugaccuccacaaguacauuuugguacauguaugcacucugccccuccacacauacauacauacauacauaauuaauuaauuaauuaauuaacuaauuaauuaauuaaaaguaugcauauuugaaaauaauucuaguccuauuuuuaaaucauaguauauuccuuuuuauuuaaaaacacuuaaguuagauaacaugagguuagauauuaaacuuggcaguuggaaaauagauuauggauauaugauuucauauaaaauaaauaucaagcaaagagauuacuuuuacaaaaauuuaccaacuuuaaaauuugaaagauguucugaaaaaaaucuauucauuugcucauuuaucauuuuaagggaaaaaaauaccugauuucuauaaauguuuguuuuaccaugaaucucacaguaacaucuacuacuuauuaguaauagauuaaauuaucuugccaacugcauucuaucagggcuacucauuuucagaugacacuggagcaucacuguuuaucugggaaacugagaucaguucauagcaaguuuugcacacuucaaaacuggcuuguccaucagugguggcacacaccuuuaaucccaacacuuaggaggcagaagcaagaagauuugcuugaguuugaggccaauaggaucuacagaguuaguuccuggacagccaggacuacucaaggaaacccugucuugaaaaacuaaaaaaagaaaaggaaggaaggaaaaggaacugcagcccccaguuauuuacuuaaaauacagcaugguuaaguuugaauaauagauacauguuuuauuacucaacuguucacaugucuuuugucaguccaugaaaguucaguuuuaaagauuuguccacaaaacuuccucuaaaaaauaucuuuacuaacagucacuguauucaucaugaauuguucuuccauucugauuuauauuuguuucuuuacacguaaucugcuuccgcuuuguguguacuaauaaaauaugaugcuuuauguuccuauaaaguaaaauuucacugugauuuuuuuuucgcgugucagugguaccuuacugugguuugaccguuuccuuccuugguaugccauuucauauguucaagagucugaccuuccuuucaguucacagugaggaaaucaacucagagcuucuaaaauguuuagauguacaucuuucauauuuuuaguuuuucucuuuuuaauugagagagaacuugaaaaacaaccugauuuauauauauauuuuuuuuguaaucaguuuccagaggagacagaacuggaucuuuugucaguaacaauugaagguccaucgcauuauucaucaaauagugaaggaucguguucaguguucagcucucccaaaaccacaggcggcuuuucaccaaguguuccuuuccagucagaagauggccgaagggacgacagucugucuucuaccagugaagacucugagaaggaugaaaaggaugaagaccgugagagggaaagauucuauauuuacaggaaacccucgugaguagccauuuacuguaagaucuuuaggugguaagucagaaucuagaagugagucuaagguauauuauccagccucauauuuaacaagcuaagcaugacgucccauuccuaucaccccagcaguucagagauggaggcaggaggauuaggaguuuaagguucuccugaacuacauggcaggcucuacuccagccugggcaacauguggcgcuguuuuaaauauaaaaucauaauaauaacaauaauaaauuagcagaaaaaguguuaaucuguaaguaauacuauaccuagccauaauuucuaaugugauuuaacuuuauauggugcuguuuucuucuaaauauaaauagguuuauuuauauugcucuaauuauuucuccaugauaauacuugucaauaaaacaaaaauagagauaugguuauaggcuaugauauaggaaagaacaauauuccuccugggcuuaauaaaaauaauaggagacacugaaagauaucauacaguugaggaaauaggaauaguagagggaaguguguaucagugaauggggauuuuaagucguucuuggaagaaaugagaauagaguguuaaugaaauaaaaggcagauggauagauagguagcucuaucuaucuacauauacaugaagucuuacugagaaaugugcccucgugaggagcuagaaggaccuuucaaauuuaccugcuucuaaagccugauccauugcaacuguggcaguaagauugagaguuuccacuguugccaucucaggcucuuacugugcucagaggguuccugcacccuuucugcagaguacaacaaauugcuuuggaaccuuucauauuagcauauuuggccuauuccuuuacuuacuggaauauagcuucagauaacuuucaaagaaaaauuaaaauucaaaucuuaaagguuucaaaauauggaguaacuuuuaugugcucauuuaauuauagcauugaguauagaauucucaaaauguuugucuuccagcaccaguguuuagcauuuauuguuuguaaucuucucaauucugucagcguaaauuacccuuccuuuucuaagugucugagugugugugcacuucugcagggucuagaaguugguguggaucucuggaacuagaauuucuuaugguugugagcugucauguagguucugggaauugaaccuagguccucuggaaaaguaaucagugcuuuuaacugcugagccauuucuccagcaaguguauucuuuuuuaacaguagcccucagagucaaacaauugcuuccacuggacagaaugucggaaucugugaucuuuuccaaguguccagcuuggucauuuuuauguuuucuuuugugaagaacauugagcaugagaugugcccuuccugggcugucugaauggguagugcagcaccauccucuguggccaggguggcacaacagguuuucuagagccuguccugaguaaaugagacuuaaugguguuuguuggcaguuccuuacaguaccuacaccauuccuuucuuugcuucugugauuuuugacuuucaaagaggaaagcuguuugaguauuuucuaugagcuuauaaauuaagaaaauuucuuuaaagacuuauucauauaacacugggaaauaguucacuaagcagacuucaauuuacuauaaugaguaauuccuuguuuucugcagacauaccucucggaagaaagcaacaggcuuugcugcuguucaucagcuacuuacugaacgcuggccuacaaccccagucaaucgaagucuuaguggcacagcuacugagagaaauauugacuuugagcuugauauacgaguugaaauugacaguggaaaauguguccuucaccccacuacccuucugcaggagcaugaugacauaaguuuaagaagguaagagacagcuggaaaaguuauaugggguucauuaguuagaaacacuguccauauaucaugauuuaucacaaauguuccccauccaacaccgcaaaauuuaaaaguaacuaguugaaguuacaguauucauuugcauaacacaguuuguuaaaauaaauauaucuuuuauggcaauuagaagcagauagcugauuuagaaucugguaaaauuguuaauuaaaauagaucuauagaccagguauuuuagcucauugguagauuguguauauauuguauaagcacaggauuuaauccccaguaguaguauguacguacacacacacaugcaugcacgcaugcacgggcaugcagacacaaagauauaagaauccuuuggaauucuuugaacaaacccaaauuucuuucuuuguauugauugaaaagauucuguuuugaggauaaugcaggacucuugauuaggaauuuugauauguuuacaaagaaagacuggaagcaguuaugcaaauagggucuaccuagauugaacacaaauaagaccugccuaaauugaacacaaauagggccuagcuaaauggaaauugugaugacauaaacagauuuaacauuagauuuugcuuauuugagggguguggguaugugucauguguaugcucuaguguaaaugcaugugugugcuuuuguguauggagaucagaaucaaccuggguuauugacucucagaugauguccacuguguuuucugcaucuuagagcucaccuccuaggcaagguggcugaccagagagcaugaagugucuuccuauuuagacccacccaguacuaggauuacgagugugugucaccaugauuuauuuuccaaggcuguguaucucaaacucagguucucaugguugcuauuggaaaugcaguccugccugagccauuuccucagcucuuucuuugaauauuucuucuccuuuuuuccuucuuuucuggucaaaaaaauugcuuaugaaaguaaaugacaguuccuagugagugaaaggauagaaauguagauaagaauagcagaauguaacaacuguugaaacagauauugaagauuuccuaucucauucccuuuauuuuuauaugucuaaaaugaaguauuuuaaugaucaguaaaugaaauuuuuauaaaaugagagaauaaaaaauacuuuagacaaguauaguaucuuauaagaguaauaauggugccuaaagaauggcugguagacuguuuuaauugaaugauaacagacugcuauguuugccuguacuugguucauccuauuauguuuaagugaugcagguaugaacuuaggaaggaguaaagcaacugugcauggcacacuuguacuuccagcauucagaaggcagaggcaggggaaggaaggaaggaaggaaggaaggaaggaaggaaggaaggaaggaaggaaggaaggaaggaaggaaggaaggaaggaaggaaaauucacaccaauaaauagagauagcuaguuuuaaggcauauaacauuauuaucauuccuuucagacauuaaccagucuaacuagaaguucuguccuuuucuuaaaugauuucuuuuuaaaauauuuugaauuugauuuuuaaauucaccccccccuuuuuuuuccuauaggaguuaugauagaaguucuaggaguuuagaucaagauucuccuucaaaaaagaaaaaauuucaaacgaauuaugcuucaacuacccauuuaaugacuggcaagaaagugccauccucucuacagacaaagcccagugacuuagaaacaacaguauuuuacauuccaggaguugaugucaagguaaaaacugaauuguauagaauaagagacuaaaauauuaacaguuuauuuucuacuagauaauuuucuuuugcuuacuuuguaaaagauaaaauuuucugacuuaaucuaauauagucauagucugaauauaagaauaucuaaauugugccucaccguuuauucacaguaggcuugcuaaaccuuuccaucuauaauuucaauaagcaauaauguauuuuuuaauuucuaaaauuauugaauuuuagaccauuacgcuuaaaauacuuuaaagacaauuuggauuaagcucuuuaauuuuaagaaugaagaaguuaaguacuucucagccccucacagcugacuuacaagcagaagcugagucuuccuucaggcuuccaagccaguaguccucccagccacaucuucuguuucaugguauuuccucaucugcaaaauuuuuauuuugauuuuucuuuaauacagcugcauuacaauucuaagacacuaaagacugaaucaccuaacgccuccagaggaucguccuugccuagaacccucuccaaagaguccaagcuguaugguaugaaagauagcgcagcaucuccuucuccuucuccuuuaccuugcacugugcagagcaagacuaacaccuuacuuccuccccaacccccaccuauuccuucagguauuuaagaggcuacacuguauuucugucauguuuuuuuaauuuucuuauuuugcuuucucuguugagauucuuuaauuucucuguuuaagaaagcauugucaauaaugacuauauaaaauccauaugugaacguauaggacuacuuuagauucuuucuuauauuuuuauuauguuagcauguucuuaauaaauaaaccacauuuuuagaacaauguauauuugccagaggguaguucaugugguuuaaguuugggagcuaugaucagcuagggaucaaauuuacacauauaugagcacacugguauuaucugcaguuauuauuuguugugaccuaaacuauuauccaaaacuuacagccuuaaucacauugccuauugaaaaaugaacaaacaaauguuaaacaaaaacaccaagaagaguuucuagauuaaagcuaagaugcuggcuaggucacuugaauacuugacuguacuagaaagaucuuccaucauguucuagucaugugaauggcuuacuggugcccuaauuccaccccauguggauaucaccacugaguugggaauauuuuuaugacaugacaguuaacauccuuuggguggaaugaugaaaagaaaagcaaaaccugcaaagcuuaauaccuuagcuuuaaaagucacagauuacuacauuuagaguuucuuacugauuauacaggccauugaaagccagcaaggguucuuggaaagcaucugggaaaugcauaucucagcacaugcaugauacgcuacacacacgcacacacacacacacacgcacacacacgcacacacacaugcacacacacgcacacgcgcacacacgcgcgucuaacauagggauuguaagaacuaagcaagaauuauugaagauguuuuguuuagaaauuucccaugcuauauaagccuuuuaaaguagucaguaaagaauuaugacaagaaugccuagcuagugcuuaccgcuuuucaauugacauaguauagguagauccauuaagaaugaggcacauacuaguauuccauuguauaaauggagaaaguuagggaguauagauuuggggcacuuuccuauauuuauacaacuaauuuucaaauuggagauugaaaacaaaguuagcaaugacuuuguuggguacuuuaaugcauuuuaugaagcauaaguacuugacuaggaagaaugaaugagucauggucuccuauguaaagcacuauuguaugaacauauuaaacauaagaaauccaaaagcugugauaccuucccuucacuuuccacuaauucauauuaguugagaguuucuaucuuuuuaagugaacaaauggacuaguaccagccaaacaaguguaaaguugauaauuuggaacauagugugugaccaagcacaaguaagaauaagcauaguauuacaaacauuaauaauauuuagucuaacauuuauguaucauuucuauccuauuuuuacucuuuucucuuguagucuuagauaaaguacuucacuuaauuaaguugucauacaauucuaacuucucauuaacuggucauauuuuguugggacauuuuauuguguuccauucaguacaucacauuuaucaauauucuagcuaaaggaaaaggaaguggaggaguaaaaacugccaagcucuaugccuggguagcacugcagucauuaccagaagaaaugguuauuaguccuugucuauuggacuuucuugaaaaggcucuggaaacuaucccaauuacaccaaucgaaaggaauuauacaggucaguacucuccacauaugcauucugacuuuagaucuuauuucauagaguuucucagugcuauuacacguuguuauauauucuaugaaacccccaacgcacauacagcacaggacuuccaggucuguguucauucagagaugaugaaccuaacccucaaaagacuggaggccccagggaguuuagaggucaggugggguggggggugggugcauccacguggagacugggugcgguaaaaaagagguguaggauguggaguaguuggaagguggaugggaggggcgaggaguagaauauggaauguaaaaaaaaaauuaaaaauaaaauaaaauuuaaaaaaacaaaacaaaacuggagaagaaccagggaggucauuucagucuuacucggagguagagaauccaagcugugguaaagccauauuacuuuucaagguuacagcuugauagugacagcacuagugauuguauguccuauauuaauguguuucuugugcuggacucuguuugugggcauggcauaagugcuguuuucuguguauagugugugcuguggugggaagauugaauuuggggaaaugaacaugagauuugaguagguaaggauauguagccugacagacuugaaagcaaguuucuguuauugaugcaucguauaucaauacuaguuaggaauaaggauuuucccgugauuugcccuugauauaaaacuugaaacuaaauauuuuaacagcagucagcucacaagaugaagauaugggacauuuugacaucccagauccuauggaagaaucaacaacaucccuagugucaucuucaacaucugcauacucuuccuucccuguagacguugugguuuaugugcgaguucaggugaggaguguuguuacuucauaaaggaaauauuuuauuuuaaauuuuagcauuauuuccuuucagauucuucugaaucauaaucucaugaauguuugauaucucuacaauggcuuagaaguuugcuaaguccugagaaguauauguaaaaauuugaaugaauuuacuauucugaucaguuuccauuuuggguuucuaaucuuuuaugaaacaaaauuaaaauauuuaaguuuaaaccuuuugaaagcauuuuaucuuuuuauuaguaugguaccauuuacucucaccauuacacuuucuggauggauuuaccauauaauuaagauacaauaguaucuuuuaaggaguuuguguaaaaguuguauaauuuuaaaauauuuuguuauuuaauucaaucuuaucaaugcacuuuuaggaauauauauuguccuuugacuuaauccauuuguuaaagaggauuagaaagaugacuguauccaaaauuuaaguucagauuaccagucagauaaaauguuuaaaucagucuguaaaaauaagaaaagugcugguaucauuuagugcagcaauuuucuacaguaacaguuuguccagaagaucauuagucugagacgcuggaguuuuguacuagcuuauguuaaaagucugaugaaaauauacuaaguacuuaagaguuuauaaaaacuuuuguuacuaacacagcaguacuuaguguuuuaacaugugaguaccuccuuuaaaagaucugacccuuaacgaaaaauaguauggacauaaauauguuuaagguucugaauuauccaaaugucaguggauguucaaauacuuuguuguagacaauaucucacacucuguagcccaggguggcauauacccuaaguuggccuugaacuugcaauaauguuccuccccuaccaccccuuacagcaagugagcccuauacuauaauauuuagcuucauaaagauuguuccuuccuguucauacacuuugguucuaugucauccuucucuuuuuaugaguuguggcauuaaauauaauuucuuuuaagugucagaugauuaaacauauuuaguuguguauguuaaaaaauuacauauuucuuuuaacuauuaaguucuuaaaaucuuuuucccccuccuuucuacacuuuagcccucacagaucaaauuuagcuguuugccaguaucaagaguagaaugcaugcugaagcuaccaucucuggacuugguauuuucuucaaaccgaggagaacuggaaacuuuggggacuacauacccugcagagaccguguccccuggcaguaaugcuccucagacuggagcaaagaccucugcuagcaaagcuggaaugccagguauagagauguuaagccaccuggugcaaggccaaguacuguucuuaaugguuauucaucuauauuuuaaauaguuuuagaaaagcaggauauuaaaaaucgugacauuuguaagaaaaaaaucuauagcagaccaaaguuguaaguauauuucauguuaguagaauaugaguccucuuuaauuuauauguuuaccucagcaguaauuagauagcauuacagcuucagcuugcaugccacuagaagcacuauaauaacuaauaguucaugcauccauguacuuuugaauguuugugucacauuggauuauacauuuuaggaacaaagaguuuugcaacuggaaauaaaagauaugcuuuuaugaagaucuguccuuaucaaauuuugccaaguagcacuuguauuuuuaaaugguaaauuuugcugucuaccuccuuuguuucguuaaagguuugauuauaaaguacaguugaggauuucuugauuucuagcacuucuuccucacugaaagcucugugcuacaaaucauauagaaauacaaauuuaagugagagcgcaguguuggcuaguuugaguggggagugacaguagacuuguguaaacagcaguucuuagcaagggcagcagaugccuuucaguauuggauuucacaacugagaaucucuaacuggaagauaguggggaaagcaggagcaguaugcagauaucuggccaaucugaagacccuucuuucuagaaagaauaauuugauuuaaaauguuagaauggccaaguggaacacauuaaagcaaaauaugugaaugaacuccgaaacaccaguuccagagaagcaugaaaacuguuaaugggaaaucauccuucagauuuggaaggugucacucaggcuuagguccugauuuuuuguacaguuaacuugaauucaaaauuuuaccaaauagccuuauguuuggcuuuugagagagagcauguuuguccuuggagacuucucuguggcugaugaugcuggaaugucucauuuacaggcucuucaggauuaggcagcccacuuggccgaagucgacacagcagcagccagucggaucugacuggguccagcagcagcucaucgggccugagcuucacugcaugcaugucugacuucucccuguauguguuucaccccuacggugcugggaagcagaaauccacuguuucuggucucacaucuggaucaggaggacuagguauauuugcucguaggcaucuuuguuaauuuuuuaagcuuucuuuucuuagaccacaugacuguggcuauaagccaacaugagaaacuuguauuuuucccuuuugauaauaccuaucuuaccccuguuuuauaaguaaaacuaugaaacaaauucggauaaacugaugauacaagaauuuaaaauugaagaaugcuuauuaaaugauauguauaguauaauauagaagaguuuucuuaaauuauuaaaucaaauucauuaaaauauuaucaaaucauguauaaaauuauaguccauaaaaaguaaaauuuuuaaaguauguagguuaugcuuaguaauuuuaaaugagaucauuaaacuguuauuuaguaaaacuaaaucugcauuucaaaguucaggucucauuagugaauauuucuuacagucauauaaguaaauacuaccuuuuguuauuggaaugagcuugucauguauaugggcuucaaccugucuaaacucugugagaaaugcaaaugcuucuuagauuauucugucuaaauuuucacuaauuuaacuccuguuaauugguggcauguuacaguauauuggauaaucuucuuuaaccaguugugugcauaugcauacaucuguauguacaugugcauacauaugggcauuuuucuuguuuuguuuuucucagggaauguggaugaagaacccacuucagucacuggucgaaaagacucacuaaguauaaaccucgaguuuguaaaagugagcuugucucggauaaggcgcucaggaggcgccucauuuuuugaaagucaaucuguaagcaagucuacaagcaaaauggacacuacauuaaucaauauaucugguauucucuuuuauaguuuuuaauuaaaauaucauuuuaaacaaugaacucuauuuuuaauagugcuuaaauauuaaguauacauaaacauuaagcuuagugauaaagguaagaaguucagccuagccuacaaagacucucaacucaggcuguuaguguuagaaugcuuucuagguagacauauccaaggguaaaaaauaccaaauuaaagaacaaaaaauucuuauuuuuuuauuuuccuucuucuugguuaugaguuccuaaaauuuaugacuuuuuauguguaucagcuuguagauguuuacaucacuaaaaaugggaugaguagcuuuaauaauaaguccuacuuuguacuaguaggucuuugcauuguaacuugaguacuuaaaauuaagugaauauaaccaucuugggaauuuaggguacuaagugaaaauguuuacaacaauaaucucacuaauacaguauuuucccuuaaggugauaaccauuuagcaaacacuuuuagucuauauuuuaucguaaacuuuugccagauacuaugcuagguuacuagugugaacagauguaaugcaggucuuacaugugaacaaaaauaauaacacauauugaugucaggaaaauacccuugaaaguagcaacaugauauuucgaaucagcgguauugaaaagggauaucuuuggagcaucuuuggcuacuauggcugaaucaugagguuuaaucaaacaguuguacagaguagauggggcaagagggagaaguccuggcuaaagguaaaggugaugaaauuuaccaguagcugacuguggagucagauugcacugagggaucagauauuuauucuuuagguggugagaagccauuaaaggauuggcuaaaggacugggaugaugcuucagauuggugcuuuagagagagucaguaguaccgcaagccaugggaggaaaagaugcuugaggaugcuguuuaaucagcagaagugagugaaaaucugaugcaacaguaaaaagagaaaggggggaacagcuucaaacugagagaagaaaguccugaaguugcacaaggagcaguagaggacaaaggguggcugugaacuuaaaugaccuggaggggaaugguugaaaccauuaacuuacauaacuauaaaacaaucuaaaagugcuuauagaucuaucaguggaucagcuggucaccaggccugucuguaugugcucagagucucuagcaugaagaagcugcgggagaggaacagaagagaaagggggcagaaaggaaaaggugccaaagcugagccccugaggagaaccauaagggugcuuuucuugugaaaaugucugcccuggacaaaaagggaacuaagugcuccuuugcacacagcuguuugguuugcaguucccuuugugcaaguucauauuccagcucauaaucuuaaccuauuccccauauucgaugagcccuauguuauacuaaaagcuugcuuuauagcuaaucucuagcaccuuucuguggcagaacaauaauagagcccuaacuugccaucucccgaagaaaggacacagagcuaaugauuucgcaaugcacucuuuuucuuuugaagaaagauaaaaugcaauguauccugguauuuuaucugguguuaaaaguuuuagaagucuguucuaagcucuaacaaacuauuucugcaucagcuguuugugauauagggucugcuucauuuaaguacgauaugcgccgacucagugaaauccuugcauuuccaagagccugguauaggagaaguauugcaaggcgccuguuccuuggagaccaaacuguaaacuugccaaguaaguguguuauguaaccauaauuagauuucuuuucauuuggguuaaagaaaacaagauccaugauuaguaacacaauuuuuguuaaucuauaccaugugauucauucauuuguucaaaagaaugucuguugagucccucuaauggcaagcacucagcauaccaaacagacaaauaccuuacccucuugaagauuaccuacuaacauuuuauucuauaauaauuuacucgauaacccuuguaaauauggaggugcaaguaucuaugguuaauuaauaguuaauuaaagcauggaaaaaugaaaauacugaagacaucguacuguuuuugccuccaucucuugaucuuagauacuguuaugacaagcugaagagguuguggauaggaauaguacaguugauacaguggaaaauguaaaaaaucuugaguggguuuguucucucuccaguaauguacuuucugccaggauuaaauaagaugcuggauuguucuuugcaaauacugccauuugugaaaggaauagacaauguaguuagaaauagugucugggugaaagaacuuuuaucacuuaauguucuuaucugugacuuuuacuuugucuucuacuguuguacuagcaucugguccagggacuccugauuccauugaaggagugagccagcaccuuucucccgaaucaucaaggaaagcauacugcaggaccugggaucagccaagccagucagccuccuucacccauaugccgcagucacccaauguguucaaugagcacaugaccaacaauaccaugucaccagggacagcagcacagagccucaaguccccagcuuccauaagaucaaggaguguuucagacucuucagucccucgaagagguaacuuuuguuggccaguaugccuccaguguuccuaagauaaaaaucuuacucagguuucuccccaauuacuagagauggauucuugaggaaaagaaaccaguaaguaccaaacacuuccagguacuaccuacagaagagcucuguggcugucuaguaacuucacaaaggguaggaagugaagaguugccauauugucaauguacucuguaagaauagcugcuuuuagaaacauucuaacaauguugugaauguaccaaaagaugguucaguauugaagaaacaaagucuuuauauugauucaauuguuuguuuauuuagucuuuuuuuuccaccucuugcaugcuaguguuguccuugugcuaaugccuggauauaucaaaaugaaugauauaguucuuggcacaaccaagaccaaaguacaaugagcaaggucaguacuuggucugcucagaguccauuagaugaaugccagccacccagccaaugccugcauuucugaaugguuucugucuuugaggcuucuguuugacugaaacauuuuggcuuuuggcuuuuaugaagaaaauccuggagugaugaauuaucugugcaucuguaucucaugugcaccaaagcccccucaucucaccuguuuuagaagcaaugugauuauuaaacauuuggucucauacaacaauaucaugucuaccuuuagauuauagaaacuaguggguuuuacuuuguaauaagcucuguuuuaagugaauaaaugugcauuugguuuuuuuuuucugacuuuagauucaauuucaaaaacaucaacuccuguuaacaaaucaaacaaagcagcaagccagcaagggacuccgugggagacacuuguuguguucgcuaucaaccuuaaacaauuaaacguccaaaugaauaugagcaaugucaugggaaauacaacguaagcuauucagagaaaaauaugucuuaucuaauagcacuuuaaauguuccuugcaguguuguaaagcaguucaaacccuuuuaaaugcaguaauauuuugagacaguuaaauaggugaaaaguuuuaaacuuuuuaaucuaaaaauggauuaauuguuuggacacuauaauacaaacaacaugaaauacauucccaauggagaauuaucagaaaauaggauacuuuucuagcuauaaagcuucauuaguuuuaauauucaaacaucaaccacauaguauuuaguucagcuauguugagcugggugugucgggugcaugccaaucaucccagcacucaaaaagcugagauagggucauuucaguuccauuauucaagaccagcuucaacaacacagugaaaaccugacucaaaaaaaaaaaggaaguauuuaauuauaaaaucagaucugugcauaaucugauuuugccacugguuuuaauucaugauauuaccagccacauaucuaacaaucuuuuccuucuuuuuaguuggacaacuagugguuugaaaagccaaggccggcuuucuguaggaagcaaccgugaucgagagauuagcaugucuguuggucugggaaggucacaguuagauuccaaaggaggaguaguuggugggaccauugaugucaaugcuuuggagauggucgguauguuggaauuuaacaacuacacagcuuauuuucaaacauuauguuugaagaaaagagcuuuagaaaguugaauuugauaaguuuuuccgugaauauuuggaaagugauuauugauuuuauuuuagcucauauuucugaacauccaaaucagcaaccaaaucacaaaauacagauuacuauggguucuacugagucucgaguugauuauaugggcucaagcauccucauggguaucuucaguaaugcugaucuuaagcuucaggaugaauggaaaguaaauuuguauaacgccuuggauucaagcaugacugauaaaagguauguauuagaauguccccuucuaaaaacuuugugugacugcuguuaacauuuuuuuuuaacauucaggggcaggagaauuaguucaguauuuuucuacagacuaauuuuuauauuauacaacuaauacaaaugaaaaaggcugggcaggggaggauaauuacuuuugcuuuauuuauaucaucucugaaauuuauuauauaaauuguauuucaugcuuuagugagauuuuugugcauggagauuugaaaugggauauuuuucaaguaaugauaucaagaucaacuacaccagacuugauaaaaauaggaaugaagcuccaagaguuuuucacacaacaguuugauacuaguaagcgagcucugucaaccuggggaccuguuccuuaucugccgcccaagacaaugaccaacaaccuggaaaagaauucacaagaacaauguaagauuuagagcguugguauauuuuuugucuucccuauauguuauauucuuaaguaacacauuuguaugcuguacuuagaaaguauccugugggcucuccaucccguccacucagcagaaaacugacuguguuccuaguaauggugucagcugcucuuugggaagguauuacuuuuuauccuccaccacagcuuagcugcagcauaucuacuccgugacaaaguuaaaaucugauaugugacaugggccgaggacgcagaauaacugagucugucuguuaaccuaguauuaggcagguuaucaucuuucacuuaguaauuaagaaauuagcguguauuuauugagcaacaacuacaugcuuucauacuucucuaggcacaagaguugcaagauaugccaucacuaacucaugaaccuuacauucaaauaggagauggagacuauaauuaaauauauaaaagucaugguuucagguagauagaagugcuuauguaaaacacaaagcaugggaaggauauagagaagguuaaagugaaaugauggcuauuucagaaaagaugaucaggaaagccuugucugaagugacauuuuaguagaaaugagucauuugaugaaagauaugagacugcauguugggaaaguucugggcaaagggcuguggaggucugaagcuccuguuguuacucauaaaguuggcuuauuugagaaucauuacuggaccugggaucuuaacccuugggaaggugaggcaguagacuacagaucaaguucaaaggcagcuuggauaacuuaggguaagacccugucucagaaugaaauggucacuauagucuggagauacaauucagugguagggcccuugccugacauguucucaauggacguggggauuugaggggaaaugagagucauuaaaauaacugaacagagcagaaugaucaguaagaaaaauauuggacauuaucucagauaaaaggcaaaaauaagguuuuuaauaugaugaguauuguagaguuuuuaagacauuugguaucauuugguuuaccuugguguaaaauacuccuuugcaaauaaucaccauagcuacuguggggagaacagacauguaggccuaauagggauggacacagggaggaugguaccuuuaacuaggaugacagugguaaaugugaucaguaguaagcagaaugaagacaacuugguaacucguaguugauaacucuuuacuugugguuuugggguuuucuagguacaggguuucucuacauagcccaagcuguccuggaacuagcuauauagacuaggcugaccuccuaagugcugggauugaaggugugcaccgcuacaccugagcugucuccuuaauuguguacauugaaagcaagcuagaaaauguaaacaaaagugaagggucauauuccugccucagaaucaucacugugaagcagcuuagagcuuaaacaugaacagauuccuauauauucucuacauauuuguacacuuguuuguuuuacuuugcuuuguuuuuccagucagggauucucuguguagcccuggccuuaaccaaaguaucacuaucccuuuuuuacacucaaacuuucuacuuugccaguuaccugucucugucuuccaggaacaaacuuaaugacugacccacaaguaccaagcaguuuguccugaccaugcucauaguuuaaaccugguuguuaucuaucuguacucuccuuuaguuuggcauaguucuuuuuguaugacuauacuuacuaaacaaacauggccaguugucugcaggacaccauacucucuucagugaccuguuugugguaucauuuucuuauuccuuuaugccuuuauagucuuuauaagcacuguuguuagcaagcauaaguaaauuuuggugcugugcaaaguuuaaaaaguccuugucaagaccaguuaaauacaauguaugauccucgguagcacuaagaaaaaaauggaaaccgucaaaaaaggacauuacuggaauaagugaaaaaaaucuaaaucugaauucugugauugauuagcccuuuucaaacauucaugugcauauauaacaccuggaaaucuauauuuugaaagugcuaagaagugaacucagggccuuccacaugccaagccaaugcucuaucacugagcugugcucagccuaggaaauaaugaguagauuuaagccuggggaauucuaagaagcucuuauuguggugcugauggugcuagucaucugaccuuacuuuaaguagaaagcacaaggaaagaaacauaaaacccuucauucuggguuuuuuuuuuuuuuaaccugugaaaaguugauagacauaacugacaguugcuguauuucuuguuguguagaauuugugugaaagaccauuuaggcucuuuguaagucaaucagcauuauagacaucgaguugugagaguuuugaacacuagagccuucccaagguucauaccuucccaagcucuguccauccuuaugcagcaucuuuuccuacugucuauugaacaguugcuuagcauuccccauuauuuccacucauuaucagaauggaaaccacacaucauacacauggcuauagacccaccucuggauacuugagacaauuuaugacaaauauuucuucauuuucuuguagugcuugaugcugcacaccaucgacauuggccuggcguguugaaggugguaucuggaugccacauauccuuauuucagguuccauuaccagaagaugggaugcaguuuggaggauccaugagcuugcauggaaaucauaugacccuggcuuguuuucaugguccaaauuuccguucaaaauccugggcccuuuuucauuuagaagaaccaaauauugccuuuuggacugaagcucaaaaaaucugggaagaugguaauaugauacauuuccagcuuuuauucuuugugucuucuggcaugaucauaaauaagucauuuuucuuuguuuuguauguugauuuuugaggaaugugugucuauguguauggcauaaguguguuuguguauguuauauguguguuuguguaugcugugugugcaugcauaugucuaugagugaaugcaugugaaugccacagugcaugugaaguuagaggacaaccugggguguaagugcucacccucugccuccuuuaagacuaggcuagcugacucaugugcuuucagggacucuccugggcccaccucacaucucacugucggaguccugggacuagagacacauaacacuguguccagcuuuauauugauucuggaauuggagcaucgggucucauacuugugcagcaaaugcucuacacacuaagccaucucccugaccuccucuuuacuuuuguuuguuugcaguuguuuauuuuggaagggauucauuugugcuauaacaaacauguagaagucagaggacagcuugaggaguugguccucaauuuccaucauguggauuuuagggcuuaaaauucagguugucagguuugguagcaagugccuuuauccccugagucaucucaccaaccccuucugacuuuuuuuauuggagaaauccaucucuguuuguuauccuguaaguaaaagaucggggaguucauuguuagugaaucagcauuuauaaaguauagacuuguuaaagaaacaucuaaauauacuucuaaacuugcccucguacuccauguuacuuaauuuagugcugcugugauggccuuagcauguuaucuagaaauauuccuuauaaaaacaugaagacagugauggugugagaaaauucucugucagacaaacaaaaaaaaaaaaaacauuguguuaugaaacuugagggaaauaauagagcccugggauaccucaggaauauuugggcaacacaaauuggccuugacagguuuuuuaaaaaggacaccaagacauacacagaauucucaaagaacuaauaaaaauguaaaaagagcaguuccuuugagcaguuuccuauucaaauaguguugccuugugcuuugcuuuuuaacagugucuuacucaguugcccagguuguccuguaacucaugaucccccugccucugcuuccugagugguauaacacugacugacccacuccgagguuucuuaacaagaugguugauguucuucauuucacugggauaaaaccagcuaacugugggcuuucucacuuauuuagccuuuccuacucuauauagcuuacucuguuacucuggugucauaguuauuuucuaagccauaaagacaguuuaucacuuuuagaaacauacuuaucuuguguuauaggcucuagugaccacucuacauacauuguucaaacacuggauuuucaucugggucauaauaccaugguuaccaaaccaugcggugcucuggaaagucccauggcaacaauaaccaagauaacaaggcgucgccacgaaaacccaccccauggaguugccaguguaaaagaaugguucaacuaugucacugccacaaggaaugaagguuaaauauuuagccuuuuggggcuuauuuucuuuuuuguuuuauuuugaccucugucagcuguucaaaaaucaaguagagaucaaauguucaugucuugauacaguuuuuauuuuauuucuguugauacacaaagugguuauuuaauacaagaaacaaucaccugguaguacaacauuuuacagguucaaauuauucuagaaauaacugaaaccauccuuuaagaauuaguuuuaaauaaauaaaaauuaaauuuguuaauuuuguaauauuugguaaauauuuuagaauuauuagaaaaauguuuuguaguuauucuaaaaauuagacauuugggaaauguauuauauggccaacuaacaaaaugccaaaaauguaagauucuacuuaccuggaauaaaaucucaguaauauucauuaauucauaauguaaagaaaauacuuuugaugaauuuuucaccuaugagaccacuucucuggucugauaaccaagaugacaaggcauaaccaccaaagcccuccccgugguguagugaguguaaaagaauguucaacuaugucacugccaggucauguuguaaauaacuauaguauuugccggauugcuccuaugugauugcuuucaguuugcauauguaacauugcuuuuaucaaucaucugauauuuggcaaagcugauuagauuaagauauguuacgauuuaacuguuuuacuuaaaaauggccuuucuaaaugaaaaauauugcuuauaccaugugauuuuagauuagcuuucaggaauaggcacacacucuggagggguaaaauuauauuaaaaagaaaaaaaagacuauagccuauuuugacuuuuauacauuuggaaugggguuguuguugagguuuuuuuugucaucuuuuuguuuuuuaagauuuucuuuuaacuaggauguuccaggaagcuguuuauguaugcacagcaauaauccucacagcaguagaguaguuauaauauuccaaaaauaggacuucuacauaauauuuaguguucagucuauauagaccauucgguuuaauaaaauccaacucaguaaaguacacauuucuucuuaagaauaucauuauuuccaacuuguaaagugacuagaauaugauauaguaucuuuaaagccauacuuuguacaauuugguuaaaucuauuacucugaagccucauuuauuugccuaugucuaaauacaguuuaucucuuuuagaggcauacuuuguuugucacuaggcucugccuuccucucuccugcccaaucacugacucuagccuuuuauucagcaauagcuuuaaauugggaaguaagguuuacacgacaaagacugguguaugugauaauucacuugucuagaggcaaccauaucuugggguucagaauauaaaauuuguauacauaccaacagacgaacccccaacaagugaucauucucuauacauuguuuaaaugcaauguggugacagugcccuuugguuuaacauaacccuuucuguuuuuauguauauagagcuaaacuuacuucguaauguugaugccaauaacacggagaacaguacuacuguaaagaauucuaguuuguugaguggguuccggggagguucuagcuacaaccaugaaacagagaccaucuucgcauuaccaaggaugcagcuagaauuuaaaucaauucauguucaagaaccacaggagccuucauuacaagguauguggaaaauauccaauuuaauaaaaccggugauguaagucaaauugauguuuuuaccagauauacauagacugugguaaauuuauuuagcuuauuugugccuuuuuggccaaauauugggaagaauaauuggacuuuauuuauuuuaaggaacaaugauacauucuaggaguguuuuacuacauucucacuagucuguaaaucauaugcacauagcaguugcucauuucccaaaucuucacauuuauauuacaaguguaugcauuuacauggaucuauguaaaucuuuaucgauggaagaggccuuugcuucauggaauuuuuuacuguaacauccuuuaucguuucagaugccagcuugaaacccaagguggagugcaguguggugaccgaguucacugaccacaucugugugacuauggaugccgagcucaucauguuucuccaugaucuggugucagcauaucucaaagaaaaagaaaaggguggguugcaugguuuuucuuucuucuuucaauuacaugaaaggcaagugccaguggauuaacauggagaauguuuuuauggucuggggauaggaugaaugccuuuuuccucuguggacugcaaaugucaugaaguagcacuucuaaaacuacaugacagguuucugaguuucugcuggaugcaucguggugguauugaggcaggcuuuccuuaugaccuugagcucacucugcauuuuaggcaggccuugaacuuuugauccuccugccucaccuucccauauaggucuaggauagcagagcuacuuugccaggcccaacucuacaugugauucucaguaaauauaacuuggaaaaacauaacuuguucaggccauucuuuaguuuuauuuuggguuuuuguuuuguauuuuuuaaugaagaaaaaauguuaaauuuaccuugcagauuccucaaaacaaccauuugggaagaguacaaaguuaacaaguuaacauagauuggacuggucuuccauuaauuacucuucaucagaaauauaccaaaaauuggacaagaguaaaaucuauagugauggugggaaaaguaagaucaagcugccacacaucucacgccuugcccuggacagcacugucugucgagcccaccuuuccuguccuagcacugaagugcagcagucacuaguuaccuugaugcucaugcuguguucaguaucuauacaaaauuauacaaagcaagcuuuguacaaaccaacguuccaagcuucauuuucagucugcccauaugugagagcccauauuuaugucucucaaauauauuaugaaacccuugacauuuugugaaauauugcaaggugugguuggcauaagcuuauaaucucagugauucaagaggauugcaaguucaaggccaacccagccaauuuagugaacuuuuuucuuagggaaaaacuuaaagagauuaggguuauauaucuuaguuaguguacuuguguagcaucugguaggccuagacucaauccccaggaaugcauaaacaguuguaagacauuugaaugagaaaagacaaaauguugucuguaaagauuucauuguaaagauaguauaauagcuacuuaaguauagcucauuauuacaauuuaagccaaaauaaacauaagcaucucugagaaaguuuacaccauuauguaagacuagacggaaaucaacaauuucuagaacauggagauuauuacagcagugaaacuuccaccaauaauagaagccaguaagcagcagaacuuuuaggcaucuauguucuuucuggcugugguacugccuagccuguuaccaaucaaguuacaauaaaaguugcauagcgaacaucauauucaacuguuuuaaguccacuuuguguucugaaguuuguacuuaaagagaaauauuguguuuauucaauuagaucacauaaaagucuaugugugucucagauuugaucauacauguguguguauuuaugauagccaacuuuaaagagacuuuucuuaagcaccauaaggaaaggacuguacccaaaaugcuucuuauugacacuguuuauguaacuauacaacuauuaacauacaaaagcacagauuauacacuuacuugauuugguauagaaguaacaauacaacuaaacuuuuaagucaucaagcuacaacucuuuugcuauguugacguuuagacaagaaaguauuuuaccagggaguuaauaacuccuggcccuccuucaaauuuuuauuuugacacacacucaccaaauuuuaaucuggcuugaaguaggcagucuccucauucuccuucccagcugcgauuacagaugugaccagcauacucaacuauuagucaucguugaggaaauccaccucuguugacuacagugcccuacacuugcuaacacaaaugugaugucuacauucuuuaucacagugacaaccucacuguucacagaaauacuaagaauugauauuucccuuggcuuauuuuaagauaucuuuuaacagguguaauuaaaugaaacuuggcaugguaauagagcuaguggugguucuuaagaucuggcuuuacauauauuuauuauuauuauuauuauagccauuuuuccaccucggauuuuauccacucgaccaggacaaaaauguccacuuauuauacacgaugauaguuccucugacagagacagagaagauagcaucacuuacaccacuguggacuggcgagacuuuaugugcaacacauggcaucuggagccuacucuuagguaagacuuuggugugcacaccucaguauguucaaggguaccaaagugguugcuuuuccaacugaugugaccaaaugcuugacaagaagcugaaggugaaagaguauuguggcucacaguuuaggagcaaauacacuguccaucuuggugucacaauaugaggcagcugcucacaguguauacacaaucagaacaagaaaaugacaggaaguauagccaggcucuaacaccucagaaccugcccccgaccuacacuuggucgaggaaagccucaccuccuaaagauuccacaauccccacacucuucaacacugccgucagcugggaaccaaguguucagcgcagcccaugagagacauaguguauguucaaaccgcaacacccacuucaccccccacaggcuuaaagccaccccauaaugagaaaugcauuuauucacugucaaauguuuucauaguuccagcgcuauuuaaaauuccaaagucucuuuugggacuuaaguccguuucuuaacuguaaacugcuugcuauacaaucaaaggacaaguuaauauuuccaauauacacuggcacagaauaaaccuuccccauuacauauggaggaauggggacauggcaagggaagauugagccaaagcaguacugaaaccaaacagaacugaaaccaaggcuccaaagguguugaguggcuccaguuuuccagcucugccuccugaaauacacacacccucuucuuuugggccaguucuccaugccugcagcuuuucucaggagacaucccacucuccuggcauuccucauucuaggcuuccuucgcuacuuacugcuucacuuucacaguuuuaugcaguaagcucuuggccuuucuuugcagagacuuugagccagcauauuuuucaaaugcagguacaaaugcaguaaaaaucuucuuuauccuucuccccccucucucccucucucccccucucccucucucucucccccucucccucccucuccccccucucucccucucccuuuugcaaccuccccagcccuaccucuauucucucgaguaauuggcuauagccacuuuuauuuaaccaauagcuuuaaauuggugagucagguuuacacaacaaaggccacuguaugugaacacucacucaucugggagcaaccagaucaugggauucagaauuuaacauuugcauacauaacaccagaccagcccccaagacuuaucagcacacauaaauuauuuuuaggaauuauuacaaugaauacaaggcuuucagacucaaguauucaaauauaucugcuaaaguauuuuauccagaguauauuaagggagugcaguaauguucaugaaucauacaccuugauagugacccugauuucuaauuaccauuucagauuaauuucuuggacuggaagaaagauugacccuguagguguugauuauauucuucaaaaauugggcuuucaccaugccaggacuacuauucccaaauggcuucagagaggagugauggacccacuggacaaggugcuguccguucucaucaaaaaacucggaacugcccugcaggaugagaaggagaagaaaggaaaggacaaagaagaacacuagaauagcaauuccaucugugaaacacuugacucuguuaauuucuauuacacugcaauuuuuuucagcaaaauuuaaaugguacuuuaaaauaauucuaaauuuuguggccauuauugaaaguuuguaaguuaaucuguuuauucuagcucuaccauucuguauacaguaaaguauugcaugaaaauguaaauuuuguagaaaacuaaauuaaaagauauacaucugcucauuaaaguuuaugauuguuuuaugugcaauaugguugcugcauuuaaaguauuacagaguaacugugaauuuuuuuucuucuuggccauaacuguuagaaaaauaucuuguugauaaugucauugggggucuuuuuuauguagacuuguauaaagaucuauuuguauauaauuugaguaauugugaugauuguauaccacaaaaagauuguuuguaacuauuguaauaaagucacaauaacggcuucaguccauaguuguuucaua

SEQ ID NO: 1397 - RNA, 5439 nt, Mus musculus
auuuuuuuuuuuuugccuuugccaaaauaagauuuuauuuugaaagacaggaaggacggaagaaguaaaagugugcagguguagauuccaaaccagcaaccaucuuuaucaggugaagaugaauucuucaguaaacucugagcugauguuagcucccuggagaggagaucuuuucccacaagccaucuuuauuuuuuuuuagaggagagcuuuauuucuugaaaacacugauuaacauagaguucacaggaauaacugagaaguuauuuuagcgcuuacuuugugcuguccuaaaaaugacagacaucugagcuuauuuauauuugaaucaucuaaauacuuuuauuaaugagucuaccuacacaugauauuuaacaauucaauauaauaaauaauuucagauaaauaguuuaaaacauuuuugagcccuuggggcuuacaaaaagaaucuuuaaagauccauauuuaucaucugaagacuaguaguuacaaaagauaguaaacaauacauccaaaaauaaauuaaaguuaaauauuuaaauaaauagagagccuuauguguuguaagcaggagguacauaguuauugagggcuuguugagaugaugcuuugacagaaggcuauccaucuccucagaaaguccaccacaguugcugacucaucaucgaauuggcacucaaauguguugucagagcccuaaaaaagaauauaaaauuguaggcuaagguagcuuacuuugcauauaauuauucuucacggaagcuuuuaggcauuuauuuuaacacugguuaaauauauugaacauucacauuucugaaaugaucacaauuauuggguuauguuuuauuaugauaucaaaugguaaagcauaaaaaauaaagcucuccagaguugauuaccaacgagcauuugaugggaacacugaacacuucuguagaauucaguugcuugaccacuuuuucucugguaaguguacacagcuaugcaucaauuuaggcuucaggaauggagaaaugauacuuguuauauguucuuugcuaaaucuuaagagucuauuauucaauucuuucccccccaagucagaaugggaacaacccagaguagguuaggacaagcaucuauugggggaaauuuggagaauuuuguuauagauauaccuacccugauaccaguguagaugaaucacaaaguuuguacauguauaaauauuauaaauuuguucuguggauuagcuuuuugaaagcuaacccucuuugcuaaaggagauauuuuaauucuguuuuuaggugacaagcugagaaggaaauauuuugacaaauuuaugggauggcuuuuccaaaucugacuaauuccuuguaagucaaaugaggcagauuauuccuuuuaaauaaauacuccuuuucaaauaagcugcuguggucuuauauacccucuuuacauagcuacuucaauauucuaaugucuugaauuuuucauuuuuaaaaauauguggcccuugaaacauuuuucuaguucucauguagcucuaaaguuuguaccauucauuaggggugaacuuucugauguuggccauagauuuuagagcauccaucuuugcauacguaaguacucgauuuuagagcauccaucuuagcauacguaaguacucacaccuuucaacgucuagaugauguguauuucagccugcuuuaaaaaccucaaauggaagcugggcagugguggugcaggccuuuaaucccagcacuugggaggcagaggcaggcggauuucugaguucgaggccagccuggucuacagagugaguuccaggacagccagggcuacacagagaaauccugucucaaaaaaacaaacaaacaaacaaacaagaaacaaacaaacaaaaaaaacaaaaacaaacaaaacaaaaccucaaauggaaacagugcacugaaaugugacuuugguuuggaaaggacuagcccacacccucuuggaggcuugcugcuacugucucaccagaguccaugauucuugugcauuuaaaaacaaagcucugcagugggcucuccccguccugcucuguccauuuuaauggcugccauuuuuggagagaaaugucuguuuuucuaccaauaccagcacaacuucucuggaaaaacuuuucagauaauuuuuucugaucugaugaauguaacaccagcaagaguugcuuguuucuuguggaauucuacuccgugcuuucucucacauccaguucuaugcugguguggagggagcagaguguucauguucccaguuuccuugcaggugaugguagguggaaauucuagcaucauccuacaguggaaggauucacuugcacagugacuuuaaacuuuggcugacuaaaugcacagaacccaucaaagaccagaaauggcaagccacuuaaaaaugcauuucuucucuauuuuauuuccagauuagcaaauaaagcaacaccuuaccuuuaguuuuacaacaguuacucugauauugcugaugaaauucucagcaucuuccaauugaaagcuuuugcuuugagucaaauccagaacaugccgcagagguccaaguucaucuucuaggcacugaagaucuuucaauucuguggccuagaggaguaauaagcuuaaccaucagcucagcucaccacauacugaagagccagaaaguuagucugcagucucucuaaucaagagaaggcagcacauagcuuuuaccacucccuguccucuguaaagggggacugagguaaucgaugccauaaaucuagaagagcaagagcucacaaccauaagggucaccuugacuguuaggccacucuagugagcucuucuggcuucauuagacuuuguaaaaagucuguguuucucuaccaaugcauagcacaaguucagacuauuguuccaaucuacaaagaaaucugcaagguucacauucuaauaucuaaucgcagaguugagaaucacagaaggguaagggacaggaauccuuggaugccaacugucauaggccuaaaucuuacagauuagguuaucauggcccugacugaggggugucaagauagccaggaagacacauguaauauuuuuuaaauuuauacuucucugcaauuacuaaagaugaguuuuuuaaaaacccauaugucaagcuaggaagauggcuuuuaagguaaagguaccugccaccaaacuugaugauuugaguucaauugcagugacccacccacauuguggaaagaauggcccaacuuucauauuucgucuucugaccuccacaguuacacugugauacacaugcaccuccacacauacauacauacauacauacauacauacauacauacauacauacauacauacauaaaauguaaaaucuauuugucccaaugaaaaaagucauaacauuuuggcagaacacuugggagaauuuuucugauccauguaugaaauaauguuuaaauacaucaugcauacuuacauacauauacagggaaaaaggauauugucuagcucuauaguacacuaugauuuccauaaagucagcugcuuuaagucuacagugaacuguguuaucuccauuuuaccaagucucacaaucagugucuuucccacaaccacaugaacggggagcaaggguggcccggucggucggucgcuccuuucauuaaccacagccuuugaauuacaugcuucuauuguuuuuaaaaucuuacauaccgaaugcagguuaaaugaaaacaucagcagaauuuaccacauuacucuuguuuucaauaauuauuuuaaaacuuagauuucuaggaauuucaccacucucuaaauuaacaugaucucuguuguuucucuaacaauccuuagaggaagagguuugacaagauaacacguaguuccugauuggucugcuauugaccuuccaacuuguuauggugugucuuggguauucaguguggagcuccuucccucacagaacucuccaguuuguuacugugggagcugaacauuaugugacuguaauuaagcuggaagagcaacuggggccuuucuuuuucaucuccuguagaacagcuagaggcaaaguuccccugacucaauaggaaugggucaacagcugccucuuuguccccuuagaucccauuuugcucuaggcuuggauuuacuugggacaagcucuuucuaggaccaaaguuauccauucucuuuugacuuucgggacuagagcaaauuucuacccuugcuggaguucuaagagcuuguguaagcuguuuuguaucacacaacauucugccuccaaaggagaccaaaaaaccuuucaauauugagagauaguaucauguaguaauauuacagcucucuaguuccacuaguuaaaagagacuguauaaauccaaaauuguuuuauacaucucggacuucuucucuagcacuaauaguguguuuaugugcuguuggccagacacuguucugaaaccugacaagugauaagcauagcaaugaucauuuauguaagugggugaaugagcauagacaacuuccugaggccaugagagcuaggcccuagcagggcuggacuccacugcagaucauuggcccuagaaucuuaacauugguuaugcugcuccucaaaaaugcagucauaggaaucauucuuaaaacaguaaaguguguguaaaaugagacccucucaagucaauuuuuacauuuaagaagcugaaauaaugcaccucucucaaauaucuguaggacaagcauaaaacagaaaucaacagucuuuaaauuaucccagcaucaaaaugcaaucaucuugcauuuucuucucauucccuuucccaacacauaaauacacaggaaaaauguaaagaaaaccauuuaaaagaaguaccauugucaagauuuuuuuacagagagauaucagagaaacuuauuuucuucagaugagguacuauucaucuggucacauguuauuuacacguuauacacauguauguuacuuugaauucauuagagcaccaguuaaacacagaaacucacucaccugcuugggcaaguaaaauuugaaggugagcauccuggggaguuucagguuccuguaauucugagaaagcguaacacauuauuauuaaagguuauuaaacacagccuuuggcaagaaagcuaaagguauugccuauagaugggauggcugugcacuuaccuccauccugcucaggagcuccuguagguccaucaacagcugcuccaggugcugcugcugcugcugcugcugcugcugcugcugcugugcuuccgcuguagagcuugaaguggagcuugaagugggugcgcuguugacaaggagcacaagugucaaugugacacaggaugcgagcugcaugcuguacaugccugcaggacuugaggucacugugaggagugauuagcaagggugauaggcagc

SEQ ID NO: 1398 - RNA, 1139 nt, Mus musculus
cggcgugacucacucacuuucuaaacucuuacgcugucauuuaccauaauucucuucuuugagugucucuguguggugcccucauuacuggcaauacucuccuuguuuucccgauuuaugcaauuaaaggccuagcugugcgagcauuuccccaguuucauuuacauugguaccaagcugaagaccagaauaaagauguucucagggcagagacagcagaagccccuccacacugaaugccaagccacuccuccaugggauaugaguggcacaaggguuggaaugagcuguagaggcugacccuuugggaaguucaucaaagacaagaagacaggagacaaagagacaagaagacaggagacaggagacaagaagacaggagacaggagacaggagacaagaagacaagagacaaggagacucacggagguccagguacacgggaauuacacucagagacuugugauuucugcacuccacucugccugccuggaaaucucauccuuucuuucuuuucaaagauuuguuauuaaaaugcaaaugcugccucuuaucuuaaauaggauuacaaagacaguuccagagcugucauaucccaaggcucugaaaacagaauuaucuguuccucguucagaaacugaucccagcacugcuuucuaucauugcuuguuugucuuaggaggguaaacauguaucauauaaggauaugucauaauaaggauuaauauuauauaauuauaaauaauuuauaauacuuauaauaucauuguuugguucacuaauaaaucuauggauacauggucaaaauggaaaugaauauuuugccaauuauuaauccccaaagucauugaaaauaagcauaaccauucuacugacuuguuagacucuaaacuaacauaaaauacauuuucagaaauaaauucaaccgaucuuaccuuuacaucuuguggagcugauagaaguucaggauccuaagaaaauuaaccaaagaguauuaguucugaguuggugauacaagucaaaaggcuccuuuugcauuaauuaaaaaaauauuauuuaaauugcauugugacaaacauggccuuaccaagucauuuucauagauuuucagcuguucaacaaugucaauaaggugacga

SEQ ID NO: 1399 - RNA, 4706 nt, Mus musculus
gagccgguuucauuaauuaauauauuuucugcauuguaguuaacauagauguuuuuuauauacuuucuucgagucaccuugcuuuucuugaaguagugauauguuauauucagacaugaguacauuucaacagucuuuugcaauaaauaucauaaaauaauagagauucgcauaauaaauauucuuuacaauaaaaaaaaguuuaacagacuuuugucuuaaaaauagccaggauucaacuuugugauuuauacauaaaauauacaaaaaagcaccacaauuugugguuaaggcaaugaaaacacaggaaggguuggaaauacucagcuguuaagagucaaaaggccaagagccaaaggcaccuuagggagcuguagcucugagauaccaggggcaaaucagacaggaauuucaacuacaguuaccaaguguccucagugaaguggggggcgugaagggaaguccuucacagauacugggcgcuggaggaggaaaaggguugccaacaucauaucugaugugaagaccaacaccgcacagagcuaugccaaaggggugugcggggacgacccacuggcaucugcgcaaugcauugugggggggggggguucagagggcuguaaggagaaggcugggaaaaccguguucuaaggaguagcuccucccauccggcuaggagaaggacacuaagauagaucucaucagaggcagauuaauauauagcuuauuuaagcacuuacaugguuacuuuuuuauaaaccaaacuaaguccacgaucccacaguaccagaccccaaacaacucucggccaaauccgggcaugcguauaucuucacggaagcagcuggagagcggaugcagcacacaggcccucgcugcucccagaacccucgagguggaaugagaacaagcugggugcaguuucacaguccacuccuauugaggcccauccaaggcaggagagacucgagaagaaaaucugccucuaauaccaacagccaaaguuuggaagcuagacauuccgcggagguccaacccaccuccagaagucaugacaguuugcccugagcccuugaggggcagcucuccagcuuacaauagacaguguuggaguuucuacaccugcagccagggcgguggguccagucguaacagccccugcacagcuucaggcagcccuuggcgggaggguagcagagcaagcaggguaggcacaaagacagggcucccaugcacagguaucuggagcagcagugggacugugaacaggagcauggguuauccgaguaagaaccuccaucaucaucauuggagcagugguagaaaaugcccuugaccaggcacaugcaggucccguauuccaccaugcucuccgcggagcagaggcacugccgaucacaggccagacaggagggcagggcccggggggccguacacucuccacauuugcacuugccacacuguucgcagaugaacuugugcugggugggguccucuuucaaggaggccuucaagucuuccaccagcagcugcuugggcuggguccggaugacccgaucugaccuaugaccugggaugggccuggugggcggagaccguccuaauaggcccugcucagaagacacacugcugcugcucccugagcuggccgcgcuuccggugcugguggaccugcucagcaccgagccccuggcguugcccggguggcuggcaggucggugcucguagcugcuauucacauuggcugguaugauuucaugaguccuuuccugcuuuucgggucuuggugcagugcgaggagcaggucuucucgcuaccgaaggucccucuguguauucauugcugccucugauggcuuugaucuggucuagggacagaaucguagcaggcugagugucccugucauagucuaaccucugccggccuuccacagccgguggcugaaucaccacuagcgaaguguggcugccaugcugacuuggggaauccauguggagugaucuccaguuccagcagucagcggaaaucugccaugcaucugaaauccuaaagaagagugagagagaaaauaagcgacagaaagcggauuugggggagaagggcugcugucaaguaacaaauuccccaagccaccugguaaugauccccuucaucggcugauuucaaugaugccgaagccuggccagaguccaacuccaaaaaaaagauugcagaggaccauaucacaggaagacagcaaagaccucaugccuuaaaaauuagaaguugcucuccagcuucuaagaagcagaggaagucgugucuuccuguuugcaaaccuaacaaauaauuaaaaugaaauaugccuucgaaagagcaauucagugugagcccuggaacuguucucagaguucacugucaguucacuggcaguucacguaaggaaaaugucagcuacuuuuuaaagauuaagaauggcuuuagugcuguggccucucggccauuuauaugcuguuacgagcuuuagauuaaugagaaaauuaaucaaggcaauuuccaaaacaccggcuauuccaagcucacucggaaucucaaaaggccauuuucagcagaaguccgggucugaagcuagcucaucacacagaucugugagacgagcaaaggaagcuacaaagaaugaagagugcucugccacaaagaacacaacccggacgguguggacuuagcuuuccuuaaagguuaaucaaggcucccccacacaacgaggauaacuuaugcacaagugucagcccuuuaaagcagggagaggagcccuggucuuuuuacauuauauuuaauucccuucauuuauuagcacgacagaccuugauuuucacaagcccugaauugaccugcuuuuuguaguaaaauaaauacacugauagacaacaaacacaacuuccaugucaaaaggaaauagcuuccaauuuauaacguauucuuccugagacagaccaaacucuuucgauucuguuucugggcaauagguaucuaagauauuuuuuuacacaaaugccuuccgaacucacagaugcaccuuaauucaagaaggcaccccuuugcacuuuucuggcauccaaagaaaaucaaaacaaauacgucgguuuacuauggaugcuaacuaauguccccagacuacauauguguuagcuuuuuggaggccccucuaagcuuauaacuaccuucuccgcacaugagaugcacggccauaacagcauguuguggugccgaagcccuaaacgacacuagaaaacugcccauccuugcuccugugccauaucuauuuuuuaaaaauuuaaaacuccauaacgaagacuuuaaauaugccaagucucauccacaagaaaggaagacgugggcacggcuuguuugaguuaugaaaccccuaggcacggcuuuaauuugcauuuuacagggcauucccaagcaaguucgcucaggcggagcaccuaggcaccccgcaacuguccagagcgaagccggugcgcacccgcggacagcaguguggguagcaccgucgggcgcuugggccccacgccgagaccucaggggcaccgagccgcggcagguccggccggauaaaguuaugaaugaaaacagcucgcgggcgggaggaggcagcgcccucuccccgcgucccgcggcacugcgcuccgagcacaggcgggcgcuggguccccagcgccaucgggugccgcgcgcuuggcacgggcugcgcgaggaccgccaggaccgcccggcccgccccggcccgcaccugccgcccgcacucaccucggccuccgcggcgccggccgggggcgccgagcgggcggagcgcgcgccgcaucaagcgcggcggggcggccgggcgcgcauggcccgcgcugcggccucggcggcccccgggcaggggcgcuucuccgcgguuggcggcggccgagggcggcucggggacauccgccgggugcgcgcggcgcccgcuccacagcaccgucccgucccggucgucaggcgcgcggcccggcgucgucccgggcucucggguccccgcagguccgcguccccgcagucgccacgccggcugcagacgagcagagacagaaacacgugagucccuugccagcccgggacgcuguccugcucgccgagauggacagccacgagccccggacacacacggccgugcacguuuugcccccacggaaugccccgcaguccaaagcgcguccgagagacgcgucugcgcgaggcaagcccgcacgcagggacgggaaaagucaggucuggcacgagcgcccggcgggucgguccccaacaaugcgcacagacacgcgggugcgcggcggugccagcccgcguucgcacacgcguaacucgcugccuggcuacggaacucgcugcagggccgaccgcaaagcgccgggcacagagcuagagccagcuccgaaaacguccagcuccucgaaaauaaaauaaaauaaagcaccauucucaccugaucuugccagguccucggcgggaggggaaggcucuuaccuagugcagagccuggggccggcccucccggcacaugcacgccgcucgcagccgcuccuuagcccgcagagcucuggcugcggggccgccgcaaaccccugcgugcugagcacucgcgcgcgggcuccgcagcauuucagcgucgccgccaccuccaccuccacgccggg

SEQ ID NO: 1400 - RNA, 66283 nt, Mus musculus
uugacucugugccaacucgcccccaacccccaagagcagguaggggcgggcagagagcuguccagggcacaggcacccagcauuguugacggaccacuucauaguuacaaaucuccuuuaaugggggcucaacuuugccuguugcuacaaggacugcgcucaugguucgaccucguggugcggcuguugugucccuucgguguuuucuuuggugaguuggcccuuugauguuuuauguugugggucgcgugaaggugagcgcguggaccucacuucugucuucuuugucuuuucugucuguccauccugguaaucgagguuuugguuucgguuugguucgagggugagugugcagcgagcaugagacaagcgucagcggccaucuucuccucuuuauuugucuuugagcgagcgagcgugcugcugcaaguuugcugcggucuuuuuuuguucuucuuugucuuugggcgagagugccgcgauaagcauaaggcggccaucuuuucugucuucuuugccuauucucauuuucacuuuuggucuggauaugggcuggccaucugggaucggcucccgaacaccuuuucaagggucccucaacaucauugacucugugccaacucacccccaaaccccaagagaagguagggucaggcagagagcuguccaguacacaggcaacacugagaaucaaacauggauccaaggcuuacacagucagaaagcagaggcagauauaacuugcaaguuuaaggacagccugguuggucuacauaguuggcuccaggccagccagagauacagugagauccugacucaaagagcaaaacaaacaaaaacuccaugcugagggacuugaguccuggcucaguuguggaauuuacuuaaaacuuuuuauagaggaucuggguucuauucccagcacccauauguuagcucacaaccuucugcuuuuaacuuggcaggaauggccaccgaaaagccaugauguacggaaagguauaaacaauaauaguaacaaggcugggguguggcucggguguagaugagcaauggaaaaaauguauacuaauaagguuuucuaggcuugguggcacaugccuuuaaucucagcacucagaggaagaggcaggcagaucuuaaguacuaggcuauccuggucuacauagcaguuuccaggcuagucagggcaacauaguaagaaccuguuuucauacauacauacauacauacuaaaagcuugcuuagacucuggggcaggggcaugccacuuuacuucuggauggucaaacugacucagaggaugugauucugaauucagguguguuucuaauagcaguuuccguucucaagggacuuggccaaaacauucggaagucugucuaacugaacacccuuacuguucuuaggaauggcuauggugaccaccauuuuucugugagaaguaagacaaaugugagccaggaucaggaguaaaggcagagagaaccccagaaguuucuuaucuguggcaaugaaguaucagcuuuuaaaaauguuucaaugccauguguguacuagggaggcagaggcaggaugcuuagaaguucaggaccagccuuggcuacaguguaaauuugagccugcuuuggauacaugaggcccaaacaaaacaaaaacaacaaaacaaaacaaaacaaaacaaaacaaaacacccaaaucaaaacagaacauucuuagguaaagagugaguugauugaggaaucucuccuaguaguuggagaaaaagcaaccuccccucuccaaagaauccuagaaauagauauguauuuaacugaccuuugagauggagacagacuuguaaacauaaaacaguguauuaaauacaguggaauaaguuccguggggaggugugucugagaguguguaggaaagaugaaauaggaacauacuugaagaaagcaucacuauuacaauguuaguuauaaagaauaccaggggcuacugaaguagcaagagacccagggcugucaacuggcaggcacuuaagucccaccagagagcaaagaccaaggcacugagcuauauguuuuuaaugugcauauguauauaauagccgaauaguaacuggccuuuucuaaaagucaccuuucaguuagacuguuauucuucucucucuaugccagaauguaauaugucugcaauaaagcaucuaauaugguauuggcgagguacauucauagcucgaagugcagggaagguggccagagacuacggguguucuuaaaccgcaauucaguaaagcugugaucccaggagcauccucagagauggguugaaaaaguccaaggaaggcagcagaguccucaaagauacacccugaaagaacaaacacacaggcacacugaaagcacuggagggugguuguguaugaagggaggagacgcaaguuuguacgauuucaguuuuuauagaauuaguauacauugcuucuauaacuaggagauggcuggacaugguaaccgaggggaagggucccuuucccugagcuaagcaucauaagcauaauaagcauuuguccuggaaguguaggaugaaauaagcccuuuacucccuaaguugcuuugaucacgauauuucaccacagcaaugaucccuaacuaggauacaugucugaaaaacaaaugacuauaagcauaucauuucaguuugacagcuucgggguggggguugaucacacugaccccaccccaacucugugucccacuaugccaaauaguuagcauuucagaagaaauggggagauguucagagaccuacauaaauaggcacaugaagaagucccagcaaaauauauguucuuuaguucuucaguaagagaauuuugcuuucucuauauuaaaauugacuuagcuuuucccccucccaagcagggccuuuucuuagcccagguugguuggagcucauucuguagcucaaauugguuccaagcucaugaucuuuuugccuccagucuuccaagugcugggauuaugugugccaccaugcccaaccaacuagacaaauuuuuuauagucaaugcucaagaacuuuaacaauuuugaauauagaauauugcucucauaaauucuuaauguuuucaaaucaaccuauaagcauauaugcugcugugauuuuuuuuuuccaugacuguuuauuuaggucucuggaacauuucugcuuccuucuggaauucuuuacauuagaggcaaaccuacuuuggucuggugcacuuaggcccuuugcugauggacuaauucagucaggcuaacgaagagacaagcggcugcuggcaaaaggaaagcuaaugaacgcucagaagugggucuaaaaauucagugggugaucuucuccgguuugugaucaaucaggagccaguauuccuuccuggugagcuuugaggcaacaggagaauuccucauucaggcuccucuaaacuugguuugaccugaagccucuggucagcugccuuugaacaggaaauaggucgggagacacggagccuucaucagcagagagacagauggaaaacaggugcaggaagaagcagagcuuauggagggaaggaguagggcuuaaaaacacacagagugcgcaucugacacagaguuuccuuuaugucuuuagaucacugugucuucccccaccaaccuucccucugacaagauaagaaauaauaauagcagcaggauuuucugaagcgaugacucaggcuuguaacugcccggcuuucuuuucaguagcugcuuuauugagccuuuaaggaagcaguucauuggaauuuaucacuuguuuuuuuuccucuuaaaucagcgagugguucagguuaugagacuucccuagguuuguucuaucugcguuggcauuuccacuggaaauacggaguguggccuuuucuuguuugggugucuaaucccauuuuaaaggcccgucacgccccugcugagggucagcacccugugaauagacgccucugcaccugcucgccuauucucuguccuucuccucugaggagaacgagaggauguuccggauggcaaacaauaccaugcuucacuggcuguggugacagaaaaccauucuggaccugggaauuggguaaacuuuaaagggcaugagaaaauaaacacaaaaacaagcaagucugaaaagggccggugggcuggugcaagagcauugcguuuaaggcuccggauacaagggggaucacgcccuugaauuucuuagcucaggcacugaagaaaacugcacagaacauacgacaugccuucaccacaggcgccucuaacaugaguggaggcgugaaaacagcagaguccuccaaaugaccacaguggcuagauauggcugccugauucccagaguaaaacuccagauuguuguacuucccagaucugaauaagcaguaauuggauggagacaauccgaaccgguaaaagacuucacguccacacugccuguuuucuccuguucuguggacauagcucguggcccaugcugaugcuugccuguaaccccugaucauggagaguagagaauuucacaggcagauuugaacccgugacuugucacaugagccaaacucaugaccaaagugauaaaaacauaaaguucagggcccaacuguuuuaccucaugcccaucacaaaaucccccgugucuuaugcagccacaucaauaccuucaccaucuuuccuaaaaucacgcuguuuuucauuuuuccuaaugaaguacaauucccucagauuguaacacaagcguauacuagcuuucacuucgcauuccaccaguuacugugugggggaggggugcacacgccacagcacaugagucaaggucagaggacgucuuuguggagucagcucucaccuucugucuggauacagguuugaacucagguugcccagcuggagcaggaagugucucccuccugagcuaucuuuccagccccuaucuuucacuuugugucaggcuccaaaauccaggcaaggugcagcugaucagaaucucuuucuucccucuuaaucuuagcucuugauccugugugcuugccugacacuuucauuuccgcaugucccauauguugucagagaagccuuccugggagagaacaugacacacucugcuuucaguaccuccuaucccaaagcuacauagacuguggcaggacauugagcauggccccgggcgcuuugaaaaugugagugacugcauuugaccagaagacacguugucaaggcaaccugugacaaagcauccucguggagcauggcuggguacagcaggcaggaucagagggguuagugagcucuggcucgcggcuggacuaugacugugaguuccagauuuuuguccuucagguuucaagagucaaaugaaacugggcaggguagagauauuauccagaaaaucuugcuuccuggaaaugcgcggggcaguuugggugggguagcuggguggagauuccucagagaaacugguuagaagaccagagcugugaucuaggucuugauuacagugaaguaaugagaagagggugguaacguugagauacugcaaaggaagggcucacaggaucuggaaccaacugacuagcuaccagacaggaucaacaaauccccucugauuccaaacugggagucugugagaagcuggaguagauagauggccucaaauguacguggaaggcuuagguucauuauguugaaaacaucccacugugugcauaaggguagggguauuggcguaucuuugaagcuauaacagugcuggcuuggguaugauaaggcugcaagaugguguugguucggguaguuuuugcauuuaugaacuaggaaaaacgagaaggcuuggagggaaaggaaggcagggucccagggauggcugccucugaggugaggguagggugagagaagagaggagggcagaagugaagacaaaaagaagaguuuacaaucaucaugaggcaaauaaggcaggcaggcaggcaggcaggcaggcaggcagacugcuugggguggaggaccgauguuugaaggcuugaggaaagaugucacagcacaggugacgagaaaauggcuuugcaaagguggcggcagcagucuaaaaugucaccagugcuuaugugauaaagaaaauagagugugugcgcugggggcugugcaugaugucauaggcccagggagaacgcucgaggugcagaggacaccuggagcugggacaggagaagggaggggacuuggggaugagucacagggaggacucugauggaagaaacaccuggacugaguucagaaaggccaugaggcuguggccagaggggccagucacaaggcagagcauuuccugcgucccagucugacuggguuuuguucugcaaucucugcaggugcaugcagacgguugcggcuguguuggcaggcucauccugcugauagccccuugcucgacuuccagacccaacugcauugaaugccucugacacaaaauaagcaacugauaagcgaggaagggagggugcagaggguuagcucuagacaggagacgagauuguucuaccagguaggaagagaggggagacgcugagucaucaaaggaagguuccccuuuugcaagauaauuuccaucaauuuagggacguggcgguaucugagagcuuuccccagacagggcaguggcagggccuggggaacacugguguuuucugugagucagcuugcccacuagacacuuuaccaugcucccugagagcuuaccgcagcaccaggugccauugcuauuuugaccaaaauagaugugcacauggaagaccauaguacaaauccaggucucgugaugcaaaacccauccaaucuccaguggcccacggagggagcaguuguugggcucagagagagaggaacacauugaguggagucaagggucuagucagggugagugaacuugaacuuggcuaauguacaggcaguaggcucccaugacuucuagaagccaagaauuagagaaugccaaggcuguggaaaucuaggcucuguuucagcuuagagaggugagaaguuugaggaggaaggauguaaccaaggaggguguugagggccaauucaguaacugcuucaggaggcuagauuuagucucccaggagaguuugugggugcucaaauguuucccugccucacagaucauccagaacggagccaacuccaccagguuggccuuucucugcgggcggcuucucuggguuuguggagaaacgugacugagguuuuccaagaggcccacauuacgccuuuccucagccuucagauaaauucccuaucacucaacaccugugcugucaauuguguuuugaaggaaauccuuuuucuuacucuauguguguguguguguguguguguguaugauguuuguaucccaguacuuucuucgggaaaauguucgaaacuucaaagacugucuuccugucuucccauaaacaccagaggggccaagccaaacugcugaccacugugaaguaauccuuucugagaagcacaaugaagugugccacaguugccgagaacacaguuguggggagcuucacuaugugugcgugcucaaggcacaaaagcucgagggagcggcucuagggaggcugcucugucugucuggugugacucuuacauacgguggcuucuuccuguccuagaugucucauucacagacaacucagagaagcucagauucuguuuuggaaugaaaguaaaauccagauucuacaggucuguuuuuccaggcgugcuccauguaucagucaaacaaacaaacaguguucugaagguuuggguuuuuguuuuguuuugcaaaauuuuguaauucucaaaugugaucuuggcagauggcgauaucuugugauaucaaaagcucagagacacagaagaggcauaacuaaucaaacugaccuacaaggauaaccucucuaggccuuuaaaagcuagaguguacauucuugcuguuaguucagccagcagcacuaaagauacaguuuauucucaucuaaggacuuaauuguucauaguagcacagaucaguuaauaugcacagcacacucaucuucaguggacauuugaaugcugaguucccacagcagaauaucauaucuggcauccaucaggaacuguuaucuagguaaaaauuuacaaugcguacaaacaaaucaguccaucuguccccagacagaaaagcaucgcucaccuucaagaucuaaagauccuuuuguuuguucuuugcuugccuuagguuuucccuuucuggaagaauaagcugaaacagaaucucacaacaaaaucucuccccaucuguaugccugggugugcaccuguguguguggccaugcuccuacaagcaucagcucucauauuuugacauggcuaacaccuucuucuuugccugggucaugguagucucaaaguauggucagccucugcuugccgcugcauuauaaugucuacuugcaggguuaauguguaauuaaaacucuuguucugaaaugucuaaaacucaaauguuugacaaauggcaccaugcacucuguggauaaaguaaacauuggcucucagacaaguggacgcucccaccucggggucugcauuuuauacuagaauggccuaggcaugugaugcuagaugcuuauuagauuuccaaaaauggacuuucuauaaagaccacacugggccccucagcuguuuucuucuauugcuuauaaagaaauugaaaacaaaugcucuaaaaggaaagaaauaaagaaagaaagaaagaaagaaagaaagaaagaaagaaagaagagaagagaagagaagagaagagaagagaagagaagagaagagaagagaagagaagagaagagaagagaagagaaaaaagagaggaagaagaagccgccucuggaacuagaaacagcugucagggugcacuuuuuuuucucuaggauuaauuuuuacuuuagcaugguaaccggagucauugaagccacaccuuccccuaugguggcucucacaaugugcagaaaaacagcggccgccuugauuuccucaagugguggcucagauuaagaugggagacacauuucauuuuggggugucacuucauugcaaaucuauuuuccacaccagagaacuuugggaacgucauuuauuguguuguagugaauauuacccauggagcuagagauggugguuucuccccucuacuccagccuggaguaaaugcuugaccaaagcacaauaccacagacgaugacaguuggagacaauccccagaaacaugagcacagauuauuggauggcuuacuugaucucaaaaaaauuagcauauuaaauaaccaggaacuuguauugaaacuuaacguuaagaaugcaaaguaagaugcuuuagugguucuugcuguugccgcuguuuuaacuuuaaaaauaucauccccgggcuggagagaugguucagcaguuaagagcaugcacugcucuugcagagggccugauuucuggccccggugcccacauaauagcucacaacugcuggcagcuccaguuuccugguacccaaaauccucagcugggauacauguacaugauacaauauaaacucacacagggccacaaacauacacauaaauaauaaauaaaucauuaacaaauauaucucguccacauacuauaugcuaggaaggauguaacguagcuaaguuccugucaggaaugcguaaucuugaguucuaacacgaggcagccucagacaacuguaaaugaagcuugccccaguuuaagagagaacaauuuuuuuuaaauguuacuaucauaugaaauaaggaaaauuccaaaauuagagacuacugaagacccaucacggcugaaggugggagccugaaagaagaguggaguggcuugagugauaauugguacauaaccggaaguacugccaugcucuuagugaccaaucagaugccgaggugcaucagagagcugcuugcuguacaacagcgaaagacaaugguacgcaauguuaacaccugaauuuccagguaaggacaggacuugcggauauucuuugaacugcucucauuuuuuucuaugccugauuguuuccccccaaauagcgaucaaucugaacgucuugucuugucuuuucuuuucuuuucuuuucuuuucuuuucuuuuuucuuuucuuuucuuuucuuuucuuuucuuuucuuuuuuuuuauuagauauuuucuucauuuacauuuccaaugcuaucccaaaaguuccccauacccccccugaacuuauuuucaaacuaauuuauuuauuuuuauuuuuuuuuuaaaaucauguuacuaggaaaaugaugcuuucugaggauaccucuugguaggaaccguuguugugguucugugucuguagccacugggugaaguugagcgcugucuccguaacucugugaccggaucagggacaccgcugaaagguugaaagacucugacuuuugcauuuacacuuaguggccacugauaugagggaggccucguguagggaucaucggccuuguauuuaugcguucaacaccuuguucuggcauuugaccaucuucagaggaguuggcuuuuuucuugcuuagguggccaucaguucugaagcgauuuaguagacucaagcuucucuccaggagaaacaguuuuacuuuauuauuauuauuuuaauguaguguguaugugguauagguacacugugugugugguucaugacauguguaaacaacacuggggguccugcugucugauuuauuauucuucaccuuauuccuuugacacagggucuucccugaacccagagcaaggcugcugccagcaaacuccaggggcucuucugucaccaaccccuuagugcauggucacaccuuuguuugugggugcugggauccgaacuuagguccucccacauguacccuugggcugcugaaaugucugacuguuuuguucuaugucuuccuuugaaucucuuauaaauuuuaauguucugucuucagauccauacauacuuaguucauuuauuuuuauauagugcuuucauuuuguuuuguuuggcuuuuugaaacaggauuucucuguguaguccuggcuauagaccaggccggccuggaacucagagauccaccugccuccucccaccccuggugcugggauuaaagguguacacuaccaccacccagcuaaugucuucauuuucuaugaaagucuacuuaccugacauuaauaaagacacucacuauuuguacuggaugcugucacucacuuuuuguuucuaaguaucuauuucuguguaauguaucuuugcuagucaggaucucugaugccuucuugccuguuaugugaugugugccuguaagcuaggguuucuagucuccuugcauuuacugugacuauugcucaguaggauugugucuaucacucuccuguugucugucugucuguccucugcuguuccuuuucuccuucuguugaucucauuaaaucccagcccuccagagcguccgcucuuccuauuuaugugaaguguaauuagucauggcuguaaagcuggccuugcacguuucaaauguuuccuucuauggaaaccacaagaagggaugcagucuuguuaaagggacagugacuuaccuuucuggccucuuauuuccaccugcaacucagcacuuggcuucuugggcugaagggcagcugagcagucucugugucuuguuucugcagacugugccguccuuaccugauagcuucuaugucaccuucuuuuuaaaugcacacugguuucuguuguguacacaugucugugcaugugugcaguugcaggugcacauguguacauguguguagaagccagaagacagccucagggauugcuccucagggcguguccacucuuuuugagacagacugucucuugguuugagaucauggaguaacuaggcuguuuggccacagagcagugggcagcugagugucaccacuuucuuagcacuggguuuacaaguauguacuaccacccuuggcauuuuuacaugaguucugggugauggaaccuaagucuucuuguuuuugugacaagugacucagccaauuccccuccauacccucaccacaagcucccucccucaaaauccaugacagaguugaaacugaaaaacagugaacuuuauaggucauuaugacucacgugguuaccaccagcauccaaccuucuccaucaccaagagucugucccugcauccaacccuucuccaucacccagagucugaccccccauccaacccuucuccaucacgcacgcagagucugucccugcauccaacucuucuccaucauccagagucugacccccccaucuaacccuuuucuaucacccagagucugccccaaccccucaaaacuuucucugucacccagagacugauccuucucauucuugccacauauuauucuauguuuauauguguaugcacaauauaugauguauauaauguguauacacacacacaucuacuauaggcuagggucaggauaucagggagaaugagcaauuauuuuuauuucugagauuguguaacuuugcuuggcauuauacauucuaaguccaucccuuuuccugccaaauuuaugauuucauuuuucuucagaguugaauacuaucagauuuacauuauccaggaucaaugggaucuauugcuuugugccugaaacauaaugcuauuguagcaggagugugggauggaagaggaugcucacacaacagcaggcaggaaacagacugagagagggcuagaucccuggaccagaugcccauccgcagcguguuuucaguguaccuggucccugccacuucccaguaauggcaucaaauuauaaacccauugauaaggucagagcccucaugucccaauugcauucaaauuuugugcauuaaaucuaugacuuaugacgucaggucuucucaugccuuguuguaaaagcuuugggcuacuaccuuccugcaaggaaugacuccugaguuagcagacaguucgguuagacuaucucucaagcucugucuucccacaaauccugucugggcagguucuaggugagcuagggcaggcuggcagcagaacauucugagacacaaacuucagcguuucaggugaguuaccagggugauaaugggcugcccacaaugugcugcucuggcaggggacccuccaucagugcagagcuuacucgcaaucacuuggcucagugguucucaaccuuucuaacccuucggcucuuuaauacaguuccucaugucguggugacccccaaccauaauugcuacuucaaaauuguaauuuugcuacuguuaugaauuauaauguaaauaucugauagauaugcauccccauggcugucaagacccacagguugggaaccaacacuagcuguuuuuuguagugagccucggguuaccuuaccacuguguguccagugcugccucuaaccacagaccaugucaggcucccacagagaccucagcaacucccuuucuguguaguucuuugcuugcccacagauucccaccauucuagcugucccgaguucugaucucagcuuguucagagcagccccaaugucaugcacugcuguucaccuagaguuagaguuugaaucugaucuaucucccgugaaauccuaucuugcauauuugauccccagcuagugacgccguuuaggaaguucaggaaaaucugagagaagguccuaggcagggacguaggugacugggaaaagucuuuaugaauguuauccuuggcuacuugaugugugucucugucucucucugucuccuaugugcugugguaugaaccacuacccuuagccauaugcuucuguugcuaugaccaucugaacuaggcauggagccggaacaaccauggacugagccuucuggaaucauuccccaaaucagccuuccucucucagguugcuucuguccgaauuaugguccuagugacacagaaguagcuaguuugccuuguugaggaaauuucccuaggguaagagagcugggcauccccagagacuaguguugaguuucugcacccaaagggauuauaaucuuggcugccuguccuucauuucuagaaacaaguauuuuguucaauuuuaugauaauuuucaaagaaagagggcuacuuugguucagguacacuauagugguugggagcuccuaaggguuuuacauugaagaugaagaggagaaggaguggagagaaaugaggggagggagggaagagacagaaacagacacagacaguagagaaagcaccuggaccuuggaccuugaugcuuacuaaagguugaauaaccuaaaaagugucccuugagaaguuuacccauuugagcuuauaucuaauguuuacaguuucauaauauuaauaaugauuaucuccuauuauugaacauuuguaguucauuuaagauuugaacuuuucaaaaacaguuacuucacuaggaugccguuuaaauuuaaauaauguacucuccaggcuauuuuggcuguuguccuuauuaauugguuuagaaauaucucaagaagaaaaguaacuauuuuugauggaacaguuuguuucaauuuauccauacuaagaaaacaaccacacuuuaaugcaauuucauaggauauuauuagaggguaaaaagagugguuuguaguuugcauguguuuccccccuggaagcugucaaugucuguggacagaccgaggcugcuguacuguauuucguuaugaauaugacagugcuugggguugggaaggcugcucagcagguuaagugcuugcuaugcaagcaugaaaaucugacuguggauccccagccugguccgguauguguggaaccccagcacuaaguaugggaacagagauaggcaaaucccuggagcucaucggcuagcuaggcugguggagucugucaaguucagugagaaacccugucucaaaaaacaagauggaggaugaggaaggacaacacuuaguccucaugcugaccucuggccuauacacacacacacacacacacacacacacacacacacacacacacacacacacacauucauacacacacaccuguacacacaugugcuuacaugcacacgcacaugcaugagcacacacacucacacucuugcacauacauacauauauguauacaccucugcacauacacacaugcaugugcacacacacuugaacacacacauacauacgcauacauagucauacaaacacacacacacacacagaauggcagacuauggaagugcuguauguuuuggaacugaguaagcugauguucucucaucagaugaaguucccauugccccuggggagguagacaugagaggcauaggaauccagccucuccugccccuaccuccuccagucuuucccguuuuuuaaagagaacugaagcccuaguacaacuucuugcuguggaucuagugugaaauauuguuaauaguaauaauaaaaacaacugccuaacuuccaucucccacacaguuguuucccagucucuuuagaagaugugcuagggaaaggcagcuccgccauacauuuccccaaggcaagcauugccuccggacaccuaacuacagcccguggauaaucagacuugcccaugaggaccaaguuggagcauaccauccuugcuagccagggacaggaagagcuugcuugcagaugcucaggcugcucaggugggauggaacgugguaucugcccauagaagacucccugaagcacuccugccucuccauguaaagggggagggaacgcuguguuuuccgaguaucacucgggaaaguggcuuaacacaacagugaggaagaaaaguaagaacaccacaauauacaguuagaauuagaacuccgagggcuaccaagaugguuccacaggugaagacgauugccaccaaaccugauaaccugaguucagaggcaguugagaugcucggccaagcaguguuuucaauuuuagguucccucugccccugaguuaggcauguuuacauauguaucgugaggugucuugggaaugggauccgagccuaggcaguccuguaucucucuguuuaccuccuccaugcagccuggacacguucugauagacuauacuguguguaguuugauagucuaccaccgagacagcugaggaaucugacccaugucaccuggugcaggugcucaggacaguucugauuuuggagcuuuuaggacuucaguugcagaucuggaccggguaauuugcacugucauucccacuuugcccauaaggaagccagugcuuccgaagaagaagaaggaggaggaggaggaggaggaggaggaggagggagaggaggaagaggaggaaggaggaagaaggaagaagaaggaagaaggaggaagaaggaggaagaaggaggaggaaggaggaagaaggaggaagaaggaggaagaaggaagaagaaggaagaaggaggaggaagaaggaggaagaaggaggaagaaggaggaagaaggaggaagaaggaagaagaaggaagaagaaagaagaggagcguguucugggagucugacuccagaugaccuucaagucaaagcuugugauuucaaaugcuucugcaguaucggguguagcuucaaugggagaaccugucugucugucugucugucugucuaucugucugucugucuaucucuuucccccacuuccauaaaaugccaccuuagggcauaccuggccaccagugaggaaaaccacucuucaagcugagcuagaagugaccagaagauuaaugacaaucgugcaugacagcagucuaggggaaaaaaaaaaaaaaaaaaaaaaaaagcagacuccuggagacacagugucuguguagacuuccaaauaaaagcaguaggaagcuuuuggcucgcuucaggagcugagacgugaggaugagagccacaaaugccagcugaggggaaaacugacuauguugcucagaagcuggggacaugccaccucuaccaugaagcgagggugagggguacaggagcaucagcgagcagugaggaccccgugcccucgcucauaauuguugcugcucucuucaguggucacaguccccagauguaacaaauauggccuucgagaaagaagagguuagaaguucacugauaagcccuccuuauuugguagugauuggucugagaucaaucuaaccccuccuuuaaaugacccugggauuguugacuuuugugauguaaccguaaggggcacgauguuaaauugucaugugcuguuugaacucaccaagaagaugagccuggaggugggguugccagccccauuucauaccuaaacagauuugucucaaagugcccacccccaaggucuggagauuggcugccuucugagucugugauagagagaaaaucgacaaacagcucaggaaugaaaacacugucccugagaacaacuagaagagaggaugcgauuguuuaucccccuaauauaaaaaugucuguaguggggaggaacagccggaaguucaacagugcgagaaagaucacugggagaaggaacguuagcggaccccuugacuuacccgguguaauucugcuggguguuuugagcagucaauuagccaauguuugcucacccacucaaucucuuucugauucuuucccuuccucccucccucucucucccucccucuuuucuuuugacuuguauacuuaaaaaacauacccauucaaaccucaaaauauggcuaauguagauagaucacucucuggauuguacaaaagcaauggcuuuuuaaagguuuuuaugguguggacugaauuugucuuaucauaccaagacaagggaaaggcugauuuggcucuaaccugaggcaugcuccuuaguagcuuuuagggagugaaggucugauucucuuuuguuuggaaucuaagucuuaacaauguaacccuaggggcccggaacucaggaugugguccaguuggccgggcacucaugacccuccugcauuugacuccugggugcugaacuugcagaucaucgcuacuuugugguguugcuaaggguggggaugcuaaccagacaaggucgugucuuuauccuuuauucuuucagucucguauuugcucauccucgcugggauuucuuuccuccaaguuggcuuaagaaucacaauuagagacaggagugaggacaaggugggcuugcuugcagcagagggagcuucccugucacacuggggacguaggagccacaaggcuccacuuugaugugggucagugcccugcaccgaaugcagagagagcugggggcagggcgugguaauggauuccagagaggguugugcaaggcaggcgcacugccaacccagcguggacaaacauucucacccuggcugucucccgaaggaagguucgugcagcuuguguggggcauuccugaaagacgggcgcauuuguuugacuuacauaacgucuuacaucagaggacuaaagccgcccuuccggcucguguccuguugaaccggauccaaccgaaacuucuuuccguuccauaggcagaaaccugauuaccuguguaagugcugcuugccggucggcagaguugcccgcccucugcccuccucucaggcaucuuggugacaucgcuccuuccucuuagaauuucacccauucgucaaguccuuaaaaggacuuguucagaacucguccaucagagacuucucccgcauagucuuauuacacugagcaugcauuaaguguguauagcuuuggggcagaggagaugccaggagauuguagaacugcaaaggcacuuggggauuaucacgguaugcauaaagggacugcagcuuucagcaagcacucucauucacgcugugcaggcagcaguacuugguuugacuuguguuuccugacacggcuuugguccuaaguucuuuccucuguccaaacuuaaccacgcaucagaggaugaccuugaacaugugaucuugcuucccuuccgagugcuggacauccagucagcacuaagccagguuuaaugccuugauuauuaauuauuauuauuuuaaguuuuaaguccacaacaggaguugcccuaaaucacugaaacuaaaucuacuccagaaggucacuauucccuacuugaaccucucagugcuuuuugugcucugacccccaccugaagaccaaagcagaccuggggaacuuuacacaagcuccacagcggucauagagggcauagcaccaacuuugugaagggucgcugguggauaacagcacaggacucagagaggaaggacuucuguccaagaguuccuucaauuacaggacaccagggacagcggccuuugcuuuuacauccuccuucauaucugcuacuaagaugggcccagguacaggggaagggagacaaaagggagggagggacagagaaagggaaggcgugugacacauuggugguguguuugagauggaggguccugcggagucacuccaugcagcagaggcaaggugagaggacauggaugguccuuagggagcagcacgguggcuccuacuccagagaaggcagacucucagcguuauagaagaugcagucaaugccccugcagucuugacacccugacuggagaagucuggccauccuaguuagcuuucccugucaacuuggcacagccuggauuuaccagagaagggacccaucaaucgugagaucacauuggccagugagaucacggauaggaagcuguccugacuguugagugauguaggagugcucagcccacugugggugguaccaucccuagacugguggucccaggcuauguaagaaagccagcugaaugugagcccgagaacaagucaucaagcagagucccuucaugguuccugcuucaaguucuuguuugagugccugcccugaccucccucaguaaugggcuguguccuggaaguguaagacaaauaaaccuucgcuccuuuggucaguguuuucucacaauagaaagaaaagcagaccauccuggaaaggaagcuuuggacauaugaggcccuauugucuuccccagucucucucccacaguuccuaucucagccaaucaaucauucacucacccccuccacacccccuccagccucccauuaucugugaguacaguuagaaggcuugucagagaccggagcuaacacacagugggaaaagccagacguggaaaauuuugaguaaaaauccucaggaaaaauacaauaaaauguuccuaaaaguuaaaauuaaucacuuggaguuguguggcuuguauuuuuaaguuaaaaaugaaguuucaagguguggccccuuauaauauucaugggacuggcuauaaaauauugccauuauuuuuugaaauuuucuauuucaaaugguguuggauuuuuuuuuuaaugguauucugaaguaaggacuguaaugucagccaggaccauucagucagccuuuccacuuguaaaugggaauuuaagauaccugcuaagagauacagauucauuuucgguuacuggagaugccaacaaaaaugugauuauaaaacuaagauguauuauuuuuuauaagagcagaauaguugcaaauaacuagcuagccugauauuguaaagaauaauuggcuggaauucuugggacuuaauaugaggcugagaagcccuuucucugugaagucuggcuucuuuuuacaguaggaacagucauuugaaaccacagagauggggacuuuuuaccugaguguggcuaucuguaggggcuagguagaugacacuccuaaacaaguggacgaacagacagacagacagacagacuggcuaggaagguagaauucaccugugguuuuagaugcauaggguuuaaucuagauuuagguacucaggaaagggcuaucccagugcagaggucagaaagcuggccuucauggucagggaaugccccccagaugucagaagaaggaugcuaagucuacaacccaaaacacuugaagcaguuuucaaaaccuugguggcagcaggugaacucugggauuuucugagaagccuucuuccacgguccagggcugcugagugacagacauggaucccacacaucugacugaggaugagcacacccaucagcucucagcaccaguuugugccauaucuccucaucuggauccccaugaggcaguucccagggagauccuacucccaaagcuguggcugaucauggcaaguugcuagaugaccauuuucaaaaggccaacuuuucuaacaaaugaaaguuaaaaaagaaaagggacccucggaggguagagaguauagcucagugacacaaugaauuuuuuacaugcuugaggcccuggguucauccaucuguccagcuuuccauccacccaugaaucuauccauccacucacccaucccccacccaucccccacccauucaucuauccauccauccauccuuccaucuaucuggccaaugauaaaaugaaaaauaccagagacucuugacaugaguuccuguccuucacucaucuauuccuuacuuuaaauaacaagguuccacauuucucaccagcgaagauaaauccucagccauuuuagugugugugugugugugugugugugugugugugugugugugugugugugugagacaguuaaucuguagguaacacucauaagagguacuugagcuucugaugauguaugggggugauccauacugacaggagggucucuacuagaaauuagacacagcuggagaaaaaaaugacagccagucaaccuagaucugaacuucuucgguucuguuaucugaggacuggaggaagguuuccaaaguuugaacaaaccagaugaauugugugaccuagaaagagauaaauaauugaguuagaugugucacuaauacacacaauguauguacauauauagagucaauuuugugacuaucauaaaauucacauugaaaaguuaaaacugacagauacaguuaggccaguuucagacaggagaaauguaacaaacaucaagaugcagaugggcuguggaguacaaccaugaccaugguccucaaauguugccccaccuuuaaagucuggggaugcugcagccguagcaaugugggugauuuacuccccacgcguugcucauuucaguaaaaggaugcugucuucagucuuggcugucucgugauucucaguccacaugcacauaugaacguggugagcagaguaugugcuaaccuacugcuggugcgcugggaaggcuucagcucaacagcagaccugguuuuuggaggagucaagucacauggacuuuugaugacauccuaaugucccuacuguucaaggucaaucauacuucucauguccucggcgugauguuaagagcuuggggagcaggacagauaguccacuucuuuuccuuacaaguccugugcaaaguaggaaagaggugaugggaacucugaguuggacagugugacuagagcucagacugagggcgugcugagacuguuucauuucuacacaagguggcucacugguguggacagucugcccgugugucccuugauuccucuguuggcccuguggucucagccuggauccuaguuuguagauuucugaucaaaucacucaccuuuggggguacagagggcugggucacagguaagucugcaccaggagagggccagccaguacuuacuaaccugucugguuaaaugucugguuaaaagccauagaccauugccuucucaggaagguuucuccacuaaggguucugcuuccccaaagaggugaauaggaacaauuaaggcucucuaaacugagaagagauguuuagcucugauucuugagaaucaaaaauuuaaaaggaaggcaguaaucggugcugguggcagagcaauucuuuaugaguaagggacacauaggaguguaggaguauuuagaauuaacuuugagacaaugucagacagagaaccauaucuuggggcugaguugguaaaaugcuugaugcacaagaaugaagauuuuaguuugaucuccagaacccauguuuaaaaacacaguguguugguguaugcuuuuaauucuagugcuggggagguagagacagggggaucuuugguagucaaggacacucagcuaagccaauaaaugagcuccaaguuccaugaaacauacagcugucuccugagaggcucugccagauccugaccaaugcagauauggaugcuugcagccaaccaucagacugagcacagagcccccaauggaggaguuaggggaaggacugaaggagcugaaggggccuuaucuggcaucaaugagagggaggcccuugguccugggacggcuugaugccccaguguaggggaaugcuagggcagugagacggaaguggguggguggguggguuggggagcaccuucauagaagcaggguaaggggggaaugggauggggguuugcagaggggaaaccaggaaaaggaauaacauuugaaauguaaacaaagaaaauauccaauuuaaaaaaaaaugaagaugagggugauagagguggacauucaagguugacuuguauucuccacacgggcugcauccaaaugugcccacgcacagaaacagcacugugcaaugcuuaagucuauaucuuucuaagaagcagaucauaccaugaauauuuuucuucuuacugguugccuacaaaugaggauuuauagucucuuguucuucaaauauuaucagcucugaggugaucugaagggcaaguacaucgggugaaguuucuagucuguuagagcgagucuugguggaaucuguugaacacaucucuguuuccuugguagaguguccugcgagcugucugcaccucagaauggcggaaaagacucggcuccagacaucacugccgcgugggcagaucauggcagugaggcugaugagaaguucauucuggauccuuccgcugucuccuuugucaccucucccugacugucaacugcacagauggguccccacagcagccugaagauggggccacuucgagcaugcgagcacuuguggcugaguuccuacuuaauccucugcucuuguucucuccaccuccagaacuucaggccuuacuguauaauuuaggcagcgugcuucccuuuccuccuguccccucucuuccccgcccccuuucuccuccccccacugugguuuugauugugguuuugacuggggaguacagcacaggcugaagaagcaucuccauguagauaaauaugggaacucaccuugaaaucagggggucaguggauacacauagaaggaugggaggggaauuagugucaaauggaaggacucauauauccuuccugagaggccacucugccaccugagagagcugauggcuucagccccuuggcuucauagauguguuuugucuuucaugaaucccauuaucugaccucauaaggcaagaaccuaacugcauccuuguauaaaacgcucuguucuauagaaaccaacuuacacugaccccauagagacuagcacacaaccacagugucugguuauuuauuuacauuaaaagugauuggcaggggucuggggcugagagaggagugacccgucccugcacugggcguccgugccuuacguaugugugagcccaaacuguauaauucugaucaagaagagcaguggggaaauuguuuucaacuucccaccaacuucccuuuuucuguuuaacccagagguccuguguugguugucuugguuuguuagaaucugugauuaaguucaggauaucucccuggcuuucuagagcuuucuagauuaucuagggcucaugagugagagcuacaugauauuggacacuugccuggaucuguugaagcggcauucuucucuaaucugcuguauggccagagguuuuuaaauguucagcuugucuuguaacgagucaguaaacgguguucacugacauuucuguuuaauuuccggcugaauucaguagacucauacuuuauucagcauacuggaguuuuguaagugggauuggucuguaauuucccuuucuugcacugugccugucuaacucagacauauugcaguuauauuaacuuuauaaaaauacugugagaucuuaguccccuuuccuuccuucugggaaaaguuguuauaacuuuggaauuaugaaccuuuuagcugucuaguggaacugcucuagaagaccacgugagugugguguuuguuuugaagaggaacacuagcuuagcuccauuucuuucacagaucuuguauaagcuucucuuucacacggugcuuucuagacaguuuuaucuaagucuugaaguagguuuaauucauauuuuucucccaggauuaacaacucccccccaccacacacacacacuguacuuagagucuugccuccucuucaucuauugaaaccaucaacacuuaacacacauacauuuugguacccacacuuuaucucaguugcuucuggucuaaaaguucuguuuuucuccuucagucuuuagcucuaagucuacuacugauuacccuugguauuucuucuucaguccaugaguuggauuauuuugaggcuuucagacaagcauuugacgauguuuuagugcagaauucugguuuuccuuuugcggggucauaugugcacucaaccgaccccccacagaacucuugcuuuuccucuucccauuccacauuccccaaauauuccuccuucuccuuccauguccuauagaagcaugaauauauauguaaauacauacauauguguuuuauuuuaaaucuaaauuccacucaugauacaaaccagacaacaguugucuccagagucugguuuuuuucacgucccaugaucuccaguuccauguacgucucugaaaaugaaauaauuucauuuuuauggcugacugcaacuccauugggcauauuugccacauuuccuuucuuggcucaucuguugauggauguucaggcagaugcuguaucuuagcuauuggaaauaugugacaaucaccauggauguacaggcaacccuuagugcguuaauaaauuccuuccuaugucugccaaagagagugauaacagaauugccugguaaguuugauuaauuaacuaauuaaguaauuugagacaaagucucauuauauagcucagacuuuucuugaacuuguaguggucauccugccucugcugcauaauugcuaggaguacauguguaagacacaucacacagucuugcuuugagcgucuugaggaccgccauacugauuuuuacaguggcugcacaguaccacuguaaugguuugauugaaagaauacccaccauagguucauauauuugaaugcuugguccccaguucaugaacgauuuaggaaggauuaggagguguggccuuauuggaggaggugugucacugugugggugggcauugaaguuucaaaagcccucauucccaguugacccucuuucugccuuauguguauggaccucagcuacugcuccagcaccaccccuaccuuucuguuauuaugcucccaccuucuggaacugugaacccacaaguuaaauacuuucugaguugccuugguugugguggcccuucacaagaagaguaggaaaacaacuaagauaccaagugacagccauuuuaaguggaguacaauguuuguuuguuuaucuuuuguuauauuuuguauggaugaauauuuugccuguauccauauauguccaccacauauaugcuaugcuuguacaggcuagaaaagggucucagagucucugagaccggaguuacagguuguaagcuacuaacuguuuugauaccaggaaccaaacccagaucaucuggcagaguaaccaguccuccuaaccugugaaucaucuuuccagccccacccccacccaugcaguauaguuuugauuggcaucuccauguugcuuaaggaugcuggacauuuuguuuucguauguuuauugguuauuuguauuucuucauuugagaacugucuguucaauuuaguuuuccauuuacugauuuggauuauuuguuuuuuggguguuuaauuguuugaguuccuuauacagucuagacauuaauuccuucugcuguguacucaguugugcccuucccaugcugaaggcugacuccccauccugcugcuccccuccccacccuguggacugucuucccaucugccaauagauucccuugcugcacagagccuuuaauguucaugcugucccucugcaacuaucagaauuuuggaauuccuguuacgagauuugauccguuuugaguugauuuuuguauagaccaggaaagcaagguugaguuccauucucugauagucagauccucaguuugcccagcaccguuuguugaagauguugugcuuccucuccuguaugcuguuugacaccuugguugaaaaccaggcccgcugcgugggcuuguuucuggauccuccauuacauuucuguggucugugugucuguuuuugugccagcaccgugauggcuuuguugcuauggcucuguagucuaaguaggaaucaaguaugugauucccuccaggguuaauucuuccucagaaggccucuggcuagucagucuucaguacuuacacaugaaucuugguuuuguuuauuuauuuuccuauuucugugaagaaaguuauuggugauaacugcauggacuggcacauuagucauuuuuacuauguuaacuuugggaauagacaagcacgagagauguuucugacuuuuagugucuucuuuaauuucuuccuucagugucuuacuaugucauagacaucuuucucaucccugauuuauuucuagaucuuuuuacuguauauuguuuuuuaaugccacuaagaaugggauugcuuuccaguucuuaggaaguucuauacugaguauagaaaaccuacugauuuuuuaauuuugacuuuguauucugcuacuuugcugaaaguacuuaucaggucucagcaccgcuggagucuuccaggucuucuaaguguaggaucuguaggcuugcagauuuuuacagcaugacuuuuccuuucuuuaaaaguuuuuaaaaaauuauuuacuuauuuuuauuuuauguauugguguucugccuacguguaggucugugaagggugucagauccucuggagcugaaguuauucuagagcaaucuugagcuucuuccacagucaaugagucaugugguauugauggcaaggucuuagacauaagucguuaacaggacaguagagaagcaaugucccaucugaagagggcuggaucuccauuggccccagagggaagacaugacacacugaacacguuguccaaagaccuucaguuuuuaaaaugacagucuacugccacuggccuuguagaauacccuugugugccagaucauucuaagggaccagauuauuucucuuuaggcugggugagcuaugaacugucuuccacugcacucucauucaaagccauaguuauuuuauaaauguauuaaaaugcuucuacugcacaggucacaguaacuuagauauuugcauccaaggaaccuacugagcauuguguuaggggccuacuaugugggaaauguuucuuuauuacagagauauuaacauucuugggccagugaaagcucagaauauauacaaaggauuucuauauguacuuggguuugagaaguccucauaggauguucuuaucuuuccagagcauugaggugccuugacuuccaaagugcaggccccauagccuacugucauagauguagugggucaaaggauuacuucuguaaugguaauguccugggucucaguagaauaagcuaucaauugauguggccuugaggugaggugguaaauguauaacucuaaaccuugaaaggugucauaguuauuaguguucuaguuuugugaggagaugaccaaggcaaguuuuaaaaggaagcauuuaauggagggauuacuccauggagcaguagcuggaagaucacaucugaucugcaaguuauagucagacagagcgaccuaguauggacuuuuuaaaccucaaagcccaccaccagugauacaccucuuucuacaaggucagagcucuuaauccuucccaaucaguuccacuacuuggagaccaaacauuuaaauagaggcaagucucguuuuaaaucaacacacaagggaaaacaaacucacuauggaugguggcaauguugauuguucagagcaaauguguaauuuccagcaccaggcaugugcagguuaucaguuugccacagaaaugaggucacauuuagaagagacuugccauaaaaucauuaacuagagagagagagagagagagagagagagagagagagagagagagagagagagagagcagcauuaugaaacaucuaagaaugcuagagccaaacaugcccgguauugaaacucaugauuagggcuggagagauggcucagugguuaagagcacugacuguucuuccagagguccugaguucaauucccagcaaccacaugguggcucuguaauggguucugaugcccucuucuagugugucugaagagagcaauggugaauacauuaaaaauaaauaaauaaauaaauaaugcuuuuggaaacugggcauguggcguacgcuuuuaauccuagcacucgggaggcagaggcaggcggauuucugaguuccaggccagccuggacuacaaagugaguuccaggacagccuagacuacaaaaugaguuccaggacagccagggcuauacagagaaacccugucuggaaaaaaaaugcuuugggggaaaaaaaagaaagaaaaucaugauuagaaacuuggaugcagccuugccaucauggccaccagagacucucuuugcuggguuucucuccucaccucugcugcucauaugguugagcugacaaucuucauggaucuuugcuuagaaguggcuuuguugccuugcccaggcugcccucggagccaugggcuaaagaucuucuuaccuuaauucaccaaaugggacuguuccuaggggauucucagggguguuccuugaccugacauccagguucuucuuguuucaaauaauagggccaggcagacagcagcagcaguggaagcagaaaucacuacagugagaggaaaaugcagugugcacuccacagugggagcuggcuucaucaagcaggcaguucaagagcccagaacugucuagggguucuuuuaugaauuucauggaugaaagauucuauuucucaagggaaggaaaugggaguucccugcccagauugacugaggggauaguauauaacuuuggaugaucuaugugugcauuggcuguagggucuauggccauaagcauguguaccuccaucacacguacaccugagaugguaaauggaguuuucucuugacccuuugcuuucaggauagacuggcuagcaacuuacacccauuguguuuaagcuggccuuuauauuuuucauuucaagcuaguuauuuauuuacauguauauacuugugugggcauguggcagauagaggaaaaccuuuuggaguugaauuucucuguccacuaucuggguuuuaggcaugaagcucuguguuagaguuggugguaagugccucuaccuacugagccauuucauaggcccaaagcuugcugauuuuauaucucguaucaggaugugccugaccacaauuauucacaggagggaggucuaguguuguucuacuagaaguggggcagggcagaagccagauaguguauggacccccauauggcaaggggaaacacgggguucaucuucuagucuagauccuagaagagucaagacacaggguuuuauagggagguugggaugugguucguaguccguauuaacaguuuugaaggagccaucaauguccugacagcuuucugcaucagaugagaggaugggugagagucagguagguggggggcaaggaugagaguuggguggguauggcauaggugagaguccacaggugagagucggguggcuacaguggcugugggugacuuccuguuagugaugaggaguuuuauaggaggaguagagcuuuccagaaaguauuaguaauuaugauaugaaaacagaaagcagaugugcugguuguuguagcaggaagggaaggaaugauguguuuauagaacuaagaaccaauggcgcgccuuuuccauccuuccaggggcacagcaacagcauagccaagaacaacagagugggaagcagaaaaaugaacagcagcuucucuuaauuuucauccauauuaaaauccucuguucuuagauuuuugaaauaaaaacaacagcgggaauguagcugugggcuaaaacuggggcaauugagacacauuuuuuucugaaaacaagauuaaacuuuuuucucagguucauauacacaauuugaagcacuaaugaugaucauuaauugaaauucuuuuaucaaugauucuaagaaccuacaaauaagaacucuaauuuccugauaacaauggaccccaaagaaacaguaagauggcagcugauuuggguggaaguucauaucugcuccaugugaacuuuagaguuggggaaccaaagugggaagccagaaugggaaaaaugagagcuggcagaacuugcucgcaucccagaaggcugagucucuucuguuucagucuuucugggauugaaaacacacacugguuaucaaaugggaaacuaacuguacacuaucuuaguggaguuuugcucuuaccugucuguggcuguuguuuauuuugaugcccuuucuucccaugagaacaggccuuucguucuuuacugacguuuagguuuauuaggcuucuccaugggugugaaaggaguuugaaaaaccaauucuagagugcuaugcaccuuuuacuuaagaucaaggcuuaagcaaucuggaggauuggugcccaagggagugugggaccuuccugucauggagcucaagguguaaugcuguucccagcuagccauccucuauaacaggaaaaagucguacauuuuccugaucaaaguuuuacaugacauagaaccuuuagaaaggaagacucguagcuggaugugaugacacauaucuguaaucgcagcauuuggguagccaaggcaggaggauugcugugaauuccaggccagacuggaauucacagcaauccuggaauucacagaguuacauagugagacucugauucgaaaacaaagaggggaaagaaaacuugucacuugccauggagagauccaaaagccuggggaauaaaaacuuucaauucccagcgaagcagacuggcuuccucagagggggccacuggcaaugacagcccuggacuagagaggagacuagaacuaucagcuccugagacuccuagccagaggaggugacaaggccagaauagaguugguuuccaaaaauucuucaaggucucaccaaauauaaugaaacuaacuuagcaacuguacuaauauuuguaaguuuguuuugccuucugucuuuguuacuguucuagugcugccaagagacaccaugaucaaagaaauucuuauaaaagaaagcauuuaacuggguugguuuacaguuccagaggcuuagucuauuaucacugugguugggagcauggcagcaggcauguugcuagagauggagcugagagcuaaauccugaucugcaagcagaggugguggugguggcuggcauggacuuuugaaaccucaaagccagugagaaacuuccuccaacaggguuacaccuacuucaacaaggccacaccuccuagucuuucuaauccuucucaaacagugccacuccccaaugacuagacauucaaauggggcuguucuuacucaaacuaccacaccuucuaaauuaaauuuggugacaaaauucugaagucacaaauccugagagggucaggaggcaguucagaggaaaguaccauuuuggcagaguuuggguuuuguuugaacuggggccugugaguucacucguagguaacaacagugcucauucuuccaaccagggagacaggauggggauacaugcuucaggugaagaauuuccagaguguuccugaggccaguguguuccguggaaccaaucugagauaagcuuccaggaaggagggcagaguugccaugggaugggccauuuugugcucucacagugguuagggugcagguuuggccaucugggauaugagguuuuuggauuugucuuacagcuucuguagaaugugaucucugagcaggaaguauuagccugggugucauuuuagcugcuugcauuuguccaagaugaacauaaguauggugauccucuauucuagaagaaaauuuauucaggagugcccaacugaguuucuauucaggucagcaagguucuccuacuccacauuucccaaagauaccacaaacccgaagucccaguagccaccucccaaagauuucuacugggucuugccaggcugcaauauguugaaagaauuaauggcuucucagaaaguccuuuuagaggccacaauggaagaaacuccucgcuuuuuuuuuuuucugcccuuuggaccuuuccuucauuuacuacucauucaguuugugguguguguguguguguguguguguguguguacaagugugcugcugugaguagggagcacuguuuaccuuguguuuuugagacagacucagucacugugaccugaggcuugccaaguagccuaggcuagucagucaaugagucucagguguccuucugccucuguccucccagucuggccucacaagcgugcccaccacacccagaauuuuacauggguucuggggacccagcucaauccucccaagucuuguucuuuauuuucuccgagccuagaacaucucagaacguggugggugcucauauaaacuuauauucaagugaaccuaauacagaaaugacauuauuuaugaguugguagugagucacagaaacaaggguggugaauuaauuuuuucucauagauguccuccaagcuucccaacuuucccauaucucacucagguucuucucuccucuguguuucccuucccguggugauuugaaugagaugccuuccauagucugggaaacuugaacacuugguugucagcugguggcucuauuugggagacucuauuuuaggagucguggccuuguugaaggaagucuguccguccgucuguggggcaggcuuuaaggguuuaaaagcuacauccacccccaguuugucccucccugcuuccugcuggcucuuugugaacucuugcuugcugcuccauaccugccugcugccacaguucaccaccaugguggugauggacucuuuucucucugugaccauaagcccaaaaaaaaaaacuuucuucugugaguugcuucggucauggugcuuuaucacagcaauagaaaaguaaccgaugcacuuccuuucccuccaccccugcucugccuuucuccuccugcugcugaauucucuuugcugaugcugagugaugucagcgauagguuauuuuuccacaggugaaaggagccaauucaauccagauuagaauauaucaaagacagguuuauugggaagcugcucucgggugagcaaguucaauggccccaaggaccauugaagggaaguugcccuuggaagagagguggggugaggggaagagagaaaaagggugcuggcauagagagagagagagaagagaaggagagaaggaggaggaggaagaagaaggugggucuggauuauauagggaggaaccucugggggaagggcagcucagcuccugggcuggaaaaugcaggguugggggcaggaugugccagguagggacugagggaugcugggagaaccuggaagccaggucuauuuugauguaaaauaugcaccucaguaccuaguccaggggucugaaacccaaccguuggagugguuaaggugcucggccacugacuccugcccuuuauccuugucuaucuuguguaagcuucuuugccucccagagcaucuucugguaucuugcccuucucuguucagaacuucuuccacaugggugugaagugagcucugaaccgcgucuuucacgaacuucuuuuaacaguaacgcuuuggggcacccacaggugugaaucauggggacaagggguuggagaggaagccucauuccagcucauuccagcuaagagcccagaaguucagcacaccuagagcccuuucucacuccucagcucuaaaccucuauuuuucuaggauuccugcugccccccagaacccccauuuguacuacagaugugaagaguaaaagggggcaacguuucuuuuuuucccuucuugguauuucuuagccuuuuuguuuguuuguuuguuuguuuguuuguuuuuguuuuuugguuugguuugguuuuucaagacaggguuucucuguauagcccuggcuguccuggaacucacuuuguagaccaggcuggccuggaacucagaaauccaccugucucugccucccgagugcugggauuaaaggcgugcaccaccacgcccggcuuucuuagccuuuuuuauuuuucauauugagaacugucuguucagaucccuagcauauuuuuuaaagaauugaaaauagauauuucucucauacagugcauccugaccacaauuucccuucccuuuacugcucccaacucuccacacccccaucucccucucuccuggauuggauccauucacaucagaaaagagcugguuuccaagaaacaacaaucaaauucaacaaaacaaaaggcaaaagcugucauugugaggggggacaguaggagggaaagaauuccaagaggaggcaaaagagucagagauacugcucccacugucaggagucccacagaaauggacaccaagcuaacagccaaaacaaguaggcagagagaggaccuggcgccgccccagccacgcaggccccgccccagccacgcaagccccgccccagccacgcaagccccgccccagccacgcaagccggguacuugccacuucagagucugugagcucacgugaguccugcuuaguugauucagugagcuggguucuccugcguuguccauccucucugacacuuagaacguuuccucuuccucuuccucagggauccuggagaucuaagaggagggaccuggggcaaagcuucuuagcaagcuuggagaguaauuugagagccaccaaagcgguauugcugcccagugcugagaucuguaacugcagcucuaucuucaagaagcccacaccccuaaucucaguguuucuucuuuuccugagcccuuucuuuguguuuuuaacaaauuccaacucugcuucauauggaguuguccugaaauucuuuucuaugcaggagcuaugggucugguuuugucugaguccagggucucuggcccugcggccacagacaguuccaguucuguggaacaacaaggccccuuggcuucuguguagacuucuagccugccacgcggcucuccugacuccgcagaccuccuaggcauaucugggaaaaguuauccucugacuuaagugcugucuuacaaauugccugcuuccuugucuuaucagcucagugugaacuuccuuccuggucuguccagauguuugucauuccugccucggugccuuucucuccugugauacuuaagaagaggcagggggccucuuauuucagcuuaccuucaaguuguuuugaauuaacccacagguccguuuacagaucaccucacucugaggaucaggugugggucugaauaacuucuuguuugccaagauuuauccagcaccauuuuaacaaacccuuugcugugugaggaguuuguucuuccauguauuagguuuuuagaaauaguugaccaugacuucuauuuuccauuuaaucugccugugccuauacuaguaacucuugucagacauguuuuccauagaauguucuuugggcuuuguucauauuuauuuaaacacacacacacacacacacacacacacacacacacacacacacacacacauuuugcuauugaaauguuuuguugcuuuugaauagaaaaccccaguuaaaagaaacauucuaacuuuguaugucuguguguguguguguguguguagacacauacaugugcacaucuauacuuuguguguguagaggguagaggugucucauccacagcaacucuacccaccucuuuugaaacagggucucucacuggccuggagcucacaauugaacuagccaggaagcccugagugcugggaucacaagcauacaccaccacacucuggcauuguaaagucaguuucugggaauugaaaucagguccucaggauugcaaggcaaacacuuuaucaaaggagcuaacucccagcccccaguguuucugauuuuaaaguucuuaucacaggacuggcuaguugcugccagaugcuuuaagagccucugguaacacugaaggcaacuugucauagaaugacacuacaugagagcaaugugucaaaguccauccaucuacuuccucaugacugaugcuccuugggccagcaucagcccaucucccauucagccagucuguccuccaacagccuacucuacggcacacuaacugcugagguggacacaugcagcgucuuaccuggcucguucccaaagccuacuuccugucauucagcagucauauuucaaaacaaauuaacucuuuuuuuuuuuuugguagggauaaaaagcagggacuggugagauggcucagcggguaagagcacugacugcucuuccaaaggcccugaguucaaaucucagcaaccacaugguggcucacaaccaucuguagugagauaugaugcccucuucugguguguuugaagacagcuacaguguacuuacauauaauaauaaauaaaaucuuuaaaaaaaaaaacaaacaaaaaagcagcugccugguggcccacuuucauggauuccucuucuaauucauugguucucaaccuuccuaaggccucaaaucaggauugaggacagaggugagaagggagccucagacucagaggucaggcuauaauaacuuauuuauucacaaauaguaauaaauagcgagguggaauugcauuuauucacaccacacacacacacacacacacacacacacacacacacacacacacacacacacacuucacuaacuuccggucuggcccuauauaguagucuggcuugauagcagugcaucagguaaggauugcgaagucuccgguccauggugcgagcuccucuaguucgacaguggacauuugggucgauggacuggaugucucucucucagcacgauggcgucucugugggacuccggaagugagugaguugcaguggccagacccggguauuuaagcuacuuuuagccaaucauaauuaagguguucacacauuccuucaccaggcauugaccuuacuucaucauuaucagauucgcacacacucuaggcuugguuuccaugguuacauucauccaugguaugauguuuacaucguguuccuugcagcugcaacccuuuaauacagcuccucauguuguggugacccccaaccauaaaauuaucuuucucgcuacuucauaacucuaaucuucuacuguuauaucugauacacagaauaucugauaugugaccccucugaaaagguccuuugcucccugaagagggucugaacccccagguugagaaccucucuacagagaaauacaucuuucgcuggguuugucuaagacuguguuuugugagaccauccuacguuuuucacaacccucuggagcauguuguaccauuaaccaccugcauuuaccgaacacaagaugccgcaugcuuccugaaacucacaccaugcagggaggccuguccuuggacucaugcugguguucccuguaccaucugccucuucuagcucuuauuuggaguugcauguugggcaguggacugugccaggaaacgugguaugguugaguggguuggaagcccuggaacuucauaccagaggauggcaggaguuucacuugcuuccgaccaggacccugucacaugaccacagcaugccauggaaaggaucaugacaaucacauaggagcugugccccaagucccuuuacaugcagaugaggcaucccuaacaucauagaccaagcaaauagaaagcaucugcugccagacuccaacccaccccaaaaacauauaugagacccuauccagaagaauggauauccagaagaauggugugagaguuacuccaucacugagagcuucugucacagaagagcuguaacacuuccugggaaagaggguucucuccugaaggcugcuagaagcugccuggacccaccucagucacuugccaucagguggcccagaccuuggugguucagucccagcagugggagcagugguggugguugcccuucccucucccugcuuguguggccagccugccugcuguguagcaaugucuugcuguagcagcugccacagaugagaaccucgauccaacucccuucuucccuuugcuuaaaugcuaccaauggccagagcccccacagaucuccaaggcuaguguccgguauacagacaggcaguugcagggugaaacccacagcuauuuugcuucuuauuuugcuuauguuaaaaccauagugcccuuuuugacugggaauagaguccaguguuucuaacuuaagcaaaaguauuugugcacuccuggggaaggcuuacuucccucugcggcccuaugguuagaacaggagacuugauuagggguaguuuucucuucugaguccaucccugcuuccccaggagugguuaauuuuugacuaggccuagcauacucaaucuuuucucuaguaguuuguccuuugggugacacauuuaagaagcaauugccuaaacucagaccacaaagauuuauucuugcauuucaacuccccccaccccuggguuuauaguuugggggggggucuucauuuacuaccuguagcuccaauugcagggaccugguguucucuuccuggccucugugggaacccacacauguaugaugacauaugcacauauacauaaaaggagaauuuauaguuuucaaauuuucauguaggucuuugauccacuuuaauuucgucuggucugacuggaaagggacauuacaaauuucuguuuggcccccgccuuucuuccauuucuccuuguuucucuuuucugccuucuguccuggaaguucuauuucuucuuuaguuugaggcaagguuuuacuguguggcccuugcuggccuaggagucaugaucuagacuaacuugaccucaaauucacacacaccuaucugccucccaagagagguggcauugaagguguggccaccaugcuuggccuaaccagaagcucuguuugaaugucaacauucaauucauaagaagaugcugaagcacccucccugcacaucauauggaaaacacaggcccauauucaguguggagaacacaccaugguuguuuuuuuuccuugauuaguggcagagucuaguugagcucguuggucaucguuauguagguuacauugaagagcagggggcugggugaccagucgagacucugugguggccaaaacuccacguccuauuaguucuguucugcuuggacgcugugcagaauacaaugcuguuuugcaggcaaguaggaucccccgguaugcagcuauaaacagccgagagccaaugggcaggaaaaucaggcugagcgcuaagccuguacuuaagaggggacucuuccagugaagggcuacugcugaggcugcggaaucccauugugugcuguugucccgggaagagagaaaacagacauuguugcguuucugucauaaugagugugcuuacuuuacuccuggccacaacaauggacuguggggaugugacucaaucugccacacaagagaaauccugaaaaagccagguguggggauccggcagagguucuuuguguugauuuccagucaaagugacaaaagcuaauucaaaucuucuguaaauugucaaaagaagaguggcccguuuggcagcuuuugggcaggcauguccuuccugaggugugugggcucugaauauccacagagcagccucauccaggagccacuggggcuguauaaccauggcacaaagaaccaugcacauuuuccgcccauggauccacaugaggggacauuuugacuaaaaugacuuucagaagcugcggucaggaaggacaauggagccauaaagugucugagcuagguccauguguuuugauccacaguuaucgucuuaguuaaggacuugcugcugugaagagacaccgugaccaaggcaacucuuaugagaauaacauuucauuggggcuggcuuacagauucagagguucaauccauuaucaucguggugggagcauggaagcuuccaggcagggauagugcaggaggagcugagaguucuacaucuucauccaaaggaagccaggagcagauugucucccucauggcuaagaggagauccuaaaaauccacccccagagugacacacuuccuccaagaagccauaccuacuccaacaaggucacaccuaauaaugccacucccuuggccaaguguauugaaaccuccauagucauuaaaguaauaguuguucauuggcauaacaccaucucauauuaccaaaauaaaguucauucgaguaauaaucuacuucaaaguuaaaaauccaguacuaaccguuaccuacaggugaaaaggauagucaaaaaagaagcugaaauuccuagacuccugcuaucaggcuaaugggcacaaguuagcaugcuucaguugauaagaagggcagcgagugggagcuagggagcuugaugcaaaucuuaccaccaguccaauccacucagcaaaccucagggaaggguuggcuuugaaaaucagccacagccaggcaugguggcacacgccuuuaaucccagcacuugggaggcugaggcagguggauuucugaguucgaggcuagccuggucuacagagugaguuccaggacagucagggcuacacagagaaacccugucucgaaaaaagaagaagaagaagaggaagaagaggaagaggaagaggaagaggaagaggaagaggaagaagaagaagaagaagaagaagaagaagaagaagaagaagaagaagaagaagaagaagaagaagaagaagaagaagaagaagaagaagaagaagaagaagaaaaucagccacacaaccuaacaggguuccacaguuucuugaucauuuaaauaacaaccuuucuuuguuuagucaugaggagacauuaggaagauaugaagcaacaaagaccuaaggaaaugugcucauuagaguucuuucuguguucuugcaacaagaggcccgauggaggcaauuuaaggaaggaugggcuauccuauccgacucauaguuggagaggucacugugguggcaggagcaagagacucuagucacaccguggaauagugucauccauauuuugguggcuuuuuucacaucgguuaaccugauucagaaaaucccuauggagaugcucagaggaucaucucuggguugacucuaagucccaucaaguugacaaucaggacaaagcaucccagcgucuuuucuucucuaccacccucgcauauaguuuguuagcugucagcuccaguggaaagcaaucugccaggaacugcacacaggagccuguaagaaacaggaacccagaagaggacugugugucucaaguggugcaggggguggaggggugggggugagggggcauagaaucaccaguugacuucuucaaaaugagucuccuauaggugacaauuuguacuuugaccuagcuaacucggggaacccauggggucuucucacaggcuauaugugugucugcauggcaggcaugccuuugauacaucgcaugcgcugaggcacuguuuacucugagucuguccuuuucuguuccuggcugucucuccacugacugcugcucuuuguggucaugugaucccugugugcuacacacaguggucuugggcuaaggagacuugaaagugguucagugucuucaggcuucauuguaucagagggguaaggaaaacccacggacaacuaacuaaacucuaugaagcagaguggaaccacgugugcuuuagaaagccuugguguucacuggcacaggccucaucagugccagggcccugggggaaucagaggauguggagggcuaaucccuacuccccaccagccugggugagccugcugcaaggagacacacuuuugcuagucuccuuuccaaugagccaggccugguuuuuguaugaguggaaauuaaauccauaagacaugguaauguuaaauaaaacuccacgagggagggucaauauuaagaaaaaugcacuuuuaaaaguguaaacuucucuugccuagaaaggaggauauaaccccaaggagggaaacugaugagagugauacuccuucaaggcccucaggaagagagagucuguuaucgugugaggcuuugccuggugaguaagaguccacggccgggccaggagaaugagcucugcugcuaagcuuucgauccuaagccaggcacucagccaggcucgcuggcaaagaugaaggaguugcugauccuuaacagacgcgagccuuagcauuccagggcucacguucugugcauguuaccucuucgguugaaccagaacaggauaucuggcucucucccuuucccugcaucuggguggaugucuucuucaguugcaucucugggagguauuagggagucuuugauggugggaaucacaauuagguuccaggagaacaaagucuuauguauguuuaugugugcaaauaauucugagagagggagaaagaaaaguuugagaagagaggauugugccggaucgugagugaaucaccuucgcuucugcacgccagcaucuagcaggaccuggcugaaguuguaagaacauucauuaggguagggaagaaagccuguuccauggcugcucaguggguggaaggagaagggacauacugaauaugagagaugaccccaaaccccuguuaacacauucccacuccuaaagcagcauucugauuuugaaugagccuaugagauggugcagaguuuuauagaggcaaacuauguggaaauuugguacaaacauaauuuuauuuuuuagaaaacguaccacccugacuauaaaaagcacuacaggggcccgagaguuugcuuaaccuggaaaaugcuuggccucacuuucauccccgagguccacaugcaaagcuugggcagggugacacacacucguaaucccagggcugagggggcagaaucaggcugaucucugaucucucuggccaucuaguguagccuacuuggcgagcucuaguccaaugagagacauagacucaaaaaaaaaaucaaggugguugacucccaggaaaugauacccacaguugugccaugggcuccccacacaugugcacacacuaucguucauacacacaccugcaccugcauauguagagaaauaaguacuauuaaccaccaagucgucgcccuggcucacuucauucaauuucucuacuucuggcacagcuguaagccaaugaugggaauuauacucaaaguucugauuaaaaaauauuauucuguuuguuuuugaaauaagauaugacucagagaaaguaaauacaugagauaaaggauaagauauaauguauggaaaaauaaaugaauauaaaugaaugaaaauuugaaaauaugucuuaucauauuccauaccuaaugucagugccugccugucccaggagccucagcggcugccugacacagccuaacaguccccauuuucuacacauacacacacgcgcgcgcacagacacacacacacaaauaaaaauacuuuuuuuaaaaaaagaauucuaucuguguuuucuuauuucaucuuuugaggugaaaauguauuaauuagcauggaauuuaagaauucaacagguggauuuuccuccagaaauuauuaacauguaaaauuauaacaugggauucaaaauuauauuaagguaguauaauuuccuuuguuauguuuauuucuuuccagaauuaaaaaguacacacacacacacauauauugcacauuuagccuuagaacuaaugcauagucacaguggcgaugggauaagagggcuggguguguuggcacaaaucuuuaaucucaguacucuugaggcagguaggcagaugucugugaguuuaaggucaagcuagucuacagaguuaaguuccgggucaguuagacccuaucucaaacaaacaaacaaacaaacaaacaacauauuuacaacaguugcaaugaaagaaugaguuuuguacuuagcugaaugaaacauaauuaggaagauaguuccuaaagcaauuaggaagcuaauuaaauauaggugaaacaacguggcauuuaggggcuugcuuuaaaucccucaauguugaagagagggagaaaaaggccacaggcagggugcuguauuguauguauuguauacuggcagauggcuggugagacuccacauaagacaugguggaaugcuuucucuugggcccguggcgccggcaagaugggcaagugucguggucuccgaacugcccggaagcuccgcagucaccgacgggaccagaaguggcaugacaaacaguacaagaaagcccacuugggcacagcccugaaggccaauccguuugggggugccucucaugcaaagggaauugugcuggaaaaaguagggguugaggccaaacagccaaauucugccaucaggaagugcgucagggugcagcucauuaagaacgggaagaagaucacagcguucgugcccaaugauggcugccugaacuucauugaggaaaaugaugaaguucugguugcuggauuuggucgaaaaggucaugcuguaggugauauuccuggaguccgcuuuaaggugguuaaaguagccaauguuucucuguuggcucuauacaaaggcaagaaagaaaggccaagaucauaaaauuugacaauggaaacacaguaauaaauuuucauauucugaaaaaaaaaaaaaaaagacaugguggaauaggauugugaugugguuaccuuucuugugugugugugugugugugugugugugugugugugugugugcgugcgugugugugugugcgugcguguguguguguguauauguguagcuuuauaagccaccucucuaaaagauggagauacaaccaaggccacuuucuguuucuguuuccaagagaauucuggguuuuugaugagaaaucugccacauuggcucugugucccauaaaugaacaguaagacugucuuaauucagagguugcuaacuucaccuuguaaagcugggauugugacaucagucuacuggcagccuaaagagcauaauguaggcuguagguucaagagaguugccugacaguaacuuuuggagguaacuuacugggaauuugaauugcugucuucauuguagguaacugcucuccuguagcaugugacauagcugccaagagcaggacacauguguauagcugcuuucugccuggucugaucaugacuagggugggcuugucccugagggggggggucuccuccgauugaugucaauagcucugcccucauccugucuggccccuccccauuucagcacuguuguagggguuacuaugguccagcagguauauuggacggaugucagccacuugcugaggaugagcacucugggcguggggagcguuuccucugugcauguugcgacaugaaccuggccuuuguuaaguacauauccugucaguccagaucaaugugcugacucuaagacacuccagggacaccugcaaugaguuucugaugacacucuaguucguuaagacaaaagcuuggcagcacccuugaaucucucuuacuccgucucaggcucccaggcaacagcaaacuuacccugccaagguacagugagaagcacuccgggugaccugucuagucucggugacuugguugugcuccuuggccuaaccaacccucugaaaauaucagagacauacacuuuggcugagguggagacagagagagugaaauguaagauuagguggaaacucagcauucagacgugacgcaagcuggggcauuccaggccagacugggcuacacacgaaaccugucuaacaaacaaacaaacuaaugaacuuaaaaauaacauaaauuuagauagaggcugaggcccuugggcuguuguuggccuaucugcccaaggcaucaaacaaaaccaauagaaccacaagacaaaaacuugcuucugcuaccggggcugugggggcugcgggggcuacggggacugcaggggcugcgggggcuacggggacugcaggggcugcgggggcagcgugagcucacugauuuuguacuccugacucauucuuaggguagucuggcauccacuugcugugcccccacagccuuccuuugugaccccauggccauggagcaaaccugaggggacucuaagucucucuucugggcccagcuacugcacuucauuagugagcauccugaguccugugguaacaauuuguaaaaguccuuugaggugaaaggcaaaucauaaauauuaauuauagccauuguuuugaugaaaggaggauuacuggaggcacaggaaccucuaaaucuaccuauuaaacuacguuccaccucucaaguucuugaaggaggggguuaaauuauauuagagcgaagucucugggauuccgcuguggucgaagucuaaugaaaggcccacuuaucgcaugaccuguguagagacaccucccaaagcuuucagaggccuuuuccugagagagagagagagagagagagagagagagagagagagagagagagagagagagagagagagagaaauucaacaaaggaacuccaagcccuuaguguguuucaucaggccugcagcaagagccagcucauuggcacaaagcuccagccucuaguguuaaaacaaaucccagcuccagguugaaauuuuuaaggaguguaaaccacacuuaacagcuuuugaaguaguugugaaacugaguagaaaacuuaaauaaacauuuuuuuuucauauuuuauacguguugcuauggagaaaaauaaugagagaguuaccagugacuucaucuggaucaaaaauguuuuuuuaaaguccggcuucuuugguuguaacuaagcugguggaaggugauaguuacuaacugucccuaugaaaugcuauuugcucaagucccagggcugagaaagaauagaaagaccagcugccaugcuaaaggaaacuuauuuagaaaggugaacagguagggaucauguuuuaguuggaauaugggccugucuaaaacuaccagaccaauggcucgagguuugguuuuguuuuuuaauguaauuuucacauaacagcaauacauacauauauauaaaauagccauaguuuuggugaaaggaggacuacaggaggcacaggaaccucuaaaucuaccuauuaaacuacguuccaccucucaaguucuugaaggaggaggggguuaaauuauauuagagcgaagucucugggauuccucuguggucaaggaaugaauauguguguguguguguguguguguguguaugugugguuuagaaacaaguuauuguguuguuuagaaacaggguccaggcuagccuugaacuccugucguagcccugaacuuggaauccuucugcauuccccuuuugaguucugggauucaggccugccccuggacccugcccacagacaaugauuucauauuucuaacgcauagaacagcaaucaucauuaacacuguauugucucuauccauuuauucauucacuaauccaucuauucacauauauuuuuaaaauuuuauuuauuuuauguaugugaguacaccguggcugucuucagacacaccagaagagggcaucagaucucauuauagauggcugugagccaccaugggaguugcuggggauugaacucaggaccucuggaagaguagccaguguucuuaaccagugagccaucucuccagcccacacuuauucauauuuuuaguaaguuacuuaauauaauaucuacuauuuuauaacugcauauugucacuuaacaugcauggaucaucucaucuaucucaggcuagccugggacuugcuauguggcuuaagauagccuauagcuuuaaggagugcuggggacucagaccauguauuugugcauguugggcaagcacccuaccaagugagcuauuucucuagcccauaaaccucuuuuuaaaaagccuauaucaucaucacuuuucuacaacuuccacuccaucuagaagcacauucccugcauauagucuccucuuugggcuugcuaauuucagcuaauacuuuaucagaucaucaaaauccaauccauuugcaaguucucaauggucuaauuuguauucacuugcuaaaaucgcuggaagauuucuacuuggaauagauagauguaccaaguaguaagguuuucuaaaugaaaucguuuuaucucuuacaagucauucacccacaugugcugccugcagcccacuguaagcuaugugggugcagaaguggaaaggagaccuucugagguucaugucuggugccugugaauuaacucacaagagaacaguuguguucuacauucacacaaguaagcuccaagaaaagugaaaaucccacugguaauuuggaaaggcagcauguuggcuuugucucagaaccgugaugggauggaggacgauuccauccuagauggguagaaguagggguugguuuuagaaaaaguaugccaaguuuguacaugggaagaagagucauagggcuuaaaagagaggauguccaaaaguuagaaaaagaagaugcaaaucuuggaggugguuuuaucacaggguguggcauauagacuaucagaagcacauggaagagaacagugggcccagagccaguaaaaagaaacuggggaucaagggacaguucugaugacagacccuaagcucugggucugucacaauggaagaguggcucgaagucaggagggugccaggaagggcauggcugcaaacagaccugagauaaaagcauagagucaaaacugagggucugugggaagcagauguaaggguacgcaugaaaggugagcucgcaggauggcuaacaucuggauuugcaaccauccaugucaggcucaguguacccagggucagugauggcuagcuggacagucaugcaaaaaacaaggcugcucccgcacaggugaucccagggcuguaaauauguggucucuguuacugaggugagcagaccagacaguucugagggagagagcugagccagggaggcuggucacuggcuuccugggaacucuugcucauuccugcuucugaccacggggguucguuccaucaaacagaaacagagcacuucauuauguccaagaggaaccgaggagguguuccaagauguuugugucaaagcugaacucuuugcugcugcuuucuugcuccugauagaagaucucuauggaauuuuaguacaacgucccugaagcucauuagcagaaggucuggagguuugaacauauucaguccaucaaaccaaugaauaacucugacuuacauaauuuaacuaucuugauugaucacaauagcuacaacuuccuucagugucucaucaaauauuaugaggauucaaccacuagcuaagaccgaugauggucugucuggugggcauaaaaaaaaugaggagccuaaaucaggauggauguucuaggaguuaagguauauuaggcuguuagauucaaguuucaagacuaugauucaaguuucauuuguuuguuugcuuguguguuugacacagggucucaguacaaagcucacacuggccuugaacucaugauauccucccucagcuuccugagggcuagagucauagaccuguguaccaccacaucuggcucuccaauguaucauuguuacuguaacauuuucuuuaugcauuuaacuucugauucucagccauacuacaggaagguagggcuguuccuauuacuguuuaacaaaugagaaauuugacucucaagucacuagcuaggcauugugguacacaugccugcaagcccagcauuugagugucuaagacaggaggauagugagaccccugggcuuauauacucaauuccaggccuucccaggcuacuuagugaaacacagccuaaaauuaaauaccaccccaaacacacacacacacacccucacacacacacacacacacacacacacacacacacacacacacacacacacaccccuuaccaauccaaagucaccaaaguaguaaaugacucaaccagaccuauauccuauaucaauugugugucugucugacuccagguucccugauuugucacuugugucauauuuauguacugggguauggcauuaacauggagagugaguaaagcccucuuccugucuuuaaugauuguauauuccaaugcaggaggcagacaagucaaugccacuacaaucagucaaguagaggucucuggaguucuucacaugucccaugagaguacaggggucacaucuggugaacucagggcuuccagcuagagagaacaaucucagcucagaccagcuugguggcccaagauuucugugccaucuuuaugguauucuguuuuuggagggagguuuggaaugaggaugauucuaaauguugaaaaagaauggcuaguacuauaagaguguuccagaagcuccgccuggcucaggguguggugugaaguuaggcauuacuuuugaaaggcuguggugaaccugcaucugguuuccuaagcaacuuaccaguggccuguguggaagauggggaugugggagcagcuuuggucaaaaucaguucuaccuuuuuugggggggguguucuugucccuaggagacuacauuuuuuucuggcauuuaaucauuuucaucauguugaagagacuuuuaucauuuuuuaauaauucauuuuaugugcauggaugcuuugccuuuauguaggucccugugccaccugcacaugccugguggccauagagucauaagagggagccagauccccugaagcuggaguuacaguuuccagcuuccaugugggugauacgacucgaccuggguccucuagaacagcagccagugcucuuaacugcacauccucucuggccccccaaagagccuuuuaauuucuuugccuuggcuauggaaucuugucaguaugagauaccaugcauggugacacuaaauucagagagucuauggguucugacucuuucuuacaggaagaaauuggcuuuuccagaccugguagccuggucuaucucagacaucuuccuguucaaaagucuuuucuuugaguuggggcuucgucaccccaucuuucuccagguuacuacgcuuaaagaagagauuguguuauuuggcuguaauauuaguccauuaggagucacagcuaaauaaaaggaucacuacuaaggagaccagaguugaagggagaggagcguguggugaagggaaaaacugggcaagagaaagcuugagucuccaugaagaacuucaugaaaauaaccaagagugagguuuuggcuaaggcucuuccagcaagaauucuguauacugcgugcugaggaagaugcuacaguuacgguaaaugaccauacagccugucuggcagcugucuccagugcugcacuccccuucaaagcuuauuuaauuaugaaacaugaaauauaggguguuuagaguacagcuuuuaaaauuucuauuuauuauuauuaguacuguguguguguguaugacauguggacuugaguguccauguguugaggccagaugacaacuuugugaagcugguuucuccucuaccuuuaagguguguuccagagaugaaacucagggccucuuacuuguguggcaagugcuuuuauaggcugagccaucucauuggcccuaguuuucuuuaacacacacacacacacacacacacacacacacgcacgcacgcacgcacgcacgcacgcacgcacgcacgcaccugauagaucauggugaugcauacuucuaaucccagcacucaggaagcagaggcaggcagaucucugggagacggggaagcugggaccacuuagaaacagggucaagaaaaaaaauugaaaaacaaaucccccuauucuauuauauauauauauauauguauacauguuggaguaugauggaaauuaugaagcguuggugccuggguuccagcccugaauccccuguaugaacaaagacccagaaaucugcauuuggggauggugcuggagacugaaugcagagccucgggcaugccugacaggagcuguacccugcagcugugcuccggcucaggcaucugcaguuucacagaagcuucugaugcagaucccgaggcagaacagagaacagcagcuguagaacauacagggaucugaaacacccaccuucaacccagacucucacuacauaguucccaugcugcuuuaaggcaauagugacuuugcugcgggcaauuucugguugauuguggaucagccugaaggagcagaguccaggaucucacucucagacguacagucggaacuggggaguccaaauguguacacacggucuucugcaaggaauacugcucuguugggcugucuuaacuguauuccuuucccgacucaguucuugguugcgcugguucaaaguguaagucuauguuaggacagacaaaaggcgagaagcggagagagauuuugcuggggguggguuugucugaaggguucuguuuguggaguacuuuuuaaaacuccugcaucgcuuccagaucaccccugacuuccuuuaccgcuuagacauucuuagggaauucuuccugggccagccacaucugcuuccaguuccugggcuggucagcugugccugcagaagguugucugccucucagacugcaggcgggaacccagcucuucgcucccaccgcuuucgggcagguagagagagaaagcucauagcucagguuuuguuaccaagcaacgggguuccauuugccaauugccaccauuuccuucgcauaguauuacaggccuuauuuuuaacauuuaguucagagaaauugccgucauuaugcgcaguaacuuccuuuggagguuacucauuaaccuuagguauuuuacuguguaauuauaacugccaaugccccaggcuuggaaaaccuuugaacuccuuaagguauuagggggacggcagaaaggauauuaucugacuuuucuuccuuuuccaguuagguuaauuucggaggugccuguguccccuccucguucucccucccuccaaggggaagcccuuccaguguuuucuuccuccuuucuggucucagacucugaacuaaaccuguuagcguccaauuucuuugauacugggccacaguaaaacuguuuccccuuuguuuuauaaggucugggggggaagaggggcgggaggagacugagaagucccaguggcugggaagugacuggcaggcacccuucggccucccggggcucugugaugccccccuacacaaugacuggaauuagauaucgcguacagccuucuuuugacacaacggaaggccuccucucggcuuucugcaagcagcuuuucacucccaggcuccgcgggagccaggugcauagccucauaaugcgccuauuauacagccaggcucagucgccauggcucacacaaugacccuucugaucuggccacaacagcagggaugggugccaaggcuucgguccccacccacagcagauuuagguaugcacuucggguguauuugcagccccucuuuacuacccccgaaaggagaguugaaugcauccccgugaaacucccccccccccccgccccaacucuguuucaagacaaacaagaguaauuggggcacaucaccugcgcgcgcagcuccaggucuuucuggccuccgcccagacauuccagguaacucgaggagggcugggcggccacgugacuguguuggcuagggcgcaccuugcuccagcagggacaggugagcucugcacccuggugggagcaugcauuuugcaaacucaggucugcaccgccccacugcugcuuugaucgggacaaaugaaaggcuggacuggcauuucggcuucacggagcugaaccgcagcauuccagcagguacugcaagucucacggaggccagagcgccacgcugcccgcucccuccaccccccaaaacgagcauccuucaucuuccgaaugggagggggcagcgagggacauuuugcuuuacuucaaaaggcucgaggacuugcagcuuuuucuuccccacauaaagggcugguggagguuucucugacgguaggaacauguugucacacgugaccuaaacagcucagcugcuccagcgccuauuagucaaccagccaacaccuaaagaaccugguguucacucagcuuaggagaaggcuggcaggcacaggcucugccagcccaguguuuauggguuagcuaaggguugaggagagaccugugaagaagggaaacagauaccaucugugagcgcugccuagugccagcacugugauacccucucucauuccuucugacacucugucagguaggucuugguuaugaccuccacuccaggcauuuuagagaggucauuugccgaagcucucagugugggcaucaggcuguggaggucacaaauguuggagucacggggcccucuccuacccacaucaguuuguccuaguucgcucucuggaagauagagaccuugucuggggucaugguccagaacauucuuuucccauuucacugcugagcugggaugacagaucauucuuuagucagggugccccugcccccacuucuguuucuuuugcuuuggcugugcuggggagacacaucccagugaaugucuucuugggcagcaggugaucuugucuugcccucucugguuuuauuucagagguggagaguagagaccucacucaaaucugggaagucuacaaagccaaccuucaccagaugaucuccuaaaucccuuccuccaaugucaaugacagacacccagugcagccacuuuccugaaagauagucauguacagcccaugucucccugacacccuaaguagagcuggucuacuauccaggcaucuauaacucaacuugccacaucuggucauucaacuccugcaccauaccucaagagccugacaggaugugguuucucaaguaggccaacgucuugaugccuuuuaauaguguggagcccgagccaauaggguuuuaugaguaucacagggagucacauccuuugaccugguauauaaucugacuucucuggauccugggcuaauuacggcaguuccucugagcauggaugaauaggaaaccuucugauguuugaaaacuaagcccauccaucauauuuguucucuauguugugucuuuagccagccuaguugguggggacugagaccuccuggacauugcagcuuagacucagucccucuugguugacaguucagcgcuuggaggcugaggguuucaucuuuuuguucacugagcaccucugauuaugugguaaauuggagaaagaacaggaaucugugcucaccagccucaucccaccacggccacggccaccccuguaagccccaguuaccucaucuugaaggaaacaaacuaaaacguggcuuuaaaaucagagcaacucuugcauguuauuguaugauuuuguuuggauucaggugcucuggcuugcugggacuuuugugcaagguauuagguugaaaucaaaagggaaggaugcaggacaaacccguuucugcagagcagauggcugggcugcagagaggcuacugagacccauuccugcuuagccccaggaacuggccgguugcuccugggaaguacccaggaaggaucggagaaaucugcaaaugaaguuuagcuccagacacugguugccauagcuguuggaucagaucaagaaaacguugcuucauuagaauuugagagccaaaaaucaaugguuuugggaagcagauucacuugcagcuaugaauaauaaagacugaugauacagaaauguaaguccucacauaagacucccaggaagggcuacucagagcaggugcucaagcuccaggcaugcucagggacccaggcugcuuccaggcuuuggcucucgugucccaaagcaucaaguucauucucauaguugccuugggguccaagguggcugccagacuccguccacugcacuugcauugcaggcucagcaaagucagaagaaggaacagcaagagggaugugcagcccagcugggccagucuucccagcagucccuugugaguuacaccauuggccaggacucagcacgauacagucucuguucugggcaguguacugggaaucuggaagaguuuucuuuaaagagaacauggcuagagauugacagguagugagggucucuguguuaggcaugguccuuagaacucuggacuggauucauuuauuugguagcaaugagugaagcacugggggcuggauggagggaaugaagacuuggacugcagggaccauggcuggaagggaagagucugacaagguuugcuagcugaauugagaaaucgggaacagugccaaagguagauggugaugucauuaguugacauuagcaaggaagauccuggauuaggagucagacuugcugacuguguccagugggcuguccugcggcuggugcucagagcuguugaggguggacauuuccaaugcauacugaaccuauuuacauauuaagaacauucuaaugucuguaggaugucuuaacauguauuuugggguuuuauaaguugcuacuuagggcucucuuaauugugucagaggaaggguauagggcugccucuuuuugugcaauaucacugggccuaaggguccugagagucggggcaaaguuuuguucuugaaaaggugcuucuccuuugccuuccccucccuugccuuuaguuccugccuauguggugguuggaagcaggagcucagugucccagcgaaaaaaaucagaauaacacaaaucugaagaugauggccugcacauuguauaauauuuaaauaaaguuugaguguuuaaaccaacguuugaaguugagcaauauaaaccaaaauagucugccagcacaccagugcuacacaggcacuaagugcuaagcaaggcucuuaggagucaggugggaauggccccuaggcaggggugcagccccgaccuuacccuacaacaacagcagguccagggggcuucaguuccugccccacccccagaucuucucgugcuaggugccucuugcaagacaagcugaacugugggaaccuuuggagaggaccauagaaccagccagggauucccuaaaacgagacagacuggcagauuguguagggccauggagaaagcucagugagcaaugugcuugcugaauaaacgugagggccugaauucgagccccaggaccuacaaccuaugucaagaaaggcagguacauagcucuugggaggcagaggcaggcagauuucugaguucuaggcuagccuggucuacaaagugaguuccaggacagccagggcuacacagagaaacccugucucaaccccaccccccccccccaaaaagaaagaaaggcagguacaguggggcacuuguagucucaaugcuaaggagagagaggcaggggauagccauguggcucacugcaggccagccuugcuaagauggugaccccagcccaaugauagaccauggcucaacaacaggagggcuccugacaagugacacucaagacugacccucaggcuucacccucauggacacacaggcaggaccaucuuccacuuuguuaaacacagaccuguaugaauugugugcuguucaucaacuguuaauuauuauagaacugggugagucgcaggucaacgaguggggaaaagaggaagcugugggcugagggauggagugagcaguucuaggaaacacugugucucuagaggaaacguggagcuuaaaaagauacccucuggauauuuuucuuuacagcgauaugguaaguggucacuccucuggccacauguugugcaugaagcaguacagacauaggguagaguggcaugugagagaaggguuaaggugagugaggucuugcuggcuuuccagucagucuugaaggaaugcucggucuggcagaacccuacuuugaacagucuguuuccucuccugacacaggucuuggcaucccuggggaaguugccucgaagcccugaagcuggaaggggcccugcugcuccagcuguguaacccuuagcuuuaucugucuggcuuuggccucuuagguuuguccugccuugguuguuuuguuuguccaaaugguucuguucuuagggugacacauaacagcagcaucugauugcuucuucugaagaagaagaagcaggaacagguuugagaccuguguugcugagguggcucauucugggcugguuauugcugauuuguuuuaacagcauguggagaagucuggugggcagaaaaaccucuguaacccugucaguggcagaguuuacaagcuugucuucgggguucuuggcaguugcuaagccuuugccaggcccauuucuguccuugcuacuggugcacccaacccuggacacuacuuacugguguagcuguuagaguuguguucgggagcaaacaaguguuuucugaaaaugguggcaguguuucccuugaugggaccugcgagugucauccaguacaacgaaaugagggagaagaagcaaacaaaacaaaacaaaacaaaacaaaacaaaacaaaacacaaaacacaacaaaacaaaacaaaaaaaacacuuguacagaaauagcagaggcaguaggaaaugacgccgguucaggcuuguuuuccugacugguguggccucauuccaaccuguugccaugggcucuggccugucugugggacacccuggugcagggggccucagaggaagggaacuucuacauuucuguuugccugggcuccuugccaaagccugaguucaaagugcaguuuccaguaauuuguggggacgucucuguggguucacugggccaggacagaagccugcaagcccaaguaauauuuccuaauugcugucgcuccuuguggagggaaggaaggugguugaggcucuugcuggugccuaggguugcuuccuuggauccugcagcugacuggccuucucugucucuggcuguccccagccuuccucugucaucccaugcagccaugggaguccagcccaaaaugagacuggauuuuauauuacugauauccacuuagccccuucuuagagcauccucuccacccugccgcuucccugugucucagaacauccuggcgauugugggugaacccuuggcaaaugaagggcuggguaauggcgggccucaccucagaggagggcuuggagaacaguggacuuucuaucaggcagauacacucagggacaguguauguauguauguauguauguauguauguauguauguauguauguauguauguuuuuugagacaggguuucucuguauagccccggcuguccugaaacucacccuguagaccaggcugggcucgaacucagaaauccgccugccucugccucccaagugcuaggauuaaaggcaugcgccacaguguuuuaaugaauuguguuuucucuggcuguggaugagacacucuugacauggagcagggacaguuuuaggccacugcgaucuucagcccugugaacacagggcaguggccuuuuaagucugauacccuaccucagguaucccgaggccacccugauagcacugaagggagaauggacacagcaccaccccacacuguguuccuggccuucuuucuacaacacacuuuuuuucauuugcuaaucucagacuggcucucugguggugucuuuccuccaaccuggaaacccaauuugagugauuuuucauuuuaacaguuuucuguagcaguugggcuugcugguggggauugaggggacuuccccgcauagaggaauuucuaucuguuuaagaaucacaaaaccaaguggguauaaaauauuauuuaaauauuuuuauuggaaggucaguacuuuuugaaaucaucuaaauaauuaacuguacaaugccaaaauaccucauuaaagcuuuaaaaaauauuucuugguuguguggccuuuauuaagcaauuaauggcuuauauagcuuugcucuucuuuacuaaguugguuuaaaaaaacaaaacaaaacaauuuacauuaacugagcaauugugauacaccuuuaaucccagcacacuggagauugaggcaggugcguucaaggccagccugggcuauaaagugaguuccaagacagccgagguuacuacauagagaaacccugucucaaacaacaacaacaacaaaccaacaacaaaaguaacaaaaaccgauuuauauaagagaauugguuauuuguucuuaaaaaugucuuaugaacccaggaagaguccaaaauauugcucuagccuucaguuaucauuuaaaaagaaacaaaacaaaacucgugacuaauuucuuuaaaaaaaaaaaaaucccaggugccugacuagcuaagucuguagcaaaucuuggggauggugcuuuuggaguuucugcagugagccagguagauggcucaggugauaaagugcuuaccucguagacaagaggaccugaguuugcauucccagcacccacaaaaaagugggugcagaaagcaacacacuuacauaaucccagcccugaggagguggaggccgguggaucuaggaucuccuggccagccagccuagcugauccagguucagugagugacucugucaugaaaagagacugagaugagggugucaagauggagcagcacacacaucacuuccguggauucuuguuaguggccacagcugggagucuggcuaacugugguuagaucuuucuggaaacagcacugacgguuucaucugcuuccuugguccccaaagaagccaugauaagucuucagccuccaugaggccagaagcucugagguuucaaucuugagaaagugccuuaugcugugaguuaacugccccucccccuccacaccccaggagacucaguuauucuucacacaucaggagcuguaaaaguccugccaagagagcaacauuugguucuuuugugggucccccacucccuccaaaagucccccaaguguuuggugggaauaacacgugaagguucagggaaaucaaaguucugagggaaaaguauuuuuauauuuauacaguuuucaauaucauauuuuaaaauucacugcuguauuaaaaggacugaggagucaguuggcuuuuaaaauaacugugcucucaaacacauuguggaguguguuucaggcuacccugaggucggagaguuuggaugguagaggaacuucuggggucaugccuucagcuuuucucuguuuuauguuuggguaucauggaaaauauuuugaagacaaccauacuguagcaacugacucuuccucccuguuucgaauaaggaccuacagggcuuauaugugcaucauggagagugacaucagcaauguguucccugucuucuccaagcugcagaaagcagccaccucaaagauuggcuaaaccuugauuggaacaacccagagagcagcaguaaugccagagguguguuuagugugcuccuggcccuguucauccccaguguaccugugcuuggcuauacccucucacagcgaaggcacuuggagaugauuacucccacugcaggagccucccucccugcaggggugacuguggagcccuggucaggucacacuuccacugugggguaugaaucaacuuuuggaucuucaacugagguaguugugcaaaaucaguacaggugauucuaauggaaaagaaaaucguauuuauuuuuaucuuaugcguguggguguuugcuugcguguauguaugugcaccaagugcaguguucuggaugucagaagagggcaacugguccccuggaaccauagguauagacgacuguuagcugcggugugggggcugagauuaaaccuagguccucagcaagagcaacacgugcugagucaucucuucagccuccggagucuaccuuuuaucaauuccaucucucccucuaaauuuucucuguuuuuguuuuucuuccaacccacgaucucaaaggcauccugacaaccagcuggaaaggaaggaaggaaaguauaggaaggcuuuccacaccguuuaagccuccccaugccaccaacguaacucgcuccagacaccugaguguguagacaaugcucagaaccguugagucguagcucuaguucucauggaauuagggcaguuauaucccuauacuuuguacaguucugagggcagagcucuggacucucugcugccuccacccagcaggaaggauuuggcauccaucauccccucaaaguguaacaccauaguuucauuuaaaaugacuuucccuaauaugcugaaaaguugagccauggcaugaccccguagcauaaagcaacaugacuggucccucuuccacugugcccgugggugcugggguggaagggccaugcuuguccagagcacaauuccuccaccaaagcuaugccuuuccgaaugacuucugccuuauuuccaaagugacccuuagauagcuuagccuaaaaguuauacaucugggcugucauuuaaaacuuccaacucaguucugucucucgcccuauuaccccaacuacuuuggguuccuggaccugacucaaguugucagaccugaguguugaucacuuuuaccugcugagccaucuggccagaccuccuuuuuuuuuuuuuuuuaauguuuaauaccuggcuuacuaacugugggcggaaauagcaaguucuuacagugucuguguuaacauuccaaacauaccccuuucuuccgagauuguccuaucuauuauuauuaaaaaaaaaaaacaaaacuucuaaaacguaaaugacuuucccaagccagugcucuaaucucagacauaaaucuugcuccauuaagaaaaggggaacaggcacucugucagaagaauccaaacucaggagaaucaaaaaacuuaaaagguuagccaggggaguagucccauagcuuuugcuuaugaaacacauuaaauuaaaaccugcuuuccugaacgugucuagugugaggguggguagugugagaggaccgauguagauguagaagcuguguaguucugcaggcaugcugcagccaaggguguaggaugcuggccuccuucuccagccuggcuucagggacugagggcuggcaggagccaggaggugaggcuuccuuuaugccuucgguuuuguugaaaaaugacgcgugagcauacacagcuccgucucccccaaguacgacgucccaacauagaaucaguuucaugaaguuucauaguuucacagaacagauucagucauaaaucagggaaaguuuaaaauacauuagugggcaugucagagagguggucagaugggagaagcucaguuauaggucuaagaggcugucggaugauauucuuagcuuuuggauugguggaauccaggggucugcuauguuaauagauuccccaaacauuuuugucuauuagucacaggauguuuguuaguucugacacagaggugggugaggaauucagggggcuaaagcuagcccaggaaaagguaauuagccuuuggaccugucacauuccugucucuccacgguccugcagcuccggucggucacuuagucucagcuucuuuccaggaauucuuguucacagguggcuuggaaugauucugccuuguguguauuuaugaguucucuaaauccugaguguugccaagaacuugugauagccacgcagggcaaacacagagaauggauguggugggauggucugaccuucgagccaauggaugguauauuccgugguauuucuuaacauuuauuuauggacguauaccucagugcaugugugaaagucaguggaaaauuuggggacucuauucucucuuccuaccaugugggucucaggacugaacuugggacaucaggcuuggcagcgggugcuacuuaaucaccuuaccucccugccaucccacccauuucuuuuguaaggucaguuuaguuaaacuucccauuuuuuucuuaagcugguguaaggaucaaacccagggcuucacacgagcuagguaagugcucuaccccaugucugcagccuuccuuuaaaaaauguucacuugggacuuuccuucccacaaacccucgcgcccuuccuuuccuauuugggcccggcagaauggcuccugcaaagaaggguggugagaagaagggccguucugccaucaacgagguggugacccgagaauacaccaucaacauucacaagcgcauccauggagugggcuucaagaagcgugcuccucaggcacucaaagaaauucggaaguuugccaugaaggaaauggggacaccagaugugcucauugacaccaggcucaauaaagccgucugggacaagggaauaaggaacguuccauagcgcacccuaguacacuuguccagaaaacguaaugaggaugaggauuccccaaacaagcuuuacacgcugguaacuuacaugccuguuaccacauucaugaaucuacagacggucaauguggaugagaacuaaccugcugaaugucaaauaaaguugcagaacugca

SEQ ID NO: 1401 - RNA, 10968 nt, Mus musculus
gcgaacuaggacaaacugauguggguaggagagggccccgugacuccaacauuugugaccuccacagccugaugcccacacugagagcuucggcaaaugaccucucuaaaaugccuggaguggaggucauaaccaagaccuaccugacagagugucagaaggaaugagagaggguaucacagugcuggcacuaggcagcgcucacagaugguaucuguuucccuucuucacaggucucuccucaacccuuagcuaacccauaaacacugggcuggcagagccugugccugccagccuucuccuaagcugagugaacaccagguucuuuagguguuggcugguugacuaauaggcgcuggagcagcugagcuguuuaggucacgugugacaacauguuccuaccgucagagaaaccuccaccagcccuuuauguggggaagaaaaagcugcaaguccucgagccuuuugaaguaaagcaaaaugucccucgcugcccccucccauucggaagaugaaggaugcucguuuugggggguggagggagcgggcagcguggcgcucuggccuccgugagacuugcaguaccugcuggaaugcugcgguucagcuccgugaagccgaaaugccaguccagccuuucauuugucccgaucaaagcagcaguggggcggugcagaccugaguuugcaaaaugcaugcucccaccagggugcagagcucaccugucccugcuggagcaaggugcgcccuagccaacacagucacguggccgcccagcccuccucgaguuaccuggaaugucugggcggaggccagaaagaccuggagcugcgcgcgcaggugaugugccccaauuacucuuguuugucuugaaacagaguuggggcgggggggggggggaguuucacggggaugcauucaacucuccuuucggggguaguaaagaggggcugcaaauacacccgaagugcauaccuaaaucugcuguggguggggaccgaagccuuggcacccaucccugcuguuguggccagaucagaagggucauugugugagccauggcgacugagccuggcuguauaauaggcgcauuaugaggcuaugcaccuggcucccgcggagccugggagugaaaagcugcuugcagaaagccgagaggaggccuuccguugugucaaaagaaggcuguacgcgauaucuaauuccagucauuguguaggggggcaucacagagccccgggaggccgaagggugccugccagucacuucccagccacugggacuucucagucuccucccgccccucuucccccccagaccuuauaaaacaaaggggaaacaguuuuacuguggcccaguaucaaagaaauuggacgcuaacagguuuaguucagagucugagaccagaaaggaggaagaaaacacuggaagggcuuccccuuggagggagggagaacgaggaggggacacaggcaccuccgaaauuaaccuaacuggaaaaggaagaaaagucagauaauauccuuucugccgucccccuaauaccuuaaggaguucaaagguuuuccaagccuggggcauuggcaguuauaauuacacaguaaaauaccuaagguuaaugaguaaccuccaaaggaaguuacugcgcauaaugacggcaauuucucugaacuaaauguuaaaaauaaggccuguaauacuaugcgaaggaaaugguggcaauuggcaaauggaaccccguugcuugguaacaaaaccugagcuaugagcuuucucucucuaccugcccgaaagcggugggagcgaagagcuggguucccgccugcagucugagaggcagacaaccuucugcaggcacagcugaccagcccaggaacuggaagcagauguggcuggcccaggaagaauucccuaagaaugucuaagcgguaaaggaagucaggggugaucuggaagcgaugcaggaguuuuaaaaaguacuccacaaacagaacccuucagacaaacccacccccagcaaaaucucucuccgcuucucgccuuuugucuguccuaacauagacuuacacuuugaaccagcgcaaccaagaacugagucgggaaaggaauacaguuaagacagcccaacagagcaguauuccuugcagaagaccguguguacacauuuggacuccccaguuccgacuguacgucugagagugagauccuggacucugcuccuucaggcugauccacaaucaaccagaaauugcccgcagcaaagucacuauugccuuaaagcagcaugggaacuauguagugagagucuggguugaagguggguguuucagaucccuguauguucuacagcugcuguucucuguucugccucgggaucugcaucagaagcuucugugaaacugcagaugccugagccggagcacagcugcaggguacagcuccugucaggcaugcccgaggcucugcauucagucuccagcaccauccccaaaugcagauuucugggucuuuguucauacaggggauucagggcuggaacccaggcaccaacgcuucauaauuuccaucauacuccaacauguauacauauauauauauauauaauagaauagggggauuuguuuuucaauuuuuuuucuugacccuguuucuaaguggucccagcuuccccgucucccagagaucugccugccucugcuuccugagugcugggauuagaaguaugcaucaccaugaucuaucaggugcgugcgugcgugcgugcgugcgugcgugcgugcgugcguguguguguguguguguguguguguguguguuaaagaaaacuagggccaaugagauggcucagccuauaaaagcacuugccacacaaguaagaggcccugaguuucaucucuggaacacaccuuaaagguagaggagaaaccagcuucacaaaguugucaucuggccucaacacauggacacucaaguccacaugucauacacacacacacaguacuaauaauaauaaauagaaauuuuaaaagcuguacucuaaacacccuauauuucauguuucauaauuaaauaagcuuugaaggggagugcagcacuggagacagcugccagacaggcuguauggucauuuaccguaacuguagcaucuuccucagcacgcaguauacagaauucuugcuggaagagccuuagccaaaaccucacucuugguuauuuucaugaaguucuucauggagacucaagcuuucucuugcccaguuuuucccuucaccacacgcuccucucccuucaacucuggucuccuuaguagugauccuuuuauuuagcugugacuccuaauggacuaauauuacagccaaauaacacaaucucuucuuuaagcguaguaaccuggagaaagauggggugacgaagccccaacucaaagaaaagacuuuugaacaggaagaugucugagauagaccaggcuaccaggucuggaaaagccaauuucuuccuguaagaaagagucagaacccauagacucucugaauuuagugucaccaugcaugguaucucauacugacaagauuccauagccaaggcaaagaaauuaaaaggcucuuuggggggccagagaggaugugcaguuaagagcacuggcugcuguucuagaggacccaggucgagucguaucacccacauggaagcuggaaacuguaacuccagcuucaggggaucuggcucccucuuaugacucuauggccaccaggcaugugcagguggcacagggaccuacauaaaggcaaagcauccaugcacauaaaaugaauuauuaaaaaaugauaaaagucucuucaacaugaugaaaaugauuaaaugccagaaaaaaauguagucuccuagggacaagaacaccccccccaaaaaagguagaacugauuuugaccaaagcugcucccacauccccaucuuccacacaggccacugguaaguugcuuaggaaaccagaugcagguucaccacagccuuucaaaaguaaugccuaacuucacaccacacccugagccaggcggagcuucuggaacacucuuauaguacuagccauucuuuuucaacauuuagaaucauccucauuccaaaccucccuccaaaaacagaauaccauaaagauggcacagaaaucuugggccaccaagcuggucugagcugagauuguucucucuagcuggaagcccugaguucaccagaugugaccccuguacucucaugggacaugugaagaacuccagagaccucuacuugacugauuguaguggcauugacuugucugccuccugcauuggaauauacaaucauuaaagacaggaagagggcuuuacucacucuccauguuaaugccauaccccaguacauaaauaugacacaagugacaaaucagggaaccuggagucagacagacacacaauugauauaggauauaggucugguugagucauuuacuacuuuggugacuuuggauugguaaggggugugugugugugugugugugugugugugugugugugugugugugugugugugaggguguguguguguguguuuggggugguauuuaauuuuaggcuguguuucacuaaguagccugggaaggccuggaauugaguauauaagcccaggggucucacuauccuccugucuuagacacucaaaugcugggcuugcaggcauguguaccacaaugccuagcuagugacuugagagucaaauuucucauuuguuaaacaguaauaggaacagcccuaccuuccuguaguauggcugagaaucagaaguuaaaugcauaaagaaaauguuacaguaacaaugauacauuggagagccagauguggugguacacaggucuaugacucuagcccucaggaagcugagggaggauaucaugaguucaaggccagugugagcuuuguacugagacccugugucaaacacacaagcaaacaaacaaaugaaacuugaaucauagucuugaaacuugaaucuaacagccuaauauaccuuaacuccuagaacauccauccugauuuaggcuccucauuuuuuuuaugcccaccagacagaccaucaucggucuuagcuagugguugaauccucauaauauuugaugagacacugaaggaaguuguagcuauugugaucaaucaagauaguuaaauuauguaagucagaguuauucauugguuugauggacugaauauguucaaaccuccagaccuucugcuaaugagcuucagggacguuguacuaaaauuccauagagaucuucuaucaggagcaagaaagcagcagcaaagaguucagcuuugacacaaacaucuuggaacaccuccucgguuccucuuggacauaaugaagugcucuguuucuguuugauggaacgaacccccguggucagaagcaggaaugagcaagaguucccaggaagccagugaccagccucccuggcucagcucucucccucagaacugucuggucugcucaccucaguaacagagaccacauauuuacagcccugggaucaccugugcgggagcagccuuguuuuuugcaugacuguccagcuagccaucacugacccuggguacacugagccugacauggaugguugcaaauccagauguuagccauccugcgagcucaccuuucaugcguacccuuacaucugcuucccacagacccucaguuuugacucuaugcuuuuaucucaggucuguuugcagccaugcccuuccuggcacccuccugacuucgagccacucuuccauugugacagacccagagcuuagggucugucaucagaacugucccuugauccccaguuucuuuuuacuggcucugggcccacuguucucuuccaugugcuucugauagucuauaugccacacccugugauaaaaccaccuccaagauuugcaucuucuuuuucuaacuuuuggacauccucucuuuuaagcccuaugacucuucuucccauguacaaacuuggcauacuuuuucuaaaaccaaccccuacuucuacccaucuaggauggaaucguccuccaucccaucacgguucugagacaaagccaacaugcugccuuuccaaauuaccagugggauuuucacuuuucuuggagcuuacuugugugaauguagaacacaacuguucucuugugaguuaauucacaggcaccagacaugaaccucagaaggucuccuuuccacuucugcacccacauagcuuacagugggcugcaggcagcacaugugggugaaugacuuguaagagauaaaacgauuucauuuagaaaaccuuacuacuugguacaucuaucuauuccaaguagaaaucuuccagcgauuuuagcaagugaauacaaauuagaccauugagaacuugcaaauggauuggauuuugaugaucugauaaaguauuagcugaaauuagcaagcccaaagaggagacuauaugcagggaaugugcuucuagauggaguggaaguuguagaaaagugaugaugauauaggcuuuuuaaaaagagguuuaugggcuagagaaauagcucacuugguagggugcuugcccaacaugcacaaauacauggucugaguccccagcacuccuuaaagcuauaggcuaucuuaagccacauagcaagucccaggcuagccugagauagaugagaugauccaugcauguuaagugacaauaugcaguuauaaaauaguagauauuauauuaaguaacuuacuaaaaauaugaauaagugugggcuggagagauggcucacugguuaagaacacuggcuacucuuccagagguccugaguucaauccccagcaacucccaugguggcucacagccaucuauaaugagaucugaugcccucuucuggugugucugaagacagccacgguguacucacauacauaaaauaaauaaaauuuuaaaaauauaugugaauagauggauuagugaaugaauaaauggauagagacaauacaguguuaaugaugauugcuguucuaugcguuagaaauaugaaaucauugucugugggcaggguccaggggcaggccugaaucccagaacucaaaaggggaaugcagaaggauuccaaguucagggcuacgacaggaguucaaggcuagccuggacccuguuucuaaacaacacaauaacuuguuucuaaaccacacauacacacacacacacacacacacacacauauucauuccuugaccacagaggaaucccagagacuucgcucuaauauaauuuaacccccuccuccuucaagaacuugagagguggaacguaguuuaauagguagauuuagagguuccugugccuccuguaguccuccuuucaccaaaacuauggcuauuuuauauauauguauguauugcuguuaugugaaaauuacauuaaaaaacaaaaccaaaccucgagccauuggucugguaguuuuagacaggcccauauuccaacuaaaacaugaucccuaccuguucaccuuucuaaauaaguuuccuuuagcauggcagcuggucuuucuauucuuucucagcccugggacuugagcaaauagcauuucauagggacaguuaguaacuaucaccuuccaccagcuuaguuacaaccaaagaagccggacuuuaaaaaaacauuuuugauccagaugaagucacugguaacucucucauuauuuuucuccauagcaacacguauaaaauaugaaaaaaaaauguuuauuuaaguuuucuacucaguuucacaacuacuucaaaagcuguuaagugugguuuacacuccuuaaaaauuucaaccuggagcugggauuuguuuuaacacuagaggcuggagcuuugugccaaugagcuggcucuugcugcaggccugaugaaacacacuaagggcuuggaguuccuuuguugaauuucucucucucucucucucucucucucucucucucucucucucucucucucucucucucucucucucaggaaaaggccucugaaagcuuugggaggugucucuacacaggucaugcgauaagugggccuuucauuagacuucgaccacagcggaaucccagagacuucgcucuaauauaauuuaacccccuccuucaagaacuugagagguggaacguaguuuaauagguagauuuagagguuccugugccuccaguaauccuccuuucaucaaaacaauggcuauaauuaauauuuaugauuugccuuucaccucaaaggacuuuuacaaauuguuaccacaggacucaggaugcucacuaaugaagugcaguagcugggcccagaagagagacuuagaguccccucagguuugcuccauggccauggggucacaaaggaaggcugugggggcacagcaaguggaugccagacuacccuaagaaugagucaggaguacaaaaucagugagcucacgcugcccccgcagccccugcaguccccguagcccccgcagccccugcaguccccguagcccccgcagcccccacagccccgguagcagaagcaaguuuuugucuugugguucuauugguuuuguuugaugccuugggcagauaggccaacaacagcccaagggccucagccucuaucuaaauuuauguuauuuuuaaguucauuaguuuguuuguuuguuagacagguuucguguguagcccagucuggccuggaaugccccagcuugcgucacgucugaaugcugaguuuccaccuaaucuuacauuucacucucucugucuccaccucagccaaaguguaugucucugauauuuucagaggguugguuaggccaaggagcacaaccaagucaccgagacuagacaggucacccggagugcuucucacuguaccuuggcaggguaaguuugcuguugccugggagccugagacggaguaagagagauucaagggugcugccaagcuuuugucuuaacgaacuagagugucaucagaaacucauugcaggugucccuggagugucuuagagucagcacauugaucuggacugacaggauauguacuuaacaaaggccagguucaugucgcaacaugcacagaggaaacgcuccccacgcccagagugcucauccucagcaaguggcugacauccguccaauauaccugcuggaccauaguaaccccuacaacagugcugaaauggggaggggccagacaggaugagggcagagcuauugacaucaaucggaggagacccccccccucagggacaagcccacccuagucaugaucagaccaggcagaaagcagcuauacacauguguccugcucuuggcagcuaugucacaugcuacaggagagcaguuaccuacaaugaagacagcaauucaaauucccaguaaguuaccuccaaaaguuacugucaggcaacucucuugaaccuacagccuacauuaugcucuuuaggcugccaguagacugaugucacaaucccagcuuuacaaggugaaguuagcaaccucugaauuaagacagucuuacuguucauuuaugggacacagagccaauguggcagauuucucaucaaaaacccagaauucucuuggaaacagaaacagaaaguggccuugguuguaucuccaucuuuuagagagguggcuuauaaagcuacacauauacacacacacacacgcacgcacacacacacacgcacgcacacacacacacacacacacacacacacacacacacacacaagaaagguaaccacaucacaauccuauuccaccaugucuuuuuuuuuuuuuuuucagaauaugaaaauuuauuacuguguuuccauugucaaauuuuaugaucuuggccuuucuuucuugccuuuguauagagccaacagagaaacauuggcuacuuuaaccaccuuaaagcggacuccaggaauaucaccuacagcaugaccuuuucgaccaaauccagcaaccagaacuucaucauuuuccucaaugaaguucaggcagccaucauugggcacgaacgcugugaucuucuucccguucuuaaugagcugcacccugacgcacuuccugauggcagaauuuggcuguuuggccucaaccccuacuuuuuccagcacaauucccuuugcaugagaggcacccccaaacggauuggccuucagggcugugcccaagugggcuuucuuguacuguuugucaugccacuucuggucccgucggugacugcggagcuuccgggcaguucggagaccacgacacuugcccaucuugccggcgccacgggcccaagagaaagcauuccaccaugucuuauguggagucucaccagccaucugccaguauacaauacauacaauacagcacccugccuguggccuuuuucucccucucuucaacauugagggauuuaaagcaagccccuaaaugccacguuguuucaccuauauuuaauuagcuuccuaauugcuuuaggaacuaucuuccuaauuauguuucauucagcuaaguacaaaacucauucuuucauugcaacuguuguaaauauguuguuuguuuguuuguuuguuuguuugagauagggucuaacugacccggaacuuaacucuguagacuagcuugaccuuaaacucacagacaucugccuaccugccucaagaguacugagauuaaagauuugugccaacacacccagcccucuuaucccaucgccacugugacuaugcauuaguucuaaggcuaaaugugcaauauauguguguguguguguacuuuuuaauucuggaaagaaauaaacauaacaaaggaaauuauacuaccuuaauauaauuuugaaucccauguuauaauuuuacauguuaauaauuucuggaggaaaauccaccuguugaauucuuaaauuccaugcuaauuaauacauuuucaccucaaaaga

SEQ ID NO: 1402 - RNA, 1176 nt, Mus musculus
gacccaccuugcucugagaagaccuccacagcuucacugcucagccaguggaauugcauguccggcugcucauaacaacauggcuucacagagcugccagagggguccagagaguaugcgcauggaacccaaggggugcagcccuggcucuucacuaaauggcaacagccuaggaccacccaggaaguguggagagcuaagcaagccgguccaauccagcuuggagggcucaggguggcagaguggcugaguuuguuauuguugcuucuguggugccugcccucaucagguagaaugcagauggaaugggaaagaagagggagaggccguagcuccugccauccccggugggcuccaauggguucccacuuacugugguuguggcuucuucacucugucugcacugagugcucuuguacauuuugcagaaugcugagugguugaguagucaggcuuugaagaccuacagugugccguuugccuuaauuguagaccuuucggugccucggugccucacuacuucacccaugaugugggaacuagguggaaaguuggagaaaaauuaccuucaugucaucuaggcauuuguacuaacacuuuuugcagaggcaggagggacaguuuccaucuaugggaacacucuaagggacuuaguuuuguagucagggaaucuaaguuaagagucuggcuguuuuagcucuaggguaguuuucuguucugucaucauggcgacagagcucucucuuguagcuuacauacuauuugaagucuccaaucccauucagaaggcugcaaccucaagcugucaucaucucccaaaguccuuacuucuaaacacuagccucaacuuaugaauuugggaaggacagaguuccauccucagcacaucaccaaacauguucauggacugaaaauguaacauucuuauaauaugcccagauugaucuacagacucguaggugagaaccuuguagacuucuuugcuggggguaggggcaguuccagcagagucuucuuucauguuguuuuuacuugaggcagcagagggggaagagcaucggugaaggguaagacuuuaucuuaagagauauuuagggcugcuguauaauaauaaaaaaguuuaauugucaaagucuaaaaaacaaacaaacaaauaaaaaggcugggauguuguga

SEQ ID NO: 1403 - RNA, 1078 nt, Mus musculus
uguagcaauuggacuugauuuuguucuuucugauguucauaaaauaaauuugaucucgugguaacucuuggucuuugaccuguaagaaucaaaccaauaaacugauuaaaucgucaaauggaugaacagagagagagagagagaagggucaagacgauucuggccgaggagaccuuccuaaacauucugacucuucccauguguuaccaaacuacacugaucuggguuauccucagaggauaugcauuccccaucuuugaguuggcgcaucgcugagaaacucuugggugucugugagggcuucucuuccucauaucuuagcgcucagaagugauuacuuuucucuaaguugccuccuacucuaucgcccugacagguuuuaauggcugcauugccucagugcucuaugguggagagagccuccccuucagugggaagcacagcuuggcguccaucuccaaaacagacccuucagugaagaucggcugucggggcccuaacaucugugccagcaaccccugcuggggcgaucuucuguguaucaaccagugguaugccuacaaaugugucccuccuggugacugugcaucccacccuugccagaauggagguagcugugaaccaggucugcucuccggcuacacuugcagcuguccagagucgcacacagggaggaccugugagacggugguggccugccucgguguucucuguccucagggcaaggugugcaaggcuggaaguccagggggacacguguguguccagagucaggguccagaugagauauccuuaccucugugggcagugccugcaauugugggcagcugugccacagcccuagcgcugcugguccucaguuugauucuaugcaaccagugcaggggaaagaugcccaaaaaccccaaagaggagaagaagccgaaggagaagaagaaaaagggcagugagaauguagcuuuugaugacccagacaacaucccucccuauggggaugaccuagcuguuaggaagcaaccugaggggaaucccaagccggacaucauagagcgagagaaccccuaucuaaucuucgaug

SEQ ID NO: 1404 - RNA, 1818 nt, Mus musculus
uaaagcacgcagcgaagucucugagaccugagccucucaagcggccacuuagggccggacagugucucguucgauccaguuuucugguggucuccagcgaagacaggcgacaaagccguuguugagugggaugggccggcgaccgcccgguagugucucuauugcaagaacucugagagaaaugaagagaguccucagcaaugauguuggcuucucgugguucccagagcccugcuuaauggauggagacuggacgagaaccuggcugcugugguucugaacauggcccagagcccugugucugccgaggucauucaccagguggaagagugucuugaugaagacgagaaggagaugaugcucuuccuguguagagaugugacugagaaccuggcugcaccuaacgucagggaccuccuggauagcuuaagugagagaggccagcucucuuuugcuaccuuggcugaauugcucuacagagugaggcgguuugaccuucucaagaggaucuugaagacagacaaagcaaccguggaggaccaccugcgcagaaacccucaccugguuucugauuauaggguccugcugauggagauuggugagagcuuagaucagaacgauguauccuccuuaguuuuccuuacaagggauuacacaggcagaggcaagauagccaaggacaagaguuucuuggaucuggugauugaauuggagaaacugaaucuaauugcuucagaccaauugaauuuguuagaaaaaugccugaagaacauccacagaauagacuugaacacaaagauccagaaguacacccaguccagccaaggagcaagaucaaauaugaauacucuccaggcuucgcucccaaaauugaguaucaaguauaacucaagggugagucuggagccaguguauggaguaccagcaugaaccagucucagagauguaauaaaaauaaacaucucauuucauaugcuguaauagcuaaacaaauucugauagauauguguuugauuaagaauguguauaauuucuuaugauuauaaaccuuaguaguguucaaaaauauauuuggaaaaauuuaugaaauauauaacaagaaaauaauuuuugugcccauuaucugggcaugacuacuguggaaagcuuucuuuuagucucuguccuaugugcauuagcaaaugugucuauuuauacaguugaauaucuuuuucauucuuuguuucuuugaagagucaauuuuaaaaauuaaaguagguagaauguacccauagaaagaaaaaguuaaauguccccaaagagauuuuaaaguuguuuccuucuaccucacggaacucauguccuaccuccuuccuguuaaggagacuaaucuagaccaguuucuucuauaaccaugcacagagaaucuacccacagagugucuacuuuuauacaagugguagcauaucaugucugcucuucugaacagagacuccuuagauauuguuccauauaguuaauaggagauuguuucgacuuaaucauuauuuguauuauuuugaaugauaccccuacccuuuuaucuucuuuugagacaagaacuuaccuguaauccagccuggccuggaauccauuauguaaccuaggcuggccuugaacuugcaaugagccuccucuugcuucagccuccucgggcucauggcuuccauuuucugcauguacuaaaauguauuuaguucuuucuugcugauguauaaauugccuccuuuccuuuguuacuagaaacaaugcugcaaaauaaacuuccugauucuuaaaaaaaaaaaaaaaaaaaaaaaa

SEQ ID NO: 1405 - RNA, 8312 nt, Mus musculus
ucuguuugccaccaccgccuccugcagggcccacacgcuucacacuucccuuaggcugccgguccgcuuccggccucgcggcgcgcacgcgcacucauaggaguguuuugacagcuccgggccuggagaaggagcaggugucgcgagagugggcagcgcgccgccuagcgagagcuggaauuauggcgaaccugggaagugaggcugagcgggagccccucuugggcccgggaucaccggaaagcaggugagcaggcgggugggacuagcugggaacagugaguccacuguccggacccgaaacccggcugcacaugcgcaugcccagcaacgccuucggagcugcuuaggacaggcuccgggauaaucgcguguacuugggaauagaggagaaucuuggugcuuggagaacuuguguaccuaacaaagcugggcagggggaugcuucacaaaggucacagcaguuucacauuguagcccuugugcugugugucuuaagcaucugccugaauccuguuaugguaauuccuuccuccuugagaauuucuuuuucuucacuauuuuuccuguuuuguaugaaaaaaccuaagcugccucuuuuacagcagacacugcauucuguugacccuguguagcuguccacugucacaaaagccccaaauggugguuuuaaccgacacucaagagcuaaacuugaguuagacuuuuccuaaccuaauaacuucuucauauuuugcaaauaaacccacuuaaaaugacucacacuuugcucaguaucacagguccaaaauaaacacaccuuuaagcguuucauuaguauuuucauccuuguaauucucauuuugauccuuauucaugagcacuaauuuagaaaaguugggcuugucuuacuguagcaauauguauuuuuaccuuuacgaagcaguaaguauuauuucaucgagucuuuuguuugaagcgcaguguguguuuuauuagguucaucuuuugagggggaacagguggcacaugcaucaugguuuguacagaggccagaggauggauuacaauuuuauguuucuugauuuuaucuugaggugauuaaaaugaguagcaguguugacauuuguuuuaaaagagcugcaucccccaggccuguugagaccuucgaagcuguuggcuucugcccugcuuuuugcugugcagccauccuuuuggaguucuuaagcucuguaguuguccugccuauuccacgccuagaagagaccaucccucuucucccuuuugaaaucugucagcaacccucauuuauguuaccugcaacuccugccaacaacuuuuuuucuuccaggcuuguuauuugccgggacccugaaguuauuuuuacuuacuguaauuuugugcuucugauguacaggcucugccaggcuagagcucccuguuagucacaugcauagggcuguggcauuuccauuuccuagccuucuuugugcugcuugcuuuucuucuguuguauuucaugucaggccuguguuuuccagaaagagcgugggauccuugagucauagauguacagcuaaccauagaaauaugauuuugauugaaauaagcuuaaacacauuuucucuuacuuuucucucccuuuuaaauaagugauuguguuaggcuucaucuauaggugaagauggacagauguuccuguccaugaagaguucauuagauugaacucuauguucuguguuuagcauuuuaaaaauuaaaaggaaacauuuucagaacaauucaacaaguauucuguuuuuaaaaucauaaguugauucccuaguuaugacuaacugcaggguuugcucacuuguacuuuacuguacaaaguucaguauaguaagccagcagcccuuaucaaacaagauugacuaaucaggauuuauugauguaauuggcuuagauccuucuuuucuugagugucuagugcucucaacugacuuccuuuaugaauuuuauuuaauagagcagaggccgacacuuuuucuguaauagacccauugguguauaguuuagguuuguugguucaggcccaaaggcaaagucauggauagcauagauacuuagaagagaaaaucugcagaucauacuaaaugagugcauuguuuagucaguagguuggucuauugaggagaaacuuggucuuugaaguuagucuuuugucaucugguaacaacuauucaccuguaaaccaguuuuaucuaucaagcuaaagacugguggugucuggauuugaccuaaagauuauagauugcuagccuuaccuuagguuuuuuugaaauacuacagacacuucaaauucuuauuucaguauuugucaauaaaagaaauauuacugcacccucuguccuuacaugucugcacuaccucccuccucucuucccucacucccuuccuuucuuccuuccuuucaaguaaguucucacuuuggagcccaggcuggcucacagcucagucugguagaggcuggccuugaacuuagggucuuccugcuuucccuccuucguagugcaauaacaguaauaggcaggugcuaguaugcuugucuuacagugcagaccuuuuauuucugucauaugucugcaguuauauucaguacugcucucuccagaugcucacccuucuugcucuccaguucugagucugacuguucugccuuucuguagugagaccagagcgaauuuugaaagugcagugcugcucugccccagacucuguacaaaaacacacacugaaucauauuguuuuacccagguguucaguucaugccaguguauuauguauuuuucuuggauuuuaagucauauauuuguuaaacauucugccaucuggagcugugguuaucaaaauauuagaacaccaugguuuuacuugagagagaauuccaucaggaaaaugaaugccaggauacagcagaacuaguagauagaagguaaacguuaaacaaauccccuuggaaagauguacagcauuuuuuguuuguuuguuuguuuguuugcuugcuuguuuagacagggucucacuauguguguggagccgcacucacauuugccauuacaagauggcgcugacagcuguguucuaaguaguaaauaaucugcacaugugcaggggcaguuuuccugccaugugcucugccuuucucgugacgacaacugggccgaugggcugcagccaaucagggagugacacguccuaggaggaggauaauucuccuuaaaagggacaggguucuggcacucccucucuucgcuucuucgccucuucuucucuucgccucuucgucucuuucucuucaucuuuuccucugcucucucucucuuccucucugccucucucugccgcgcucuuccucucuugcuccugaguaagcaauaaagcuuugccucgucuuuccuggccggucgcaaacgcgugcaagaacuauguaucccuggcuggccuggagcuacuauguaccuucaaacuuacagagauccugcugucucugccaccuaagugcugggaugaaaggcaugcgccaugacacccagguucaguuuuucuucuuacaccccuguaaagcagaagucuguaaagcucagccucagccaucuaacaugugugucaucaaaauaaaaaauguaugcuaauucaguaaaucaacauccauauucuguuauuccuucuaaauuaaaaaaaacauaauaaaaauuuauuacuuuaaaagauuucaaauacauacaaagauugaaauaaucuaccuaaugcuaauaucuuuccaauuaguuuuuccccagaagucagaugucuuuauacacacacacaucuauugcuaaaguaaaguaaguuucagauauuacgaauauguuauugcagucugccuuuuccaagaacaaauacuucccuuacacaacuccaccaauauaauuagaaacaacaauuaaggaguauuauacaauuuauacucuguauccacucuaauaaugcaaugaacacacauacauacucauacaagccaguuaccguuccuguguugguuccauccuguuuugaacucuaguuuagaacugucccagcacuugggaggcagaggcaggcaaaucuuuguaagucugaggucaaccuggucaacauaucgauucccaggacagcaggacuaccuagagaggucccguaucacaaaacaaagcaaacuuuuacugguccuauguuugcucauguaagaguugacuacuaggucugggucaguauaccuaagggcuaucucacaaucuagcuccauggacuguuucuuagucacaggacugucacauaacuaauacugagaaaugcuaauauauucccugagaagugcaggcugccagguccccaugauggagaaugucagacugaaugucgugcacagauacacaugaaggcaaaacacucaugcacauaaaaguaaauuuaaaaacaaaaacaaacaaaaaaaaaaaccuagaggcaaagucuugcugucuguucaucccaggcuggugaggagcuugccaucuucuuagcaucuugaccguuuuuuuuuuuucuccccagagugucuuggaucccaggcuuaccuugaaguuccuauauagcccgagagaugaccuuuaauuccugaccccuugucuaauguugagacaccuguuaugccucaguuacuuaagugcuaggauuauggguuuggcaagaaaagcuuguuuuuguuucuuuugugagacaaguucucacuuuauagucccggguauccugaauccacuacauaccacugaacauguaacugccuuuuggccaggaaagauuuuuuucuuuuaacuagggucucacuauguagcuguggcuguccugaaacucccugaagcccagagcuccaccugccucuguuuccugagugcuagugccacuacuacccugauccuucuuauagagugauuauguguuucauuucuaaucaucagagauuaauaaugggucucuaaaaguauaauacuagcaaaguauuaaauugauacaagaaucuauauucugagauucaaugaugcaugcuuuucccaguauguaauuaacugcaaugguauacauuaaauucaaguauguugauuuuguaauacauguuuaucuuuuucagauauuuuauaucacgauuaaaaggucuguguguaggucacuauauuauaucuucagugcuuuaaguacucagaauguaucaguaaugggggcuggaaagauggcuuagugguuguaggagauugcuccucagcuugaugaccuuaacuuugauucuuggaucuacuggguagagaaaacugacucucaguuuauccuuugaccuccacauacaugcuacagcacucaaacacaaauguaaaaaauaaaacaugaguaaauauaauaaaaacgaaacacacaaauaucaguaaugaaauauccuuggcaaauaguacaucuaaacauguuucuucuucccugccauuucuuggugguuuguuugagauaggguuugucuguguagcccuggcugcucuggaacuugaucuaggcugcccuacaacucacagagaaucacgugccucugccucucgagugcugggaucaaaaggcaugugcuacuaccagccuccuucugacaauucuaagucguuacauuugaaaaaagaaagcuuuucaaugaugauuaaauuugacaacaucacagucuauuuuauaaaauauucugggaccacagacaucaugauaacagaacuuuacugagggaagaggauuuagacuccagccuggcauagaaccauuucuuaacaaauaauagugguaacagaaacaaaucaaccaaucccuuucuccaaaaaucaaccaaucccuuucuccaaaagaaaauccucccaaaugcugagauuacagaguugggccaguauucccagaaauaaagcuaaacauuuaagaguaggccuuccauaauuucugacuagauuugccuaacauuuagaauggacaauagugcugggcuguaacugggugguagaguacuuaccuagaauuugagguuccccuaucacuacagaaaaguaaaacaaacaaacaaaaaagggcaacauugacaaauaguguaagaguuuuuccauuauaguauugaguggggaaaccuaucagaaaucaggacuuugccucugaaguauggcauccucaaguaaguuaguucauauuacuucccuugagaugguguuccagcucccucgcuuccuugcagugaagugcucuuucaaacaguacagacaauuucccucugacaaaguggccuuucuugcacucaugugugcugugagaggacagagacaaauucuuugcccuugcuagaucaagcauagucagggacuauaauuaccucguuguuucuauuuuguuauuagaauuuauuauuauuccgauaacuaacauuuuacugcuugauaaaauaagcauuguguauauaaauugucagguuuagaauaucuuaaaaaaaucuuugcuguauuuccaaaagcuauggcuccaauagugauuacaucguuauaaugcaaguaaacaugucugccucuuugcagguuuuucuauugugauaauguccaucuggccauaucuucaaaagguuugugcacuucacucuguuuuugaacuaauaguagagguaacucuaauauuauugagcguugucuaaagagugucuuuaguauuuuguaguuugaucuguuuagaauaacuuagaguaauaauuacucaauggcaguauaaguuggucauaugcuuuauuguacagacagaaacauuugaagcagaaagggugcugggccaagaagcagacaacugccuggagaguagcagacagaguaaagcugugguuaccaacuuacucaguugucccugagucacuaccuuguugcauccucccgagggaagagcagcucaagaagacaaguggauucuuaaaguguacagaucauauuucugaggaauaguuucacguuuuccuguggaauuaauuuggguuuucaggaaagcugguguaaaguauagccaauguggcucucuugauauuccugggagauugguuuucaggucccccaaaaguauaccaaaauguguggaugugaaagucuguuacauaaagugauguagugugggaagccacaugugccguugcaggguggcgcuggcuaccacuggccaccacacguaaguuuggguagacacccaauguguacauaugcaguagaguuuuuuugccaagaugagguuuugaguauuaaccaaucagaugagagacaugcaaaugagguauguuaaccaaucagaugugagacaugcaaaugagauaguaagcauaaccaauccaggugugagacacgccucuccuaggccuauauaagcagcaccaguucugggcuugggggucuuuucgccucugcaaucaagcucucucaauaaaugugugcagaaggauccugguguggcaucugcuuugcuggugaaucgggcuugcacaagaaguggugccaaaaccugggaugagacaucuucaggcacgagcgaagacccccugcuacagggaggauucagaacuauaucgcggggaaggaguggcuaaugaaguguucccgcaagacagacugcucagaaggauucgaauguguggauucagaacaauucagcuggggaauggugguacugguaaguauaaagaaauuaaugugagucucugagaggcaugcuuucauacgaaauagauccgauaauugucgcugggguugugcugcuugcuaucuuucuugccuugauuuuaugccauugccuuaauugucauugcccugggcacgaguguaucugcugggaauaauuucacguagauaacacuuuaguccaggacgaucauggguacuggccaguauaugcccuuaguagggccggugcaagccuugcuuaaagaaagagguuuaaagauuucggaaagcacagugagcggguuuuugaaagaaauagacagacucacucuuugguuugccccuauugggugcugacgcuucuuaguugggaaaaguugggaaaagauauagcaagagaggaagcagacgggaaaguaaaagcaggaacaaggccguuauggaaauuaauuaaggcuuguauccaggacaugaaaugugagcuagcuguuaaggaagcgccgcgacuuuuauaggagcaacaggaaaguaugucagaaacagagagauaugaaaaagaaggcacgcacagaaaaauaaguaaaggaugagaaauaaaaggag

SEQ ID NO: 1406 - RNA, 9618 nt, Mus musculus
uagacauaauuuaguuuguuuucaagacagggucucacuauauaguucuguuugucuuaaaccucacuuugcaaaccagaauggucuuaaacuaacagagauuugccugcuucugucucccaaaugcugagauuaaaggcauguaccaccacaccugacauuaggcauauguaaguacaguacaauguggcaaaaaguuuccugguaacaauuaacucaaucuuuugugcacaauaaagcuuaaaguacgacuacaucaaaacucuuuucuaaaguacaauugacuucuuccacaaagaugaguucuauagcuucaggcuuaggggaggaucuugugugguuucugucauacagacauaguccagaggucaccaggcuauaaaguauguguggcaucucccguaaagaugaguucuauugauggagaaacaaugcuaaagauaaaggucuagagaggaggucugggcuaaacauaagagucugagggagucaggucuugccugacccugcagauagcacaggucacuaggcuaucaacaacuuucagcucuagccuucugggaggaaaauagguuauacauuccuuuuguugaagagccgaccccacauguuugacauuccggguuuccuuagugcuuaucucugacacaaggaccuuugugcucccaacauccagacaguuggggccucugugucgucauucaggcaauugggguucuauguucucauccaggcagucagggauggagagguggacagaggccucccauuagcugcugagggugaugggcagagguacgacuccccaaagaugcuaggcacugaucuucagagccugugaaaauguuaagucaugugauaagaaagaacugugguugaggucgaucuaugcuguugacaguugacuuugaguugggcagaugguccaggauuaucugggugaacacaguauaaacaugagguccuuagaggaagggaggaaguaucaguguacagugacuuggaaaacauuuggcuggcuaucgguagauuugaaguuggaagagguugaugagucacaggagaacagcccuaggaagcugaagaagacuagauuuuaaauucaccagagucuucagagagauagacuugccauaguccauggagcacagugucugaguucuggcuuccuuaacugucaaauaacagauauuuuguggauuucaggcauggaauacauuuuuauuuguuauagcugauauaguaaacaauucacacagccuuauuuauauuccuauaugacccugugguuggagcgcaucugaaauaccugucuguauacaccccuugcucuucugucucauuacaucaguuuucucccuguguccaaguguucauacauucuacacuccacccccccccacgcacacccacccacuaguuaucaucccauccaugggauucuccaauugggaaagaauaugucccucuugguauaaugaauauggguggacaaugucccuuuucccuaggaacugcuagaccugauccuuugaugagcagguguuaggagauuucugucaacaugguuuacagugccagacugacccugaagucaugaggacaaacaaaggauuuaccuuaugagcaugcacaucggcgacuuuagggacacacaugugguagcaguuacaaagaagcaugauguaggggaugaagagaaagaaugccuggaugccuaagggugagugugaggcccaagauugggacuggggugaagcuguucaguucaagggacggcgugaacucaugaaagaugaguugacuagggagccgaagaaugggacgggcucuuucugguagagaacagcuaguucaauccuaaugccaucaccggagagaucagagagggaaagcagauacauuucauaccaggcugcaagcuguuuagcaugauaauagggguaucagcuaucauggagagagaagggcaaacuagggaggaccaguaagcagaagccagcugucaaaucgcuagacaggucccacuaagugggucuucguucccaaggagccacucacccauuuaaggagaggaaugguauucauuuuaggaaggucccucugcuugccacagggagguucaguguggaaagauuaaagucaaagguggaagggaauagguaagagcccguugucugggggaauugguggagccugaacuaaggcacguauugguaaucuggagagggagcaguuggcaugagaagagcuuaggaagaagaaucagaauauguaggaaggaggauggaggggaugaagggguaaucaggagcccuacugucugagaugggacuugugaauauaugagggacaugagaaggucgguuuaguguugaggcugucaugcuugcguggagaugggcauucacacgagggaaagaauuuaggcuggagguaauucugaaacacuuugcacaggugagaguaaaggacaagaacaagggccaaacuguaaguaaacaggaugggaagaaauggcacaagaaguuuuaggagacugaagugacucacggggcccagugccuuugcuuggguuccuauaguaaaucaucccagacucagaucgaaaacaagacuuucuuccauuucuggaaguugagcaaccaaagaccaagcccuuaggugaggacucugucaucuugcuuugagauggcagcuguguccuguugugucugcaccagcagggaacagggcagagggagaacaccguccguuucuuauuucccauuagcaggugcacccucaugacauagccauccccgaaaggucuccccugcugacacuaucagguugggggucaagaguucaucaugugugugucugagaggcaccuucaggccucaguaccagggaagagagggaaagggaauucaauaguauggaaagccacugagucucuggguaagaggagaagcauucacaugucauguaagugaccuuauuaaggagcuagacagugaagaagaggugggaacccucaagauaaccauccauggcuuccaagaagcugggcugugagaaguuggagguugagccgaaggugaacugugagucaguuggacccucuuugaggaaugcugggagagagggagaguagagaaagggggcucuagaaacuaaauaaagcagaugaaucaggcacagggagggagucuagcuuuagaugagaaggggaucccucuuagccaagcaaugaacagcaaguuuauaaguucugagguaggaugggcugcagcagcaggaaaaauacgguagucaauauggcauauuuugaaaaaagauuuauuuauuuuauguaugugaguacacuguagcuguaccaaugguugagaccuucaugugguuguugggaauugaauuuuuagguccccugcucgcucagucccugcuugcuccggcccaaagauuuauuuauuauuauacauaaguacauuguagcugacuccagaugcaccugaagagggugccagugguuguaagccaccaugugguugcugggauuugaacucaggaccuucagaaaaucagucagugcucuuaccugcugauccaucuugauaguccccauauggcauuuuuauaccuauacaaauguuuucaaaauugucuccagccuaaauuuugugccuuugcauaaagaauuggagaucauucuucaccaaggacagauguagaggaggagguuuggcaaugaaggcaauuucuaggauuuaggcauagacuagauagaguacagagaauaagccggaggccaccagagucuagcaugucaagcacuuacagcuuuagguuagagacugcauugggagguuuagcucacccaagcuaacagcaggucaaaguugucuauauacugauauguucauaucuuauguacccaaugggggaucauguacaacaugaauccauuccuucccucaucccagaaggccuaucacacauaaggucuugauuuuaauucacaaagugaauaacaaaacugaacucauuggaagauaagaggagacucuuugaauugcugugccaucgaaggcaagauugagagaccuuuuccaguauggccaaugagaugaaagucucccuuuaacuccaugugacacacuccucgcgaggucacacguuugaacacuugauauuuagcuggcagugcuguuuuagaaggcuguggaaccuuuggggccgguguaauggcugacggaaguggacugcugugugcaggauuuuuguggaccauguggcuuuccuugcucugugauccucugcugugugagcaaacacaguggcugagccauggugcuuuugugcuacggugugacuuauucagaaaucaagagcacauacacgccugucuccuuuaagcugcuucugucaaccauucugucucccugaugaaauaaacugacaaagacacucagugaauucucugucaccuccugugaacgcugugauaaaucaccacaaacugugggcuuaaaaauaaugaaaacuuguucucacagaaacuccaaaccaaggugucaguaggggggugcuugcccugaaggcuauaguggggauucugucaccgccucuucuagcuuuugguggcuguggguuucccugacuugaaacggauaacuccagucucugcauccaggucugcacaggugccuuccugguguuucuguccugucccuuuuccauuuuuccucugguuuugugucuucccucuuucugcuucuuauaaggggacaagucacugagagcccaucuggacaaucuaggaugugcauaucucaauaugcaccuccaacaucccagccaugaaugaggccacacagacucugggugggcacagaucuuauguaagagcuccucacuagucacuauagaucagcagagucucuuuccagacauaugccuacauuuaaguacaguuuaagugcauuuauauaccauaguauuuuauuguauacauuuacuuuuggauuccacacucuuucccacaaaacagcaugaagcacucagugaucaggaaguagaauugagaucuguguaagagucuucuagaucacaugcccccccccccaaagauauuauuauaaauauuaguaauuuagcaacgucuggcuucauccacagcagaugguggcuuugguauguugacuugaauuuaagaagucuaaagaggggcuggaaagauggcucgauaguuaagaauggcuugcucuuccagaggauccagguugaauuuccagcacccacagggcccuuacacggaucuguaacucuagguucaggggaucugaugcccucuccuggccucuucuggcauugcaggcacgcggugcacagacauucaugcaggcaaaacacauauacaccugacauaaaaauaaauaaaaauaauaacgaaaagaguucuaaagaaaaaagaacuuaagaggcagaaauacccaaagcuucuuuugcuuuuuuugcagcuugggcuuaauuauaacccucagagaaauuuaaaaaaaacuuuccuuugccuuuggagacaacaguugacaaaacagaucaaaaaguuucugaauuacuauaaaaagacccacaaagacacaccugaagcguggcagugcuuuucagcaguauaacucggucuguguagcagaucacaaaugccuacgcaggcaggcaggucaaugacugacaugagcaagugaagccauuccagcaaggcgagcugcuguggcuaagugcggugcacugucaacaauucuccugcagccccagugugcuucauuacaauaaugagaaacuaggaacauuuuaugcauuguaaugaccaaaaaauguguuucauaugccuuccagugauaauuuuguuuauuauucucaaauauaucuauguuuagucauuaauucucacuuuuacgcuggucucaaacugaaaaugcuuagagaggauuccuaguugcaaguuuugccaugcaaaauacaaauuaaaucuuaaauaagaaccccagaaaucucuccucacaccuccaucucugcuacugaugucaccucuuguggguauuaggguucuuaaauuaacagcauguuagagcaagggaaagccuaggguaguugucaagaucugaagacuuaguuuagauucguuaggccacacaagauuugguuaauuuauauaaacuccaagaucugugugugugugcacacgugcaggugcacauguauguauauguguauggaggucagaggucaacccuccccucccucaggagccauccaccuugucuuuugagacagucuguuacugggucccgggucucaccaauuggcuagguuggcugaaccagcgagccccucccgucuccgccuccccagagcugguguaugcaaacacacagcacugcgugguguuuucuacacgggugcugggguuaagugcacgcaugggaagagcucugucaacugagcaguuucccagagcucaggaugauuucauucaugcgcagagugaagacucugggccugaagccagacuacuuacucauuuaucuagcacacacauuuguggcaucuacucgcacuagcuggucauuaucagaggcgugaggugcgggguggggcaggucugcauccccguucaugggucuuucaccaauucugucugccucagccuuccuuucucuugucagcugccccccggcaccccagucaaaacugggugccuccagggccuucuggucucucuggucuccccacccucagugauggagcaucuuugccaucuccuuucaucauuucuucuuccagaccugaugcuuccuguggcuccuguaacaacucuuaggcaguugucaagcucuuccgugaccucucuugguucucacgucugauuuuaucucgcucgaauccuaccuaauguaguuuuucuuugucaaacauacuccauucucucuugcugaggccuccuccacgcuucuuuccucccaccccuaccuaauccuguaggccuccaacaaagccacaugcucucaaggaggagaacccacaggccacauccuccuccccucaguuauauucuggggcuuuuugcauguguacuggugaauuuuuuauuuuuauuucauuuuauuuuauuuuauuuuauuuuauuuuauuuuauuuuuuugucaacuugaaacaagcuggagugaccuauaaagagggaaccucaauugagaggauaccucuaucacauuggccuaugggcaagucccauaacugaugugggaaagccuaacucacuguaggcagugccacccuagcagguggucccggguuauauaagagagcaaggugugugugugugugugugugugugugugugugugugagagagagagagagagagagagggagagagagagagagagagagccaauaagcagcucucuuccauguccuccgcuucggugcuucaguuccaguuuucgcucuggcccggcuucccucaaugagggagugugaucugggcauugagauggaaacgaauccucuccuccucagguugcuucuggucguuguguuuaucacagcaauagaaagcagaauaguggggcauuuggcuacagcauaucaugucuucccuucauaaaaauaugucucacuguguagcccugcuuggccaggaacucacuauauagaccagccaagccuugaacucacagagauccaccugccucucacguaccuucgugccuggcccgaauuugggagcuuuuaauacaaauauccugugccagcccuggucacaaucauaagcaccagagugaaauuugagacugaauucccaggucugaauucucagcaaggcccccguuuuucuggcugugugaccacagauaauguacuuacccucucugaauguccaucucauauuuucaaaccuggggcauuacuauuggauggcugaguuacucacuauucaguaugaguacauauuguuacaguuuagaugagcagggugcuuaaaauagacugugcuauguagugagagcucaggaaguauuagccugaguuauuucauaggaggucuguguaaauuaaauccaagcccuaggcguagugccuggccuggaacaagcauucaguaauauuagccagugcuguuaucuuauuuaacauaugagaggccuguuagaaaagaaaauaguuaugguuauuuuacugccaaaaauauuuaaaauguccuggcuagaauuauaauuauauuuacuuuguguuuauauauguucacguguguuuacuuacaugugugugauauguaugugcacauguguguggagaccagaggacaaccagucucagguauuguuccuugggcacaauuucauccaccuucagcuuguguguguguguguguacacaugauuguauaugugcagucauguggaagucagcagauaacccuggugcuauuuacagucgcccucugcauuucuguuugauacaggguuucucauuggugcaagaagggcuuagucaggaagaauagaccuggggcuggcaagacggcccagagguuaagagugcuuacugcucauacagggacccggguuuagcacccagcacccacaugguagcucacaacagucuguaacuccauucucagguucucugaugcccucuuuggucucauuaggcaucaugguacauacauauacuaaaggugaacauucauacucacaaaaggaacagcaguuaguucaucuuuuaagaaaagguuagcucaggggccagugagcuuccaguggcccacccgucucucucagaaucacugagaugacaagacaguuccacuguuccuggauuuguuuuaaaacauaaagucuggaaucuacacucaggaccucacuccucggaggcaagcacucugcugacucagcaucuccucagccuugguuuuugagacagagucucucauuggcccuuaguucaccaguuggccagugagcccagggagcuuccugauucugccucccagugcugggauuacaagcaugugucacuacaauuagccuuuuuuaaaaauguggcuucuggagagugaacacgggucuucacgaguacagggcgagcacuguacagaugcaacugucuccccagaccauguuuucuguuuuuguuuguuuguuuguuuuguuuuuuguuuuuuaagacuguaacuugaaguuuaaagagguaaaggucacacaacuagacacacccaaacaagcuaaagcacccagagagaccauagaagcuccuccuuuuagacuguccauacugggccccugguuuuaggucagccaguguggcuacguuugaucuaacaccaacaacgagcaugagguuuggguccacaccaucugcuucccaucuuaccugaggaggauauuuaauccugcagagguugcauuuccuuauccgugggauggagauggugaugccucccucguaggcugugggaggaacuagagaaguaagccaugucacacucccugaaacgccuggacuuuagaugcuguucaguauacuuuaaacuccuuccucugaaaaucugagcaagacuccauuuagccc

SEQ ID NO: 1407 - RNA, 55901 nt, Mus musculus
gcagugucccugcucugagagcauuccaggggcuccaggcacccaacaagcuccggggagcagggguuuaggagggaggcgcucauccugguguguuggacauguguggccuggugaguguguugauuuuuuuuuuguaacuuuggaguucuguuuuaaaaugacuaauaucuucaagcauuugcuuucuaccuagaacuugguguuuuccuaaaaucagucauuggucaucauaucaaccuauaggacaacaauguauugcugccuaugccacuuuauuguuuuuuuuuuuucaacagagagguuuaacaacaaacaaaaaaggcuauagaauucccaagagucacagugcuagagagacuuucagcccauuucuguggucccaaaccugacccuagacuaagcaccacuggauucgcaucugucccccuguguuauucccuuacucccuauagcuggcagggguuacuuuaacaucugaauagcccgugugguuguacaccauguacccuaaacucuugaguguccuaguuugcuuucuguuucugugauaaaauacauucugacaaaaaacaauuugaggaggaaaggguuuaaucggcuuguacuuccuugucacagccuauuguugggggacauugggguagaaacugauacagagaucauggagaaacacuucuuacuaguuugcuccugugacuugcucagucugcuuucuuauacuacccaggaccaccuaccuaggggauggcacugccuauaguaggcuggguccucccacaucaaucauuaaucaagaaaaugacucccccaccaccacacacacacacacacacaggccagugguauuuucucaauugagguguccucuucccagaugauuccagcuugugucaaauugauuagaaaacuaacuaacuagcuuaaagugauaacccccuggucaccauuagaguaaccaugcuauauucccagaaccauuucguagugacuuaugagaugcuguuucuaacauucuguuggaccauucacaucacauggaauaacuauugaugauacugaugacagcauuuauuuaaaacccccaaaauaauaugauuccugauucaaaaaaaaagccuuuacuuuggagauuaguggccagugauaagcauggauucccaauguggaauugaaacuaccgguaucugaaaugccauggaccagcaagaauggggaggcccugacucauggccucccuuguggccaggaugaacucagcucucugugcuccaugaugaagguuuauggcccuucugaggcuccauaaagagaguccauugagugggacugaagagagucaggucguauauucggaggguagggggaugagaggucugaccacugucggccucccucuugggaggagucuuaauggacagcauuuuaauccauuugggcacuucacucuccauggccuuguuuuuggaaggaaucagauaaauuagccucugaaacaccaggugcaacucucgcgggguagaaucauuguaaaaggggucuugggaccagaagggaacaaggucccagcuuuaacucacuguguucaggaaugugaaacgggaaacucuauuucccacaaaagagccaauauggcuucucccaugccaggugcuaugggaaaagucacacaaaugcuguugaaagccaucucagucaccucggucuaagcuagcccuguucuaaauuaauacagcaugucuguccuauucauuuucuaugaaguuaucacaaauuuagugccauaaggaagcgugcaucgaugacccuguaguuccauagcaccgaaauccaaagugggucuccgugaaccaaaaucacaacgccauggagaccacaucucucucagcucuggggaccgggaguuuuuugcauuuucugggcuuugagaaugggccaccucccugcccuucuaagcugcacagaggugaaauccacacaucucuucccucagacucagcucucccucauucaaggacucuuauggugacauugggccugccaaaaccaucccagauaaacaccuauuuugaagucuguuaauuaguaaccuuaauuccaccugcauucuuagcggcccuuugcacuucugggcacccagaagguaaucuuucacagguugcagagaauccgauguuguuuuacuuuccuuuccuguugguguaagaaaauaccgacaacagaaacuuaacaaaaaggcucacaauucaaggcuacacacacacacacacacagagagagagagagagggcggggagagagggagagagagagagggagagaaagagagagagagagagagagagagagagagagagagcaauacaggugcacacugugguguuuccacaaagacagaauaacuuaauaaauuauugcuuggugugguucucuguuguuaagugacgaaugaucauagccccccuuugugauguauaaauugacugucucaaagaauaauggcuuagaucaacaaugucuuaacuauuaaaaugaaaguugguuucaguggguuagcuguagguugacuggggaacaaugucaguuucugcccugugugguagagcuggaguuacuauauggcuguauucagaugggagcuuagaaaaauagccuguuagccugcauggucccugucuuuacccucaugccacuucaucauucaggagugccccuagaauaucguuacaacguggcaagcagcuucaacaagaacaagaguaaaggcugccagcuguguccucauacuggcacaguucugcucuuguugaaaucaaaacagacgcagggucagccagauccacaggaaggagaauggauugucucuguacagaaagguguaggagaugcuugcaugagaucagugagcaacauccauguaaugugugccuggagagauuggaggccacaguacugcucugagucccaugacugauuaugggcuuggauguucccagccugcucgggagaaccucaggcagcccucugccacucagucgcuucacguuuaccaagaaaaccccugccagucucucaaggcagccccaggagcuacauucugcagccccagagcugcuuagaacugagccagccugggcuacagugugggacuccuucccaaaaacaaaacagacaauuauggauguauauauaagcauguauguagauugugugccaccaaacaaagcugaagaauacuaauuuggucuuuccuaacuuacugugcugccaaccauuuuuaaucggcuaaguacuugugguccuggaggauccaccuuguagggcagucagauauagcuugccugcuaauaaguuagacaaagaaacuauuucccauuuugaagagugcagggugaccucucuccuuucucuacaauuuuaagacagaagaucaaugagagcaaacauaacggacagcuugauuuucauagucuuccaagacaagaggacuucccucuucugccuuucuauuagauagcagcuuuucucauauuguaacuaauuuacaaaaauaauucaucuagacuaggguugugguucaauggcagagacuguguuuaacaucagugaggauguggguucaauccccagcaacccccacccacccuaaaccuagcauaugccuagucuaucacuuaggaugcugggaaaaauaaugggcaaauauggagauuacaaacaaaaaugcuuaguauuuucaaaaaguacuaucuccagagcaaaaugaaccuuaggcugggguugaggcucaguugucacguguuugccuacgcugcacaaggcccugaguuccagcccugauaccacauaggccagguauggggauaugcacuguaauccagcacucuugacacuugcaaauaaagacagaaggaucaggaauugaaguucagccucagauacauagcaaguccaaagcuacccuauuguaacauauuuuugucuccuaaaaaauagauauuaaaaaagaaagaaagaaaaagaaucucuaauuaagauuuaaaccccagucauucagggcacuuuauaggaagacaccuuugacuuuagggccuagagucuucuacauuguagugggagucauuucuuuugggacaguggcucuagccaaggcagaucacccaugaaggaagacuucagcaaaaacagagugaccuuacacauucuaccuuaccuuccucccuaauacacaaacacaaacacagcuacacacauacacagccacacgcagaauguuccagucaccuguaccuuccaaggaccuacucucuggguuucccaagggucuggccuuccuugcaaggggccccauccgcugcauacccugccuauccgucucugcuuuugugcugcuccaacagaauaauugagacugguaauauauaaagaagagagacuauuuguccacucuggagacugagaauuccaaagcccaggaccagcaucugguaggagcuuucuugcuagagauccuaagguuggaagagagguugggacugaugggugcuugcuuuuacaucucccucuugugacaaugaaccaacuugugugacaaugacauuaaacgaguccugaggcagagcuucaugaccaaaguaccucuuuaagguuucccuuuucagcaccauggcacuggagacuaaguuuccaaacaugaaaucuuugggaugcacucauaccacagcagugugcaguaagccagccccagagagcuacauacagacuagaugggcauaagcaaagcuuucccagcuucagcccucugucgcugucugaguugggaaauucaugacuguagacauauacucuauggcggaguaauuuaaauaugucuacaaccaguguccuagauaugcauguuuuucaugggaagcaugcacauuugaaaauaaaucagacaaaauuuauacuaauguggaaugucaucugccacagcacuuaggucauucuaggacauuuaaaacuuaggagauccaggcauggugugucaugacgguaaccuuagcacccaggaggcugaagcagacgaauacuguaaccucaaggccagccgggacaauucagugaaaccucgucucaaaauaaauuguaaagaaagagcuagagacagaaaguagcuuggugacacauuccuugcucuguguguguguguguguguguguguguguguguguguagcagggagaggggacuaaaaacaaagcuaaaaacuaaaguugagugggcacuacaaaauacccagaaugccagacugagucuagagauccuacacagaaccaacacagccucacaauuguuuagacaguauugauuuagaaggcuggggaucccuugauucuccuggagccuauagauuugggggguguacuuggauacaggugucuguguaggccucacuuccugguggaauaaaaggacaagcgucuagcaaccaccgggaccagaucaaacaaacaauggcaaccuaggggagagucagagcccaaggagaagguccaaagaauucuuuucuaacagcagagaucuagucucaauuauguuuaacugagaugaagcaauauggugcucuagugagaaccauggaccagaggacaggacacauggguuaaccccaagcucugguuccaucauuagcacuuaauguagccuuaagugauccaggcucuccaaggcccacucaacuuaucucugaaaagagggagguccuucauggucugaagcuuucuuuggcugcuuugagaccuagcugaacauccauuagguugcaaauacuggcuuucuugcuugacggugccuagagaguugggagcgugccugaacucaagcccuguaucauuggcucgcgucuguacagugggauccagggaagaagcacgcugagucacacagagaacacacccugaagcugagggcugugggcaagcugcuccucacugcaugcugcuccaggucacacagaaaagucuguggaagcuggaacugaggauucuagucucagaggcaggcagcugccaagagaaaaacccagaaggccugagcuagcguuccugaugucaccguaguccgcaguugggauaaguugucucuucucauccccaggugugauaguuacuuaucucauagcugugacaaaaaucccugggaaaagcaacuuaagaaaggaagagucuauuugggcuuaaaggucaagggggugugguccagaaagaaaagagcuugaggcaguaggaagacuguacuagaggagcaccaaugccagcucauggucuccuuuugauucagucagaaauucaauccccaggaugguaccacucauacuuggggcaggucuaccaucucguuagcccaaucuagacacuguuucucacacauucucagagauuuguuuucuaggagagucuagaucccaucaaggugaccauguaaacagcacacucugggcugcuauaacaaaguagcuuguuuccagcggagucgaugcccucuucuagacuccacagguacccaggcucacguguaugcauaaacacauaugcacccgugcacaagcacacacaauaaaacaauaauucaaaaagaaaaguuggcacuccaauuuugcaaaaccaaacuuccagaggaugagaaugcaaaguguuuuauuuuauuuuauuucugaauuuguggauguuuuaaaaguggagcaugagcuuuaaucccaccacuugggaggcagaggcagguggauuccugaguucgaggccagccuggucuacagagugaguuccaggucagccagggcuacacagagaaacccugucuugaaaaaccaaaaaaaaaaaaaaaaaaguggagaauaaacacaugacuauaaacaugacugguggggagcauggcaggagguuucgggaggcguuguucaauaccaguccacaagugacugaagaaucguucugauguucccugacucacucuucccuugcccauauguuuugugagaagcuggaaguccauaaaaaagauugugagguuucauuauacauggcccuuguucaaggcaagcaauaccgaaaacacaauauccugaauuagacauagauuaauuacaaaggaaggagaaaccgaagagggucaauauuuauugaguaucgucuguuugccaagaacuauacuggguacuuuauacacaugaauuaaccuuugcagugaguuaaccuuuauggugacauuaacccuaaaguauccuccggaaugacuuccuuauagagauaaauauacugaggcuuagagagaucaaaccaauugucaauuaucacaguuaccacaaggcaaaaccaggucuaccuaggacuugggucuuacagcaauaguuccauucucucucucucucucucucucucucucucucucucucucucucugugugugugugugugugugugugugugugugugugucuagggaggguaugugugggugaguggguguuucugggugugucugugugugugugugguaugcauauacuaaacagugaacaaaagaucuugaauaugugggaaaacgguucuacuacuggacuacacugcccgcuccaauacgcccuuccacaagucucucuguucuauaaacuuagauuagaaaucagggugauagaagccuggagccuuaaggaaguguauuaaaaucagaccucuauaggaaguaauagacaaggcagaacaaaauaugagugaguccucuuuacagccuguucagaaucuauguugaccauuaaugaaguacaaacagcagcuaugauggugguaccuagacuguguucacgggaagagccaugagaauggugcacacaccaggagcccagacagagguuucccacagauggacucugggggagggcucaucugaagccagggauggcuggauugagaggaccagaaagccaguccagcacugguaaguagauagaggacaacuggaagaaagacaguaucuucccagagaaaagcgagccucggacagcaaaggcuaccaaggccaugggaugcugggauaugcuuuguaagacaggcaaggaguuacagguacagcucagccagcaaagugacuggcucgugagcaugaagaccugaguucuaaacccagaagccaccuagaaagccugaggaugacuauacagagauggguagacauuuacccaugggaagccagccuagcuacuuggcaaauggauggcacuugaggaaugacagccagaguuuaccucuggucuucacauacacaugcacauaugcacacaagugcagcauguggggacacacacacauacucgcucaaaucccacaauucuacuacaaguaaagacaaguccuggcuccuccccugcuuacucuggaaaugaccguccuguugcacaguugggauccauuacaaugaauauggaauccaaaugaauaugucuaaauuaauagcucaccaaucugcauuaacagaaaaagugaguuuucuagggaaccgacacuuauaacuuuuaagcauuaaacuuuugaaaaguuuagccauuuucacggaaacuguaauaaggugaaucccugucugcucagccucauuaaacagaauacauugagcaucauuuaaccaguuccggaugucuuugaguccuugcugugaacaucaaccacuacugggcaauggcauaauauacccucaggcucugugguaacagacagggcuucuuuguacccccguggccaucuuuacugcacucaggauugggaaccacccagcuuuccagcaucuccagggugguuuguacaguaguucuccuaacagaucaccuaaaacaucugugccacuuucugcuugcacuguaguucuucuaacaaacagaugaccggaaccuuugcacgaaaugacagcugccguggaaauaaaauccgccagcuucugaaaccgucuccaucuggaucuguaguucucugucaccaagcuaaaauacaaugguugagaaggagcccugggcuuaggcccuaaauaaagcacuuagacucugacagggaguuuccuugggaucuagcuggcuuuuguauucauguccaccugcaucacagcucaaugcugcauccacacuuaugaccauaagggguggaccggacaguguuucuuucaccagguuuguccuucauuuucugagaugaugucacucggcacucuggccucauccuauuauuucugacuuauuugucuacagagaauacacagaaagguggacucuucuguuugaauagcuuguccuuuaccaaacuccagagugcagcagcuugugauuagaaacacgagcauuucucgaugcucugugacucaguaggaaauacuccuaggcuggguugguucagccacugcucaccccacccacacccacacccacccaaauccuauuuacguggucucagcugaaagagcuuggccuucucuucaugucuucucccaguauccggcagaccagcaagcuugucgcaaagguggccgugagaaaaugaaucacauugugaaacagcauuaaaauuucugcuugggcugguaaaaugucuugguggauaaaagcacuggcugccaagcuugacaaccugaggucaguucccaggaaguggaaggagauaaccaacucucaguggugguccccugacuucuauauacaugcuguggugugugugcacauaaguaaauacauaaauaaacacagauuuccaucauucgaagcuucugcuucugucguguuuguuaauguccccacauccaaagucacugacaucgucacaggcaaauguaaaggagaaacuagcuucuguaugucaaugagaaagucuacagagucagugcaaagggcauguaugcgggagaggagaacagucuuaggacucucaagaggaucagaaccaaucaaagggggugugucauacuggguggugguucaauggagggugcacacuggagaggcugagaacccauagauguuuagucuacaaguuuggauggucagcagucccaaucuagaacugauaaucuagaggguucuggagagcugcuggucuucaauccacaucagaaaguccaagaauaugggcuccagugucagugaagaaugguagcagaugcaguagcaaaagagaugcacgcaccagcaagaagugaaagcaggcaggcaaagccagcacuccugucccuuggaagucuucacauaugggauggcaccugaaggugauaccuauucuagacuaguguuuuucuucaguuaaguuuuccaggaaauauccucacaagcugcacacugagaggugugucugcuaucugcaaucacuuugacauggagauuaaccaucacaagggcacguauauuuugcaaccaaccacauccagacaggugcaucaccucucagcguggguacaaccaggaaacugggugcugauaucauuuaauccauggagguaaaaguuuaucuucccaacagagcucuggcgauggaugaagcaaagccugucuccuucuucacccuggauucacuuaguaacucugcuuuguuuguuucuuuuuaagguuaaaaguaguuuuauuagaaaaaugaagauggcugcauacuaucuugaacauaguuauuaacgaugggaaccgaagagucccgucuugguguccuugaacacgguauccacuucuaugcaccuuguucuuuggaccuagaaaagaugagcccacucucagcaguggggauucuccgcuuccccacaugcaggcucugacaaacccuccgguagcucguucugaaacagacuuuccucuuccauugcagccagccccaguaaguccaccuuuuggaguucugggccucagacaggaguagggugugggaacagcucuuuacuggagucacuuuguaguucuuacaagccgauuucuguaaccacugcccuaguuaauugcaucucuaguaugaaaggcaucuucucugucacugggaggagcaggcagcuuugcccugcuguuguccacccacgcauacacgcacguagguccacuuggguuaucaucuccugaaccucacuuuuuuuuuaaagauuuauuuauuauuauacauaaguacacuguagcugacuucagaugcacaagaagagggcaucagaucucauuauaggugguugugagccaccaugugguugcugugauuugaacucaggaccuuuggaagagcagucaguguucuuacccgcugagccaucuugccagcccuuuuuuguuuguuuguuuguuuguuuguuuguuuguuuguuuguuuguuugagacaggguuucucuguguagcccuggcugucuuggaacucacucuguagaccaggcuguccucgaacuaagaaauccgccugccucugccucccaagugcugggaucauaggcaagcaccaccacugcccggcgaaccucacuucuuacaguuuccuguacacaucaacacuuuguucgccuguccauucacugcuuggacuguuauccuucagaguucuguucuugcuaguccagccucguuuggcuuucuuucucacaucaucuccacaaacacauuucauccaaagcucgagccuuaguuaggguuucuauugcuguaauaaaacacuguaacuaaaagcagcuguagcccaucauccagggaagccagggcaggacucaaggcaggaaccaagacagaaaccccgaugcaccauugcuuacuagcuugcuaccccugacuuggccagccugcuuucuuaaagcaccugagaccacccacccaggaguaagaaucaccuacagugaccuggguccucccauguuaaucaucaaucaggaaaaugcaccccaagccuaccaaucugguugggauauuuucuuaauugcuguucccucuuccaaaaugacucucuauauaugucaaaguugacacaaaaaguagccaacacagcucacgauaaacuuauagcaaaugauuucacagucaaaucccugguuccuagauuuguucucagaguaugacuucaguuuucaaaaggcccaagugaauauuucuacccaaaugucuaaucuagaguuguaaugaaaaccacauuggcuacacacugagaagacaguggcaggacuguaugacuguguacuguccucagagucuccaugucacauuuuccaucaaaugaaagaggguagggagguggaggaagacaguguagggcuaacauuugcuaaaugcaagcuugacacagucucuuaguuuaggaggauaaacaucuccucgaacugcuuucaaagaacguaugcaggaccaaucagauguucacacagaaucuguagggcuagaaugucaaagagagacuagugaccuugcagugacacccaaggagaugcgguauggacaugcuuaguuuaccucgugcagugacgcccagaaagacaaaguuuguacaugccuauuagccuagggaaagguuugaaaacagucaaggggucgagguaugugugugacugcuguaauguauaaggagaugucuggaagccuuaaaugauuucaauaaagguaucuuggguuaacaaacagaaacacucuuucccugagaguucuagaaaugaggugugcagagaugacucgguguuugagaguacuugcuacucuugcaagagaauucaggacugguuuucagcacccacaccagguggcucacaacugccuauaauuucaguucccaaggauucagugcucucuggucaccaugggcacacauauacacauaaauaaaagcaaauggauauuaagagaaagguuuccgauaaauggguuacaaaauaaaauuaggacucuccuuuucucaccuagucacagauccuagaagccccuagaacccagaguaaucucccagaacauuuauuguuucaagaccaaaugucuucuguugaaagugacaguucuccucauuuugugaguacacuucauucaguaaaaaugaugagcgaucuugagagaauucaccaaacucuauguuuacagccaaacauaguagcccagcuuaagucuucugagggacucuggauaacauaaucaaucagcucauugagccugauuggagccaguuuugagcacagccuaagaggaugcugauagcuuaguucccuuuccuuucaggauggggaguucugagaacacggacccugggcacgcuaggcaaggguucucccccugagugcagccucugcuuucacggcaugcaugaaucugucacuguuuucuagggucauuuucaugauuuuagucgagucuuuccuuaaacacacagaauaaggcucccuuugcuccguuguauuuucacacugauaauguacacagagggucccagaucccagcauggagcacaacguggcugaacacaagcuggugacagugaguaaagccccauucucuaagaagcaacccauuagcuugccauauggccagaugcuauucguuuaucuuucuaauuuuaguagggucggauaggaauaccugccugacacugauucuuguugcuuuuuuguuuuucugguuuguucauauuguugggaauccucuuaugaagcauccaggccucuuccuccuauggugugcucuagggccucauucuagaagacugccauuuaagaacuccgugcugaaugugaguuguccuguguuguuuguggcucuuaccgccaugcccuucuuauuguugggauccguaagugccacuguuagugaauuuggcuagcagcguuugaagcagaugagauuuuagcucacgccuugauaacugcauuggcucagucuaagcgaaagccuuauuuucauuaaagggagcagacaugcugaggaagaaggugcuauuuuuacauagggucuuuuuuuuuuuuucuacugaaaccacaugauaacacugugcuguuaaaaugaucuccagcaugcugaguuagcugaagaaacaauaugcauguugccaaaaucaaggcggaacuauucugagccuccuccgcuccaaccucuagcucuccuugguggucacgcagaggagaccagggcagaacuggcaaggaagaggaugcuacagacagaauggagggugcuacaaucgccaguaggagauuauauacauuuugacuauuuaauuauugacuccccuccaucauugauaugagaacuguuuuuaauuggauauuugaauauuacuaauauuuguugagaacccacuuuaccacacacaaugugguuuaucuauccauuugucuaucuauccaucugucuaucuaucuaucaucuaucuaucuaucuaucuaucuaucuaucuaucuaucuaucuaucuauccagcuguaacucacuauguagaacaggcuaucuaucuaucuaucuaucuaucuauccauccagcuguaacucacuauguagaauaggcucucucucucucucucccucucuacccaucuguaacucacuauguagaacaggcuaucuaucuaucuaucuaucuaucuaucuauccaucuguaacuaacuauguagaacaggcucucucucucucucucucucucucucuacccaucuguaacucacuauguagaauaggcucucucucucucucucccucucuacccaucuguaacucacuauguagaacaggcuaucuaucuaucuaucuaucuaucuaucuaucuaucuaucuaucuaucucugagucacuagguagaaaaggaucuucucuaaauuacagagaucugccugccuaugacuccugaacuccugaacucugggauuaaaggcaugcaucaccauaccaucccuucgauauaguuuuuuaguaaaggaaguauaaaacagaacucaggcuaacuuuagaacuuuacuaauagaggaaguuuaaguaaaugcccuccugccuuuuuuuuucccuuaaagcuauuauuauauuuauauuguuguuaacuuguugcuauuauaaaugccaugauugaauauauacaacaggaaccucacuaagcaaucuauaaugccuuuguugauucucacagcgaucuuauccgguaacucuuaucuccauuugaagcagacaagacgucaggauccccuaggaaccaagcaaccagagauucaaacuuacauggggcugucuagcacuaaagccuccgggucucaccaggccauacugcagcucuguguuaguacaauaucuggcccuccacuguguauggcucagccuucguucucacugucauuccauccccaaaauucaaaaaguaccaaugggagcaaguuaguacaaacaaacagcagaguuaguacagcaaguuacuacagcagaaagacaaaggucuucuaucuucaugaucuucaagcccuguaugcaaagcaucacgcauuuuguuucucuugcucucaaguggaggcuuucccccacugaacaccggaauuugagucaagugccuguucacagacaggcuuguacuugacagaggaaaugauuggagugccugcagagcagacagaugcucacguagaggacggcuuauugcuuuucggcccugucucgaaagcaaaauugcuuuuguggccuccauauuccccaagaucuuguacagauucagaguuugcaguaaggagagcaccacagcugacaggcucagguagccaaagcuuguaaacacacaaaagccacucagaaaugugacaaaguggguaagaagagaucaagaguacaaugcccuagauuugggggguaauuaagggaaucuguaaaaagagaaaagaaaucugggccaguugggccaaggaucagccaucagauuuuagaaaguuaucaacuuccagaccaaaggggacaaaacuccaaguccuggaagccuugacucagucucuuaguacagccuagaagugaucugaguugucaguuuagaagcucauacuuagagguggugucuguuccuuuaccuaucaguuguuaagaguacccagcguccaaguugugguaauggacaccuuuaaucccagcauuugggaaccagagacagguggaucccuaaauucaaggccagccuggucuauguaauaaguaccaggccagccuggucuagguagugagagucaucucaaacaaacacaaaaaaagauucccagcaccagccgcucaggagugucugagacugcuguugaaagucucauuucuggcuuagaucucacagcagaugcccuuggaaggaguaggggagggaucucuacaaugcacuacaguaaaggcggaagaccgggcagaguuggcaaaugcauggcugcuugucugugucucucugcuccuccccucgagggugagaacaugugaugaacagaaagagugacacauucuuuagggcuugauuuucuccaauguaaacaaccucugaaaccauguuuguuacgaacgcuugacuccacaaaccuauccuaggcaggaugaaccauccuuucuauuggacagcuccucccacaugccucuuaaccacacuguugguuuuuguauuuuuaauauauuaaaauacucgucccuaauaauccuucaccguaaggucaaagagcaaauccuuauaauaugccaggacuucucugggaaucuccaagguauacuuaggcauuaugagucuagagacuucuuuauccuaauguagagucuggucuuagaagacuuagacugcagaaagagcagagaaaaccagaaguuaggcuaggucagaucacaagugccugaagaaaaaaauccaucaugugucuguuaaagcaacaauacugcauuuccuuuaagugccaaaguaagucaaauucuuuucuuuuuauguauuuaagugugugugccuguguguaugaaaauguauauggaagucuuccucagaggccaggaagaggacaucacgucccuuggagcuagcgcuccaggugguucccagucaacugccaugggucugggagcagagcuacaguccuucauaggagcaguaaggccucuuaacuacugagccauccccucggccucaguaaaacaaucccaaagaugcuuugacauuuaggagguccgagauugcucuuugcaagcaugaacauaaugaaaccaacagaacuccuuagucucugcgcucuacgugaggugagcacugcaggugaccgaugccugagugcugucccucacucaaagacuuggggauuuuaacagagggaaagucaauuuuuuguuuguuuugcaauuaauucaauauuuggcaguaaaggauccaaguucuucuucuucuuucucucucucucucuuuuaaaucuuugaauaagaucaugaaaacuaccaaaaugucaacauauuuuauuguuuuguuuugcaaagcaaagacaaaaaugcuccauuuuuugcaaaccgucuacaguuuuccaugcccgcuuauguuuugucuuucuugucagcuucauuuccugaaacagcauuuuuguuuuuuguuuuuuguuuuuuguuuuuuuuuuuuuuuuuuacgacaaacucaucucuuuuuccccccuugaaaacaacaacaacucuggagaauggaaaccgacucagugguuaaaggcacuugcugcucucacagagggucccagcucaguucccagcacccacauagcagcucacaaccaccuggaacuccaguuccaggggcucugaugcccucuucugacuucgaugggcacugcacacacauggcacucacuugcagacauucacgcauacacaccaauuuuuaaaguuuuuaaauagguuuuuuuaaaaaccucucuuucuuuuccuuuggcuguguuguacuucucuucauuccacaagcacuucuguguggcuggccuuccuuuggucuuaauuacuuacucgcaguaagcauagauguauccuuuucugucugaguacuugaugguaggaauuggacaucuucaauucccuagucaaguaggcucacugaucugcauaucuagcccagauaagcauaacuuuaagcauacuuauugucuuaguuaaaguuuuauugcugugaagagacaccaugaucauggcaacuuuuuuuuuuuaaauagcaaucuuauaaaggaacguguuuaauuagagcuggcuuccaguucugagguucaguccauuaucguuacuagggcaggaaacauggcggaaacauuuagguagauggugcuggagaaguaccugagaguucuacauuuggauccacaggcagcaggaagagaauguggucugguuugagcuucugagaccauaaagcccacccccaauaaggccauaccuaauaaugccacucccuaugaacccagggagccauuuuuacucaaacuacaacauuuaccaaccucaguuuuacagaggaaccuagauaaaugguuaauaacugagcauuauauauauaaguaaaagugaaauauguuugguaaugugaacaaagaccgucacuguagcacuguacagcagaaagcaguguguuuacauguucauaauuauguguaguguuuuguauucuauuggaaauuaucuaggauugccaagcguucccacugcuugcaugaauauuaguccaagacuuuaaagugaaccuuagaaauuaugauuauauuaauauacaacagagaaugauuacugauacuaaaagauuaucaauuuuuuuuuguauuuggguuuugccuguaucuaugucuaugaaugacaugugugucuggugcccacgggggucagaauaaaacauuggaccaccuggagcuagauuuucagacaguugugagcugccaugugggugcugggaacugcaccuaagcccucuggaagagcaaccaacauucguaaccagugaacuuuugcuacagugcaaauugucaaaacucugauuuagcuuaauuaguaacacacuguuguuauugucauuuuuuguagucuggaaacccagggcauuguguacaccacacaaauguuacacuacugaguucuucuccaagucuagacauaaucuacaugagucucacauuccuuaccauuaaguaauaauguuagcuuaugucaccaauaauuccgugugcaaaacaagaacauucagaaaguuaacaaaaauauucugaaaggcaaaauguacaaaugcauuuuauuuaacacacuaaaacucaaccuucugucuuaaaccagaaguauaaacuagacugauuuauccaaagauuuccuaugaauacaucaaacagauuuagauuaucauauaaaaugcauguguuagcacuuucugaaauaauuuuuacuaaaagacuguguuuauuguauuuagcuuauuuuacagcaauucuagagcuauggguuuauagaaacauuuauuacuguccacaagucagcgagaauaaaaugucuuuaacuuagaaaagaucuaauugugauuuauuaaucuucuccccacggaaggcaacagggcacacacagugaaaggcacacauguuucucaguugcagagggcugacuggcaacagggcacacacagugaaaggcacacauguuucucaguugcagagggcugacuggcaacagggcacacacagugaaaggcacacauguuucucaguugcagagggcugacuggcuucugugaagcaaccucaguuccagguuagcgaggagacaaagaacuggauaucccaguucccaaaggacuguuugcuuucuaguagguauaaaauguuuuccuaauugauuugaucuugccaguggaugaacagacaaauaaaaagaugggcacacuggauuagcucucaucucucuccaggcagagaacagagacagaucccauuguucaccuuacagagagcgccccauuauucuaucauaaaacuaagguuccuguaacccaggcauugggcacaacaggaggacaugagaacacaauucccacuuggccagugauucaaauccagaccugcacagcaguccugaacucauguguaaccacucauuuuaugaucuuuagauugauacagcugauuugaaagaaaaauguggacucgcuagggccuggacccagcagucaaaagagacucuuggugucuccacccuaaccuguagcacuugccacuuucugcaauguaaauucuaccaugauggucacuuuccaucugucaacacauugucaugggcacaguaccaauagcgccaggaucagauuucaccugaagaugucagcagaccucccagaguggccccagagcucagcacuuucacagcacuuucaucaucuuacuucuccugcuuuuccuuacagugagccagaagucuuguuucccuacagcuucuaacagcaggacuuagccucacucuguguaaguugacaagauaaggcuacacacugagccaaugaauguucaaagccaagugcagcuagcuaucuugaaacuaggaagcuuguguccccacuuuauagauaaagaagcugacacuuccccuuuaaucccagcccucaggaggcagaggcggguggaucucugaguucaaauucagccuggucuacagauugaguuccagacagccaggguuauacagugaaacucugucucaaaauagaaccaaaagaaaaagaaaggaaaaaagaaaacaaaacucugagugucaaagauucuaaugauuucccuguuucuucaauguuacacuuugucacauuggaggaaaccaaagauaaaauuuucacaacacaugcccucugagucuuuguucuuuaauuguauugcuaacucaucuaacauuaaaaaaauugauuuuaucauauacacauguaugugugaaggcacauacaagccaaaugacagguguucucugucacuaucugacuuauucccuagaaacaggaccucucacuuaaccuggagcuaggcugacauucagcaagguccaaugauuucugguuuacccauucuuuagccuccccagcacugaaggcccauauuuuuaauguggguguuggggauuugaacucagguccucuugcuugcaaagcaagcacucucacacacugagccaucuccccaccccagacucguuuuuuaacuccucuugucuuaguugcucucaucuuguaugucuguuuagauggcaucuuuauagaaaccaggcacccuggagcuagucggaccgcagauacugagugucggaguccacacuccaaacaaucaauacauuaauuauuuuagccauuuggacaacuaacugcuucacuuuucaaaaguuaaaaggauaauuucagagaaaugcagaaagaggcagagguuuaauaaauugggcaaggagcacagcucauuggaggguaccuggcuagcacgugaagaacgggguucuauccuagcuccacauacaagaaguuuaacucaugaaugaagacauuggcuuuaaaacauuugaggaacuaggauuuauauggacugaaaaauaaaaacacaauuuuugcagaccauuaaagcuaccuuuuuuuuuuccuuuuuuuuuuuuuuaaagcuuccuuuccaccaaaaagaaaccugaaaguuagcacaggucuuucuguuccugagcccuaacuaagcccaaagucaaacaggacacacccuccuauaaacuaaauguucccauggaaaccuuacacaauacaguacaaccuugaaaggacuuacaguuccuaguuccucuaauacuuuaaaaccaaugucuucguucaugaguuaaacuucuuguaugugguacuagaaauccaaccucugauuuaucuucaaauaucuccacagcccuugcuaccuuuuauauuaugagccauugucucuccagccuucaggaccacuaaaguaaagcaagauagacucuacauuuaacucuauggccuuucuuucucucucugucccuccccccuccucccuccugcucuuuccuuucaccucugcccuuccccccacacccacccaaacaccccaugccucagguccccuguaucccaagcuggccggccuccuggccccaaacacacuauguaccugaaaacaaccuuuaucuucugcucccuaacuccaccucggggucaccaucaccaccuccauuuuuuuuuuuuuuuuuuuugcagggcugaagauccagccuggagcugugugcuugauacacaagcccucuacccuugagccacauucccaagccuuggaguucuuccuguaaguccaguuuauuuuucuuuccagcacaagauggauuucucuauacccauaaucaguaacgcucgauugagaaaccuccuguguagcaagguggccggcaaguaacaauuacucacuggaguucuggguuaagagacaggcaaaccagacagcuggcugaacaauaaaggggaaaggaaugccaaaauaucaccaaaaccuguuguaaugugggccagguaauacauuucuggccaccauaccuaacauaaucaaggauuauaugaaugaguuuuaccaagugguaaaagaaaaugcuuuuaaggagaaaaaauaaaggccucccuaucuguaccacagcuucucuguugaguauucucagaaggcaaacaaaacccuaaacagaccucaauggcuaagagcuacauuuuaaaccuuaauucuugucccuggagcccaaagacaugcucaucugaaauuccaaagcucaguaagcaauccagggcuguuuaccaagaacaguaguuuauuuaguuacuuaaaccauaaacccuucaccagccugucuuuccccaucaaaaaaaccauaaaauaaaccaaaaagauuaucacaaaugaugaugaaaagucugguaucgggauggauaacccacgagggucaccuuuguucuuacuuacgcccaagugagcugagcuuuccaugaaggaaugacacaaagacugaaaacauuuucaaaauauuaaaacuuuauuguuauguuaccacaugucauaaaacccguauuuuagcauuaagaauugcagacauuuuauuagcagaaaaaaaauaauuuuccccaacucuugucagauauguguuuaagacauacuaaagggauauggguuuguauuguugccagauucugagccacaucaacucuggcucuggugacugguucuaacaucuggaaccacgcaaaaauaaguggaccaguuuccauauggcugaucaucagaucccccugcaggcggcucaucucugcugaaagaagcaugcccucucugaaaauggcuucaagaucuauuaccuuccuuuggggguaguccagcuuacuagugugucugucugaguguggccuuguuggaggagguauggccuugcugaaagaggugugccauugugggcuagggguuuugaagucucacauaaacucaagcuacacccaguguagaauauagucuuuuccuggcugcuuuuggaagagagccuccuccuggcugucuguuccuccugcuuccuacagauaaagauguagaacuucuggcuccuccagcaucuuguuuaccuguacacugccaugcuucccacccugacaauaauggaguaaaccucugaagcuguaagccagccuaaauuaaaaaaguguuuuccuuuaugggaguugccuugguccuggugucucuucgcagcaaugaaacucuuaagacagggcccuugcugugcaagcaugagcuucgcgucccuauguaaagacggaggcuuggccccacucaugcuugugaccccagugcugagaagguuggagaaggaggauuucggggacuuguuggcaaccagcccagcucuaaauucaguagaagggccuuccucaagagaaacagaagagggguggaacagggcaccugauguucuccucuggccuugugugaacuugugggcucacaugcauaugcacauaugcauacauacacacauaccucacaggcauacucacauacacaaaaggagaaggagaagaagggaggggaaaauggaggacgugaagaaggggaggggaggaggaaaugcaguggagagaaggaggauaagaaaugucucauaccacauuuauagcaggcagucauguuggucaaccuguuuugccaacucuacggucaaacaagaaggcaaggggacacgacaccaaacaccuguaaaggagagauuccaugucuaagcuuucuggagacacugagaauucuugccaggcuaggggcagucagucaauuucaguccagggaagaaagugccacaccauucaaagagagaaaccccaaccaaaggugugugaugcauaggugauuaggagggugcaaagggacaccagggccgcacacaugaucauggguggaagcugcuaucccagaaaaugccugggaguggagcuacagacaccaauggguauugaccggauggaggagggggacuuuagcaucuaagguacuuucaccaugggaauggcauugagcugagacugagucucaagggaacuccacagcucuccugaaucugccuuggcacucaagcaagcucauccauugccauagcagaacaugugugaaggccucagagcacaggggacaaugaugagagauuucaaggagcagcagguagcugggccacuugccaguuaagcugaggguacccaggaaagagaggacacucagauauaguugaauuucaaauaaacaaguuuaugccucaaauaucauauaggauauacuucuccuaaaaaagcuauuuuuuuuuuuuggucugaacauaaacagaaucuuuccuguuauuuguuguuuguuuuguuuuguuuguuuguuuguuuuuaauuugcucagccuagcuauucuaaggacacucuucgcagucugugaggcaccucugcaugaccacauccuccucagacucugagaagaaauguaagaguggcucacuugguuaucacugccucuccuagcucggagucuuccucagcauauuuucuugauaaagccuaagagggagccauuggcgaugcagaaaugcagauccaggaaaguggaucuagggucagaagaaaccuuaaguugggcuggagaugguuuuucgguggugugcuaacuaacacuucacacuggacugaucuaagugauugccccuggucccagucagcuuauaaagugcuuaggaauaaguggcucuuggcuucauguggcuucaaccugagccccaaacuugcaaacuuuaugguuuggauguuuguagaaagaugccauugaucaauugcuauucaucauuucaaauuaauuccauuagacaacaacgggaugagggaagggugaccuaugcuuuugauaauaacuuccggaaauaagaaaugaguuagaaucuccaagucaucacugagaccugcagagguacaggaaagaauacacugacuugugccauggagaaaagguuuucauaugccuuguuaccaaagaaacagaugccagugagcccagaucaccagugaacucuacucauuuagaaaaggaaagacccaugaaguggcauaggauguuaaguaggaggaggacucgcccuugucugcgauuuccaguuuauaaacucuucucuugaugucuuuaaaaucccauauaccaaggucucacaacugaaguuuuuauacaaauauauaaaauagguauagaaguaaaauauugcuuaauaugaaucagaauuuuaucuuuuuuaaugauuuauuuuuauuagauauuuucuugaguuacacuucaaaugcuauccccuuucuugguuuccccuccaaaaauccccuaucuccccucaccacccccacuaccuccacccccaccccacucaccaacccacccauuccugcuuacuggcucuggcacgccccuauacuggggcauagaaccuucacagaaccaagggccucuccucccauugauggccaaauaggccauccucugcuacauaugcagcuagaggcaugagucccaccaugugauuucauugauuggugguuuagucccagggagcucuggggguacugguuaguucauauuguuguuccuccuauagggcugcaaaccccuucaucuccuuggguacuuugucuagcuccuucauuggggacccauccaaugaaugauugugagcaucaacuucuguauuugucaagcacugacagagccucucaggagacagcuauaucaggcuucugucagcaagcucuuguuggcauccacaguagugucugguuuugaugguugcuuaugggauggauccccaggaggaccaaccuccagaacauacaugauaugcacucacugauaaguagauauuaauccagaagcucagaguacccaauguacaauuugcacaacacaugaaacucaagaagaaggaagaccaaaguguguauccuucuuagaaaugggaacaaaauacccauggaagcaguuacauagacaaaguucagagcagagacugaaggaaugaccauccagaauuuuaucuuaaagcaauucuuugguagacauguaauuuuaccaauuauuaaagauaaaagcaaauauacauacuaauacgauagaugugccuauuuuggcuuacuaaauuaaaucucagcuaaauauuugauaaugcaugaagugagcaauuuucauguuuuucagagucaaucaauauugugauuuuauaauugucaaugaugagaaagcuauuucagauaaauauauaguacaaaaugccagaaacauguuuagggccauguuggaaauacuguucuaaucccaagccaaaaaucauugauuuuuuuaaaaugaaacugaaauuaacaacucaaagagcaaauuggugucugugugugugugcaugggcauauguauuuguguguguguguguguguguguguguguguguguguacauauuuaggacagagguuagccucuggucuugucccucagguaccauccagcuugauuuucagacacagucucccuggccuugaacucaugaaguagacuaggcuggcaggccaucaagcuccagccauaugucaauuucugucucuccaacacugggauuacaaaugaaagcccauguccaucuuuuuaaauuauugaugcugagaauuaaacucaaucuugguagcaaaccauuuuaucaauggcauuguuucccuaguccccaaacagcaauuuuaaaaucuaacguucuacacaauacacauuacacaauaugaucccaagauauacaacuauuuugauacuuacaugcugaggucugacagcaggaaacuauuaaggaucucuguuuuccauaauuaaaccauuauauuucuauaagcacagggaacuuuguguguacaauaaaaacacugcaaauucauagcacccaaucaccucagaucugagcugagguguucuaggaaguguuuguugguugugugcugugucaaagggauagcgugcacagcaagauuaccacgaagucacaugauguaacucaggaacauacugccagaaauacccucacauuugauguacauucgauuuugaacugcuguuaggccauugugcauucagaaagcguuuccugaugccaaguuuuucacagauuccacauucaguuguguuacccucaugggaugcccaccacacggcauaagaagcuguucaccaaagcuguaugggguggguguccucauuaggauugcuauugcuaugaugaaacaucauguccaucaugcacuuccagguaacaguccaucacugagggaaacuagggcaggaacucaagcagggcaggggccuggaggccaaagcugaugcugaugcagaggcuuaguccauuaucaccguggaagggagcacggaggcacaaaggcacauauggcgcuggagaaguauguaaggguucuacgucuugauccacgcagaaagagaagugagccuggcaucugcuuuugaaaccacacagcccagacccagugacacacuuccuccaacaaggccacacaucccaauccuucucaaguaaugccacccccugaugacuaagcauuaaaauauaagagccuacgaggaccauuaaacagccauagguggggugagaaggagaugacuagcuaaucccaaccuuuuaaaaacuaagaauauuuguauuaauuauuugagguuugcaugcauguacauaauaucuuuugggcacauuuaucccuuguuccuccccuaacuccucccagauucacccuauacuggcuaguuuugugugucaacuugaacagaagcuggaguuaccacagagaaaggagcuucaggugaggaaaugccucuaugagauccaaccauaaggcauuuucucaauuagugaucaaggaugggaggacccauugugggugguaccaucucugggcugguagucuuggguucuauaaaaaagcaagcugagcaagccagaggaaucaagucaauaagucaaucucuccaucgcucugcaucagcuccugcuuucugaccugcuuucugacuuccuuuggugaugaacagcaacguggaaauguaagcugaauaaacccuuuccuccccaaguugcuucuuggucaugauguuuuguccaggaguagaaacccagacuaagacacacccccuuaccacugacucccaucuuugaauccuccuuucuguuuuauaaucucaguucaguuuguacugcacauauaaucauggguaugugcucauccaauggugcaugguugaccuacccuuaaagaaaaugaacucgcucuccuggggaagccaucaaaugucaauagaccuugaguuaaggaugggcacucaugauucacuuccaccccuuacuccauuuuagaaugcuauggguugggcucgaucuucuucaggcccuacucaggcaacugcagcuguuaugaugucaggaguacagcggucuuaucagaagacacuguuucaaaucacuccuccuugaacucuggccuugcaaucuuccugccuccuccucugugaugcuccccaauucuugggaaggcugcgugauacucaugcuccuuucauauggaagcacuccccagcauuuaucaucugaacuuugaccaguuaugaauucagugagcuaccuucaaaaguugcuuucggcugacaagcaguauaguacaauccaugccuucaaaaauauacuuauccuucaaaauuauacuuacugcagauuuauucaaaagguaaacccuuaaaugcagcuaguagcuggauuggagcuaacacugaugcaaauguaugcauguauuuucuccaggccaaaaagguguuuggaggauuugagggggacaaagugugguguguaaaauauuucaugagcaguagaggaaggguaccuaguuuucaguuuccuuaaccuuuccuggcaugugugcccauccacauucaugcacucaaacacauaugguguacagcaaccuugcagcugugagcagguagacgggaggguggagauucccagaauuuuuguuggggcucauguaauccaaaugagugagaauaaaauggaaauagcugaagggaagaauccucugauucuacaauaauuauuauuuuccuuucaagguuuucagacuagaacagcaucuccugcuaacugcuuccugaauuagccacauauuacugcacgauaaauccccccaaauuuaguggcuuaacaauacuaaacacccauuaacucugauaccuccuauggaccauguguucagucgggagaagcuuggagaaguaguucugacuuucaugagacaagaggcaagauauuagcugaugccuccagugagggcucugugggcugcgaagacccccuugccaaggggcucacucacaggauuuggacuagggaggaaggaucggguuuuccacacagaccucuuucaggagugcuagaguguugugacauggcaguaacuuuccucagaucaagucaucuaggggaauaaaagacagucggaagcgcuccuuucaugaauuguguuggauacaaguugcauuaauucuaccacauucuuuucacuagaaggccuuggcuaaucuuagcucaaauucauccaaggggaaaggaauuagacuccaucuuuugaagagacaauguauaccugaaccggauccuaaugcuauaagaaaaugccugagacuggguguuuuguaaaauaacaacaaacaaaaacaaaaauauaaauaaaacuuugcuccaaacuguucuggagccugaaagucuaagaucaaagcacuguugugugaugaagaccuugugucuucugcuaaaguggugcuaacggcagcaccuuugcagauggaaguuauagcuucucacaugguggaaagggacaaacagccaaaaagggucaaucuacucucccaagcccuguuuaacagcccuaauuucacuugaaagcagaggcaucuuaugaucuaaugaccuuaaaaggccuuacuucuuaaaacuauggcauugggaauuaagauucaaugucaauuuuggaggaaacacaaacauucaagccacaucaaugugucaaagauuuuucgugaacauacuuuuuaaugcuugacucacaaaucgaguuuuuuuuccuuucauguaccaaauaaaauccccaacuuacuauacagugucgcaggaauaagguuccuggacaccaacaauuccggcugcucagacaacaaaagcugucaguacagucugggagcugugaagguucacaauggucacaggucagggaaacugucagcuuuaugauuugagcaaacaaagaagccagcaccaaaacauucccaacacauucgaucaugcaagucagugucuuuggauuuccaguguaaaggugagucuugaaguugggaaagcccaaccuacuuuccgccauuauaaagaaaaaaaaucaauauauauccggagucaggaaugauggcuuugccuauaaaaugggaacaucgguguagccacaccacaaacaugucugccucuaaccaauggaaggaaaaauccucagggcugugaauccaaugccugggagaggaaccugagaucagaguccugauggcuuuggugacuuuucgucgccuugagugugacaguucaaccuggagccuugauuagcuuuguggcugcuguugguuuugaaagaccuccauguugucugccuuucaggucuagagcaguaaccgguauuuucugacucuuuuugguuugauucuggguucucagauuuucuuggaauaugagcugaaauuggcagcccauuugagaggacagcucucaggaagcauggacaacucuagucagaaagcaaaauacugugucacaauaauuugcuaccuggcuucgguaccuuucaucaggaguagagaggaaaauacaaaaacccaaugcccauugcucucucaagagaagggcgagaagcuguaugcuaguuauggaggaaaggguaugucuuggggaccugaaaaggaagaguaagguuccuguagagaaagacaaucaugguuacgaaugucugagcaacuacuuauaaauccuggaacuugggagaaacaccuaggcauuuggugagcacuuaagaggcagagacagagacccaggaaauagcacugcugcauagguaagagcuuccggguguugagggguccagaggcacaugcucccacuuggccucuccaccugaauuuguucuagaagaauaaagauaguggugaugccagucacaucaaucuuuucucuccccagaugagggcugauuuauaacuuuauaccaucuguugguguuagcgguaugacucuggccaauuaacagcucauaaaggacucugccuacagcugaggcagacaguaauggcaaggaccucgucaugcacucuggcaauuucuacucagaagaaauuaagauuucaucuggaucuaaacauguguccuuuuacuuguggccaaacuccugggggcucuccccauccucucugaaaacccucaccuaugcuaccgaaguccuauaaaagaauucugggcaagucugagaucugagcccuugugccaaacauucagcaaagauacucuuaccucugauggcuuuaguaagaggagcuuggcuuugugagguucaucuguacuaguaagguagcuugauaguuuuuuuguuuuuuaaauacagaauagaaagaggagaaaauucuaaaaacaagaaauguuacuuucagaauaacuauuucaagaugugaugauccuaaaaaucaaaagacuggacgcauggcugaaauccuaagucuaacuuuccuuagcuguccaguuggugagaaguguauuaagguguguuaugauucucaggugcugaucaagcaacauuuaucgaugucaguaaaggucuaccaaugguguucugugcauggacaugaaauaaccaaucauacaauggacaugaaauagccagagggcagcugucuauuaugucgacauuguccuuccuaacagucugacuuuguuccuccuagacccacccuuucugucucuuucuaaauccgccccgcucaguacuuccuaauaccccuugaggauccggugucagagagagaguuccaguucuccagagccaucccugauagccucgccugugcccuuugccuuuugacaggagaagccauggaaauguauccacaagagaaaaguaaggcucuuccugcaggagagguagagauuguuuuugaacauauuuagucccuuuugcuucucaaaauaaacaucuuugugcucaguuacaagcuuuccaagauguuacaaggggaagggagacucuugccaaaaaaacuuaagcccagccagacaggaauacgaaaauuuugcugccuguggaaacacgugaccaggcaggacuuuggcauagaaagcugucaugugugcuuaaauaaccgcagcagagucuuaggguggcucaggguacacaggcacaguggggcucauccagcuucuuugauggguccauucaaugacagcucccagcacacgcucgacuauuuauagaauguucaaauccaacuagacaaacuucgguuuugauaauuggagggguaaagagaggcuuucaucucucucuucuccuguuuuuauucugcuuccaguuaacucuugacaaaaggcuuuaggaaaacagguccuaagagccugacugcaguuuuacaggaaugugaccuuacaugagacauccuugucuggacagcaacuaccuccucuauaaaauacuacugacaaugcuuccucaaccuccaccaugucagcuuuccaucacucuaaugaauacucaagauaauacauuuuaaagaaaaaaaagguuaaaugugagaguagugguggacuccugucaucccagcacaagaggaucagaaguucaagguuaucuuuaguuacagcuaguucaagccaaccugggauauaagggaccuucucuccaaaaaccaacacacacacauacacgcacacucacacgcaugcacacaggaacaccacacacgcauaugcgugcgagcaugcacacacucacuuuguuuugcucgaacaaagugaaaauguauauuuugacucagguuucaugggauugccauaugcgguaaugggcugcagcuuguggcaaggcauugacaucaugcugagaacauguuacagaacaaagcuucacacuaugaagaagaaagcaaagagaagagaaaaaaacagaaaacaggaucucaaaaucccugucggaggcguagcuccaaugaccuaaagaccucccacaccuuuuaauagcaacccagagugacuuccaaguauuuaauacaugggucuuugaggguauauguaaaagauccaaacuaaaacacuuuacaagcauguugagacaaucaaaugaagaaacauaaugaaaacccuuuguauguuaaaaggugccaggcaaaauacaaguuauuuuuuaauuaucugcgguuucucuuucuuugucccuuuuuacuuccauguccaaugggaucuuugucuucuuuuuuuaguccaagauuaucaguauuguucuugcuuaguuucuuacacaugggcuaucucuugaucauucaaaucuguaucuauagaugaucuauauaccaucucauucugagaccaaucuguagccuuuaguacagccugauuuacaccagcacuuguguauggaggacuggaugacucugaguccuguuauggcaauacagggcacaccaucacaucuaagccugucacaacugccagcuaugugaacgaagucuagcuaagcuacugccaccagaaucacccgucccaggaaggcaacucuguuucugaguucagauacauugggucacuuugaggcaaacgaugagauuugauguucuuuaauccugccuuugugaagaagacaggugucucauccuuaauuuaacccuaagcuuacuuggcuaugccuuuguugacuuccccaugccugcccccuccccaauucaauaccuaauuugagauugaggcgaugcaggucuuggauuccauauuagcaagacagcugauuccauuuacacucacacagcuugacuauuaaggugaugagcugaggcucccuguagcaacaugacuuacuacuuguucuagaaaauucuugcccaggaagauaaacuuguagagcaauaaauaauuucacuguucccaucaggaaacuccugaaaaccaauuuauuugaacaauaaaucugcucauguggucaaacagccucuucccaggacaacagauuacucaccugggcaauugguuuacuuauuaaacaacuguucaccuaucaaaaacuguuuugagggcaagcaauguagcucaauugguaaaaagcuugccuaguauccaugaaaaccugggucaaaucccuagcacgacaaacagaaucagaaaaucaagguccaucucagcuuccucugaguucaaggcccaccuuggcuaucugagacccuuucucaauuuuauuguauauaauucuuuuugaaacagaauuucuuugagauccugugucuucguuaggauuuccauugcuaugaagagacaccaugaccagggcaacucuuagaaaggacucauuuaauuggggcuggcuuacagguucagagguucagucuauuauuauccaggccagaaguacggcagcauccaggcagagauggugcuagagaaggagcuaagaguucugcaucuugcugggcagugguggcgcacgccuuuaaucccaacacuugggaagcagaggcaggcggauuucugaguucaaggccagccuggucuacaaagggaguuccaggacagccagggcuauacagagaaacccugucucaaaaaaccaaaaaccaaaaccaaaaacaaacaaacaaaaaaaagaguucuacaucuugauccaacuguaaacagcagaagacuggcucccauguagcuaggaggagguucucaaagcccacccccacacugacacacuuccucaaacaaggccuugccuccuaauagugccacucccugggccaagcacauucaaaccacgacacccugucaucaacaccaaacuuguauaagcauucccacgucaaacaacucacacuccacauccuguacauuuuugcauuuagcuucuaagaggcucuaugauggagcagcuccccugucuuguagacauaguacauuuaaccauggauggcauaugcuuauucuguugugaaaagggcaggcagcuuauccuugauauaaucaucuuaauauugccuuguucuugguagucugcagcuaagagcuuggugcauuaauacagaaagaaagaaaaaucaaagaaaaauauugcuuuaaauuuaaaauuuguugucaaaaaaaggcuucugaaaucaucauuguguuaaaauaauagaaguuuuuuaaguuucuuauaugauuuggaaucauuguuauuuuaaacuacacuggaugugauacauuuguaauauuuuuauuauuauuauucuuuggaacuuccagaagguuccacuuaguccugugcaaauuuaaagauuuuuccuguaaaaaauagugguugcuagcuaguuguguuggcuaauauuuuaggaauuuaacugaaagucucaggcaguugggcuggaguuauaucugagcugguuugcuguucauaguacucaaauucgguucguaacuuggcucucuugauugcuuugaaagcuggaaauuuaucaaaaugucauccauguaaaagaacacuuguggcauuuguuuaaauccaugaaacagcagucauuuaaaacacugaguuagaaaacagacuuucuuuuucuaucuuuguuuuuauuccuuugauugaaaauagauuccuuucucauacgauauauccugauuacaguuuccccucccuugacuccucccagaaccuccucaccuccucuucucucaggauccacucccuuucugucucucauuagaaaaaaaccacacuucuaagagacaaaaaacagacaugacaaacuaaaauaaaauaaauaaaaaauaauaagauaaaaacuguuacaucaaggcugaacaaggcaauuuaacagaaggaaaagagcccccaaagcaaguguaagaaucagagacccacucgaucacacacucaggaguaucauacaaauacuaaccugaaagcugugaugcacacacagaugacccagcgcagacaugaaagcuauaaugcauacauagaugacccagcgcagacaugaaggcacuacgcuugcugcuucagucucugugagcucauaugagccuugcuugguugauucagagggccuuguucuccuggugaccuacacccacucuguuuuucacauucuuuccaccuccuuuucugagggacucccugaacacucaggggagggauuaaauggagacaucccauuuagagcugaucuaugaguacaggagaauaucauuaagaaucauuuuauuaauuuuuaaaccaacaguauuaggcucuacucuaggccuucugggcuaucuagucucuuggucacccaagcaguguuggguauggguuuccuuuuguggagcacgacuuacgucaaaucaggcaaguuaugcccaccaccauuacuggagcguaucuugcaaagaggacagauuguaagucaaagguuuuguggcugggcuggugcuuacauuucuguuuugauagccugaggaguuccuucucacaacaaagauucuagaacuuaagggugaaggcuccaugaaccagcuaggcuucucuguguucaaugaguuguguggguguugucuucaacaaggaugaccaaagucaguuuacagagagcagccuguuuggcaacagccuggguuuuuugggaauuuccacgggacccacuugggcaacaacucagcugaaugcaaccagguccuaauacuucauuuggugacaagagauggccaguuccccauuacuggccacuccccacuaucaggugacuuccuuagaacugucuucauguauuuuaggaaguuuccauugcaccagguuucuauaccaucccucaauuccagcuguuucucccaggauucccucccucaauggcaucucucuucucucuacccaccugauucucccauaccugucuaccccaccugccugccccuaguacaccaauaagaucuauucuauuuccccuuucucaggaagaucuaaguguccuccuguagucccuuccucuaucccuaaccucucugggucuauggauuguaagcuggcuaacauuuauuuaaugacuaauauccacauauaagugaguuagaaagcaaucuugccaccucugccagagcucaaggaaccgcacccauccuuacaaugccggagaguuagaugugguagcugugaugcucauuucgacaucuuuccauggcuugcacauuuucuaaaccauuuugucuuaaaggaaauaucuggcgguagaaauagaacuccauggguaaaaacaguuguguacaggcauaaggaacugaguucaaaucccaacaacuaugugaaaagcugggaauggauccaugcaccuguaauccuaacacugugggaagcagagguagguaguuuccugggguuugcuggcugccugguuucagagacuugucucaaaggaaucaaagaaugguagagcaggacaccuaguaggauccucugggcaguacacacauccaaguaaacauaugagcauacaccacacauguguacuacacccacacagaaaacgaaggaaacguuucuuaaaagaagcaaaguuauguaaaauaucuaagaagucuuugaauucagcaucuagucucuguugacuuggaagacauaaaaaucauuuuaaguuuugcacccgacagaaaguugagucuuaauuuuacuucagucuucuuucagagaaugcaaaagugguacuuauuuucagucagaauguuuugcaugcauuauucagcaaugggcuugcuuccuagacagguagccuggaagcauuugauuuuuugaguacccaugagcuucaagaagaccaagauguuuccaaauaugcuaauuuugacaauuuuauaagaguauuaaucuccuuuaaagcuagugaaaccaaagcccgggcuuuaguagguuauuaaagacgucaggcaugucaaggucaagaugaaucacagucucugguugcaaaguggcugcuuucauagcucacgguugcagacgcaugugcucacugucuccuuauucuuucuacucugccacuaggcagcacgaugcaugauuccacucccaaagaaugcaugagagauuuuaaagcagguacuccaguucaaugccccguauauauccauauguuaccaagcauuaccacucaagcaaaucaaaagauagacuaggacguagcaaugaacaaaacuuuaauuccugaauucauucauucaucuccacucgaagacaguuuguuggaauuguuguuguuguuguuguuacugaucucaauacacuguaaggcuuccuaccaugaccuuggugagauucagaacaaccuaggacacaguccucagacacagcugugggggauuuuagacuagguugaaggcagaaggacuucccuaacuguggccagcaccaguccacucuuuuugcugggguauuuuauugaaguuacagaaaaaguggcuacuacuaugcaucaccuuaguaauguagaggaaaagaaaggcuucguccucaaccauccccagucucaugguugcaaugcgacaguaaaagaugcaagcgguaauauagugcucacagugacuuauuaugcacaacaugggaaauuuuaugaagaaaugaauggucaagaggacacguaagcuuguuaugucacacuuuccaauuugauaaagaguagacaguuauaauguguaugaauauguguauuuuuaaucauauauacacacacacacacacacacauauauaugauugacaauaaaagaauauggccuaaaguuccaggaaagcuagggcuguuacacagagaagcccuaucucaaaacaugagagagagagagagagagagagagagagagagagagaucucacuggggaaaugagaggaccugcuagcucaccgugucuucugacagcaaaccccaggcauagcuacuagaaugguagcucucaaaugaggauucuuauaacuugcuuuacggaagaaaugggagccagaaaggugaguguaguuucccuguuccugcuguuuccugaaaaaguucuucaacucacaaagucaacaagcuaagaggugacugagugaucaaccacuugccuagauugcacacagcccugguuugauucccagcacugaaaaagaaaucaguauguugagaaguccuaaucuggaaccaugcauucuaagucuauggacagauuauaaauguucuuuacuuuauuuaaaauaugcuugcugugacacaggccuuuguuccuagcacucagaagguggagccagguggaucuuuguuaguucaaggccagccuggucuacauagcaaguucaacccugucucugaaaagaaaaaaagaaaagaaaaagaaaguuacugucuaugggauuuguuggcauagauccauaaucacagcacuggggauauagaggcaggaggauggcaaguuuggggcuagccugggcaacuucgugagaucugaucacaaaauauaaaauaaagaaaacaccuucccagccuacaaauuaggauuuggauucuauaacguuuuauaaaaugaucaaaagaccaacacauuaauuuuuaugacucuauucugaagugagagaugucagguaguuaacagcacuuacugcucuuacagaggacccaaguucaguuccugcugcaugcaacauggcuugguccuggaaaccugacuaggaauagagaaggacuaaagaaaagacaaccacaggcacgugugcacagaaaagauggggucagaugggcugugcauacauggggaaauggcaccgauuaguggaagcaaccaggaaucucuacauuauuauguacagcccagaggcuggggcuagcuaguuugaguaggcagucuguagacaagcauucucuagcuaugaacauccuggaagaggaagcugcaguugauaguuuuccuacacacuggccagucauuuauaaacauuccuacuuggaccaaucgaaggcuuugccaauuuaccauugguaagaggcaguugguccuugacauggcugaacccaugugaacaauacacauucaaggauuuuauucacucuagaccgacauucauucguggcucccuacacccucacaagcucuaaacaucuauacugggcagcucacaaccucccguagcuccgguucuauggggauccaacccccucuuuuggccucugugggcacugcacauacacgauagacacacaggcacugcacacauacacaaaaaauaaauacagaaguggaugcucacagucaucuauaggauggaacacaggguccccaauggaggagcuagauaaaguacccaaggagcuaaaggggucugcaauccuauagguggaacaacaauaugaacuaaucaguaccccaagagcuugugucucuagcugcauauguagcagaagauggccuagucggccaucauugggaagagaggccccuugguauugcaaacuuuauaugccccaguagaguggaaccccagggccaagaagugcgagugggcagguaggggagcaggguaaagggaacuuucaggauagcauuugaaauguaaauaaagaaaauuaaaaaaauaugaugggaaaaaaaucuuuuuuucccugcaucuuacuuccucccauaguuuguauuccauuccacuucauuuuuacacuuucuuauauuuccaggacacaugucacaugcugcaaauguugccggcacaucucucuucugcuuauguagagggcaauaucacuggcauuuagcacacugcaguaauacucaugacugaacauuccucucugcgcuuuuccuucccuuuaauacccccuccuaagaagccuaaacaggagauuugcaugaaacccaaauaaaacugaucuccuuccaaagggaugacuacagcuucugggaaagagacccauuuauacacuuacugcccgguguccgcccagacagcaagaguccugggacaagauuccuucuguccccagaagaaauuccaguggaugguaagagaaaaacugccaguuuccugggccacuuagaggagguuauaggacguauguaaagccagagcuuucuaggggauuggagguggcucagaaaugacgugaccuugcugcuuuugcagaggacccgaguucugugcguaccuaccccagugugcuuaugacuucuguaacuccaguucuauaucaugugccucuucuggcucucgagggcaccugcacccgcaugcacacccacucacacagagacagauagacacauacacgcaugcacacucaccugcagaaaaaccuuuucuugccuguaguauuuuaaauguuuaugcuugagaacuuuccauguguauacaaugaacugcaaccauacauaaccccauggccccccuccagcuacccuaugcuuccuccaacaggucccugucgcuuuccuccugcccaacccccacaacuaguuccaauuaguguuguccagugcgcauggaugggagggagaccaugggcaggaggcugugcacuggaggugggaacuccaccaguuucuauauccucuccuccaacaacugucugccaccaauagcuccucaguaagggcuggagucuggagaucuccuagccaucuaugccaggauuuugacuagcuuguucuuauguaggucucaugcaaguuccacaacaaaacaaaacaaaacauaugaccuuucuugaaacaaggaggacacaccacacaagacaaccgaucaccuggaugacggacucccuaacuaauggccuucugagugucauuuuaaauggcacuugugagccagucuagugcacuuccaaugcuaucauccuagaggcugaggcaggaggagcucuagacagagccaaucugugcuacauagugagacugccuccaaccguaaaauaagagggcauaucucgguugacagaauguuacuuugcaaacauggauagaguccuggguuugauccuagcacuacacacgccuggcuuuuguaagaccugaaaucuuagcaauggggacaugaaguaagaggauuggaaguucaagaucuccuucaguuacuuggcaaguuccaggccaaccugggauaugugaggcccugucucaaaacaacaacaaugaacauaaaauaaaauuguuuauuuuuuuaaaggcauauuuuaauuuuaaagcgcgcucucucucucuuucuguguguguguguguguguguguguguguguaugugucugugaguuguguuuucaaugcacacaagcauuaaaacaaaaaauccaccaucuguuucuuuauuucuauacugauacuucuguagcguuuucccucuucucuuuucuuucucuguacacuuuagguagugcacauuucaguaguaaaugugaagagaggaaagacagccaaguucuuaacaagagaaccccaggacguaucaaaguucucagugacugugaauaauaguguccuguauuugugucauuaaaacuaugcauagaauaugaaauggccagucauuccauuugcuaacaaguggcuuucaggccaggaacucuugggugguguggaugcagcagcauaggggugaucucuccugugaacgcguggaucagaagagagcacggcauauguaucaaaagauggucuagucggccaucacuggaaaaagaggcccauuggacuugcaaacuuuauaugucccaguacaggggaacgccagggccaaaaagggggaguggguggguaggggaguggggguggguggguaugggggacuuuugggauagcauuggaaauguaaaugagcuaaauaccuaauaaaaaauggaaaaaaaauaagagaagaaaaaaaaauccuguccuagagaguggacaugggaaggagaccccuuccguccccgaggauuuauagaccaugguugauggggaaggaagaagccuuuuucuucaguggcuuagcuacugacucaacaaccacacucuuguuaacaacauucugccauguuccuauaagcaacaguaaugaagcucaguagauugaaagaaaugaauggagaagcaaggcagauuaggaguaggagggagagaagcaggaguaaaaagagaacaugagauucuuacacaagaugaauauggucaaaauguuuuguuuuucauuaacauggaauuguauucuauuucaucuauauaacauguuuuuauugcuuauuugucuugugauguacaauaaaguuaauucuaauuuaaaaaaaaaaaaaagaagagagcacgaugugaagggagcauucccaagcaaugauggccuagcugaaggucauggugcuagacagauggccuuuuuaacuugacggucacagauagugucuauaaagggaaaguggggcagaauuucucagacccuguggaaaacuuuaaaauccaaccauuucaguaauuuuaucauauauauauauauauacacacacacauacauacauacauauauauauauauauacacacacacacauagguccugggaauucaugcagguguguguguguguguguguguguguguguguguguguguguguacguacauggacagagggcagggggagaaagagaagauuauaguuuguuggcacgggcacacaacuaacucacagaauaucugugcaagaauaaccaagaaggaaauagcauuagcauuagacagcucuuugaacuuauuaaaagauagugacucuuucuuaaggaaaaggucuuuaaguaaacaaugccucugacaaauacacaguaggcaugccuucucauggugcuggugcagcagggagccagggguuggccagcucugcgucugacuuuccagagaaguaaguaaccugggaaaacauggacucucuucagggagcacacaggugacuggggucccucccuugggccuuagcacgaagcagguacuuacuguucugggcaaggaggcagcagaacguucagggagcuggcaaagcuggcugcuguaacaggaagaugucuuucaggagagggaacgagcucauccuuaaagagcaucagugagucauaaaaagggagaacagagcagguaugagaugcaggagagaaaaugucauugaugcugcucagaggugcagaucccagauagagcagacaggaguaacuuuguuugcaaguaagacccccuagcaaugaucuaauaagaucauccaucaucaucauccaucaucaucaucgucaucaucaucaucacuauauaagaagauaucuccaggcacucaccucucagugacuuacgcgucaggacugaagaauccacuucuuuguuuaacuuuuauccccaagacaacgucaaaguuccagcuugcauccauguucuagguggcucuaaagagaaaggggucaaaauggucaccugucacuuacaauuggacuagggagccaaguuaucagcuuugcggucucagcacuuuccgccugcugcguacuguuugcugaggacucggaggaaaaacuuguucaguauuuguucgaaugcgguccuggucuagaagucuuucguaaguacgauucucuuucagucucuucuacacaguucccuguguucuccuuacugcagcuccuucuuccuacggugggcuucaaguuguccauuucuaucuuuacucaaccauucuccaagaaccuaggccacggcuacagagcgaauuugaggccagccuggggagccaggcugcuccuuccucagugcuucugcuccaaugagaagguccuuuggggugagucauccagacacacacuccuuucaggguggacagucagaaaccacaaacagagaggcagucaugguacaacaugggaccccagggguugugcuuugcgaagagcaucugcucguggcugaagaaggggagcaucucagacgacauccuccagcauccuuaggaagaccugccacucccuaacaagucacauggaaaacagcagcucacaugcaagaagaaccucccugcaagauaccccacaaggaguaucugcugccuucucccugcgugcagugucccgcagaccuaccuggucagggugagaccauucuucuugcuucaguucccuggcccuuacccugugccauacacaaccaaggagcccaagccauacaugcacuguucagcacagaccuguguccccagccacugcuaccugagucagcguguacacuacggucacuuggcuccauuuuuuuuuucuuuguaaaaggaaaaggcaaaaaaacuucauggcuuaaaaguagaagugucaagaugguguuacaauuauagcaccagagucuggagagaugccucagacauggaaagcauuaaaauauagaaagcugccuuucuaaaauagcuuuauggcgcugacuuaaaugguuuggauggcuccccuuuaaaguuuauuuuacuuuuucuucuuuugauuguaaccagucaucugaaggauaaccaggaaggagcccugucggcuguagguagauagcaccuccgccuuccaaaacgcaacuggaggaggccuuucagaugagcaaugucucuuuugugguuguguuuccuuuggugugcgcacuggggacugaccgaggagccuugcuuaugauggguaagcacuccaucgcugagcugcucaacgcccccaggcuuaaggagcagaacauuuuaaaugagcuaucaacgggacuuuggggaaaaagggguauggaggggaaggcaaguacaaugguucagacaguagcugaauacucguaaggagggcaucgcgcuccagagcugaaagccaaggcuauuucccuuucaggcuugaaaacaagaaaaaaaagcaaauuaggcaccgagaguacccacaccaugaaaacugucaccuaaagcuucucuucacggaugagaaaugucaaggguauuucuaaguuaauuggacgcaccaucgaguauggcaaucucaagugcauauccuucgaaaggcuugggguugaugucuuuuaagccaguaccuucaugaagaucuuuaaucuucagggggaaaaaugugugguaagcucuauaucaugucuaauuuuuaaauuagaacaaaggucucugcucaggaugguugcuacuggaaggagccacaucauauugagacacaugggagccugaacaccuaguugguuagcuacuuggccagugagcgaaacacgaaggagagcuugcaauguuuucuccauguuuuuacugcccucguuaaugaaugccacccacaaugcaaacuguaggucgucaaggagaaauagcagaauaaggcagaguccuaacacugacggccaugucuucugacucugcaaucagcaucugcagcuugcauguagcauuuccaauuucaugaaaauguagucuuucaaacgugcucuuuuuuuuguccuaugccuacacugcaaagagauaaaagucagaaauuuuaguuuaaaguucauucuuuuauguuuauguaaccaacuuaugagagcaaguguuguauccguagacaaucccaggaagucuagagauggcgugugaugcuucggaaggugcucagauaacggcaugcgcccucagugauaaaugagucuuugagccgaagugucaggcaguucagcuagcaaaaaggcagcuguaaacaguccaggcagagggcagguuugauaugcaugauguugcuugaaguaccugcagggcaucaaucaccugaugcagaagagcuccgugaucaagcuuccucaaaggaaauuggcaaauuuguaaacagaaagacuucagcucacugaaaaaugcaggaaugugaaugacagggcauuagguccugaaggaaaacccacgccaaucaucaguucauucauucauuagcaaagacuacagugaguaucuguuuaagcaccagauaacugcaaaguccuggcauuacaaagauggagaaaacaggccugugcucuguaacugcuggguuuuacugaaacaaaugccuuccauauaugcucaacaaaugcacacccauaggugcagcaaaggacacuacugcagaaacguaaugcuguuccugggauugcacagauggaaaacaauggcaauaagaagcagagaacacacaguaaauacucuucagcaacagaaauaacacagcgaccaggcugcgggugaaugccgcaggcggagcugacgugagaacaucacacuacaugagccuguuuauguaacauuuaaaggugaaaaaacccauggcacuagggcacagagcauggcuuccagugaagugaggagugaguaucaggcuaaugaggcagggggcuggcuggggaccguuuugauuugugagcugagccgcagacacccagguguggauguuagagguaucucucugcucguggguccucaucaaggacgaagcaagagucaaagaaagauucagugaguccgauuucucagagcaaaggaagauugucugcauguagaucugaggauccacaaggccuaccuuuuaccuaccacaccuaugcuuuuucccagcaucuucuacauguuugcuacauugguuugcaaccuaugggauguugagacccuuccaguacagcuccucauguuguggugaugccagaagcauaaaacuauuugcauuacuaccuuguaacuguagcuuugcuauuguuaugaaucauaauguaaauauuugguuggaccuacagguugagaacccccaccaccaccacacacacacuuagaauauuuugaucuagaaggcaucuguuccuucuugcgauugcucugguccgugugguuggcaucaaggcuucuugucuugagccugucuuuuaucuaggauggucuaggauggucugccucucaggugacucuaggccugucacuuagcacuacccaagacacuguccucucuuccccuuuauuccuguuucuccucccucauccuuacugggaugucuuagauguuauguuauuuugcugauauucugucaaaauguguuuuguuuuguuuuguuuucauuuuucaagacaggguuucuugguguagcccuggcuauuguggaacucacuguguagaccuggcuggccuugaauucagagauccaccuuccuuugccucucaagugcagggaugacagguguguaccaccaccacuagcuuugucaacauuucuaacaagaacauuuuuuaguaaagguauaaucaccauauuauuaauacaccuaaaaaauuaucaauaguuccuuuguauuagaacacaaagcauuucuagaaguuuuagaugucuucacaauuggucaagaguuuucuguacauuugcccauuuuuuuuuuuaauuccuacgagcccaucuuuuuuuuuuucuuuuuaugcaacaauucauuacagaaacuggcuuacacuggcuugcuuuuuacaguaggagguucuccuccugagccugcuagagugcugcugcuugucauuucuuuguuuagcaauggaucucauauagcacagguugcccuccagcuuacuauguagccaaggauaacccugaacuucugacucuccuacuucgaccucugagugcugggagcuugggagugugccuccacgcccaguuuuaugggguuuggagaucaaagcaaggcuuucaugcaugguaggugaccaugcaacucacuuggcuacaucccuugcuuuccuucugcugguaagcauguuugcuccucugucuccuauggcgguccuuuccacacauugugggguucaguuucgguuuaagccauucaucuuuguugagccuuaaucuuccuugcuuuaauaugcuuugagacucuggguaguuucuuuccacagcucuuugucuugcuugguuuucacuucuauuuuauacagcucuuaaguuugacaguggcugcuugcucuauuaaugguccccagacacacagucaacugcaacuaaaaccuccaaggucaaguucuggauccuucccaucccagaaugccucugggagacgacuuccuuuccuauuccucuugggcuuauuaucaucuuuugaauuuagagucccgcagcugccuuggaagacagauugggucacucucccagaaggggugucagaacgcucacagcaaaggagauauuuagcuguugcuacaacugaaaacucacagcacuucacaauguggacugacacuaggugcaaagcuaacugaaaucaacuaccaaggaaugaacugccauccugugagcccuccucuacaguguauaagucagcuuguccuauuuucacucugacgggcugaaugacaguagcuuucuaguauuagcauucccucuucccuuacacuagcaaaaaaguuaguaauuauugaagcuagauaagucauagguacaauaaucccccuuuuaaaauaaaauaaucaaacuggaaaaugauuuuuuccucaugccugagucagauaugcaggugucaaaagcuugaguuggucacugucgcauugacugggaaagcuuaaaagcuaucuuuugagucgguggcuuaaacaagcucuggccucuccuggugcacaagaccauugcauuugaugcuauuuauuacgacugaacccuguucguguggcaucagccuugucucugcggaagcccaucuauuaucaaaagccucugcgugcuuuauguucaaaggacccagcaauggauagaaagccaguacugcccuagaucaggggacugucacaucacccagaagcugcggaaugauugcaagggaccuaucugagcucugcaugguccugcuggagagaagcaaagcacccuucagguauacuuuucucaaaugaaaauugaccuugcacaugcaacugaggccuuuaaaggaagauagacaugguuagaaaggccaaguaccuuacaaccagugugggaaagaagcuagggcaugggggugagugucagagaccaggcgcagugacaagccacuaacagggaucccgcgcuuccugccagugacuuuacuucuuggugucugggguuuucaucuaauauucuuuuguuugaauuccuuucuuuauuuacuucuaaguacgugggauguauguuuguaugcacaugagaauucagcugcuuacgcauguuugcaugcaugaguguggaagccagaggucaucuuucgagguggagucuuuugugugaacuugaugcucaacugauuggcuagacugauuggccaaugagcugaggggauauguuugucucugcugauaucuccaacuaggcuuacagacucacgagacccuucccagccuuuuuuuuuuuuguaauguggguuccuggaaccugaacucaggucauucuacuuaugcaucagaugaguuaucaauugagcuacccagcccuaacuuuuacacuguaaguuaccccaaauuauuguauaccuuuccauugaugaagucugaggccaaccuguuccugaauguuagugagcccaucagaugcacagucagcuucuggaugccuagcauuuaauucuaugggaacaagucagccaccaggaacgaugucgaaugcagcauggucccgguucuagaaaaauaaagcaagaaagaaguccauuuccauaccaaacuggcauguaaaaacagaacgaucaaaugagacggaggcuauuacagaauagaaaagacuuaaaaaccugaggagccagacuuacccaagccaacugcaggcucugucaacaggcacgaugcauguuccauuguuugguugcagucacucgauacugcaacacucgaguguugagcuacguguaaaucacccucucagaagaagcaggagaaacauggauagcuuaggcguaguucgcuguuugaugugcucuuuggguuucuugcacauuagaugaaaaaugacucaguaccgagacaguuccuagcucccaucuguccccucacauugaucagcugaucaccuuaauccaucaagaugcccucagugggaacagccgaucuucccuugacagugaccaaggucaacaagugcugcccaggauuauuccuguagcuagagcaacaguaccguugguccuggugaaagacaggaauuaucacauuuacaacaauaaauuaauugauugguuuuuuuucuaaucguggaggaaaacauggcucagcaguuagaacccuugcuguucuucuagagaaccaugcagggcagcucacagccaucugcagcucaggcuccagggcauccaacacucauuuccagcuuccaugggcaccaagacucaugugacaacacacagacacccagacacccaggcacacagacacauaaauaaaagucaguccuuuuuuaaaagcaguuuuuuuuaaagcccaccucucuuuacuuuggauuauaaagaauuauaguuuuccaauauuuucacuuaaaugaauauaaauugcuaaaacuggauguucugauuauguuucauauucagggaagaguucaugacacuggcuuaccuguaaguuuuauuuuaugguauugaauauucauguugagacucagaagccuuuugagaaagcacuguaacuacugaucaguuuaccacuuuuguuauuuauuucugucuucacucucucucaguucuucuaauuuaaccgcugcuggucauuaucucagcacaaguugaauaaguuuaaaaaacuguaucccauuggcuaauguuuuaacucuauauuuauuucaucuuucuacauguuaucauuuucagcagacagcagcagggaccuaugagggaggugagaaguuuaagauuacauaaacgacuuccucugagagucugaaagcagcugaaugccuauaacuggaacauguguguguacacacauacauaugcaaaucaauacaugcauugauacauuugccuuggugaaauucucaggaccucugagaagaaaaucagauguggaguuugggggcuuuuaucggauauagaggcuuuuagugaacuuaaggucugaaaaacaaaaacaacagaaaggcagagaacccucccuaauaccgucaaagaacagaggggggaacgaaacauaacaagucugauuuuguuuauauuucaauaaacaacaggcauuggaaaaauuaaccaaaaucuucauaauauuuacaguuuugcagcgugugcuccguuguuucauuuacugcaccguaauucugaagauggaaggggcucuuuguagcagaggaaacgggagaaguggaaacauuuauuuuauguguccccuacaggaagaaccccaagagugggagagguggggcagguggaaacagcugcaggaaagaaacucugagccaggucccaaggacucuggguaagaaagcaauguggguuucugucgggagaagaagcacuugagaagacugaaaauguggcuaguggguagugcucgcccagcaugcagaaggccauggcuugaccccuagcaccauauaaacuggcugagauggugcacagcuguacucccagcacuuggauggcucauagaaaguuuuagacaagcuugggauacauaaaaaccuauuuggaggaagaggaggggaagggggaaggaggaggaagaagaagagaugugaggaagaggaggaagaggaggaggagaaggaagaggugggaggaagauggggagguagagaggaaggaggagagggaagaagaagagaaggaaagagaaagaagaagaagaagaagaagaagaagaagaagaagaagaagaagaagaagaagaggaagaggaagaggaagaggaagaggaggaagaggaggaagaggaggaagaggaggaggaggaggaaaacuacccauuuucucaguugcacacuagaaucucugaggauuucugcauccuggccauacuaggccaaacucccugguagguagcguaguacguuaaagcagugccaggaacuaacuguuucaggugccccagguguuuauugcacagaaucaggguuuagaacuacugagguaagagguuuuccuuaauaaguuuuuucuugccgggucagcuucugaagauguuucaaguuuauuauaugcaauuacuauagccugccuuuaugugaguaauggccucucaguucucugggccaguguguaggcagcccucauagauaugcaauagaaaaaaauauuuagcacacucaaauauuuaaaggaaaaaaacuaacugaaaagaaugacgaucacuuaccccauucuaaugguauuucuuugucguuugugucuauguuuauguauucauacaugugcaccagugcaugugugcugcugacauguguaugugcacacgcaggugcacauucucacagauggaggccggagauaaauuucaucauuuccuuuucaagcaauugauguuaggauuccccaggguugacacgaucuucuagcucuuccucccuccccuuuuuaaucauauugaaauuuaucccaaaaugcuuuggaaguuaugugucagaggaauguuuguaagaaaggauuugcugauggugcgcuucuacaguguagauguaggucaguacaauacaguggccauaucugagaucucagaagacagaauuuucuagucgaaggagacugcgguaacugggaagguugaacuggaaaaguggcaacuguugugggcuaaccugucagcguuaacuguugugaucacguggcugauccaggcagagaucaccugacuucccaagacuucccucaagcccaggguagacugagcacagacaugaugacacugccgaggaauuacaugaauuuugucugagugcaguuagccggaggcugcaggcuggaggugcgugugggugguggaaccgcagaccagggugacaacagccaguaggagcugcauacgcugaaagccuugugucuuccugcagcccagcccacacaaugcaaguguaagagauagcggggccagccuggucuacagagugaguuccaggacagccagggcuacacagaaaaacccugucucgaaaaacaaaacaagaaaguauaagagaugaaugaagguuuaagaaaguguacggcacaguuaagaguccuagggucuuuuaaauauauauauuuauuuuaucuugugugaugugcacuaugugucugaaggagcuugcagaagccaggagaggccucagagaagugaaguuacagaugguugugaaucaucaugugagugaugagaaggaaaccaguucucugugagacuaguaaguacucuuaaccaguuaccaagccaucucuccacguccuuaaacuaauucuuaaaauaacuuuaggcuuugccaacaccuguugcuuuucaccucuugcuguagccacagucgaccccaccguguucucugacaucacggccgaugacgagcccuugaagagucuccuuccagcuguuugcagacaaaguuccaaagacagcgggaaacuuucaugcucugagcacuggagagaaaggauuuuacuagaaggguuccuccuuucacagaauuauuccaggauucaugugccaggguggugacuuuacaugccauaauggcacuggcggcagauccaucuauggagagaaauuugaggaugagaucuucauccugaagcauacagguccuggcaucuuguccauggcaaauacuggaccaacacaaacgguucccaguuuuuuaucugcacugccaagacuaaguggcuggauggcaagcauguggugucugggaaggugaaagaaggcaugaacauuguggaagccauggaguguuuuggguccaggaauggaaagaccagcaagaccauuuccgacuguggauaacucuaauuucuuuugacuugcaggcauuuuacccauccaaccauuccuucuguagcgcaggagagcaucccuaccccaucugcuugaaauacccuguaaucucugcucaaguucuuuggguuccauauuuuccucauuccccuucaagucuagcuggauggcaaaguuaaguuuaugauuaugaauaaaaacuaaauaagaaaagaaauaacuuuacaga

SEQ ID NO: 1408 - RNA, 15640 nt, Mus musculus
auguuuucuccauguuuuuacugcccucguuaaugaaugccacccacaaugcaaacuguaggucgucaaggagaaauagcagaauaaggcagaguccuaacacugacggccaugucuucugacucugcaaucagcaucugcagcuugcauguagcauuuccaauuucaugaaaauguagucuuucaaacgugcucuuuuuuuuguccuaugccuacacugcaaagagauaaaagucagaaauuuuaguuuaaaguucauucuuuuauguuuauguaaccaacuuaugagagcaaguguuguauccguagacaaucccaggaagucuagagauggcgugugaugcuucggaaggugcucagauaacggcaugcgcccucagugauaaaugagucuuugagccgaagugucaggcaguucagcuagcaaaaaggcagcuguaaacaguccaggcagagggcagguuugauaugcaugauguugcuugaaguaccugcagggcaucaaucaccugaugcagaagagcuccgugaucaagcuuccucaaaggaaauuggcaaauuuguaaacagaaagacuucagcucacugaaaaaugcaggaaugugaaugacagggcauuagguccugaaggaaaacccacgccaaucaucaguucauucauucauuagcaaagacuacagugaguaucuguuuaagcaccagauaacugcaaaguccuggcauuacaaagauggagaaaacaggccugugcucuguaacugcuggguuuuacugaaacaaaugccuuccauauaugcucaacaaaugcacacccauaggugcagcaaaggacacuacugcagaaacguaaugcuguuccugggauugcacagauggaaaacaauggcaauaagaagcagagaacacacaguaaauacucuucagcaacagaaauaacacagcgaccaggcugcgggugaaugccgcaggcggagcugacgugagaacaucacacuacaugagccuguuuauguaacauuuaaaggugaaaaaacccauggcacuagggcacagagcauggcuuccagugaagugaggagugaguaucaggcuaaugaggcagggggcuggcuggggaccguuuugauuugugagcugagccgcagacacccagguguggauguuagagguaucucucugcucguggguccucaucaaggacgaagcaagagucaaagaaagauucagugaguccgauuucucagagcaaaggaagauugucugcauguagaucugaggauccacaaggccuaccuuuuaccuaccacaccuaugcuuuuucccagcaucuucuacauguuugcuacauugguuugcaaccuaugggauguugagacccuuccaguacagcuccucauguuguggugaugccagaagcauaaaacuauuugcauuacuaccuuguaacuguagcuuugcuauuguuaugaaucauaauguaaauauuugguuggaccuacagguugagaacccccaccaccaccacacacacacuuagaauauuuugaucuagaaggcaucuguuccuucuugcgauugcucugguccgugugguuggcaucaaggcuucuugucuugagccugucuuuuaucuaggauggucuaggauggucugccucucaggugacucuaggccugucacuuagcacuacccaagacacuguccucucuuccccuuuauuccuguuucuccucccucauccuuacugggaugucuuagauguuauguuauuuugcugauauucugucaaaauguguuuuguuuuguuuuguuuucauuuuucaagacaggguuucuugguguagcccuggcuauuguggaacucacuguguagaccuggcuggccuugaauucagagauccaccuuccuuugccucucaagugcagggaugacagguguguaccaccaccacuagcuuugucaacauuucuaacaagaacauuuuuuaguaaagguauaaucaccauauuauuaauacaccuaaaaaauuaucaauaguuccuuuguauuagaacacaaagcauuucuagaaguuuuagaugucuucacaauuggucaagaguuuucuguacauuugcccauuuuuuuuuuuaauuccuacgagcccaucuuuuuuuuuuucuuuuuaugcaacaauucauuacagaaacuggcuuacacuggcuugcuuuuuacaguaggagguucuccuccugagccugcuagagugcugcugcuugucauuucuuuguuuagcaauggaucucauauagcacagguugcccuccagcuuacuauguagccaaggauaacccugaacuucugacucuccuacuucgaccucugagugcugggagcuugggagugugccuccacgcccaguuuuaugggguuuggagaucaaagcaaggcuuucaugcaugguaggugaccaugcaacucacuuggcuacaucccuugcuuuccuucugcugguaagcauguuugcuccucugucuccuauggcgguccuuuccacacauugugggguucaguuucgguuuaagccauucaucuuuguugagccuuaaucuuccuugcuuuaauaugcuuugagacucuggguaguuucuuuccacagcucuuugucuugcuugguuuucacuucuauuuuauacagcucuuaaguuugacaguggcugcuugcucuauuaaugguccccagacacacagucaacugcaacuaaaaccuccaaggucaaguucuggauccuucccaucccagaaugccucugggagacgacuuccuuuccuauuccucuugggcuuauuaucaucuuuugaauuuagagucccgcagcugccuuggaagacagauugggucacucucccagaaggggugucagaacgcucacagcaaaggagauauuuagcuguugcuacaacugaaaacucacagcacuucacaauguggacugacacuaggugcaaagcuaacugaaaucaacuaccaaggaaugaacugccauccugugagcccuccucuacaguguauaagucagcuuguccuauuuucacucugacgggcugaaugacaguagcuuucuaguauuagcauucccucuucccuuacacuagcaaaaaaguuaguaauuauugaagcuagauaagucauagguacaauaaucccccuuuuaaaauaaaauaaucaaacuggaaaaugauuuuuuccucaugccugagucagauaugcaggugucaaaagcuugaguuggucacugucgcauugacugggaaagcuuaaaagcuaucuuuugagucgguggcuuaaacaagcucuggccucuccuggugcacaagaccauugcauuugaugcuauuuauuacgacugaacccuguucguguggcaucagccuugucucugcggaagcccaucuauuaucaaaagccucugcgugcuuuauguucaaaggacccagcaauggauagaaagccaguacugcccuagaucaggggacugucacaucacccagaagcugcggaaugauugcaagggaccuaucugagcucugcaugguccugcuggagagaagcaaagcacccuucagguauacuuuucucaaaugaaaauugaccuugcacaugcaacugaggccuuuaaaggaagauagacaugguuagaaaggccaaguaccuuacaaccagugugggaaagaagcuagggcaugggggugagugucagagaccaggcgcagugacaagccacuaacagggaucccgcgcuuccugccagugacuuuacuucuuggugucugggguuuucaucuaauauucuuuuguuugaauuccuuucuuuauuuacuucuaaguacgugggauguauguuuguaugcacaugagaauucagcugcuuacgcauguuugcaugcaugaguguggaagccagaggucaucuuucgagguggagucuuuugugugaacuugaugcucaacugauuggcuagacugauuggccaaugagcugaggggauauguuugucucugcugauaucuccaacuaggcuuacagacucacgagacccuucccagccuuuuuuuuuuuuguaauguggguuccuggaaccugaacucaggucauucuacuuaugcaucagaugaguuaucaauugagcuacccagcccuaacuuuuacacuguaaguuaccccaaauuauuguauaccuuuccauugaugaagucugaggccaaccuguuccugaauguuagugagcccaucagaugcacagucagcuucuggaugccuagcauuuaauucuaugggaacaagucagccaccaggaacgaugucgaaugcagcauggucccgguucuagaaaaauaaagcaagaaagaaguccauuuccauaccaaacuggcauguaaaaacagaacgaucaaaugagacggaggcuauuacagaauagaaaagacuuaaaaaccugaggagccagacuuacccaagccaacugcaggcucugucaacaggcacgaugcauguuccauuguuugguugcagucacucgauacugcaacacucgaguguugagcuacguguaaaucacccucucagaagaagcaggagaaacauggauagcuuaggcguaguucgcuguuugaugugcucuuuggguuucuugcacauuagaugaaaaaugacucaguaccgagacaguuccuagcucccaucuguccccucacauugaucagcugaucaccuuaauccaucaagaugcccucagugggaacagccgaucuucccuugacagugaccaaggucaacaagugcugcccaggauuauuccuguagcuagagcaacaguaccguugguccuggugaaagacaggaauuaucacauuuacaacaauaaauuaauugauugguuuuuuuucuaaucguggaggaaaacauggcucagcaguuagaacccuugcuguucuucuagagaaccaugcagggcagcucacagccaucugcagcucaggcuccagggcauccaacacucauuuccagcuuccaugggcaccaagacucaugugacaacacacagacacccagacacccaggcacacagacacauaaauaaaagucaguccuuuuuuaaaagcaguuuuuuuuaaagcccaccucucuuuacuuuggauuauaaagaauuauaguuuuccaauauuuucacuuaaaugaauauaaauugcuaaaacuggauguucugauuauguuucauauucagggaagaguucaugacacuggcuuaccuguaaguuuuauuuuaugguauugaauauucauguugagacucagaagccuuuugagaaagcacuguaacuacugaucaguuuaccacuuuuguuauuuauuucugucuucacucucucucaguucuucuaauuuaaccgcugcuggucauuaucucagcacaaguugaauaaguuuaaaaaacuguaucccauuggcuaauguuuuaacucuauauuuauuucaucuuucuacauguuaucauuuucagcagacagcagcagggaccuaugagggaggugagaaguuuaagauuacauaaacgacuuccucugagagucugaaagcagcugaaugccuauaacuggaacauguguguguacacacauacauaugcaaaucaauacaugcauugauacauuugccuuggugaaauucucaggaccucugagaagaaaaucagauguggaguuugggggcuuuuaucggauauagaggcuuuuagugaacuuaaggucugaaaaacaaaaacaacagaaaggcagagaacccucccuaauaccgucaaagaacagaggggggaacgaaacauaacaagucugauuuuguuuauauuucaauaaacaacaggcauuggaaaaauuaaccaaaaucuucauaauauuuacaguuuugcagcgugugcuccguuguuucauuuacugcaccguaauucugaagauggaaggggcucuuuguagcagaggaaacgggagaaguggaaacauuuauuuuauguguccccuacaggaagaaccccaagagugggagagguggggcagguggaaacagcugcaggaaagaaacucugagccaggucccaaggacucuggguaagaaagcaauguggguuucugucgggagaagaagcacuugagaagacugaaaauguggcuaguggguagugcucgcccagcaugcagaaggccauggcuugaccccuagcaccauauaaacuggcugagauggugcacagcuguacucccagcacuuggauggcucauagaaaguuuuagacaagcuugggauacauaaaaaccuauuuggaggaagaggaggggaagggggaaggaggaggaagaagaagagaugugaggaagaggaggaagaggaggaggagaaggaagaggugggaggaagauggggagguagagaggaaggaggagagggaagaagaagagaaggaaagagaaagaagaagaagaagaagaagaagaagaagaagaagaagaagaagaagaagaagaggaagaggaagaggaagaggaagaggaggaagaggaggaagaggaggaagaggaggaggaggaggaaaacuacccauuuucucaguugcacacuagaaucucugaggauuucugcauccuggccauacuaggccaaacucccugguagguagcguaguacguuaaagcagugccaggaacuaacuguuucaggugccccagguguuuauugcacagaaucaggguuuagaacuacugagguaagagguuuuccuuaauaaguuuuuucuugccgggucagcuucugaagauguuucaaguuuauuauaugcaauuacuauagccugccuuuaugugaguaauggccucucaguucucugggccaguguguaggcagcccucauagauaugcaauagaaaaaaauauuuagcacacucaaauauuuaaaggaaaaaaacuaacugaaaagaaugacgaucacuuaccccauucuaaugguauuucuuugucguuugugucuauguuuauguauucauacaugugcaccagugcaugugugcugcugacauguguaugugcacacgcaggugcacauucucacagauggaggccggagauaaauuucaucauuuccuuuucaagcaauugauguuaggauuccccaggguugacacgaucuucuagcucuuccucccuccccuuuuuaaucauauugaaauuuaucccaaaaugcuuuggaaguuaugugucagaggaauguuuguaagaaaggauuugcugauggugcgcuucuacaguguagauguaggucaguacaauacaguggccauaucugagaucucagaagacagaauuuucuagucgaaggagacugcgguaacugggaagguugaacuggaaaaguggcaacuguugugggcuaaccugucagcguuaacuguugugaucacguggcugauccaggcagagaucaccugacuucccaagacuucccucaagcccaggguagacugagcacagacaugaugacacugccgaggaauuacaugaauuuugucugagugcaguuagccggaggcugcaggcuggaggugcgugugggugguggaaccgcagaccagggugacaacagccaguaggagcugcauacgcugaaagccuugugucuuccugcagcccagcccacacaaugcaaguguaagagauagcggggccagccuggucuacagagugaguuccaggacagccagggcuacacagaaaaacccugucucgaaaaacaaaacaagaaaguauaagagaugaaugaagguuuaagaaaguguacggcacaguuaagaguccuagggucuuuuaaauauauauauuuauuuuaucuugugugaugugcacuaugugucugaaggagcuugcagaagccaggagaggccucagagaagugaaguuacagaugguugugaaucaucaugugagugaugagaaggaaaccaguucucugugagacuaguaaguacucuuaaccaguuaccaagccaucucuccacguccuuaaacuaauucuuaaaauaacuuuaggcuuugccaacaccuguugcuuuucaccucuugcuguagccacagucgaccccaccguguucucugacaucacggccgaugacgagcccuugaagagucuccuuccagcuguuugcagacaaaguuccaaagacagcgggaaacuuucaugcucugagcacuggagagaaaggauuuuacuagaaggguuccuccuuucacagaauuauuccaggauucaugugccaggguggugacuuuacaugccauaauggcacuggcggcagauccaucuauggagagaaauuugaggaugagaucuucauccugaagcauacagguccuggcaucuuguccauggcaaauacuggaccaacacaaacgguucccaguuuuuuaucugcacugccaagacuaaguggcuggauggcaagcauguggugucugggaaggugaaagaaggcaugaacauuguggaagccauggaguguuuuggguccaggaauggaaagaccagcaagaccauuuccgacuguggauaacucuaauuucuuuugacuugcaggcauuuuacccauccaaccauuccuucuguagcgcaggagagcaucccuaccccaucugcuugaaauacccuguaaucucugcucaaguucuuuggguuccauauuuuccucauuccccuucaagucuagcuggauggcaaaguuaaguuuaugauuaugaauaaaaacuaaauaagaaaagaaauaacuuuacagagucaaguacugaaaaccaacccauauuuuucucaguaauccuuuuuguuaguaauuaguguuuauuuucagcuuggauauucauaaucacgcuccuuuaaagcauucccuuuacccucuagguauguaucuuggagacauggcuucagucaaguuguauaauccacaugacuguaucuaaaagaaaucuuuacuuuuggagauaaaauggaauacuuguccacuugguaauagagauuuaaaaaauuggcauacuuuugcauauucaaaucaauaggacaugcuuauucucguaugcuugaacguacucauuugcuauuauuuaaaauaacauuuaagggcaugugagagggcucaguggauacagcacuugucacaaaaucccaacaacuugaguuuaguccccagagcccacaaaaaaagguagagagaacuaauuuuacaaaaaugauccucugaccucuguauacacacacauacacagagagagaauaauuuuuaaaaaaauaagagagggacugaagauguggcucuguguuuaagagcucaugcuguucuugcaaaggacucaagcugaguucccaucaccuuccuacagcagcugacagccaccucccacuugagcaccagggauccaaugugucuggccucuucuccuuggacaucugcauucaugugcacauaaccauacagauacauagguacacacgugcacacacaggcauacaugcagaacuaaaaauaaaauaagucuuuaaaauaauuauuaaguuggaaaucuaucauuucauaacuuuauaaaacaguucaggcugaaugcucaguggaagcuaaaacacguuguguagucuauuacuuaaucuugcaaauauuucuuugcaaauuacaauuacaaagaaaaaagugguaacuugauggggguuguggggaacugccagauacuagcucagcugaaauagaacagacaaaccaacauugaguucccugauguuaagcucugagagggaccccuucguaccugugugagcugcucaccccaaugcacugggucauaaaaaacaaugagcccaucaagacaagaggcacacugagcugcugauguagagcagcgguagagugcuugucuaacaagcauuaggcuugugcuucaaacuuuaacacugcacacaccaaaaagagacauucuguaauuggccugugucuuaguuaggguuuuacugcugugaacagacaccaugaccaagguaacucuuauaaggacaaauuuaauuggggcuggcuuacagguucagagguucaguccauaaucaucaaggcaggaacauggcgauauccaggcagguauagugcaggagauggugagaguucuacaucuucaucugaagguugcuaguggaagacugacuuccagaagcuaaggaugagggucuuaaagcccacgcccacggugacacaccuauuccaagaagaccacaccccuaacaguaccacucccugggccaaacauauucaaaccaugacagccuguaugauccaaaauuguucaaccugucaugaaagguugaaguucuguacaacaagagauuaaagaacacagaaaccaaaugcaaugcauauuccuugucaaacucuagauauggaagagaauugcuuuuucuauaaacuacaguaaaaggggggaugagaaaucuguauguacgcuggauagaacugcauacauguuaaauuucuugaauugauuucauggucauaaagucauuguggaagauacauacuugaaguuauacuuagggcuauagaauagugaugucuaaaauaggucaucaaaaguaacaaaauaagacaaguaagauggcucagugcagacaggccuuugcuucuaggccugacaaccugccugauuuccuaucuccagaacccacauagcaggagagaccagacuucugcaagauguccuuuguccuucucccucccccaauaguaaauagauagcuuuuaaaaguaauacaccucguuaaaaauuaauaaaucuagcugacaggcauaagaaguucauuguacuauguaaggucuagggauuuuuccucucaaauaaaacacuuguaaaaucuauauaaauagaauacccaagaagccuguuagcagacaucauuuggggaaggucccucaucuguuuguuugguuuucacuuccuccuccaucucagcccucucugaacacuuuaacaaguguuuaaugguuugugaagagacaauaaagcucuaggaaagaauucaauuuaaaggaaaucauuuuaaaaauugacaaauccauuuauaggucaauaaccaucuccuaauuuauuggguuaauaaauucaggauuuggagcaguuagauuuuccuggcauuuuuauuguaguaaaacauauguagcauaaaauuugccauuauaaccaauuuuugacggcguuaaggacauucacacugaugcagucgucaccaucauucaucugcagaacacuccggagcguuuucucaacugucccaagcucucaacauugaacacgaacucccuaucccuccucuuacucauuuuauucagucuaaauauguauuccuuccaggacauguguccugcaaauauucucccccauccuguagguugccuuuuuccuuugaugcacaaacuuuucaaguuuggugcugguuuugcagcucagaggcagaacauuuuccuagugcacagaaagaaguguuuucauuuucauaaagaaugaagcucaguuugucccagaagcauuucugcuugguguuuggagugcggaauaggaguagcugguuugcuuguuuguuuguuuguuuguuucucuuugcauuuuggaacagcaaggacaaccgccacucaccuuugcagaagguauaauugacaggcgucacgcuccguacuuuuugaaacuaaaauauauuacugacucuuuugcauaaugauuucccauuaaaucuuccuuugaauacuucuggaaaugucuuagaaggacaaucucacgugcuccagaacaaacgucuuguuccauuucuguuuuuccacuucaggcuccuuuauuuugccugggcuacuguugacccucgugggguuuuaacaucgcugauguccucuaacugugcuugcuuuugacgccucucaagugcccucuccauccugaaccagguaccucgggcucccuugcgcagaaaccugucacuuuccugcccuggagaagucacagagacuagcaaagcccaugauggacugagugcugaguugcagguuagggacccaaaguccugcuaaagaaaauauugacacaugcuaaguguauaaaagacuuuguucagaaccacugugaaaggugucaagauuauuacaaguggggagaagacugggcucuccuccaaacacaacaagggcaggauucauaaccaaagagugagugcuucugugaacagaaaggccagagaauggaaaauuacaucaagggcuccuaguuaaacugacucaguaggauucuuguagaagaugggcuauaguuaucaggugccaaaaggacagaaggaggaauuuaauuagauagucagauugccucugaaugacucaacuuaauucuuagaacaaugagugcagguuaggaaccuggggacagccugcuaaagaagagaacuugacaggaagccugacuauaaaguucauuccagagagagaaccucuguccaccuuuuccccacuacccccuucaaagcaggaagacccagugcagcccagggacaauuuccugugacacaugugugguuacucuacucugauacuguuugcaaaauaauucuggucuaauuagaguuguccuggucacuacaucaauaaaacacaaaugguacagagccacauugguauuuagaguuuucuuggcugguauuuuccauauggauucagacuauauuuuuuaaaugcuuccuaggaagucagggaaacggcucagugagguaaaguucuugcuaugcaaaugugagacccuaaacugaaauccccagcauccacguaaaaguugggcaagguagcuuguaagcccaguucugucagggcagacacagggggauccauggacaugccuggccagccaacacagucggaucugugaauuucaggcucguucguaaaaaauacuaugggaccagacuuggcucagugauugaagaugucugccaccaagcuugaugaccugaguucaguagaaagagagaguugauuucuguauguagucuucuggccuuugugugaauaacacacacagauacuacacacaaagccccuugacacuaggaagccauaccagaacaaggcuugggacuaguucuuucucuugaaugcuucuuuuccuagguggcacaaaagauacacugcccuucuccugaauacacuuucaaacucccuuaaccugucugaucccuguugggugcuuugucagggaggugcauuaggggaggcgacccuaaccuaaggucaccucgcccaguucugcaguaaguuauuauaaccguguggucauaucugauguuucuaccacuuuccuguuauacucugucacaaaggggacgcguucucacugaauguguugcaaauaauaagauuaccauggaaauaggaauauucaaucagaauuucugaauuuggaaaggaucaagcaaagagaaaaauguguuucauuucuguuuacaaagguauaaucauugccaugaguuauagauagcuuaggauuaaaaaaaaaaguuccuuauaacucccucccccaccuccgcuacaaaacaucaaagaauuaaaaaauacccaaacuaaaggcaauaaucccccuucaucaguugcccacugcaaggcaguuagccugugcuugcuccgcuugaccucaaggcagcagcuuuauaagaugaaugagcuucuugcuguaguuggaaguccuaacuguaggggccaggcucacagccaccacacugugaacccugggugccugccugccaaguuccuuuccuugagucucugaaacauucccugcuuuugaaagcaggaguucauucuagagcuauagcguaggcuggccuagaacucuguguauaguccaagcuagcuccaaacucgccauguaccugccacugcuuccugaguccugacgaugcagacauauaccgccuugccagcucacugacaguuauuuuauuuauuauuauuuuuguguguguguguguguguguguggaguauugcucagagcagauugcaguagauaaucagaguaaaacaguaacuaucuguggaaggcaaaacuuguagcauggucaugcuuaaagacuuaaugagaguuugugcaauaagauauuuaggggucuggggagauggcucagugauuaaguguacuggcuguucuuccauagggcccaaguucaauuccaagcacccacaugguggcucauaaccaucuguaacuccagaucccgaggaucugaugaacucuucuggccuucuggggcaccaagcaagaaugugacaaauagacguacauacaaaauauucauaugcauaagauguaugaauuaauuuuuauaagaaacuuaguuauuucucugaaauauuuuauuuuuugauauuucucuuuuguuuauuuugagacagggucagggucucuuaaagcccagaguagccucaaacucuccacgaagucugcgaaugaccuugaacuucugauccucccacacccauggcugcuggcuagagcucuuucaccaugccugguuuuggcaaccaaaagauuagcugaauccaggacauucuggcugcuggccagcacuguaccaaccaaacuacacccccagccuuuguuuacuuuuuuuccccuaaucuucuuuaagaggguuuucaaacugaccucaaauuuuucuuuucuuuuuucuuuuuuccuuaggauuucucccccccccuuuuuuuauauauagucaacuuuuuaaacaauuuauuuauuuauguauuuguaugcaugugaguacacaguugccgucuucagacaccccagaagagggcacuggaucccauuacaguaagccaccaugugguuggugggaauugaacucaggaccccuggaagagcagucagugcucccaaccacuaagccaucucaccagaccucuuuaggguuuucaagaugauuuuuguagcucuggcugaccuggaauauauuguguaaaccaggcuggccucaaauucagagaccaccucccucugcuucugccucuugagugcugggauuaaaaacggguucuauacacacacacacacacacacacacacagagagagagagagagagagagagagagagagagagagagcauugauaucuaacuuuucaagcucccucccccuuuccaaauucuaggaccacaaacaggcauguguagcgguacuuuggcuaaccacguugcucccggauggucacaugugcucgcuucaccccacccuccccacacacaccaguuacuuuuaauacaccuuuacuagcccaaaggcugggcaguucuaauccuucccgcagcuagcaaacaauccccucuguuacucccgaguaaacaucuuuuaaaaucucuauuuuaucucugcuaccucaaacacagcuguggaaguggcccguguggccacuuucccugauucucacaugucagcuggccuuuaggucuccucuuccuucuuccccaucauggcgaucucuuucuccucccucucucccggcu

SEQ ID NO: 1409 - RNA, 27546 nt, Mus musculus
gucaauuguuaccuuuuaaaugagccaggcugcuccauuuucugguaaccaugucucuacagaauugcauauuuucuagaacucuguguuagagcagagagaauggacagagguccagaccagaguagacugucacauggguuugaagcuccagauugucccgugucuucgagcugguggcaggcgaugcucuugagguagaagggcaagacccaugcucaggauaacggcaacacugaugagagguggagaguagacacgguucaaagccuggaacagcuuaaagcuugcgccuuguguugcucucuauucagcucugcuuggugacaaugaucuuuaugcaaucugagaagcagcuacaggggccggagaaagaguucagcagucaagagcacuggcuguucccccagaggacccagguuccuucccugcacucacauagcagcucacaacugucugugacuccaguuccagaggauccggcuccgucuuccugccucccuuagcacuacacaaacacagcacacagacaacaggcaaguaaaaaauuuuacccauacacauaaaauuaaguugaaaagaaaauuuuaaagcaauuucgggcuguggugauuaaucuugauuguuaucuugguaggauuuagaaucaucaggaauacacauucuuaggagugucugcaggcauuucuaguuggguuaauuagugugccaagagccaccacggugugagugucaaagcugaucuaagguucuggacugaacaaacaggagaaagggaagugagcauccacauucauccuucugcuuccugacuggggaugcggugugaccagcugccucagcacccugacaccucaccacaggcuggaugcggugugaccagcugccucagcacccugacaccucaccacaggcuggaugcggugugaccagcugccucagcacccugacaccucaccacagggcccuucuaggcguaccuucccuucccaucugcuguggacuguacucagaccgugugcugcauaggagucaaggaucucaaaagaaacagaacccugggguauacaugcauacauucauaauacauacauacauacauacaaacacacauauacauacgugugugugagagagagagagagagagagagagagagagagagagaauuuauuaaauuggauguaaaaugguaacaauagcaaaauccugccugagagcuaagggucugguaguuuacuugaucuucgagccugugugccucagcagucaugguugucccacaacaguugucucucacuuuaauggugucaacaacaaccaguaggaucacacagcaguugucucaguguucuuaguagauaccugaagccuggaaguuuccuggagaguggcuguucccccagaggacccagguucauucccugcacucacauagcagcucacaacugucugugacuacaguuccagaggaucccacuccgucuuccugccucccuuagcacuacuggaagaccugguucuggcaucagggaaggaaacagcagcagcaggaagguggcaaaucaacucaugagcaagaaaaaaggcuaagcgagagauguucuuucuucugcuacacuucuuuauuauuauuauuauuauuauuauuauuauuauuauuauuaaauuauguaauuuuuuauuuauucauuuuacaucuaaucacugccuaccuccucgucauucccucuagcaaucccccccccccauucucugagcggguagggaccucugagggguaucgccccacccuggaacaucaagucucugugaggcuaggcacauccucucccacugaggccagccaaggcagcccagcuagaagaacacaucccacguacaggcaacagcuuuugggauagcucucacuccacuuauuggagacccacaugaagaccaagcugcacaucugcuacauaugugccacauuucuuuuuaucugggaugccagaaggugccuuccacaaucauggugggacuucccacaucaaucaagauaaucaggacccuucuuugggaaaggcucucucuacucagguaauuuuaauuugcggcaagcuggcauugaaacuagccaucaaauaagccaaaacgaacccuucucucacuaagcugucuuugucagcaguucagacagcaccgguuaaugcuaacaaucaucuuccccaauauugguuuauuucucuaaccuacggggaggaugucuuucugacaugacuuguuuguuugguugguugguugguugguugguuuuuuuuuuucuuuuugguuuuucgagacaggguuucucuguauagcccugguuguccuggaacucacuuuguagaccaggcuggccuugaacucagaaauccgccugccucugccuccagagugcugguauuaaaggcgugcaccaccacgcccggcucugacgugacuuuugcugggaucuuggagcagcaugccuccccuggaucuggugguugcucaaaguugcucaucagaucucaguugccaaucugugccagucacaaccuggguucuucagcagauucccacugaacagggcgcuuuagauggaacagacaagggagaguggccuggcucugguuaaagauucccagaauuacaauuuugguuagauuuucccuaaacugccuuugaacuaaguucaguucugagaaugcauucuagagaccuuaaggaugcugggagcccuaaaauccauccaccuacuauagagucucaagccuggaagucaauggaacaccuaggguguauccugccucuggaauucucaagaagcuccccauacucaaggcagcuuuggugucacccagaacucacagggaagcaagacaauaaaguacugagagugugguacccaggacuagggauuuaucucagugguacaggguuuguguaucauguccaaagcucugaguuugauaccagcaaguagguacuauguugaaagacauuaacaaaaaaaaaucaucauagucacauugagaugccucuuuguuuuacguucuuuggaagacucuagaaggaaaucucucaacaauggcuuccacaauaggcagggaugcuugagaagugccagguugcuuaacacucaggcuuuuggacuauguaucaaaguauuuguguaaaauguaaccaugagucauucacuaaaagauaucuauaaacauuuucauuuucuuauaaauaauuacuagaggagaaagagagcaacuagaagaaaggacggcagcacccuaagugcuuguaccucauccaaagcucuucauaaaggcuccaugcaagaagcaggagcaugauuuuaaugggcugggugggugcuugcauucccagggcacaaagcaggagguugggagagcucagugcuccgaacccaauguacuuuauacaauuauucauagaagaaugguuggguuuuaauuauuuaugauaauagcccucagugcacuaguaaauguccuucggugcauauuuuguaaaauaaugaagucuuugugauaugggcuuucucugaagcuauaagcaacccucuccucacuaaaaacccagggcagcagaguguguuugugcuugcauguaagugugcguuuaaguugucaaauugagguuuaccaagaugccauuaaauuggacuggggauuucucauccuccucaucccccuauccuccucccccagcccuagaguugguaacuugaccaaaggaaacaucaccaccagcgagaucagcagacugucuugaguauuuguuucugccuuuugcacugcuugccaguucccuucugcugcuauacucuuacaguauuucaauaaaacagagcaagacagucaaucucuaguccccucucuagucuaaguuguacuucauacacuuugugaauauaucauauuaugucaauggacuuccucuccguuuucugcuugugccuuuuguucuuuuuuccuguuaccucugcuguuagauuaaauuuuuccuccuuuaagaaauuucagugcacuaaagucagaguucacaggaccaugucagugucaucccauugguuaagagucacaggaccaugguuugcugugucucagcgaugucaucccauuggcugagaguucgcugcaucaccuguaugucucauuccauuggcugagaguacaccauaugagcugugugugucaucccauuggcugauaauuuuaguuugaaaggauaaaaccaccaacauuuaagguucuguuuuauacuauuucaguaaccaagaucauuuucagguguccgaccuuuauaacaauagugacgaauggucacuuuacaacgaacagagcaaacccaagcuucacuugaugcaacauuugugguugugcuauuugcaggucaccuaaacaguccuacuguguugugguuuacaauaggaauuucuguuccguagagguuuugcaaaauuaugggauaaucucuguaaauaacuuuacaaaaaaaaauugaccaugcuugaaagcuggugggcaagacucuugauaagcaaagcucauauuacucgugcuggagacuugagcuuuuaugaagagucuggacguagcucuugagauuuuaccacuaauaacuauucgcuuaaacugcccaucaucuuguaagcgccacgauaagacgacuacuugaaagcuaucuguaagugucucuuucucagaugagauuacaaacaaguuguagucauugagacaggaacugaaccugcuaacaucaaauuuauucaccuacaaauuaaacauggcuucagggcaagugaagcaugcugaccaaauuuugcuugagucucuucuauuuccagaacaaagagcuucucugacaucuaaaguaaauggaucaucaaugaguuaguugaaagauauuggguaaaaauaaaaauccgauuaucugggagcuaaaucucagauuauguaaggugggcccagugcuggcaaaaggggcuguggggaccaugucagggugcucagacacugugagagcccagaugggcggcaguuucuaaaacacguaauagaacccaccuggccgucaggguuaaaauguugguuuauggaugugacagauggaacaauaagagugacagaagaugauuugcauccgcugggcuggugacauuccuaguguggcugaggaaggauuauaacgucaagaucugccuugcuauagaaugaauucaaggccagccuggcaacuuagacucuguuucaaaauagaaagagagggcugaggauacagcucaauggcgaagugcuugacaaguguguugcauccccauggcugccaaguguccugggauuggcacuucuguccauguggaggaccaaugcaaucauuuuuucauucauugcuccauagcacauguuuagcaaacaucauucauacuugaauuccuuaguuuguaaugagaguuuuaccaccacaaaagcagacacacaugauuuaugcaucauuucaaaccacaugagggaagcuggcuaauuuaaaguacaguuaauagaaagaauuaagaauuuacccuggccuuccacaggauccacaugucaggaugcauaaaaguacucuagcuaaugaugaaguaauaauuuucagaaaaccgauacuuauaacuuaauuaacuacugacuguaaguugggacugccgacaucugaugguaucacaggagaaaucagugggugaauggcaugugcccccuuacaaugugugcaacuucacccuggaagucaccuuggcaacaagaguuuaaugagggccuaagaucuaaauacuauuucacaagauacuagaacaguauaauaucuuuucuuuuuaaaaauauuuucucuuuauucuugaaaauuuugugcauauauacaauaaaauauaaucauaacugccucccauuuccccccuguaacucacccauuuacuucccaacacaucaccucccaacuuuauuucaucuccucuucuuagugcaaucaauacugcccauauguacauggguaaagggucauucucuagaccauggcaaauauaccgugggucacaaccucaaaaugaaugacucuacuugcuccaccagcuaccacaucgcuccucaguuaggguuggggccugaagagcaucuuccccaucuacaccacaauuguaguugacuagauuucauauagguuuugagcaguguccuuaguuaggguuuuacugcugugaacagacaccaugaccaaagcaagucuuauaaagcacaacauuuaauuggggcuggcuuacagguucagagguucaguccauuaucuucaaggugugaacauggcagacacgaucaggcagagcugagaauucuacaucuucaucugaaggcugcuagcagaauacugacuuccaggcaauuaggaugaaggucuuaaagaucacacccacagugacacaccuacuccaacaaggccacaccuacuccaacagggccacucauuuggcuaagcauauaaaaaccaucacaagcagguaacuagagaugcuauagcucaugaguacagccacaggcuguguccagaagauagcauuucauagcauguaucccuccucugguuuuuuuucuguaccccuacccugagccuuguuggggagagugguugauaaagguaugguugauaaagguggcuuaggguugaguacuuuaucucuuauagaaugcuuucuuuuuaaaaaaugagacuauagaggcggcccaggcauuaagaaugcuuguugcucuugcagaggacccagguucaguucucagcauccacaugguaucucacaaccauuaauaacuccaauuccaaaggauccaaggcacucuucugaccucuguagauauguacaugauguacaaacaugcauucagguaaagcacucauacacauaaaauaaaauaaaccuaaaauaauacuuuaaaccacuauaaggguugaaucaacaaaaucuaguccaugugaaauucagugggaaaaguucuuaaaauuuaaaaguauugggagauaaagcaaaagaggcuaggggguggcuuaguugucugucugucugaguuguggcagcauguguaauccaccugagaagucagaggcagacugucccugaggcucacuggccaacaaaucuagaggggucauugaucuacugguuagugagaaauguagccgucuccaguaaagugaggaaaauaguaaaacaccugacacuggccccuggcuuccauguggaccagcacucaugcacgcaugccuuugcauacacacacaaggagacacaguguuauagcaaugagaagguaaggcagggaggcugacagaacugucaauuaauugcuguguaugacucuaacuuagagagaggcaaacuguaaagaagcaaaaacagacagcugaagcagcauagacacaugucugaagguauggagaaauuaaauagugggccagugagaugauucuguggauaucagcaguugcugcccagugauacaugcgugacaaccugaguuugaucccugggauccgugugaaaguggaagagaagagcugauuccauaaagugguccucuccccuccacacacacaccacugcacacacccacacacacacaccauggcauaugcaucacacacacaccauagcacauguaccacauacacaauauggcacacauacacacacacacacacacacacacacauucaaacacacacucuggcacaugcacccacacacacaccaugacacacacccacacacaacauggcacacauacucacauacacaccauggcacaugcacucacacauacauaauauucacaaaaaacgcauaauaaaaugaaacaaguaaaagaacagucuuaaagcaauuucauucugcacuggggcucuaggucaguggcaggcacauacccagcauauguaaggcccugaauuucaucuccagcacagaggaaagcaggagacuaauuuuuuagguaagagguuaugguaauuaugucuuuuaagaggaggccuuauccuuucaacauaacacugaaccacguaccaguaaagcaacacacugucuaagauuucuucaaaaaaccaagcauuauaaacagagauauagaaaaggaaaaaaacucaacucagacucauugggaaauuuacacuuuuaugacacuuguacauguuuuuuaaauuccauaaucguuuuaauacauaaaagccaccaugagaaaggaaauaucagcuccaaaucaaaaggagagagaacacagaaggcucgggagaaacagaacauagcaggagucuagugagagcaaugagggaaagagacgaacugucaucuguaugugaaagcuuucugaacucagcaaguuugugcagacuacugaaauguagccuccacuaagagccuuugguggccaaggaugaccuugacucgccccugagaggcuggggagucugucaugcuugaggugugccuccuaaggagcuggaguuauauugggaguugggacaucuuuugacugggcagcuuugacagcuggcuagguuagcaguuuaguuugcugccacagaagaaagcggggccaacugggccacaggaggaaguaaccugaguccuuaacuccaaccugggaguugaguuguaacuugcccacuguugccauggcuguguggggacagaggaaugcucuauagccuacagggcagccuggggacuccaguccaggagaaaccagucuuucacaaacuugcgaaauacuauuuggcaaggccuauaagggugacuuguagccuaguugaauggaaauaugugucagaaaaggugggaacagggcagagaagaaaugccagcaagauggcccuggcuugucacuguuucagaagggggaggaaucacagagaaagaaaagcuuccuuuccccccaccucucagcuuugugaauuuuaaguuuuuaguugucucauuuguuuucugauauuuuuccuuucccuuugugagugugugugugcguguguguguguguguguaugcgagagugcacgcucacggauguggaaaacauaagacaaccuccaguguccucaggaguacccacccuguuuuuugagacaaggccucucccuggucuggaacucaccacuuaggcuagggcuggcuggcuguccagcaacccccagggacugccugucugccuccccaguugcuuggcuaacaagugcgaugccaccacauccugcuuuucauuauaugggcucuggggaucgaacuuaggucccccggcuugugagcacuuugcugagccccagcugccuccccagaucccugcucuuuauuucucucucuuuuuuuucaaagcauaacccugcuaacuaccacccucuaagcguaacauuaacucccacgcuucucccuggauacggagcucgcuccuuucucaucuccaugccucuuccuccuaccuuuuugucaaaucucguucuuaagaaaaacagccucucucccauuucccucuggaucucagucuuuucauguccucugagccucugaggcuagguggcuucuucuugguucugaccucuggaguacgcaaccuuauugagaggagagcaagaagcuuucagagugagaucgcacugugucaccacccccccaaacccaaccccaacacacacacacacacacacacacacacacacacacaccgguuaacuguuuuacugggugagguucauaucucucuuuagcuucaaggagcuguuacuaggaucuuucagcauccugcuaggaaaaagcugucagggcuuugcgggaccacuugccccuuccuucccaacuagauucuguuauugucuaaggaggaucugguuaaagaggagaagacggaaaucagagcaagaaguagaacgagacaggaagugacccauguuacccgcugaaaccuugcuuagggacaguuggagcucacuuuuucccuggggaacugauauccaaggcaggcucugaggacugcagagccagaacgcuucuaaagcaggagcagaagaaagggggugggguggggaggagggaggaaaagagggaaaggggaagacgguaauuaauaucucaaauauugcaagucgacuuccacacuauuuaauuguguagaaauagcuauuuauuuguauaguaaaaguuacuguaucaaaacuauucuaauuucucccauguuuugucaaaaaaugggggcaaguuccauuuuaucuccacuuuucuaagugagaaaagaaaagauuggagaggcggggguuuuuuguuuguucguuugauuuuguuuugcuuguuuuuuguuuguuuguuuguuuguuuguuuuuggugaccacgcagccaaaacugauuguucagggaucugacuugauguaucuucaggguuuuauuggaguuuuuugcuugcuuuuugaaaauaaaacguuuguuuuauuuauuuguguguguaugcguguaucuguagaggucagaggacaucuuggacugguccucacauuccauccugugcaugagcucuggggcucaaaguuaggucaucgccauuggccauaaauaccaagccaucucaccagcuauauuccucugguauuugacagcuauaggguuguucauuaaaucaauugcuauugcauuugaggcuuuacaaaauaacuuuuacuuuucaaaagaaaagcagcuugcuuuuuaauaugacaauccaagagacucaucuuuuuggcagguguggaaagacaagcauuuaccuauggaaaacugguaaugggccauagaaauaacaaugccaaaaaccugccagaacuuagcaauuaacaacugaaaauacugggccucaaaugucagcgaaggccauccuaacagucugucuauuaguagucagugucucucccucucuguguaacauagucugcccucaaacccaagagccuccugucucaguuucccaguguuagaaauacagguguuugucaccacacccaacagucagguuuuaaguagaguuugauuuuccauuagugcaggaggaaaaagaugagauuaaagauacuggcaaccuagaauaauuuuguccaacuguaauuacacuucaagauuucuacccaguauuuucagcuuguagacaggggaaaccaaagggaaaccagacagaggugaggcccugauaacagcucuuaaagcucaucgcuaaagugcuagcuucuacuaguauauauaaugacuaauacauccuuauggcugaauuuuuguuuacuucaugauaccaauaaaguuauaaugaaggcuacccagcaguuauaauuuuuaaaauaguagcaguaaagcauauaagauaauugcuacaucauaguuuucagagaaaaugaauucgugugaaaaaaauauaaacauuaaauuuucuacuuuuuuauuuauugucugucugccugcuuauuauaacacagggcuuuaaauaguacaggcuggucucagguuuguuauguaacuaagaaugaccuugaguuucugagccccuggcccgucucuaccucuuaagugcugggacugcagacacacaccacuaaguuggguucugcuuggugccugggagcugacuccuggguuauuaugcgugcuagguaagcauugcagcuuacgucugagauauauccucagcccucucuaggucucacacuguagcauggguuguccuggagaccugaacucaucacagucuucuugcuucagccucccaagugcugccaguacaaguauaagcucucauaccuggcuuuuagaaagagagaaucugucaaccucuaaaaaucccaagaaaucagaacauauguacuggaauuaaaugagugaguuuagcuauccaauaugcaaaacuuaacugaguagaauuucagggcagaaauggagagcggcuacccgauuguccugggacgcacguagagcacgggaacugucaagaugggcagauucaccuggggugguggcaagcaugucuaccagaggcauaaaccaaguaaggaaucgcccgucucucagaggauuacuagcacagcguugagguuuccugcaggagcccaggagaagacccuggaguccccgucacgauaagcccugcugagccuguagagaagacagcucuccgcugcuaggaacaauaaauuguccaaagccuuuuaaugacuggcgaugaaucugcugggacaggugagugauuaucaguucuuauaugucacaugucacaaucccauccuccaucauuagacuuccuguauccauuucugagcagaggaaaaaacugcucgugcaugcuuucccggcaugcuuuguggcaugggcugugaaggagucagcggagaucccaccucaugauuaaauaaauggucuugaguccuccaggacguaagggugucugaggccccucuucagugauggaggcuuugcccugauauuaugagugacuuggggguuuguaccacagcaggccacuacuauuaacuuacagugcagacaugccuauuuuucuaauucuauaucaugaguauccagaauuuuuuucuguuucauuucaugaauuuuuuccuuuuuuccuguuuuauuugggggagacgaggcacuugaggaauagagaauuaaaguuuagccauguaaccagauugguccaaaauucacccuaacgucauggcccuccuaccucagccuccagaggauuacagguguggaccacuauauucagcuuucuuuuuuuccuuuuauauacccaucaaauuugaaagcuucauuaaaaaaaaaaaaacuugggcaauuuacaugauucugguuuuuaaaaauguaagccuacauaauaauuagucuuuuucuccuuucuguuccuaaacaauuacuucuugauccugcaaacaaagcaauguugcugaguuuccugugaucuuccuuccggccauagguuacauacacacaggaaaaaguauacucucgggguccccugcaucccuacuuauacaaacgacaauugauuuuguauacucuugagcugauauuuuuucaaguacaaauaaauuaugagcgcuuugaagaccuccucugccuuagcuagcuccccuuucuagcccucauggcucucacccuaauaggcauuuacuuugcacuucuguaagcuagcaacacauuccauucccuaauuagugguaaaucuuauacaugcucauccgcucagcacuauuucaguguaagcuucucaaugaugggauacacacacugagccacuccccgcccccuuugauacaggaucuaacauagcaacgugaauaauuaugaguuuaauaaaugccuuuuuaugacucuaacuucugauuuucuugccacccacuuaguauuuggaaaccaguucuauccacuuuugcaauucaauuacauucuagcucguuaacagucagauaaauaacacggguuggccagauucugagagaggaaccacagguuuauuccuuuauuaagucaguauguuaggaaaagaaccacaaagugguuauacaucuguccguucuuucuaauuguaucuauguguucaguauaagucuaaucauauaggcagcuggauuucauuaagaacuugauaaauaugucuaacauguauacgaagaagauguaugaauagcuaauuugacuuuuaaaaauaagagcaaagggauauuaauaaguaugugaaaacuuaauaauaugggccggacagauggcuuuauugguuaagagcauuugcugcucuugcagaggauuugagugugauuccaaaaacucacaucaggccguuccuaaccaccugcagccacaguucuaggucauccaacaucuccuucuggcuccacaggcgucggcacucgcucaugcauagagcgacacacagacauucacauaugcacacaguugaaaaaaauaaaaguaaaccuuuaaauagggggaaaaauauuuaggaguaaaggcuggguuuguccacacaggaacaaaucaaaaaaugaaacagccuaaagcaguccgaauuccuguguuaauauuuagccccgaagguggugauacugaggugcaaggacuucugggguguuuggcaauuaggggaggaaccuucaugagucagaucacagcuguugaacaggaaagcaggagaaagcccuuccgccuuggucucaaguucucacagugagaaaaaugauccuuugugaggaccgagacucagccugcuucugcccuggauuuuuaccuugcaaucuuaagaaauaaccuucucuuacagcucguuagucuucauagcagcugagaccuagcacgacacccauuucaggaggucccuguuuguuaaguuuguggcuccacaaaacaguaaagaaaagaaaauguagcaaaugguauuggggaaauaauacauuuaggccucugucuaaaccuacacaucugaaugggaaaaguacaauuauaaaauuuauaaaagaaaauauaggagccgggcgugguggcacaugccuuuaaucccagcauucgggaggcaaaagcaggauuucugaauucaaggccagccuggucuacaaagugaguuccaggacagccagggcuauucagagaaacccugucucgaaaaaccaaaaaccaaaaaacagaaaaaaaaagaauauauauauguauguauauauauaucuuuguggcauaaagaaagaaugugauuuuaaauauuaaaaguuuucaaauauggggcugggaauguaguucaguucaguugguagagugcuuaccuaucacauuaccugacaaaacagguaugguggcucaugccugaaaugccaggacucaggaggugggggagggggagggucacaaguucaaaggucauccucaaauacacagaaaguucuaggcuagccugggauacaggagacucuguccagagaaggaaggaaggaaggaaggaaggaaggaaggaaggaaggaaggaaggaaggaaggaaggaagggaaggaaggaaggaaaggagggagggggaaggagggagguaaggaggaagggaggaagauuaguuucaaauguguucaaaaguagggaaaagugaccaguggacuuccaugcaguuaucacacgaauuuuuaaguucacaaaauucuauuccaaacgccuuuuuuccucacccacuaaauuuuuccuuuuuuuuuucuuuuaauuuugacguaauauugcauccuguaucacaauaucucuuaaaaauauguacauacauuuuauaugaacaugaugccaccauuauaacaguagaauauaagaauaauuaauuaacuauguuuaacaacugagcaaaagucauaugaacucauagaaacugaagcagaaucacauggccuacccgugucugcaccuggugcucugugcauauauuauaguuuucagguuagcacuuuuaugggacuccugaaugugugaaugacugggucaauuauuguuccuguucuuggggauuuuuuauuuuucuguuagcuuggcuaguccaacacugauaugguggucuuugucuuuucuuauuauaguuuauuuuguuguguuuugcuguuaucucccagaagcuggauccuugcuaaugagagacagaaagggggaagauccagaugggagagaagugggggcggggggagaagcuaaggggaguagagggagggaaacuguauuuagauuauauuguauagaaaugaaucuacuuuuacuaaaaggggggagaaguaacuaauuuuuaaaaacauucuaaaagauuucaaaauauaaacaccaaggcauuugauuaucuaagaauuagaauugggggaaaagaacagagagugaaggcuauauuaagagaugacuaucuagaauauacaaagaacccuagcaaauuggcaaaugacagagacuuuaaagaaaaaacuggacauagacuacaaugggcaacuuauaaacaggcaaaucaaagaacuugaggaguaacccuaaagaaauucaaauaaaaauaagcaucaguauauaccaaguagccuggaaaaaauuagcugguuaaugccaaguguugguggugaugugugcuggcggaaggcagauugguguauucugggaaagcaaucugucucuauuuaguuaaauuaaguauaaagauauucugggauccagcaguucuguuccuggauaugcaucucaaagaagcucuuacccagagccacucagcaauacacaaggguguucacugaaggguuacucacugcgggguuauucaucgucaccguuguggacagauggagaccaucugauagugaauaggugauacacagaacaccagugcacgggcagaggccaggcaccagugcacacucagucacauguacaggugcuaaauauguacuugaguaaaacgacugagugcuauaauacgucaucauuucaguuaagaaaaucuaagccaaacccgucaucuauuuugcaagaacacauucagcagcuggggagacagcucagucuguaaagugucuugggucuucaugcuuucgaggcauaaggaucugaguucaguccccaacacccacauagaaagaugggcaagcccagcauuuggaaagcagagacaagaggauccuuggaacuuacuggccagccagucuaagcaaauuggugagcuggcugcagguucacugacagauccugucucaaaaacuuauguggggaaaaaauggcaaaguggaguugaagaggaaaauacccagugccagccacuggcuuuugaaugcaugggugcacacacauucaaauaugugcguguguguguguguguguguguauacauacauauacauauauauauauauacauauauauguauauauaugcauacacuacacaacacacacacaguuaagaauauauauaagcaaaaugguauugugaugguauaugcaaugauucuggaggcagggagaaaggcaugcaaauggaguacuggaguaagaaggaauacauaaauaaaagcaguugcuggcacagacuaaugauaauaccguaccugaagcggagaaauagcaucaccucaucuuucuauacccaagugagggcuaagggugagagguacaaagcagaaauggcucauaucuuugaaugagucuaaauugauuggagcuuucaucacaagauuuaacaaacuagacuaaaauaaaauaaaauaaaacaaacaaaaacucuucucugccugaaucucaguaguagagauugaucaacugguaaagggccauguuugggguguggcucaguugagaaaguaugggccuggcgugaccccugaauucugucuccccacugaauaaaaccagucauguugguccaugucuauaagcuuggcauuuaggagguagagccaggaggaccaaaaguucaagguuacucucaacuacauagacaacuugaguccagcccagauugugugagauugcauuuuuuaaaaagaagaaaagggggucuuggaagucaaaaccaaaagcacacaaacucaagagaacugauuguaauggggaggggaggugggaagagggugccacggggaaacaugggugcaugaggaagucuuaugaucaauguggaaguaauuuaagcauaaaguugcauugguuuuuggauucaacguguaaauauccauguacuugcauaaaugaaugauggaauaaauuaaugaacuaacagaauacagauaauuuauagcaaugcuccgcccauccugaggcgcacagaccccuccccaaccccugcaguauuaggccuugcugccacagagcagaguguggaaagaugucccuacugggcauuugaagcugaaccauugccuggaggccagggcuucgaaacuuagaaaaccauuauaccugccugggucucaguuucccuucuguacucuaagaaccuccaacuaaaagcucucugcuuaacauggguaaaaauagagcucuacagcgaauuugcuugagcuuaaccccacccugucuuaacaaaugcuuucuuucuaaaucuucuuuccuuccuuccucccucccuccaccccuuucucccucucuccuuccuuccuuccuuccuuccuuccuuccuuccuuccuuccuuccuuccuuccacacagaauccaccauguagcccagacauggcccuaccuugugguaaccuucaauagcccaugugcauacacagcuaguguuggucauuaacccuuccaggaggcugggauugaucacauuagcucagugcuaacuugagagccuggguuugcaucccagcacugaagaaaaaaaagaaucaaacaaaacaaccaaagaaguaauauaggauggaaguggacauaaagaaucauggacagacaaaaagcagcaccugcugucauaguaacgggaucuaacuuaauguacaugacacggcaaacagcugcaguagcauaugccuacagucccagaugcucaggagacugagacagaagaaucaucuaagcucaugagugaaauucucucaguacaagaguaaaauuucacuuauagauagguagauagauagauagauagauagauagauacauacauacauacauauauacauacauacauacauacauacauacauacaugauugugggacauaaaaccaugccaagaaguuugguaagguagagcaggccaagacccagagacucggugggcacacaccugaggcuuaggugauucccggcucccugccugacuuggaacaagugccaugcuucucacauaaaagaaauauguucuauggucacuuaggcucaaaucaagagucucaggcucuuaggucuccaugcuaaugagguaccuagaggccuggagggcuuagccuuucaucaagaucaugaaggccuuugccuacagagcugcagccuaaucuccuguagaaggcuucucugcacucccagccacaaucgccacgaagccugccacuaucaagguaaggacaaucauccccauugggacaagccgaaucuccccuuuccccccagagccccaacuccauucucugcucuuccaagauucccagcggcaccuggaugucuaagagucugagaaccucauggccuuguugcaggucugggacgccugaaccagccccggggacccugaacgagcuccggccuucccacagcuaagacugugcuuucccacccccggagcggcguccucaaaguaccaaugucuggcuuguaaagugguucaacugguagaugcuucggcugcccugaguucaaucccuuggaccuacauagugagagagaacugauuucugaaagcuguccucugacugccuggcacacacugugcugugcucaccucccaaauaaauaaauaaauguaaaaauggagaaaggaaaaaacuugucaacaucuuugaaugcagggggauucugagagaaggucauagccaagaagaguuaaggagaccauggcagcucaagucaacuugugauauccuggacuggagaaagaacauuugcaaaagaaggaaaagacaguaauaguuaaggaaauauggacuuuaggugucaguacugugccaguacuggcucacugauuuccacaucucaugucagugugucaaugacuaguggaaagcugagaagguaugggaauucccccguccuucugcuaagcaugucuauuaaucuaaaaguauucuuuuuaugauagugaaaauaauuuccuucuuaauaauacaucuuagucguuuuuuuuuuaaaaaaaagaugcauuuuuacauauguguauuuuccguguaugugacaugaagguguucauggaggccggaagaaggaaucuaaccacccuaagucaguggcucucaaccugggggucacaaccgcuuugggguugaaagaugcuuucacagggcuuuccgaugaccaucagaacacagauauuuacagcgcaguucauaaaagaagcaaaauuacaggguuggaagucagcacaacaugaggaacucuauuaaaggguugcagcccuaggaagguugagaaccacugcccuagcuggaguuauguggacagcugugagcugccccaagcaggugcugagaacaaugggguuugccgaagcauuaggcaagcuggauuagugcuuugauuagguaaugcaauggcaacacguaacucauugaguuugaagagaaccccaagguggcaaaugugcacugguuccuguggcaucuaaguguuagagcagaggacugguuucuucauagagcucaaccacaagcaauuagaaagauguuuuaaccagucugaaguuacgacaaugauucucaaguuauggggucuuugagcaaaaaaaucgucgagaggggguuaucugugggguuccaucuuacccggguccugacacucaguagauacguaagagauguucuaguugggugugguucugcccaccugcaaugacaucacucggaucaugaucaagaggaauucaaggcuggccacaacaagugagaagcuugaggccggucugggcuauaggaaauccuugauaauuaauuaauuaauuaauuaauuauuaaaaucggcagaaauucauuaaagugauggcaacgugcuucagaacucaggguacaacugcaguguuuuauauacaucuuucacaaaacaaacagcuauauagccuaucuggcaaaauaaucaaauaaaaaaaugcacuauauauuuucuaguuaaugacauuuaucuguuccugugauuuaaguugcaagucucugaguagaacuaugccuuuaauucugggacuacugggccaugagucacuugcaagguaucuucccuaaguacguauuaaugugcuucacagacuggaaacuggccuaucagguuuguuuaauguuucucucgugaagaaccuugaagcaauugaauguuacaauuuuuuuccugugugauuuuuuauuagcuacagaaccuugccaagucacucaagcuaaucugcaaguccuguaauuaucacaaaaaacuacucuggcaaauuaaacccacuucucaaugcaggcuuaauaggcaagagggcuguuuggaaagcucaguggauuauaagcgcuacuuuacaaaacacaccgcagcacacuuacacuuggagacaguggccuuaaauaguuaaacaaguccauugacaucaaccgggugcauuuccuuuguuuauuuuucccccgaaagacuucauuaccuccaaagcaccugacugaagaggagcaaaaggccugguggaauugcgcagcucagauggagggaagcagagaaccccucguguggaaaaguucguggaggucacuggaggugagggcugugagaacaagcuccgagggaacgucucagagagaaggacacuugguuacagucaggggucacgcagcacaagagucucugaaagacaagauaaaauaaguacaaaguagaaucaaaacaaagucuuaggcguuugaucagccaaguugaauguugaaaacaauagcgagagcgguaaaagcuuaguucucagauaaguacuugucggacucagugaagagagaucgugucugacguagaacuagcuucggaaaagaucucuguauaauuagggucauuuuaaacugaaauaaucaaggucuuccagggagucuagguccugccuaaacuacuaccuauaaguggagggccagucugcuuauaagucuccuacccugggcuggauacugaagguuuaguaaauccgcagaacagagcccaagccacgccccuuuaaacagagcucacgggucagggaacacuggaggagcuauugaagugacuagggcaacuccaagugucuggggagcucaggcucagagggacugagauaaggaaagagccauuagucaccucuuuuaacucacucucugaaguuggcugguuucacuguggacccggugauuaacaggacagagauagcuucugcaauucagcuucuucaaguagaaagaaauuugaagcuuccucugagcauucauuuccuauuugaaugcuucagaucaaaucuccacuaucaggagacgauggcuggcucucaucuugcacauauccuggagaaaagaagaggccuggguguguccuacucaauggacucacagugcaggacuucccacgucaccucucagggagcagaugucagaauaccugucagcccuggucacuccacuguggaagcacaugaggcuaucauuacugacagggauaaaacaaaaccaagaacaauaaacaacaacaaaacaaaaacaaaaacaaaaacaaaaacaaaaaacacauucccccuuuuugagagaaagagaauuggcaaaucggcugugauuugucaaacacaugcuuuauguucaaauaacucuuuuaaaauguuuuuaaguauuauucaaauaaaaguuaagaaaguucuagcugggcagugguggcucaugccuuuaaucccagcacugggaaucagcuauaugcgcaaaaucucugagaucaaggcuaggcuggucuauagggcaaguucuaggauagccagggugacacagaaaaacucuaucuuggggguuggugggggcaggucaauauuggguaacagaugaugcaauaggaaaagaccucuccaucaagccugcugaccuaagugcgaucauuggggucaacaugguagaaaaagagaaccaacuccuucagucugucccugacacaugcacaugcaugcacacauaugcauacgcacacaugcacgcacauaucuacacacuaaauaaauaaaugaauguaauaauuuuuuaaaaagauaaacaaagaaaauccaguacuuagacugauuaucucuucucuauuugauccuuuuacugauguguaagaugaauucuuaagucugggcaguggcucuguuuucgaagaugauaaagaugaggagacaggaccccacaccccauucagcuguucaaacgugaagucuugggucaagcuaauucuugucuucguuuacucuuuucccccagaccuucaguccacucuucauuguauuuuagcucuuauacuuucucuacucuuguggugcuaacacacucuaacucacgguuaugacuauaauaacuuuuuccuuucuuuuuuccagguagagccucacaucucccagacugguguccaacuacauauguagcugagguugacuuucgaauuuugauccuccugccucuaccucugaagugauaugauuacagacauguaccaucacauucaguucccgaggugcuaagucaaacucgcagucucaagcaugccagguaaacauucuaccaacugagcuauaucucagcaccuauacaagaaccucuucaauagaaauuccccaugauuuaucuuaggccaccaaagagagauacaaaaaaaaaaaaaagcaaaccucugaguucccaaccccauuuccuacaaacuccaugguagcaucuucccaagaugucuauguaaggcagccuuucccuccuuggcuggccacaguuacagguaaucucuauguguuuugcuuaccccaucagugauguaaaacuucuuguuucuuaguggagaugcuuacaagcucuugggacaggaaucacauugguccaauaauacuaucaugcaguacuuacagccauguucagaacaugguagauggucagugaguguuugcuuuugagaugaaaaagagaaggaaguaggugaccagauacaggaguugguaaguuuccgaaaagaaacaaaauagugaacauguuuagguuacagccacugaaggcccugucaucuacucuucauguaaagaucacacaaagguccauggagagagcaccaaggcccauaagauggcuuagugaguaaaagcaauugauaagccgaguucaauccccaugacccacaugguggaaggaaagaacugacuccuucaaguugucagaggacaggcacauagagcaaacaacaacagcucaaaauaucaaagaauauuuuuaaaagaaaaaaaaaaacaaaaaaggagcaacaacaacaaaaaagacuacacuagguugucuguuuucauuuauuuuccuguuaccgugauaaacauucugacagaaguaacuuaaaggagaaaggguuuauuguuacuugcaacucaagucacaugguggggaagucaaagcagugggagcuugaagcagcgcucacagcacacccacacucagaagccagaaagcaaugaacucucaguggugcucagcuccuuucuccauuuacacaggccaagcucccagcuagggaauggugccauccucagugggaauaggaauuguccccauaggcuuauacauuugagugcucuaucaucagggaguggcauuacuuggaagggaucacaagguguugucuuguugaaguggauguggccuuauuugaggaagucuaucacuaggggcaggcuuagggguuuuaaaagcccaagccaguuccagugucucucucuuccuugccuguggauuuggcuguggaacucuuagcuuccucuccagcaccaugucugccuccaugcagccaugcuccccacugugauaaaaauggacuaagccuuugaaacuguaagucucaauuaaauauuuucuuuuauaagaguugccuuggucauggugucucuucacagcuuagagugcuaaaagaccaccucaaagcgaucaagauaacccccuacuggccuuucucccggguaauucuagaccugucaggcugacaguauuuacuaucacacuugcuaauuccuagucaaagacaaaauuacugccuaguugucucuuguguccagcuuuugcauaaaugcccaaauuuuagggugaaguagauagacuacaguaauguaucaguuguaacauuuuugcccaguuuccucucaagagagcccaggccaccugcagcugugcugugugguuccuauuucaauccaaaucaugaccauuugcucugagaaacugucaggugaccucuauggaaucaagaauuaugacaugaaaaugaacugguauaaaauacauaagauccacauagcaaauuaaaaccaaaugcaaacugagguucccaaagaauaagucaguugcucaaggaaagagacacaaagaccugaaguuacaggguccccaggguguugcauaacugggcuuggauucuguauggcauauucuaugucucauacuaggugugcuuuguuucuagagaugugcugucugucauaucucuccuuaacuaucucaguaaaaggauucuaguucgugaccaaaaacguggauauccaaguuacugguagaccuaaacaaccaauacacauguuuaauggguaucuuucauguugaagacaccaaggaauaauggggcaaacagauucauguaagaaaugaugaucacauugaggcacaauagaucuaguggagaaagagauacagaugacaaauauuauugaccaucucagauauggucugauaaaugcacuaacauguuucuauguguuuaagauuuauuuauuuacugacuuauugacuuauuuauuuauacuuugagauagggacuccuauagccaaagcaagucucaaacucacuggguagauucaggugaccuugaacuucugauccuccugccucuaccuccugagucuuaagauuacacauaucauuuaucacagggccuggaguaugcagugcugaggaucaaacccaaguccugugugugcuaagcaagcacuuuaccaagugaucuaaauccauggcccgugucuaagaauuuuuagaaauucaauuuaaauucauuuguauaaaugaaaaugaaagcagaugcuaaggaaauaauauguacugauucaaaaaaaaguuucaguggugaauuuugauaaauaaaacuguuuugaucagaauuauacuuugauuuacauauuugaagcacguuuuagcagaauuucaaaacuacuagccacgaggcacaucuccucacaagaacauaaaccauucugaugcucuuucacaaggagcugauggcuauccucagaacacccaagaagcauuugggcauaaaggcaaaggucuacaugaaguuccugguguguccaaagugccaacuugguauuuccucagucugggcaucuuauuaaaaaaauguaccauaugccgggcgugaugacacacgccuuuaaucccagcacucgggagucagaggcaggcggauuucugaguucaaggccugaguucaaggccuggucuacaaagugaguuccaggacagccagggcuacacagagaaacccugucucggaaaaacaaaaacaaagaaaagaaagaaaauccaauaagcugaguuggaucccuaaagcucauacaaagaugugacgagagaacuaacuuuacaaaguugcccucugaccuccacaugaacauuccuccccccaaaccaaauaugauguacacauuuuuaaauauguacguaauuuuaaaaaaauugggggcugcaacggauggcucagcgguuaagagcacuugcugcucuugcaggguuggcuccggguuuguuucccagcauguguauugggcaguuacagcugcagagcaucagcugggaucuacacacacacacacacacacacacacacacacacacacacacacacacacaaacuuuuuaaaauggagucugaacacaguaugcuucggugcugggaucuacacacacacacacacacacacacacacacacacacacacacacaaacuuuuuaaaauggagucugaacacaguaugcuucggugcccagugcagacaacacagaucauuacaugaacaucucagugauagggguaggauucugaguuaguaggaccgcuccugaggcucacaaagcgauagagauuagcgccauugcuuuugguugguacguuagcuacuuuuuuguugugggaaauauuaaaaaaugaauuaacucucugcggggccaggccccgcucccucgcuccugccaaucacaacucucuggagccccugcgccaggugaucucacucacucugucucucugcccgccaacucgccagcccugcuaggccacauggcuccaccaggccaucucucggacggcggggggggggggguccccugaguucuuuuagcuuucaugcaacucccugcgcaccccugguuagccauuucaacaccuaauuaccccguagaaucaagacucuuacugcuuaauuagccaaucagauuuauguaucaauaauaacacaauuuacaagaugacaauacaauaauuucagagucggauaaugcuaaagcuuuaacacaauuauucuaaccuuugauaacaccacgucagccuccauuuugguucucccucuucuccucagaucucucucucucucugucugucucc

SEQ ID NO: 1410 - RNA, 27546 nt, Mus musculus
ggagacagacagagagagagagagaucugaggagaagagggagaaccaaaauggaggcugacgugguguuaucaaagguuagaauaauuguguuaaagcuuuagcauuauccgacucugaaauuauuguauugucaucuuguaaauuguguuauuauugauacauaaaucugauuggcuaauuaagcaguaagagucuugauucuacgggguaauuagguguugaaauggcuaaccaggggugcgcagggaguugcaugaaagcuaaaagaacucaggggacccccccccccccgccguccgagagauggccugguggagccauguggccuagcagggcuggcgaguuggcgggcagagagacagagugagugagaucaccuggcgcaggggcuccagagaguugugauuggcaggagcgagggagcggggccuggccccgcagagaguuaauucauuuuuuaauauuucccacaacaaaaaaguagcuaacguaccaaccaaaagcaauggcgcuaaucucuaucgcuuugugagccucaggagcgguccuacuaacucagaauccuaccccuaucacugagauguucauguaaugaucuguguugucugcacugggcaccgaagcauacuguguucagacuccauuuuaaaaaguuuguguguguguguguguguguguguguguguguguguguguguguagaucccagcaccgaagcauacuguguucagacuccauuuuaaaaaguuuguguguguguguguguguguguguguguguguguguguguguguguguguagaucccagcugaugcucugcagcuguaacugcccaauacacaugcugggaaacaaacccggagccaacccugcaagagcagcaagugcucuuaaccgcugagccauccguugcagcccccaauuuuuuuaaaauuacguacauauuuaaaaauguguacaucauauuugguuuggggggaggaauguucauguggaggucagagggcaacuuuguaaaguuaguucucucgucacaucuuuguaugagcuuuagggauccaacucagcuuauuggauuuucuuucuuuucuuuguuuuuguuuuuccgagacaggguuucucuguguagcccuggcuguccuggaacucacuuuguagaccaggccuugaacucaggccuugaacucagaaauccgccugccucugacucccgagugcugggauuaaaggcgugugucaucacgcccggcauaugguacauuuuuuuaauaagaugcccagacugaggaaauaccaaguuggcacuuuggacacaccaggaacuucauguagaccuuugccuuuaugcccaaaugcuucuuggguguucugaggauagccaucagcuccuugugaaagagcaucagaaugguuuauguucuugugaggagaugugccucguggcuaguaguuuugaaauucugcuaaaacgugcuucaaauauguaaaucaaaguauaauucugaucaaaacaguuuuauuuaucaaaauucaccacugaaacuuuuuuuugaaucaguacauauuauuuccuuagcaucugcuuucauuuucauuuauacaaaugaauuuaaauugaauuucuaaaaauucuuagacacgggccauggauuuagaucacuugguaaagugcuugcuuagcacacacaggacuuggguuugauccucagcacugcauacuccaggcccugugauaaaugauauguguaaucuuaagacucaggagguagaggcaggaggaucagaaguucaaggucaccugaaucuacccagugaguuugagacuugcuuuggcuauaggagucccuaucucaaaguauaaauaaauaagucaauaagucaguaaauaaauaaaucuuaaacacauagaaacauguuagugcauuuaucagaccauaucugagauggucaauaauauuugucaucuguaucucuuucuccacuagaucuauugugccucaaugugaucaucauuucuuacaugaaucuguuugccccauuauuccuuggugucuucaacaugaaagauacccauuaaacauguguauugguuguuuaggucuaccaguaacuuggauauccacguuuuuggucacgaacuagaauccuuuuacugagauaguuaaggagagauaugacagacagcacaucucuagaaacaaagcacaccuaguaugagacauagaauaugccauacagaauccaagcccaguuaugcaacacccuggggacccuguaacuucaggucuuugugucucuuuccuugagcaacugacuuauucuuugggaaccucaguuugcauuugguuuuaauuugcuauguggaucuuauguauuuuauaccaguucauuuucaugucauaauucuugauuccauagaggucaccugacaguuucucagagcaaauggucaugauuuggauugaaauaggaaccacacagcacagcugcagguggccugggcucucuugagaggaaacugggcaaaaauguuacaacugauacauuacuguagucuaucuacuucacccuaaaauuugggcauuuaugcaaaagcuggacacaagagacaacuaggcaguaauuuugucuuugacuaggaauuagcaagugugauaguaaauacugucagccugacaggucuagaauuacccgggagaaaggccaguaggggguuaucuugaucgcuuugagguggucuuuuagcacucuaagcugugaagagacaccaugaccaaggcaacucuuauaaaagaaaauauuuaauugagacuuacaguuucaaaggcuuaguccauuuuuaucacaguggggagcauggcugcauggaggcagacauggugcuggagaggaagcuaagaguuccacagccaaauccacaggcaaggaagagagagacacuggaacuggcuugggcuuuuaaaaccccuaagccugccccuagugauagacuuccucaaauaaggccacauccacuucaacaagacaacaccuugugaucccuuccaaguaaugccacucccugaugauagagcacucaaauguauaagccuauggggacaauuccuauucccacugaggauggcaccauucccuagcugggagcuuggccuguguaaauggagaaaggagcugagcaccacugagaguucauugcuuucuggcuucugagugugggugugcugugagcgcugcuucaagcucccacugcuuugacuuccccaccaugugacuugaguugcaaguaacaauaaacccuuucuccuuuaaguuacuucugucagaauguuuaucacgguaacaggaaaauaaaugaaaacagacaaccuaguguagucuuuuuuguuguuguugcuccuuuuuuguuuuuuuuuuucuuuuaaaaauauucuuugauauuuugagcuguuguuguuugcucuaugugccuguccucugacaacuugaaggagucaguucuuuccuuccaccaugugggucauggggauugaacucggcuuaucaauugcuuuuacucacuaagccaucuuaugggccuuggugcucucuccauggaccuuugugugaucuuuacaugaagaguagaugacagggccuucaguggcuguaaccuaaacauguucacuauuuuguuucuuuucggaaacuuaccaacuccuguaucuggucaccuacuuccuucucuuuuucaucucaaaagcaaacacucacugaccaucuaccauguucugaacauggcuguaaguacugcaugauaguauuauuggaccaaugugauuccugucccaagagcuuguaagcaucuccacuaagaaacaagaaguuuuacaucacugaugggguaagcaaaacacauagagauuaccuguaacuguggccagccaaggagggaaaggcugccuuacauagacaucuugggaagaugcuaccauggaguuuguaggaaaugggguugggaacucagagguuugcuuuuuuuuuuuuuuguaucucucuuugguggccuaagauaaaucauggggaauuucuauugaagagguucuuguauaggugcugagauauagcucaguugguagaauguuuaccuggcaugcuugagacugcgaguuugacuuagcaccucgggaacugaaugugaugguacaugucuguaaucauaucacuucagagguagaggcaggaggaucaaaauucgaaagucaaccucagcuacauauguaguuggacaccagucugggagaugugaggcucuaccuggaaaaaagaaaggaaaaaguuauuauagucauaaccgugaguuagaguguguuagcaccacaagaguagagaaaguauaagagcuaaaauacaaugaagaguggacugaaggucugggggaaaagaguaaacgaagacaagaauuagcuugacccaagacuucacguuugaacagcugaauggggugugggguccugucuccucaucuuuaucaucuucgaaaacagagccacugcccagacuuaagaauucaucuuacacaucaguaaaaggaucaaauagagaagagauaaucagucuaaguacuggauuuucuuuguuuaucuuuuuaaaaaauuauuacauucauuuauuuauuuaguguguagauaugugcgugcaugugugcguaugcauaugugugcaugcaugugcaugugucagggacagacugaaggaguugguucucuuuuucuaccauguugaccccaaugaucgcacuuaggucagcaggcuugauggagaggucuuuuccuauugcaucaucuguuacccaauauugaccugcccccaccaacccccaagauagaguuuuucugugucacccuggcuauccuagaacuugcccuauagaccagccuagccuugaucucagagauuuugcgcauauagcugauucccagugcugggauuaaaggcaugagccaccacugcccagcuagaacuuucuuaacuuuuauuugaauaauacuuaaaaacauuuuaaaagaguuauuugaacauaaagcauguguuugacaaaucacagccgauuugccaauucucuuucucucaaaaagggggaauguguuuuuuguuuuuguuuuuguuuuuguuuuuguuuuguuguuguuuauuguucuugguuuuguuuuaucccugucaguaaugauagccucaugugcuuccacaguggagugaccagggcugacagguauucugacaucugcucccugagaggugacgugggaaguccugcacugugaguccauugaguaggacacacccaggccucuucuuuucuccaggauaugugcaagaugagagccagccaucgucuccugauaguggagauuugaucugaagcauucaaauaggaaaugaaugcucagaggaagcuucaaauuucuuucuacuugaagaagcugaauugcagaagcuaucucuguccuguuaaucaccggguccacagugaaaccagccaacuucagagagugaguuaaaagaggugacuaauggcucuuuccuuaucucagucccucugagccugagcuccccagacacuuggaguugcccuagucacuucaauagcuccuccaguguucccugacccgugagcucuguuuaaaggggcguggcuugggcucuguucugcggauuuacuaaaccuucaguauccagcccaggguaggagacuuauaagcagacuggcccuccacuuauagguaguaguuuaggcaggaccuagacucccuggaagaccuugauuauuucaguuuaaaaugacccuaauuauacagagaucuuuuccgaagcuaguucuacgucagacacgaucucucuucacugaguccgacaaguacuuaucugagaacuaagcuuuuaccgcucucgcuauuguuuucaacauucaacuuggcugaucaaacgccuaagacuuuguuuugauucuacuuuguacuuauuuuaucuugucuuucagagacucuugugcugcgugaccccugacuguaaccaaguguccuucucucugagacguucccucggagcuuguucucacagcccucaccuccagugaccuccacgaacuuuuccacacgagggguucucugcuucccuccaucugagcugcgcaauuccaccaggccuuuugcuccucuucagucaggugcuuuggagguaaugaagucuuucgggggaaaaauaaacaaaggaaaugcacccgguugaugucaauggacuuguuuaacuauuuaaggccacugucuccaaguguaagugugcugcgguguguuuuguaaaguagcgcuuauaauccacugagcuuuccaaacagcccucuugccuauuaagccugcauugagaaguggguuuaauuugccagaguaguuuuuugugauaauuacaggacuugcagauuagcuugagugacuuggcaagguucuguagcuaauaaaaaaucacacaggaaaaaaauuguaacauucaauugcuucaagguucuucacgagagaaacauuaaacaaaccugauaggccaguuuccagucugugaagcacauuaauacguacuuagggaagauaccuugcaagugacucauggcccaguagucccagaauuaaaggcauaguucuacucagagacuugcaacuuaaaucacaggaacagauaaaugucauuaacuagaaaauauauagugcauuuuuuuauuugauuauuuugccagauaggcuauauagcuguuuguuuugugaaagauguauauaaaacacugcaguuguacccugaguucugaagcacguugccaucacuuuaaugaauuucugccgauuuuaauaauuaauuaauuaauuaauuaauuaucaaggauuuccuauagcccagaccggccucaagcuucucacuuguuguggccagccuugaauuccucuugaucaugauccgagugaugucauugcaggugggcagaaccacacccaacuagaacaucucuuacguaucuacugagugucaggacccggguaagauggaaccccacagauaacccccucucgacgauuuuuuugcucaaagaccccauaacuugagaaucauugucguaacuucagacugguuaaaacaucuuucuaauugcuugugguugagcucuaugaagaaaccaguccucugcucuaacacuuagaugccacaggaaccagugcacauuugccaccuugggguucucuucaaacucaaugaguuacguguugccauugcauuaccuaaucaaagcacuaauccagcuugccuaaugcuucggcaaaccccauuguucucagcaccugcuuggggcagcucacagcuguccacauaacuccagcuagggcagugguucucaaccuuccuagggcugcaacccuuuaauagaguuccucauguugugcugacuuccaacccuguaauuuugcuucuuuuaugaacugcgcuguaaauaucuguguucugauggucaucggaaagcccugugaaagcaucuuucaaccccaaagcgguugugacccccagguugagagccacugacuuagggugguuagauuccuucuuccggccuccaugaacaccuucaugucacauacacggaaaauacacauauguaaaaaugcaucuuuuuuuuaaaaaaaaaacgacuaagauguauuauuaagaaggaaauuauuuucacuaucauaaaaagaauacuuuuagauuaauagacaugcuuagcagaaggacgggggaauucccauaccuucucagcuuuccacuagucauugacacacugacaugagauguggaaaucagugagccaguacuggcacaguacugacaccuaaaguccauauuuccuuaacuauuacugucuuuuccuucuuuugcaaauguucuuucuccaguccaggauaucacaaguugacuugagcugccauggucuccuuaacucuucuuggcuaugaccuucucucagaaucccccugcauucaaagauguugacaaguuuuuuccuuucuccauuuuuacauuuauuuauuuauuugggaggugagcacagcacagugugugccaggcagucagaggacagcuuucagaaaucaguucucucucacuauguagguccaagggauugaacucagggcagccgaagcaucuaccaguugaaccacuuuacaagccagacauugguacuuugaggacgccgcuccgggggugggaaagcacagucuuagcugugggaaggccggagcucguucaggguccccggggcugguucaggcgucccagaccugcaacaaggccaugagguucucagacucuuagacauccaggugccgcugggaaucuuggaagagcagagaauggaguuggggcucuggggggaaaggggagauucggcuugucccaauggggaugauuguccuuaccuugauaguggcaggcuucguggcgauuguggcugggagugcagagaagccuucuacaggagauuaggcugcagcucuguaggcaaaggccuucaugaucuugaugaaaggcuaagcccuccaggccucuagguaccucauuagcauggagaccuaagagccugagacucuugauuugagccuaagugaccauagaacauauuucuuuuaugugagaagcauggcacuuguuccaagucaggcagggagccgggaaucaccuaagccucaggugugugcccaccgagucucugggucuuggccugcucuaccuuaccaaacuucuuggcaugguuuuaugucccacaaucauguauguauguauguauguauguauguauguauauauguauguauguauguaucuaucuaucuaucuaucuaucuaucuaccuaucuauaagugaaauuuuacucuuguacugagagaauuucacucaugagcuuagaugauucuucugucucagucuccugagcaucugggacuguaggcauaugcuacugcagcuguuugccgugucauguacauuaaguuagaucccguuacuaugacagcaggugcugcuuuuugucuguccaugauucuuuauguccacuuccauccuauauuacuucuuugguuguuuuguuugauucuuuuuuuucuucagugcugggaugcaaacccaggcucucaaguuagcacugagcuaaugugaucaaucccagccuccuggaaggguuaaugaccaacacuagcuguguaugcacaugggcuauugaagguuaccacaagguagggccaugucugggcuacaugguggauucuguguggaaggaaggaaggaaggaaggaaggaaggaaggaaggaaggaaggaaggaaggagagagggagaaagggguggagggagggaggaaggaaggaaagaagauuuagaaagaaagcauuuguuaagacagggugggguuaagcucaagcaaauucgcuguagagcucuauuuuuacccauguuaagcagagagcuuuuaguuggagguucuuagaguacagaagggaaacugagacccaggcagguauaaugguuuucuaaguuucgaagcccuggccuccaggcaaugguucagcuucaaaugcccaguagggacaucuuuccacacucugcucuguggcagcaaggccuaauacugcagggguuggggaggggucugugcgccucaggaugggcggagcauugcuauaaauuaucuguauucuguuaguucauuaauuuauuccaucauucauuuaugcaaguacauggauauuuacacguugaauccaaaaaccaaugcaacuuuaugcuuaaauuacuuccacauugaucauaagacuuccucaugcacccauguuuccccguggcacccucuucccaccuccccuccccauuacaaucaguucucuugaguuugugugcuuuugguuuugacuuccaagacccccuuuucuucuuuuuaaaaaaugcaaucucacacaaucugggcuggacucaaguugucuauguaguugagaguaaccuugaacuuuugguccuccuggcucuaccuccuaaaugccaagcuuauagacauggaccaacaugacugguuuuauucaguggggagacagaauucaggggucacgccaggcccauacuuucucaacugagccacaccccaaacauggcccuuuaccaguugaucaaucucuacuacugagauucaggcagagaagaguuuuuguuuguuuuauuuuauuuuauuuuagucuaguuuguuaaaucuugugaugaaagcuccaaucaauuuagacucauucaaagauaugagccauuucugcuuuguaccucucacccuuagcccucacuuggguauagaaagaugaggugaugcuauuucuccgcuucagguacgguauuaucauuagucugugccagcaacugcuuuuauuuauguauuccuucuuacuccaguacuccauuugcaugccuuucucccugccuccagaaucauugcauauaccaucacaauaccauuuugcuuauauauauucuuaacuguguguguguuguguaguguaugcauauauauacauauauauguauauauauauauauguauauguauguauacacacacacacacacacacacgcacauauuugaaugugugugcacccaugcauucaaaagccaguggcuggcacuggguauuuuccucuucaacuccacuuugccauuuuuuccccacauaaguuuuugagacaggaucugucagugaaccugcagccagcucaccaauuugcuuagacuggcuggccaguaaguuccaaggauccucuugucucugcuuuccaaaugcugggcuugcccaucuuucuauguggguguuggggacugaacucagauccuuaugccucgaaagcaugaagacccaagacacuuuacagacugagcugucuccccagcugcugaauguguucuugcaaaauagaugacggguuuggcuuagauuuucuuaacugaaaugaugacguauuauagcacucagucguuuuacucaaguacauauuuagcaccuguacaugugacugagugugcacuggugccuggccucugcccgugcacugguguucuguguaucaccuauucacuaucagauggucuccaucuguccacaacggugacgaugaauaaccccgcagugaguaacccuucagugaacacccuuguguauugcugaguggcucuggguaagagcuucuuugagaugcauauccaggaacagaacugcuggaucccagaauaucuuuauacuuaauuuaacuaaauagagacagauugcuuucccagaauacaccaaucugccuuccgccagcacacaucaccaccaacacuuggcauuaaccagcuaauuuuuuccaggcuacuugguauauacugaugcuuauuuuuauuugaauuucuuuaggguuacuccucaaguucuuugauuugccuguuuauaaguugcccauuguagucuauguccaguuuuuucuuuaaagucucugucauuugccaauuugcuaggguucuuuguauauucuagauagucaucucuuaauauagccuucacucucuguucuuuucccccaauucuaauucuuagauaaucaaaugccuugguguuuauauuuugaaaucuuuuagaauguuuuuaaaaauuaguuacuucuccccccuuuuaguaaaaguagauucauuucuauacaauauaaucuaaauacaguuucccucccucuacuccccuuagcuucuccccccgcccccacuucucucccaucuggaucuucccccuuucugucucucauuagcaaggauccagcuucugggagauaacagcaaaacacaacaaaauaaacuauaauaagaaaagacaaagaccaccauaucaguguuggacuagccaagcuaacagaaaaauaaaaaauccccaagaacaggaacaauaauugacccagucauucacacauucaggagucccauaaaagugcuaaccugaaaacuauaauauaugcacagagcaccaggugcagacacggguaggccaugugauucugcuucaguuucuaugaguucauaugacuuuugcucaguuguuaaacauaguuaauuaauuauucuuauauucuacuguuauaaugguggcaucauguucauauaaaauguauguacauauuuuuaagagauauugugauacaggaugcaauauuacgucaaaauuaaaagaaaaaaaaaaggaaaaauuuagugggugaggaaaaaaggcguuuggaauagaauuuugugaacuuaaaaauucgugugauaacugcauggaaguccacuggucacuuuucccuacuuuugaacacauuugaaacuaaucuuccucccuuccuccuuaccucccuccuucccccucccuccuuuccuuccuuccuucccuuccuuccuuccuuccuuccuuccuuccuuccuuccuuccuuccuuccuuccuuccuuccuucucuggacagagucuccuguaucccaggcuagccuagaacuuucuguguauuugaggaugaccuuugaacuugugacccucccccucccccaccuccugaguccuggcauuucaggcaugagccaccauaccuguuuugucagguaaugugauagguaagcacucuaccaacugaacugaacuacauucccagccccauauuugaaaacuuuuaauauuuaaaaucacauucuuucuuuaugccacaaagauauauauauacauacauauauauauucuuuuuuuuucuguuuuuugguuuuugguuuuucgagacaggguuucucugaauagcccuggcuguccuggaacucacuuuguagaccaggcuggccuugaauucagaaauccugcuuuugccucccgaaugcugggauuaaaggcaugugccaccacgcccggcuccuauauuuucuuuuauaaauuuuauaauuguacuuuucccauucagauguguagguuuagacagaggccuaaauguauuauuuccccaauaccauuugcuacauuuucuuuucuuuacuguuuuguggagccacaaacuuaacaaacagggaccuccugaaaugggugucgugcuaggucucagcugcuaugaagacuaacgagcuguaagagaagguuauuucuuaagauugcaagguaaaaauccagggcagaagcaggcugagucucgguccucacaaaggaucauuuuucucacugugagaacuugagaccaaggcggaagggcuuucuccugcuuuccuguucaacagcugugaucugacucaugaagguuccuccccuaauugccaaacaccccagaaguccuugcaccucaguaucaccaccuucggggcuaaauauuaacacaggaauucggacugcuuuaggcuguuucauuuuuugauuuguuccuguguggacaaacccagccuuuacuccuaaauauuuuucccccuauuuaaagguuuacuuuuauuuuuuucaacugugugcauaugugaaugucugugugucgcucuaugcaugagcgagugccgacgccuguggagccagaaggagauguuggaugaccuagaacuguggcugcaggugguuaggaacggccugaugugaguuuuuggaaucacacucaaauccucugcaagagcagcaaaugcucuuaaccaauaaagccaucuguccggcccauauuauuaaguuuucacauacuuauuaauaucccuuugcucuuauuuuuaaaagucaaauuagcuauucauacaucuucuucguauacauguuagacauauuuaucaaguucuuaaugaaauccagcugccuauaugauuagacuuauacugaacacauagauacaauuagaaagaacggacagauguauaaccacuuugugguucuuuuccuaacauacugacuuaauaaaggaauaaaccugugguuccucucucagaaucuggccaacccguguuauuuaucugacuguuaacgagcuagaauguaauugaauugcaaaaguggauagaacugguuuccaaauacuaaguggguggcaagaaaaucagaaguuagagucauaaaaaggcauuuauuaaacucauaauuauucacguugcuauguuagauccuguaucaaagggggcggggaguggcucaguguguguaucccaucauugagaagcuuacacugaaauagugcugagcggaugagcauguauaagauuuaccacuaauuagggaauggaauguguugcuagcuuacagaagugcaaaguaaaugccuauuagggugagagccaugagggcuagaaaggggagcuagcuaaggcagaggaggucuucaaagcgcucauaauuuauuuguacuugaaaaaauaucagcucaagaguauacaaaaucaauugucguuuguauaaguagggaugcaggggaccccgagaguauacuuuuuccuguguguauguaaccuauggccggaaggaagaucacaggaaacucagcaacauugcuuuguuugcaggaucaagaaguaauuguuuaggaacagaaaggagaaaaagacuaauuauuauguaggcuuacauuuuuaaaaaccagaaucauguaaauugcccaaguuuuuuuuuuuuuaaugaagcuuucaaauuugauggguauauaaaaggaaaaaaagaaagcugaauauagugguccacaccuguaauccucuggaggcugagguaggagggccaugacguuagggugaauuuuggaccaaucugguuacauggcuaaacuuuaauucucuauuccucaagugccucgucucccccaaauaaaacaggaaaaaaggaaaaaauucaugaaaugaaacagaaaaaaauucuggauacucaugauauagaauuagaaaaauaggcaugucugcacuguaaguuaauaguaguggccugcugugguacaaacccccaagucacucauaauaucagggcaaagccuccaucacugaagaggggccucagacacccuuacguccuggaggacucaagaccauuuauuuaaucaugaggugggaucuccgcugacuccuucacagcccaugccacaaagcaugccgggaaagcaugcacgagcaguuuuuuccucugcucagaaauggauacaggaagucuaaugauggaggaugggauugugacaugugacauauaagaacugauaaucacucaccugucccagcagauucaucgccagucauuaaaaggcuuuggacaauuuauuguuccuagcagcggagagcugucuucucuacaggcucagcagggcuuaucgugacggggacuccagggucuucuccugggcuccugcaggaaaccucaacgcugugcuaguaauccucugagagacgggcgauuccuuacuugguuuaugccucugguagacaugcuugccaccaccccaggugaaucugcccaucuugacaguucccgugcucuacgugcgucccaggacaaucggguagccgcucuccauuucugcccugaaauucuacucaguuaaguuuugcauauuggauagcuaaacucacucauuuaauuccaguacauauguucugauuucuugggauuuuuagagguugacagauucucucuuucuaaaagccagguaugagagcuuauacuuguacuggcagcacuugggaggcugaagcaagaagacugugaugaguucaggucuccaggacaacccaugcuacagugugagaccuagagagggcugaggauauaucucagacguaagcugcaaugcuuaccuagcacgcauaauaacccaggagucagcucccaggcaccaagcagaacccaacuuaguggugugugucugcagucccagcacuuaagagguagagacgggccaggggcucagaaacucaaggucauucuuaguuacauaacaaaccugagaccagccuguacuauuuaaagcccuguguuauaauaagcaggcagacagacaauaaauaaaaaaguagaaaauuuaauguuuauauuuuuuucacacgaauucauuuucucugaaaacuaugauguagcaauuaucuuauaugcuuuacugcuacuauuuuaaaaauuauaacugcuggguagccuucauuauaacuuuauugguaucaugaaguaaacaaaaauucagccauaaggauguauuagucauuauauauacuaguagaagcuagcacuuuagcgaugagcuuuaagagcuguuaucagggccucaccucugucugguuucccuuugguuuccccugucuacaagcugaaaauacuggguagaaaucuugaaguguaauuacaguuggacaaaauuauucuagguugccaguaucuuuaaucucaucuuuuuccuccugcacuaauggaaaaucaaacucuacuuaaaaccugacuguuggguguggugacaaacaccuguauuucuaacacugggaaacugagacaggaggcucuuggguuugagggcagacuauguuacacagagagggagagacacugacuacuaauagacagacuguuaggauggccuucgcugacauuugaggcccaguauuuucaguuguuaauugcuaaguucuggcagguuuuuggcauuguuauuucuauggcccauuaccaguuuuccauagguaaaugcuugucuuuccacaccugccaaaaagaugagucucuuggauugucauauuaaaaagcaagcugcuuuucuuuugaaaaguaaaaguuauuuuguaaagccucaaaugcaauagcaauugauuuaaugaacaacccuauagcugucaaauaccagaggaauauagcuggugagauggcuugguauuuauggccaauggcgaugaccuaacuuugagccccagagcucaugcacaggauggaaugugaggaccaguccaagauguccucugaccucuacagauacacgcauacacacacaaauaaauaaaacaaacguuuuauuuucaaaaagcaagcaaaaaacuccaauaaaacccugaagauacaucaagucagaucccugaacaaucaguuuuggcugcguggucaccaaaaacaaacaaacaaacaaacaaacaaaaaacaagcaaaacaaaaucaaacgaacaaacaaaaaacccccgccucuccaaucuuuucuuuucucacuuagaaaaguggagauaaaauggaacuugcccccauuuuuugacaaaacaugggagaaauuagaauaguuuugauacaguaacuuuuacuauacaaauaaauagcuauuucuacacaauuaaauaguguggaagucgacuugcaauauuugagauauuaauuaccgucuuccccuuucccucuuuuccucccuccuccccaccccacccccuuucuucugcuccugcuuuagaagcguucuggcucugcaguccucagagccugccuuggauaucaguuccccagggaaaaagugagcuccaacugucccuaagcaagguuucagcggguaacaugggucacuuccugucucguucuacuucuugcucugauuuccgucuucuccucuuuaaccagauccuccuuagacaauaacagaaucuaguugggaaggaaggggcaaguggucccgcaaagcccugacagcuuuuuccuagcaggaugcugaaagauccuaguaacagcuccuugaagcuaaagagagauaugaaccucacccaguaaaacaguuaaccgguguguguguguguguguguguguguguguguguguguugggguuggguuuggggggguggugacacagugcgaucucacucugaaagcuucuugcucuccucucaauaagguugcguacuccagaggucagaaccaagaagaagccaccuagccucagaggcucagaggacaugaaaagacugagauccagagggaaaugggagagaggcuguuuuucuuaagaacgagauuugacaaaaagguaggaggaagaggcauggagaugagaaaggagcgagcuccguauccagggagaagcgugggaguuaauguuacgcuuagagggugguaguuagcaggguuaugcuuugaaaaaaaagagagagaaauaaagagcagggaucuggggaggcagcuggggcucagcaaagugcucacaagccgggggaccuaaguucgauccccagagcccauauaaugaaaagcaggaugugguggcaucgcacuuguuagccaagcaacuggggaggcagacaggcagucccuggggguugcuggacagccagccagcccuagccuaaguggugaguuccagaccagggagaggccuugucucaaaaaacaggguggguacuccugaggacacuggagguugucuuauguuuuccacauccgugagcgugcacucucgcauacacacacacacacacacgcacacacacacucacaaagggaaaggaaaaauaucagaaaacaaaugagacaacuaaaaacuuaaaauucacaaagcugagagguggggggaaaggaagcuuuucuuucucugugauuccucccccuucugaaacagugacaagccagggccaucuugcuggcauuucuucucugcccuguucccaccuuuucugacacauauuuccauucaacuaggcuacaagucacccuuauaggccuugccaaauaguauuucgcaaguuugugaaagacugguuucuccuggacuggaguccccaggcugcccuguaggcuauagagcauuccucuguccccacacagccauggcaacagugggcaaguuacaacucaacucccagguuggaguuaaggacucagguuacuuccuccuguggcccaguuggccccgcuuucuucuguggcagcaaacuaaacugcuaaccuagccagcugucaaagcugcccagucaaaagaugucccaacucccaauauaacuccagcuccuuaggaggcacaccucaagcaugacagacuccccagccucucaggggcgagucaaggucauccuuggccaccaaaggcucuuaguggaggcuacauuucaguagucugcacaaacuugcugaguucagaaagcuuucacauacagaugacaguucgucucuuucccucauugcucucacuagacuccugcuauguucuguuucucccgagccuucuguguucucucuccuuuugauuuggagcugauauuuccuuucucaugguggcuuuuauguauuaaaacgauuauggaauuuaaaaaacauguacaagugucauaaaaguguaaauuucccaaugagucugaguugaguuuuuuuccuuuucuauaucucuguuuauaaugcuugguuuuuugaagaaaucuuagacaguguguugcuuuacugguacgugguucaguguuauguugaaaggauaaggccuccucuuaaaagacauaauuaccauaaccucuuaccuaaaaaauuagucuccugcuuuccucugugcuggagaugaaauucagggccuuacauaugcuggguaugugccugccacugaccuagagccccagugcagaaugaaauugcuuuaagacuguucuuuuacuuguuucauuuuauuaugcguuuuuugugaauauuauguaugugugagugcaugugccaugguguguaugugaguaugugugccauguugugugugggugugugucauggugugugugugggugcaugugccagaguguguguuugaauguguguguguguguguguguguguguaugugugccauauuguguaugugguacaugugcuauggugugugugugaugcauaugccauggugugugugugugggugugugcagugguguguguguggaggggagaggaccacuuuauggaaucagcucuucucuuccacuuucacacggaucccagggaucaaacucagguugucacgcauguaucacugggcagcaacugcugauauccacagaaucaucucacuggcccacuauuuaauuucuccauaccuucagacaugugucuaugcugcuucagcugucuguuuuugcuucuuuacaguuugccucucucuaaguuagagucauacacagcaauuaauugacaguucugucagccucccugccuuaccuucucauugcuauaacacugugucuccuuguguguguaugcaaaggcaugcgugcaugagugcugguccacauggaagccaggggccagugucagguguuuuacuauuuuccucacuuuacuggagacggcuacauuucucacuaaccaguagaucaaugaccccucuagauuuguuggccagugagccucagggacagucugccucugacuucucagguggauuacacaugcugccacaacucagacagacagacaacuaagccacccccuagccucuuuugcuuuaucucccaauacuuuuaaauuuuaagaacuuuucccacugaauuucacauggacuagauuuuguugauucaacccuuauagugguuuaaaguauuauuuuagguuuauuuuauuuuauguguaugagugcuuuaccugaaugcauguuuguacaucauguacauaucuacagaggucagaagagugccuuggauccuuuggaauuggaguuauuaaugguugugagauaccauguggaugcugagaacugaaccuggguccucugcaagagcaacaagcauucuuaaugccugggccgccucuauagucucauuuuuuaaaaagaaagcauucuauaagagauaaaguacucaacccuaagccaccuuuaucaaccauaccuuuaucaaccacucuccccaacaaggcucaggguagggguacagaaaaaaaaccagaggagggauacaugcuaugaaaugcuaucuucuggacacagccuguggcuguacucaugagcuauagcaucucuaguuaccugcuugugaugguuuuuauaugcuuagccaaaugaguggcccuguuggaguagguguggccuuguuggaguaggugugucacugugggugugaucuuuaagaccuucauccuaauugccuggaagucaguauucugcuagcagccuucagaugaagauguagaauucucagcucugccugaucgugucugccauguucacaccuugaagauaauggacugaaccucugaaccuguaagccagccccaauuaaauguugugcuuuauaagacuugcuuuggucauggugucuguucacagcaguaaaacccuaacuaaggacacugcucaaaaccuauaugaaaucuagucaacuacaauugugguguagauggggaagaugcucuucaggccccaacccuaacugaggagcgaugugguagcugguggagcaaguagagucauucauuuugagguugugacccacgguauauuugccauggucuagagaaugacccuuuacccauguacauaugggcaguauugauugcacuaagaagaggagaugaaauaaaguugggaggugauguguugggaaguaaaugggugaguuacaggggggaaaugggaggcaguuaugauuauauuuuauuguauauaugcacaaaauuuucaagaauaaagagaaaauauuuuuaaaaagaaaagauauuauacuguucuaguaucuugugaaauaguauuuagaucuuaggcccucauuaaacucuuguugccaaggugacuuccagggugaaguugcacacauuguaagggggcacaugccauucacccacugauuucuccugugauaccaucagaugucggcagucccaacuuacagucaguaguuaauuaaguuauaaguaucgguuuucugaaaauuauuacuucaucauuagcuagaguacuuuuaugcauccugacauguggauccuguggaaggccaggguaaauucuuaauucuuucuauuaacuguacuuuaaauuagccagcuucccucaugugguuugaaaugaugcauaaaucaugugugucugcuuuuguggugguaaaacucucauuacaaacuaaggaauucaaguaugaaugauguuugcuaaacaugugcuauggagcaaugaaugaaaaaaugauugcauugguccuccacauggacagaagugccaaucccaggacacuuggcagccauggggaugcaacacacuugucaagcacuucgccauugagcuguauccucagcccucucuuucuauuuugaaacagagucuaaguugccaggcuggccuugaauucauucuauagcaaggcagaucuugacguuauaauccuuccucagccacacuaggaaugucaccagcccagcggaugcaaaucaucuucugucacucuuauuguuccaucugucacauccauaaaccaacauuuuaacccugacggccagguggguucuauuacguguuuuagaaacugccgcccaucugggcucucacagugucugagcacccugacaugguccccacagccccuuuugccagcacugggcccaccuuacauaaucugagauuuagcucccagauaaucggauuuuuauuuuuacccaauaucuuucaacuaacucauugaugauccauuuacuuuagaugucagagaagcucuuuguucuggaaauagaagagacucaagcaaaauuuggucagcaugcuucacuugcccugaagccauguuuaauuuguaggugaauaaauuugauguuagcagguucaguuccugucucaaugacuacaacuuguuuguaaucucaucugagaaagagacacuuacagauagcuuucaaguagucgucuuaucguggcgcuuacaagaugaugggcaguuuaagcgaauaguuauuagugguaaaaucucaagagcuacguccagacucuucauaaaagcucaagucuccagcacgaguaauaugagcuuugcuuaucaagagucuugcccaccagcuuucaagcauggucaauuuuuuuuuguaaaguuauuuacagagauuaucccauaauuuugcaaaaccucuacggaacagaaauuccuauuguaaaccacaacacaguaggacuguuuaggugaccugcaaauagcacaaccacaaauguugcaucaagugaagcuuggguuugcucuguucguuguaaagugaccauucgucacuauuguuauaaaggucggacaccugaaaaugaucuugguuacugaaauaguauaaaacagaaccuuaaauguuggugguuuuauccuuucaaacuaaaauuaucagccaaugggaugacacacacagcucauaugguguacucucagccaauggaaugagacauacaggugaugcagcgaacucucagccaaugggaugacaucgcugagacacagcaaaccaugguccugugacucuuaaccaaugggaugacacugacaugguccugugaacucugacuuuagugcacugaaauuucuuaaaggaggaaaaauuuaaucuaacagcagagguaacaggaaaaaagaacaaaaggcacaagcagaaaacggagaggaaguccauugacauaauaugauauauucacaaaguguaugaaguacaacuuagacuagagaggggacuagagauugacugucuugcucuguuuuauugaaauacuguaagaguauagcagcagaagggaacuggcaagcagugcaaaaggcagaaacaaauacucaagacagucugcugaucucgcugguggugauguuuccuuuggucaaguuaccaacucuagggcugggggaggaggauagggggaugaggaggaugagaaauccccaguccaauuuaauggcaucuugguaaaccucaauuugacaacuuaaacgcacacuuacaugcaagcacaaacacacucugcugcccuggguuuuuagugaggagaggguugcuuauagcuucagagaaagcccauaucacaaagacuucauuauuuuacaaaauaugcaccgaaggacauuuacuagugcacugagggcuauuaucauaaauaauuaaaacccaaccauucuucuaugaauaauuguauaaaguacauuggguucggagcacugagcucucccaaccuccugcuuugugcccugggaaugcaagcacccacccagcccauuaaaaucaugcuccugcuucuugcauggagccuuuaugaagagcuuuggaugagguacaagcacuuagggugcugccguccuuucuucuaguugcucucuuucuccucuaguaauuauuuauaagaaaaugaaaauguuuauagauaucuuuuagugaaugacucaugguuacauuuuacacaaauacuuugauacauaguccaaaagccugaguguuaagcaaccuggcacuucucaagcaucccugccuauuguggaagccauuguugagagauuuccuucuagagucuuccaaagaacguaaaacaaagaggcaucucaaugugacuaugaugauuuuuuuuuguuaaugucuuucaacauaguaccuacuugcugguaucaaacucagagcuuuggacaugauacacaaacccuguaccacugagauaaaucccuaguccuggguaccacacucucaguacuuuauugucuugcuucccugugaguucugggugacaccaaagcugccuugaguauggggagcuucuugagaauuccagaggcaggauacacccuagguguuccauugacuuccaggcuugagacucuauaguagguggauggauuuuagggcucccagcauccuuaaggucucuagaaugcauucucagaacugaacuuaguucaaaggcaguuuagggaaaaucuaaccaaaauuguaauucugggaaucuuuaaccagagccaggccacucucccuugucuguuccaucuaaagcgcccuguucagugggaaucugcugaagaacccagguugugacuggcacagauuggcaacugagaucugaugagcaacuuugagcaaccaccagauccaggggaggcaugcugcuccaagaucccagcaaaagucacgucagagccgggcgugguggugcacgccuuuaauaccagcacucuggaggcagaggcaggcggauuucugaguucaaggccagccuggucuacaaagugaguuccaggacaaccagggcuauacagagaaacccugucucgaaaaaccaaaaagaaaaaaaaaaaccaaccaaccaaccaaccaaccaaacaaacaagucaugucagaaagacauccuccccguagguuagagaaauaaaccaauauuggggaagaugauuguuagcauuaaccggugcugucugaacugcugacaaagacagcuuagugagagaaggguucguuuuggcuuauuugauggcuaguuucaaugccagcuugccgcaaauuaaaauuaccugaguagagagagccuuucccaaagaaggguccugauuaucuugauugaugugggaagucccaccaugauuguggaaggcaccuucuggcaucccagauaaaaagaaauguggcacauauguagcagaugugcagcuuggucuucaugugggucuccaauaaguggagugagagcuaucccaaaagcuguugccuguacgugggauguguucuucuagcugggcugccuuggcuggccucagugggagaggaugugccuagccucacagagacuugauguuccaggguggggcgauaccccucagaggucccuacccgcucagagaaugggggggggggauugcuagagggaaugacgaggagguaggcagugauuagauguaaaaugaauaaauaaaaaauuacauaauuuaauaauaauaauaauaauaauaauaauaauaauaauaauaaagaaguguagcagaagaaagaacaucucucgcuuagccuuuuuucuugcucaugaguugauuugccaccuuccugcugcugcuguuuccuucccugaugccagaaccaggucuuccaguagugcuaagggaggcaggaagacggagugggauccucuggaacuguagucacagacaguugugagcugcuaugugagugcagggaaugaaccuggguccucugggggaacagccacucuccaggaaacuuccaggcuucagguaucuacuaagaacacugagacaacugcugugugauccuacugguuguuguugacaccauuaaagugagagacaacuguugugggacaaccaugacugcugaggcacacaggcucgaagaucaaguaaacuaccagacccuuagcucucaggcaggauuuugcuauuguuaccauuuuacauccaauuuaauaaauucucucucucucucucucucucucucucucucucucucacacacacguauguauauguguguuuguauguauguauguauguauuaugaauguaugcauguauaccccaggguucuguuucuuuugagauccuugacuccuaugcagcacacggucugaguacaguccacagcagaugggaagggaagguacgccuagaagggcccuguggugaggugucagggugcugaggcagcuggucacaccgcauccagccuguggugaggugucagggugcugaggcagcuggucacaccgcauccagccuguggugaggugucagggugcugaggcagcuggucacaccgcauccccagucaggaagcagaaggaugaauguggaugcucacuucccuuucuccuguuuguucaguccagaaccuuagaucagcuuugacacucacaccgugguggcucuuggcacacuaauuaacccaacuagaaaugccugcagacacuccuaagaauguguauuccugaugauucuaaauccuaccaagauaacaaucaagauuaaucaccacagcccgaaauugcuuuaaaauuuucuuuucaacuuaauuuuauguguauggguaaaauuuuuuacuugccuguugucugugugcuguguuuguguagugcuaagggaggcaggaagacggagccggauccucuggaacuggagucacagacaguugugagcugcuaugugagugcagggaaggaaccuggguccucugggggaacagccagugcucuugacugcugaacucuuucuccggccccuguagcugcuucucagauugcauaaagaucauugucaccaagcagagcugaauagagagcaacacaaggcgcaagcuuuaagcuguuccaggcuuugaaccgugucuacucuccaccucucaucaguguugccguuauccugagcaugggucuugcccuucuaccucaagagcaucgccugccaccagcucgaagacacgggacaaucuggagcuucaaacccaugugacagucuacucuggucuggaccucuguccauucucucugcucuaacacagaguucuagaaaauaugcaauucuguagagacaugguuaccagaaaauggagcagccuggcucauuuaaaagguaacaauugac

SEQ ID NO: 1411 - RNA, 61135 nt, Mus musculus
cuuaaaauguauugcaaaauguacagcauuuauucacauacagacaaaaaggcacaaauucuacuaaauaguucaacaaaaaaauacagcugucuucaacuaguuuuauaaauacuuucaaaaaggggguagaaauaaauacaggauugggccauguaauauaaaauagucaucucuacauagacuuuguuuaacuucugauuuuaacucuucaugcaccuuuuuuuuuucaauuuuaguugaauggacaccaagcuaggcacauagugaaaaauccucuguacaagguuacaaauguaaugacaagucuguccauuuuaaaauaauuaagauuuguacacaacacauaaaacccuucauuuaaauuuuguguuuauaaccuaacaaaugacauuccaggcaacuuuacaaaaguucaacuagccuacauuuugacauaauacauugaucauaaucaaagauauuucuuggucaggaugcacaaggaagauucaaaagaacaaacaaacaaacaaaaaagcucaauacuaauagaaugcaaguggguagguaggugggcugcugcugccuguggccgccucauacagaguucccagcaugacaugaacuaacuuacaaagcuaucauuacacugucagaaaccgugcucuauaccauugcauuucaaagcaguaauuaaacgugugggcuuuuuuuuuuuuuguuauguuuuugugggggaaauuuuuuauuauuauuuuuuuuuuuuuuuuucauuuuguuuuauuuguuuuugguucagcauaacuuggaacauuugaaagcuuuucaaccuaaauguggggggaaacagguaaggcauuuauuuuugcacaaaacuagcauuccuaauagugcaaaugaaucuggugccuccuaaaauggugagaggccauauacucacuagauuaauuuaggguuucuuucuauggcuucacagauuauuccucuauaaauucuauucucacccagagcuguugcuguaaucaaaagauaacuagaucagaguccagccuuuuccuguauccagcaaaagguuuuugcucagaugcaaaacaucucauuuuuaaauuaggcuacaagcaaaaguacaacuuggacuccugagaaucuucgaauaccaguagcaacgagcugaucuggacagcagucucaaaggagcuccauagcucaaaaaauagucaaucuaaaaccugggucauccuuuccccuccccugaauuagcuacuacaauguacuugagaaguuaagacuuaguuugaaaaugucauacauacgaugagaugcaucagaucugucauuugaucaucugauaaaacuugcauagcaagauggaauucaauaagccuuuucuguuguugacaaucaucuggaagacuugaaagcuucuacaaacucaaagcauugcucauuaaauaucagaaugucccugccacauggaaacagauguauaaaugagucaggaaucugaacauugauauuaauaaacuaaggguaauuuaggggaaacugggcuuauuccaaaugcccuuaauucuaaaucucauugcuaaugaaacuucccuucucuuaauuuugauucacaacuacauugaauuccaaagaaaauaacaggacuuuaacacuauccacuugucugaauacauaugcacuauaugaggagugcaaaaacagaacauuauacucaaauuuaaugcuaaauuuauuauugcugauaacuuacuaguuauugccauuugcaauucgaaaguccaaguuacaaaucagaguuuagaacuccaacuccagaaaccuauucaaggauacacuuugaauucuuuccuguauaaccuugaugcaacuuauugccuuucuauauuuuaaaauauaaccuauuuugcuuuuuguuuuccuuuuugcuuaaggaauccacucaugguggaagccuggauuucccaaauaugcacuagugguugacucuguagagugagagucaccagaaguucaucacuugaacuugaauaaccauuguauuauuggaagccagauggccaaguacuggcaguagccagggaaaucccauuuggauccaaaggccagcaguuaggaaagaggaaggucaagcggacuaguaacaccugggccucagcugcccugucucacagaaguuucuggacaacuuuuccuccacccguccuguguccacagcccacucagggcuucgggaccuugcuacacgggccccaaaucucagugcagcagcucugcucugucccugcagccuuccagcaaugccuguuguguaaacucuuccccuggaugccacaugugcaagaucccaguguugugaagcuucagaaccucagcuccucauaccacacagccugggagccaaaugccgucagcauuuaccauuccuagaaaauaagcuuugugggcuauaaaugguacaugagggcuucuagaaauaggacuuguucaccacacagaauucuaugauucuguaagagugaguauucaagaguuugugcuuuggggagaauguagagggcaauaauacauggugcuauucaagccuggcccucugcaaaguuacuucauuuguugguuuuuuuuuuauaguguuuaguucagguucuaaucuuagugucuuaugguuacagucuacucuucuguuuccucaacaaguugcaaauaacacaaacuucucacaaugauuuauaaaugacucuggaaaaaaauucaaucugaauugcaaggaaguaugucuguagcucagaaacaauggguauuugcuugccccuauuaucagagcucuccucagcacacggcaacaagccaugugcuuccacaccggcuguuucaucaagaggccaagaugcuucgccugaugauaucuguccuccugcugauggugcugcuggcauggauacauuucuucucugaugccucgcucucugagucacucauuuccccaucaggggcguacccaucauucucacugucagcucuuaaccugcucuucgcucucuccuuggcuggagcucggcuuacacccagaugggagcagucugagugcugguggcaggccccaucaugggcuucuccuugcugcugccgcucccccuucuuuggaauccggaauccuccccagcuuuucacugggcuggcagguguuauaggcacuuugacuagggagccauugcacuugggcacaaucuccuuccuggugccaggugcugacugcccuacuccaggggagguggcagcucuuguguuguccagaugccucugggaugugucuguggaccugagaggcuugugacucugcuuaaaagauuuguccuuuaagucuccuuuaacgagaucacaaugaaaacgauugucucuucuuuucccauggucuggggucaccacaccauuuuucuguugugcugaugauaggagacgugcuucugcaaaagucuuuucuaagcucagcaagcuuucugagaccuccagccccucccuucuaccacaaagaccuggcugcuuaugcgaggucuugcccucggucccagaacuauucugcacugcaucucguuuaugggacuuuuucaguggaugaaccaaggaagugcccauuuguuuccugaagaaugcagaaugccauuucaaguccucuaucuugggagcauuggggcccacagaaggacuguugaaaaaaagcauguucuccagugcggaggagcaggaagaaggcacaccuaggaacagaaaaccagaggaaaaauuacauaagcaaacccaaacucauaacauucuagacuggaaacaucauuauacaaacuucccacccaagcaagcagcagcagcacuuuguuuuaaaaaaaaagauaugaccugcuucaagaaucugcuuucaaucuuuguagucaguauacuagaucuuucuuuuuaauccaaagccacuaaaauacaguuuuuuaugaaacuuuggggaauccauuugaaaucuguccaauggcggccacuaccucuacauagcagcaauugucccaucuaccagucacuuuccucucugagacuaagcagagcuucuaaguuucuuucucagaggaccacggaggacaaguacauguaaaugugcaaacugaacacagguaagugcucacgguaauucuggacauguaauacaagaagcaaaguucauucgcuguauggaaaaugcguggaggucaaccugucauucaaguuguuaaaucauuaaaucagucuuuuaugcaaaucacaaaacucacauuucauagcuuaaccuaguaaaagcuuacauuuuaugaauuuaugaauaucaauucucaucucauuagaaacuggcacuuccuguuuuuuuuaaucauuuuuuauuuuauguguaugaguguuuugucugcauguaugucuguacuauauaggguacagugcccguggacgccagcagagggcaucagauccucuggaccuagaguuuauucuaauagacugugagcugcuauguggguguugggaaucaaacccagauccucugaaauauucaagcagcaaaauacucuuaaccacucuccagccugacacacccuaguguuuugucuguuaguuaugauccacgaaaauguguuucauacucauuaauaaaccuuauaacgcuggucugaaaacugcuggggaauucauaaggaccaugguucuauaagagucucaagaccaacuacaaaacagcaagucucgauguuuugucuccucuuaagaugugaaccacaagguucaguuccauuguguacuacaggaacccucauaagaccuuacaacccacaagaccuuaacagcaacacagcugagguccuuuuuacaagcugcucaucugaaaaugccugcuuucuccgaaaacaaucacuggagucgaucuugauggcauuugaaguguauuuuuuguuuguuuuuuauugaaaugccccuaaagcaaacaaagauggagaaggcccaguguugucugaacuauaauuucuaucuaccugacuugaagcucaggcaggccucccuuaaguaccacuuccacuaaagaagcucucauuccacaaaaugacccuaacuaguucccagaaucgcaaaaguuugagccaugaacucuaaaagacacauguaaagucaugggcaucucccuugaaagugucuuuaagggcaggaaacuaagcaucccagcuuagaaaugagaaagaaaagccacucuugggggcuucagcugcauuugcauagcaucccacaacaauaaagucuuuucaaaugguuguaauugcuguucagcucaaaaugaagaaaagauuuguuucucuuuucugaauuucugcuuuuguuuucuaauaacaaggucucauucuguagccuagcgugaccuagaacucacaaccuaguccagcugacuaaaauguuggcacuccuccuaccucagcccccagaaugcuaacaaguauaagccgccauguucagcagcagcaggacuucuggaugaacuacauuucaguucuaacccaaaauauguucugaccccuugagaagagccaaguacaaaucucaaccaugaugcaagcagcugccggggauacccauaaaauaaggacuccauuccagccacacacacaucauccuuuaucacugacuccuuagcaaguaccaaaagcuucaacuaggaggccucuguauacuaccaucaaccaucccagacaccaaagagauacagagugaacuuaaagaaucuaaacuacauugucuuuaaccaaugacacuacuuggaaaacuuacuuucaaaguuuacaacugaaguuuuaaguuccagauacugaaagacacuugguuccucugaaaaauacuuaaucuuagcaagaacacauuuaaaaguaugaggcacuugaagaggagaguauggcugaaaacuuccccucagucuuuuuugugugcuccgcuaaccagguuaucucuacuauguugcuuggaugccauaauuaucuagggaaaaaauccaaagacugaaugaacaaugacucuccacacaagcaagugccaagagugcugcugcuggaacuucaaagggcaaaccaagguggagucgcucauccuucuccacugaaggccagccuaagacccaccugcucccugagguaucccaggaccaacuuccuccaugaaaucuuacacuaccuacuuucuggggcuuaucaucaagaacacuggugcuaaucgcacauuuuagaggucaugauucuauaccagacuaacugaagaucauaugaaucccagagugaaacacuuggccaacauuaauaacugacacacucuccagaguagaggaagcauauucccauauuucucuuccuuuuuggcuggcuagaacaauguaaauagaagauaauuaauuaauuaaaugcccagcccacgcagacuuccaucucauccaucccuucagaaguccaccaugaguguuaggaaaugcguguaugugguaaguagucuuagcaaguauuuacaaugguagauugcuccaaaagcuagaccaugaagucacaccuuuguagcuauccccauguuuaucaacagcucugcaaugugcuacaguuuguuuuccuucccauauccugauacuuagguaacuugagauagcauccccacuuuacaugaaauuggagagagaaauuaaggucuaugacuugcuucuacuuggucaucagggagaugcuacaggucucaaagccuauuuaaugccaaauucuguuccuucccuccaauauaaugucuuuaauguuuaaagguguucccugaauaugaacagcugugcuacugaaaacuuucuacaggacaaauuggaagaacaacuguuuucccucaacagcagugucaaggcuucaaaccccugcccuacaucuagggcuuuaugcauaccugaaacuuuuucuugcuccaagagcuuaguguacugagugaaaauuuguuccuggacuuugcacacagaccguuuaaucuuuucccugcgggucaccauguaagugagguuccgaaccuagaauguagagaauaaagauucuaagugagcaauaugguaacgauacuucaaugcuuucauuucuccuuuaccugagauauacuggcccuacuaagaccuugacagagauuugaaaucaaaacauacccuaccacuagaagaauucugcuuauucauucccucguaucuguagcaaccaugaaguuacacugggggaguagcagagauaggcagagucccacucuuccccaccagucugcaauguagagacccccuacuaucuaaucaggacuugcugccuugugccagagagcuccgcuuaccauccaacagugucuucucagaaaucuuauuguaaauaguuugagcaauuaugaagcaaccucccugaauacuucuaucaaguaucuuccaggucaauggcauaaaaggaaccccugcacaaaguccucuagaaaaucaaaugagcugcuugguucacuggguacaacuuugcaaauagccagccacuacagcauauucauuccagugaggugugcaaaugccggggaacugccccagcauccccagcaaaucuuuggaucuauggaucaucaguuuaaaccugcuacuaaccucacccgcauucuaguuuaucuguaacggaaagaccacugugcugagauuccccacucaaucggacagaagacuucuucaaaucacacacauauguauuaguuuguggucaguagucgaggcuuccagagucauuauucccuacucuuaaaaccaucagucaccauuaaguacaaaaguaaagaauaaaggcacuaaaccccacugauccuuugggcauaaagacagaacaucaggugcagcccaccgcugaacaguugaaccuuucuucagaaagaugcccguaagaccucagccaccucagcagcaggggcagaaguggaaaaugacuacaugcuccccacuggcuagcaucuagggugugcuaaaaaugcauccuccuuuugagcagucuuucuuguaucauacuguaagugcaaguucaaaggucacuagcugcuucucugacacaagccaugcaguuuugcacacuggcugacacagauauccccucagucuucagaccuuucuccauccucacacucccagcugugcuccaggcugggaccuacaugaggacaugggccaugaagggaaauacuaccggauuuugcugacccuaaugaugcacuaucagggaguuccugccucuauuucuauauuaauaacuucuuaauacuauuagguucaauuaauaaaggauuaaaaagaaaauuaugcuccuugucugaauuaaauaugucacuuggccugccugccuaagggauagccauaaucccaggcaaggaagaaggugcucuuuagaaaaacccuaaccaacuuggggcugaaaguggcuaacagaaccuucuaucacccagaugagauuauggugggaacucagaaacaaagaaaggaucaaaccuaaacccucaucacaaauuccaaccucugacaacacacauaagccagcuucccaugaaaagucugauuuugggagacaugaagugggcauuauuauaguucaugcucacauucaacucaggugugcagaaacaucuuaagccugacccaugaaaaugaauagggaaggcaggaaucucagcucugauggcuucugugccagcaaaggcuuuaacacagccucuuaguaaggagagaaaagacaaaacaaaaaaaccuuuuccuuccagugaccucagauaaauaacauuucaauaaacccacaaaacaaaaaaagccauaauuuacaguugugcucucuaaugccuauuugauccagcuuuggcugaccccaaaauaaacaaaacaaaacaaaaaggaauucuuggcagaaaucuagacauggucuuugcccagagagcuuggccacucaauucaccuucccucagcggcuagcagcaggcccccaaaccucaccgucugacaucaggcuaaacccaagucaacuuuccccuuaaagcaaguucacaaacagaaaccaugaccgcccccgcccccacuccaguuugcacuuaguuuuccagaauguuacuguugcauccugagagcagcagcagaacaggcaggagaccuugcaguggguuuccugagcccuacgcagugccugccacauugaagccucgcgugcacuuuuguuuagucaacaacugaggucgcacugaguuuucaaaaaguuauguuccacugagugacaaaugcacaggacugucccccaggacuuggagccuuuccauaccaacuacagcaagugcaggaugucuuuauccaagcuaguaguucagggagguagucaggaaucccagaguaagaugacugccuccggaagcuggaaguuacacucgccacauuaccaaccaucucauuuagagccuccugauaccuauuccugucacguagcuuucugguccagaacugguacccaggugugcaaggcccccgagguguuaauuugccagaaagaacaauuaacguaaucacugagucacgugcaugugcugagugccacucacuuguucaggaaugaccacaugccuccgguccagucgccuacaucgacuggcucaagugccuaccaugugcugauaguucauaaaaauagacagaccacuaacuuacugagaagacaaguuaauuguaccuuuggacuuuuucuuuugucauggcugcccugauaaggccuuggucugauacacuuuuuuauaauugcagagcacuguacaacucuccagggccugccauagacuucagcuuucagacaguccucauggcagggggaaaacauaacaugucauuauaaauacgccccuuuuaaacugacacugacugcauuaaaaccguagacucuuuaauacugaauguugaguaaugccacacacacacacacauacacaggcacuggugcacacaaauccugauuuauucccuuaugcaccacaggcauuauucuacuuaaacgcaaaaugacgacuccaaaaaaaguugagaauuuaauuagaaguauauguuagucucaguaacuuaaauacagaaaaagaguuaauacacccaagcauuuucuacacuuuuauucuguggugauuguuaaacaaacacagucaaaacaugagacuucucgccuccccucccaacggcuaucugacuccaugcaccccaauuacagcaguuguuggguuaggauguagcuucucaacaaaauacccauuaacccugaaucccuuucucaagaacacaccacaagugcaugugguucuucgaacugaccaccagggguugugugggagccuaaccaaccugcucccaccuccccuuagccuaacuagcacccaccaccuuacccggaauccuaacaaggucuagaaaaggacaucucaagaagucagcauuagaugaugaacuaaaagggccucuaaugagcacuuagaaauacgugcaugaccaucuccaacacgguggugcaagccucugugagaacugauccuuuuggccaaguacauuugcacucuccugccuacgcucucaucucaaaucaccuaugagucagauccuguugccaagcaggugaugaaucacuccucucuaauaagugaggagcuggagggagauacgcauuagcuguuucaggccacuugggugccuuucggcacaggcugcuucaggccagacaacuugcauaccaucucugccacacuaaugaauuuaauagguaucuagcagucaggggaguagguauggaaggugcucaagacgcauccccaauuagcaagccuuggucaaaaaccaccuacgggagugggagacccuggggaggacaguccacuccuaauuauuccugcagcaggaaaaaagguccagccggggacuccagagguaauggagagugggggaggcaccaagcagcaaacagcugaggggagugccagcagcugaggcuccaggcagccaacagccacuuaaucagcaacccaggagugugauaaacacgugugugucuauguaugcaguguacugagauugcuaagggcuccacagacauacccaaugcccugugcaccaggaaucacaccacacgcagacaucacccagagagggaugcgcgccacacacaaucguacucuguaugugcacaaccucugugaugacuuagcaccucacugccaagacugucuucuguaauagguguauauaaguccaugcacacacaugagcaccugcagccuguucuucuccacaacagagcugggaaugccccuguggauuagccuagaagcaaagaugagccaaugggaggcagugcuuggcucucucuaacgagcccuucaucagcaccuaggaaaugucuccccagguuaaacaaggaauauuccugccgcugccccaucccccauaacucagauacaucccaguucucaaaaccaggcucuaaacugcugaguuaagcccuuggucauguuccuggugcuccauucccuccagcucuauaaggacaagggaauaggggaugaagauacaccccaucugaucuuggagaacaguaaagauuaacaggagaaauaaucacaaagcaacucccacacuggcagucuugcacaaugcagugaguuuaccagcccauaaauauguuuaaccaacaugaccucaugcuguaguguguacaaggaucugagaguaaugacuggcuaucaucucuaggcaagugcccgccucuuuacaucuucuucucuaagucauuauaaggugucggugucaaucauuacccucuccagguccugccgcaggugcgugaacagcugcagccuccuaaacaagacauccugcucccgcuuggcuagauuguccucuucgucuuucuuuggggugaugaggggcuuguugaaguugaucuuccucuucaacuuccaguacugguacaggaaauccaccacuuccucaggcagccgcagcgcccuggccacauccagcagguugacaaagguguagaacucauccuccagcugcuguagcuucugcuugcgaacacucacccggugggccuccucucgauucggcuccagacuaccauagggcuccagagggcucuggggagaacucucaggggccccauucuccugggcugcuccuucacccaggcccuccucggguuuccugugugagcugugcuuugggcaguaggacuugaauuugacuucaucauucucugccaauauggucuucaucuccaggccacggucaaaagcacaagucacguggaaggcuguccggcaguucuucacagagcacugcaaacaacacagggagacaguuacagagcgguggcaacaagagcccccacugcuggccaccccauaugaugacaaagaaacacucaaugagacagaaaagcuuuacaaagaugaacagguuugaaggaacgucagggcacaauguaggguaaagcuuucagagagcaaacuauaacuugcuugaaacaaucacagcacugaaaucucagagcaggggagggggagggcuguacaacuggcuccuguuggggaggguggcacaauccccaagcgaaugcacucuauguacagcgcauacucugaggccuuaauuuaguucuccacgacuugaacgcaguuuuauaaaaacugugaauagcaauguccucagugcacacauuccugaucaguuuuaaaagacugugaauccucagugcaacccccagcgggaaaaggucccaacucaggaagguaaacacaagcagcauggaaguagcaucuagggaucacgccagaggaaaagaaggagagacaagagcccaguucaggaaggauggagaaaggucucccugcugcagacgcucccuuccuuuaggccccaaggaagucagcacagaggccaggccucaucaagaugcacugaacacccugcucacuccccgccugcacagggcuacaauuuagugccuuugauccagauacaagccucuggccagcaggagcaaagugauuaacuucucgugucugaucucacugagcaaaucccuagaaagagguaccucuuggaggcugaagccagucccuuaaaagcaacuguauugugugaggccaagggaucccuggggcaugccaggcugcacagacaaccaaggagcuugugcuccaggccagcugaaaagcuuaauuaaacucauucaacagacccugccaucacauaccacagaguagagacuggaguuggguuucccccucaucacuucagcguuuaagaugcacuucagugccagccacaaucuaauccuuuacuguacaaccgcagccccuucaccaccgccaauuccaaucaccgaaagccuaugcaccaugcuuaaucuguaccuuuauaaauaaccucaauuacaagaagccugugaaagcaaucagcucugguggcagaacacacgcagacacaccuggccacucucaugaagacacacuguuucuccacacagcaggaagccgagcgggaaguagagcgggagcaggugacugaggugcagucugcgucugccuuaaacuacacuuaacccaggccuucgaaccuuaaagagaaaugagcugcagcagaguacuuauacgggacuuugaaaagaugccaaacggccuuccucuggguguuccuauucggguugacucagcaaacagauguuacagaaacaaacuagucuucccagcugcagacauuucugagaggaguucucuuuaauaaaaaucaaucuauuuauuuuguuaagauaugaaacgucaucugccuuccuuggccccuucuucaaauuaaugcucuggggacagagaucaguggcaacauaaauguccuuaagagugucucuccuugaaaaauagacagggcucgaguuugccucccacgaaacaucagcuaaggagcaggguugaugugcucagagcagcuaacccaggcacaggaacugccauccucccacacacgccagacacgcaaguccuuuuugaccucuccucgauuccuucugcccaaauucauuuuaguuuucaacagauucuacuaacaacaacaacaacaaaaaucauaucuuuaagauccccaaagccaaaucucagcugcccagugccugcccugguauuuuuuacuaaugccugaacagcaguagaaaccauaacagugaaaagucaaaccacucaaggcuuguuaagaaagugaaaagagcccaccuuuaaucccagcacuggugaggcagaggcgagccgaccucuugaguucaaggccagccuggucuacaaaaugaguuuaaagacagccagaguuacagagaaacccugucgugaaaaaccaaaauaaagaggaaaaaaagggggaggggggaggggaggggaggggauauaauaccagucagugguuugggcaccuuacucaaagaaucauugcucaaccaaaauauagcauauuccaccaaaugaagaaacuguuuuaaagccagggccacacuugucaagucaugccuguaccuguuguauucucuauauugaaagaagcugcccaaacaguguuucuguccaccagauuucaacaacaaacaaacaaacaaaagcaaacagacaaaccaaaaacugaagaaucugaggccuacuugggucccugcuggaguccaaauuaaccuucaacacaguguucuaggccucaaaucauaaccgacuagauaucaaugaaugaaugaaccccagaaaucaauuacucaagaguuucagacaacacacagauaccauuuucccauuaacucugcauaccucgugacuuucuguacuuaccuguaccuggccauguaaaugcaaucaaucagccuuuuacaugcuggcugguucacuagggcagcagugugugugugcuccagacucccucccgguguaaaagcagaggccugcccaacaccuaccucagcuacaggcauccccagcagggagcccugaggacuucuggucugugagacuggucugugguaaugagacuacaguggaaggcuagacaacucaagugccacagucaagaguaucuaagccucgguucuuaccaggaaugucugcuuaugaaaagaagaggacucuacuaggcuuaggccagacaaacuggaacugccuccaaacccaggcagauuuccagauaaccuuccuccuccuaacccuccaaugaaugcuguguagagccuccucccccacccugcucccuagcacacagaggaggaaaacaaagcuacgcuuacugagccauuguuaccuguauggaggccccgaauuucucauugcagaggcugcacacaagcgcccaccggcugcugggaaugugagacacuuuugugaugggcuccaucuucucagggcugccaaugcuuaccuaaagauccaaaauagccagaugggcaugacacggauaaucagagucguaacacagaccugagggcuagccccagggcccagcucuggacuagcagcagcagagcccagagaucagcccccauugauaccagcuugccagucuuuauagaccucucuacaaguuuucacuucuuucaaguaucugauagcaaaaacaucuaucuuaucguaacaaggcuaggggcuggagagauggcucagagguuaagagcacuggcuguucuuccagagguccugaguucaauucccaguaaccacaugauggcucacaaccaucuguaaugggaucugaugcccucuacuggugugucucaagacagcuacaguacaucauauauaucaaauaaauaaaaucuuuuuuaaaaaaagacuuuagauugacaagaauuuuuaaggacuaaaaacccauuguaaacauauuuaaauaauagaaugagcaaagagauaaacuauauuuaauaguauuacaucagaacacauaacuauauuaaaaguaaaaaucuagcaagauaaauauggaauaaugaacugcaaacugguuaauauuaaaccaaaagauccagugaaacucccauguaaaucauacccaggcaauuuuccucuggagggaaaaaaaaugcagcaaaucacacaccaaaaauacuggaauuuaaaugacaaaugauauucucaucacaagccaugcaaauuaaauuaguuaaggucugggacuggaaauaaauuagagcagaccugaaauuaacaagguggaagccgaggaagaauuuaaauaaagcucacagaagugugaccuagggcacugugguacugcacucggaguuuggcaaacacaaacuggcagggacaguagcauggcuacccucaggacagagccgugaaggugccaggccuggccugugagugcugucaucuacgugaggguuuccagaaauggaaaaguggggcuauuuguggacaccaggccacugcugccuccaggaagccccuccacagacccgcucugcucaggaucagcuuggggacagaggggacccagcagcucuacugcugccugugagucacucacucccaccuacccaaccccagcaggaaaccaggacugucucaauuaagaugcuaucagaaagcaggcuuaccucagggauccacagggcacagcugacguggacccacuugguuccgcugcgggucggcuucauagcuccgccuuucuugggacacagcaaacauuuuggcugaacucccagggcacauguacgacauagccaacugcccucuggcaccuugaggaucccauagcaagccuguaaggccacaacuuuguuauuuauguguaugggugucuugccucuauauaucacugugccacacacuguguaaugcccacagaggccaaaagagggugcuggauccccuagaacuggaguaauggccugcuguaagcagccaaugugggaucuaggaaucaagccuuuguucucuugaagggcggucagcaagucuuacgaggcaucgcccagccccuauuugugaacugaaaaacaaucuagaaggauuuucacagagccacaccaaaguagacaugcccauauccaccuaacugugauccugacccucgaggaaauaugccagcccaccuccaagcacccaugugccugagcuccaaagacacgccacaugugucuucagcacaggaagucccaagaacuugacaagagggauccuaaaauaacgaguguugcuguggugcggaagagacccagccauaagacaguuccaaccacugagcagccaaugcuccaaccuggcugcaggcuucaagaggguacaacagaccucucucugcuuucaugaugggcgugacacggaacgaaggcaaaacaaagcaccaaagccaaggugauaguggcugggcaaccauucgcugcucaagcuggacacacuccuccuacuggaguccaacagaguucaugcgaacagacagccgcagaagagcgagacauuucaaaaugagaguuugguuucuuucgcugauguuuaaaaacaaagccuguuuugcacaaguuggcaaaauuacacaagacaacccaaacugcagaaauuaaggcuuuuacaacugaaaucauuaugcugguuuaaagaaagaaaaagcaaauguuucaauaaggggaguaaauaaacaaacccaugguaguaccgggagugugcucagacagcccuuuaaaacccagacaguucacaacguuauccuuaaaugaacugcaagucggaagucacaggaaccuggcucuauuucuccaggcagaaacagcacagccaccaugaaauccgaacgcccaggacacaagaaggaaaacacaaggaugagagcggagcucagcaaagaaacaguaacaccgcaguccugagagcuccgcgcggccacgaaugagcaguggucaacaagucuaccagcaaagcaguguucuuacagaucucaacaguaguaggagggcuucaaacgccauggcguucuagagcucccuuugaagcgaggaucucguuuacuggaaaggcacaucuacacuaaucaaguaugccuuaaagacaagccaugaagaaucucacggaaaguaaaauaaagugagcgugaagugucgagagcagaagaagcggaagucaucagggccaacucugccacccacaugcuaagguguuggcacacagcccugauggcagcuuacagacuucugaagcacagagcacaacuggauuucaagcagaaaucucguaacagcaaaugucagaagacuucagggucacuaggucaaugagaggcagcagcaacaguggcagucguguggccucccaucacacacaccuccacagggacuccagggcaagacgcccucuggaccacaaagcccagauacaaaacagguccgucucaggguucccugugaagaugagcugagacggggccaccgcuggugaagccauggaguuuucuaaagcccuagaggugaauuauagagaaagggguaacccagaucucugaguguggcagugaguaugugugaucucagcacucagcggcagaggcaggaggauuaucucaguuggaggcuauccuggccuauacacugagauacaggcagccagggcuauuuuaaagaacaauaauaaaacacagagcucaggucacacaagcaacuuuccacuuucuccgagagucacugauggccucacagaaaaguacgucaggacaguuuucuaaaucacaaaacugccugguacacauguccccacgcaaauccacaucacuugaccaccacauucaaagucaaauacagaacucgacagacagacagcugugugguuaaaggcacuugcugcccuucaaggaccccaguguggcucacagcaccuauaucagauaucucacaaccuauaugcccagcugaggggauccaacuuucacuuccuccagcauucacacagacagacagauagacagacacacacaccaccacaaaguaauaauaaaucuguuaaguuacaugagggguaaaaggccccuguaucuaugcuuaagcuuucuaaauuaccuucacuaaaagacaacagcaagcccccaccaaggugggucuacugccaccuugaaauaaugcucacgaaaagggagucagagacggcucagcaguuaagagcacugacuacucagaguucccagcacaggcagugucuuacagccaucgcagagcuccaauuccagcggagaccccugacgugcucuucugaccucugggcaccagucguucuagguggugcacagacauacacaugcacaauauucauacacagaacuaaccaaaaucuaagacgaaaagucaaaggggugccugacccccuuccacagcuaagcugauacguaaacacaugaacgcuaugguuuauccuguaucccccagaagauacuuuaggaccgcaccaccaccugaaaacgggaccuuuagaaacaguugugacacacaacuauguaaacugagaccacacugugcaggcaggcaccuaauccaacaggaccaggacugugugagaagauaacccuaucuagacagacacacagggaagacaucgugaagacuaaugggcaagccaaccaccaaggacugacaagaauccaccaugagcuaggaagagacaaggaagaacaaaacuccaguuccagagacagcuucuguuguuuuagucaccgcaguuaaaagcuaacguagaguuuaagcacccuuugcucggguuuguuuccaguguucccaguugaaucgcagugccuucguggaguaaaggcagagagccaugcccugggauuacagucagguaagacuuuccuaaagcacaacugugggaugcggcuccauuaggaagaaccacccuagacuccaggcaguacaggcuggcugagaggcucagcaccagaacggcacccagcucucucugggcucugcugccccacucaccuggugcacacagauguuacacuugucacagaacaccaucucguugccguccucgccaucaggugacuggcagacaucgcagacaacgucuucgucguauucaauccccaagcccucuucugucucuauggcaugauucauauugucauagcaucgcuguucgaauuccuccaagacccuuuccaugguguacucguccagcuccggcaucccugcaggaaaacaccgcagaucuccccugaguaagugcgcagugagaauuauagcgaagacacuggcguguuuaaacucccaaauaaacauaaauaaagguaacugagcaccagagaaaaugcuacucugugacucugaggccaguccacagauaacgccuccauuccuuauggaagacacaacagagagaagcaaaacucaaaacaacuuccgcagcauccuaggauauuaaaugcaugcccuguuaaacgccccuucacacucuugccgacacugaucugacucagagaacaggacuacauauuaugcugcuuggguuuugcuguuuggguuuuguuuugguuuuaacuuuucuuucuugcuacuuuaaacaguucccugaagcagauuucacagcaaacauccuaacguuuuuaacugacuuaucccuccccacuuugaauucaccaaacugaaaugcauaaauuuagauccacgagcggcaaacacaaggaaaugucuggagcaaagaagucagcucacuaggaguuaaauaaaauacaacacacuuccuucuaccagcaaaugccuugagggagcaagggggauggugaugauggcucaguggccaagagcagguacagcaaaggaccugagcuggauucccagccccugucaggaugcuuacagcugccugucugugacuccagaucccagaggucugaagacucucuucugaccuccccaugcaccugcacacacccagacacacauauguaauuaauauaaagccuuuaaaaacgaaaaaaauaaagacaaagugguuacuguggccucagaaauggugagaaagcgcuauuuucuucuauuugcagauguccucccaacugccuauaaggagagcccuuguacagacaggaguccuaaagaaagucagcguccggcacagugcucaugccugcaauacaugaagucuauaaugguaaugaguuucaggccaguacaagcuauacuaggaccuggaaggggggugcgaaagggggaaaaagagaagaaauauaauucaggccuauagcuuacacacguuauugcaaagccaccacauuuucaaguuuuaagauuuuggaggugagcuggaaaggugccuccgcaguuaagaacacuugcugcucuuucagagaaccagacuucaguucauagcacuaauguagggcagcucacaaccuccuguagcuucaacuccaggggagccagcacccucuucugaacgccagcugcccugcgcucacagcugcccugcgcucaugcccugcacucacagcugcccugcacucacagcugcccugcacucacagcuguccugcacucacagcuguccugcacucacagcuguccugcacucacagcuguccugcacucacagcugcucugaacucacagcugcucugaacucacagcugcccugcacucacagcuguccugcacucacagcugcccugcacucacagcugugaacacaugaguucuuaguauuuaaaccacugaauugccaaucuuucggcuggauccugaacuggacaccuacaacuugccaaaugagucaguuuucugggugguuuuauacaggcgguguaaagcauuuggccagcucaaaagacaaaacugaaucuucuacaguggcauaauacaucauuuaguuacaggagaguuccuuuuaaacagauucuaaaaccaucccuggcuugcuacuguucugaccaguaauacuuaaagcagggaacaagagcaagaaaaucuacuuuguugacacaucucaguaacuaaccaguagaaaauaccaacguucccagcucagucauggucagucccaucaacuggcuggcagcaggaaaagcugcuaucagaguccaggcugagacaggcuccaugggaacacaacuuuaaacagcccuugcccuuccaaccuuugaagccaaacacacgugacuugucacaaugugcccaagucacacuucccaacccugcuuccaccacacaaaugucuuaaacuugaguucacggacacuccagacaaacuuuuauaacaacccuggggaagaaaggcuagaacauaaggagaccaccucagccuccacaccaugaaaugcggguaacugaggucuuaagguccaacccagcagagaaacuauccaagucugggcucucagccagggucacaccucacucagaaagccaggaaagaguuaaagagguaaaaacaagaggguuugaagcugacuuuguaggcuccgucugagaaacagcaggcugcaggcaguaaaaaugggacuuuggcaucacagcaguaaagaggagcagggcacuggcccaguccuccugcucccugggcugcaguuccuguaugguaaguaaggguagaagcagacggggacaggaauucaagucagaaacaagucaggcuuccgccccgcaguccaccacugcgcuaggagcuccaaguggacuguaugucucauugcaagugccaaagccacacaagcaaucuggucuccaaagagcugggacucuggugacauagguggcugugacagugagcuccaaccucucagggacucuauaugagucacugcggacuaaccagcccucucuccaaugugaguuaaugaaguaacagucucacccaucuccuuaaauucuucauugguuacuuccagccacgcagcauccauaucauugaggucauaccgacacacacugucugccagaguccggauaucgacguagccuaacgcugggggcucagagccggacgacgcgauguacuucuugggccugaugaacaugagagacuucucuucagacacaacccugguuaauaagaaaacaaacagccagauuacccuuucuguccuguagaagaaacugucaggggcaacuuccuccuccaacccccaagccagaccaucccuauguucauauagucuaagaauuugaaaccaaaugagagcaacaccucagcuagaaaucuucaaaguacccagaauggaagcagaugcugcagccuuccacagccaucuccuucccagcacaacacccuaccacaucuccaacagagucugcucccaaacuacaacaaauaaacuuaagccggccaccgguggugcaugccuuuaaucccgcacuugggaggcggaggcaggcagauuucugaguucgaggccagccuggucuacagagugaguuccaggacagccagggcgauacagagaagcccugugucaaaaaacaaaauaaauaaauaaauaaauuuauuuuaaaagaaaagauauuucaaggguugguuucuaaaucccuuuccauuauuggugcuugcucauugccccccggaaguugucagaacagggacgaacuugcuaagcacugaguucucaggaacagagacggcagggacagccacaagcuggaugugcacagcacacgcugaggaccacaagggacaccucugaauucucaccuuccaaaaagacugagggagaacuuugggcuguugccauuccuuuauucuaagcgccagagcccaugguccaugaacauauggccccagacaauuccucuaccaccacccccuuacaagcugugagcacgggagaauuccaccucacccuagccagacuagggacagcacaaaaggagcaaaucagcucgggccaggagcccagcagaggcucuguggucacaguccugccacgucugguuuugaccacauacauucacaccaacaggaugcccagaguuuauacguuauucacccuggaacugacaggaagaacuuaucugugugacagagaugggcagacaaacuggauguauuucuccugcuugagcaagaacagguaucaagugaaacgcuccagucuaucuauuaugaagucauuucauccugccuuggcacggcuuccuagacugacagccugccggugcuggccaaaagggaccauccccauccugugcgcccugagacccgcuucacaggccaugacccucaucugaagaagcaggugacuccugguggucaccuaugccugucuagccauaguauacuaucauauaauuugaacagagaucccaaaaugaugguaaucaaaccaaucaagugucuaaggaguuaagggccaagaagugaauuuaguccauacucauccaugguaagagaggcuauuucacacagcaaggagccagccagaugcuggcagagcuaucgggcacuccauccucauaugcaaaaguggggaaaaaagguaccaacucgacacagccugucccaaaggaagaucgaggacauguugggagaggugagcgacacggcaggagaucaagaggaaacaccagcgucugcaaagagccuguccacagcucaaauuccucaucggacacugucagcuccuaaaauacaaucagccacugcccgaagcaccaaggccaccacggcucccacuaagccacucagugaagugacauagaaugcagagagaaacagacaguaacaucagacuucgccuagucggucauucccaaaaacaucuuggaccuucucuucuccaguaagagggcucacccccugcgauaaugugcuaaauucagaggccacugcccucugacucaccgcccucagcgccugaacaguuucuacauuucugccucuugugaggccucauguuacuacagcgcuaacucucagcuucuaugccugcagggaggagagcagagaagcacgcgucuauccagggugccuaccuggccacaggcugugggauggucccugggcucacaggcaccuggaccccuuucucccacuccugucuccagggaucagccagcacguaguagucauccggguucagcugguaggagucaugcaacuucauggcagugaucaggucgguccuaaacaccuggggagacgagaaagggacaguggcacaggcauucauuucagagcacuggcagcugcaagggcaccauggagcugcccauaacaaggucacgguaucaacagaguaagagugcccuguuacagaaacccuucacuccacccgacacuccuuccccucgcccaggacugaagugggcuccagcuccuucagccgacacaagcagagggugcagugauuguaucgacucaacauaacuguugcacaaaacacaaccgcuccccucuccaagaccucucaauucaccaagggcugcugaacacaggcucuuggaaauccuucagggaaugacaagccacuacggagagcucucuuucgagcccauguuuuaaaacaaaacuucauuagccaauuaaccucaaggcagaaucuagaaccacccgguagaggucacuaucuucuaaacuaacugcuaaagaagcggccaaucuccugaagugcuagcacauggggcaggcggguggugagagcaagguccacuuuggcugacagcaggcagaaaugcaggccugcaaacaucuaggaguggaacacuagagcccuguugucccacgucacaggaugccgucagcccuggaagcaaguuucuguggaaagacagaaccaacccuguuuucacugccaucaagacucagcuugugcccaccuucuaagaaagcacccuaacucaucacagacagcaaagauaagcaaacuguggggaggcagcaccccugacucaugggcccuugccauccgaaucgacgaggcugacugaccguacagcacccugucuggcagccagggccacacagcugcuucccucuccggccuuguccucagcccacugccaugugaggauguguguaccaggaagcccugccauguaucacgagcagcaugcgccuggauccagaugcucugcucaguguacagagccacagagaugcaaugcacucccucacucgggacaggaagcgcuuucuugugcugcuaagcacgggucacaguauacaccuguuggcuuuucagacugguguucucuuuaauaaacuucaucuuaugaaaguacgggguagggucugaauuaaaaggccgcuucucucgcugucauugucaauacuggucuugugccaggaugccacucuuaacaucuacagucccauuaagcaacagacugacugugucccuucugcaaagaucucaccaugagacaaaagccccugaucauaagccuacagcaacccaaccccaaggaaaagggcuuugaggucaaaguugugaguccacaccaagcaaaucagguaaaagagagcccagcuaagcuguacaagaaaacacgcaaauuugccaaagaaaggaaggcagacugaggaaggagaugagaaaaggcagcuccauuccuacagaccugggagaggcucuggcccaaagcucagugccaaguagacaccaagggcaggggugacggcuacccgagugcuuuacguacaaagcacuuugcacucagaagauuugacacagaccaggcaaggacaggguguggugccugcugcucagagggcuccaaucccacucccaggcugaaguaacagcaguauaguauggacaccagaaagguguaguagcaguuaagagcugacucaggacuuaacagcagaguaaaauacaggugcagagacguuccgaugucacaaaaaaauaaagugcgcacuguaggucaaaacagacaccaggccagcagcacuggccacagcagccguccgugaguguuugcuggaacaggucucuuaagugcuuucuggcaggggauguuacuccaucuccaggaaacuccuccgcuccuagacaaggcacucuccagcuauaugggggcagcaugggaagggacucugagaaacaccugucgcugugugaccaccacaccacaagccaacugagcucaucccacaaacagugcaaugccagaacaacuuucccacagcuuucccugagaacccgacaggcugagacaccugggucucaaugcccggcgccucggaauggccgcagagaaagcaggucucaggacaacggggccccuaagcaaccgaggcuggcgggagacagaugccucuaaaaaugauuuuagcagggaaaugaacaacgaaacguagggcaucagggaaacauaaaaugugaaaacaaauugggaaagacggggaaagccuuaagcauaacgaaacucccagagucacauuggcuuguugccaaauaagccacagauccauggcuaaaacuaacuugaggcuggcagugacuuggcagcagcugaacccgcucauguccuggccagaggaaaacuuguugggagccagcgaagacggaacaggaaaggaaaaaaagaauacaauuaauaauaauagcuaacauucacugcgcaugauauacguguaacaugcuuugcguguucgagccuauauguauuaauuagcucacuucuuccugcaacaaggcacacaucugcuucucaccaucuugccgggguauaaaguggggcacuugcccagaccugcacagcauggggcaggcaugugggcggcagguucgcaugcacuuacuuacagcacacaugaucaaggcaagcaagcauucagaaguaccucagaaggcuuucgaucuucaggucuagagcagguacuacuccucccaugcugggaucgagaaugcugggaccaugucguugacaagccugaggaaacaaacauccaaacaggaaccauuaaaaaaaaauacaggcucaguauuugagcggcgauauggcgcuaguugcacaaaccugaggaccagaguucagguccccagcauccaaguaaagaguuggcauggugaugauaggacucugaacgucagagguuuagugaaaggccuugucucagaaagucaggcggaagagacaaaggagaaggcagucuauccgaccuuuggucuccacaccuaucuacacauccucacagagcacaaaacaaacaagcaaaaaagcacaggucacugagcugucaagaggucuuuccccuacaagaaaccuucagcgaaggaggagaaccugcagugccaucacccuggcuggcucugacaggguuccuuccuuccagucauuuucuaaggugaucacugucggcuccaguguacagggugcucugccuugugaacagcgagccaagagagccugcagcauaauccaggcuccgagcugugcucaagacgcucacagacccacacugguacaugaacuagaaaucaugccggaaguuuucagccaggaucaccgggcucaaccuaagguccugcccaaaacacuugccuccacgaggcacagaaaaaucagaaaccuccacacagcuuuaacaucaccuacuacacugcucuuccgaggugccccaaucccuccuguagcugaucaccaggaaaccccaaauccuaaguguuuccaggccugaaacuuuccuguagcacugagcuccccugccugagaugcccccuucaagccacacugccuugcucccuggggcccuaauucucacggucucuccauuuccaagcaguuccgaaguagccgagucucuaaccagaacccaggggagccuaagagaguugcacucuuagacuaggcgcucucagcucgcugcagagccaguaucaccuuggugguagacaucaacuucccagucauucuaaaaucugucagcucugagcaaaaaucccaagcuccgugcucugcaugaacaugcucacuuucaccucuuccggcccccaagaugaaucccacggccuuuucuaccagaggccagaaacccacaagucagucagacucuccuccuuccuccucagaaggcagccagucaacagccaaguccuaggccaaccuuccaaugccucaaaacccuagcuccuccuccugccuauccggcccugcugccgccccuucucauguguguggccagcuacaguggccucucugcaggcacacaacugcagccggaugggaacagcauucccaaccaccuucauuucuccccuaacuuacagauaacucaugucaccuccugucugucacuacagcacccgggcacugaacccugucacuucucagaaacugacaaaaccccaagauguuaaaaagcaaaagccuaagagagccaccaauuugacagugaagcccccugucacucaagcccuuccuggcccagaaucagcagacagacacaucaacaaacugaagacacagcuccugcacauaugccucucauccaauucuuagccacagccacagggacugugagagggcugagaaggaaggaaggucucugagcuacccuucaauaccaguacuagaucaucuggcgccaucacuccuguggaaugaaacuccacccuuauaggugauucguaccauucugugaccacaccagaagauccucuggauucagcaggaaguggggcuagggugcagccuagugcacagagccugcccagcagucuccagacccgagguuccagugccaacuccaagcaauaauaguccuuggacucaaaaugcaugggaaaugccacacacucucgaaaccaugugagcacacugcgaaugagacuggucgucccugagaaggaagugugggugaaguccacagaggacucugugucagccagaggcuucuuacaccuucccucccacaacccggauauggagauagaaaaugggcauaaaaacaagacauuuacugacuauaagccaaagagaaggaggccaugaaugugaaaggcagcagggagcaugggcacaguacaaaaguuuggaggaagaaaacagaaagggaaagugaugguauaaaauauaagaauccuaaaaauuaaaaauaauaaaccaaggaacagccuaaaacuucaccaccagacuguaaaggauaaauaaaccaugacacaucccuucagugaaacacuagccagcaauaaaaaggaacacauuauaaacagaugggugugaagcacgugcuucguguaacauagacaaauacugaaauaaauacacucagugaaugaauccaaggagccagaguaggcaaagguacacuacacugaugcaaaguucagggaaaugaagacucaucuaucccgacagcagcucaguggcugccuggggcaaaguuggauggacauguuauuuugauuuugaugacauaauacaugcaaacacagcuaaaccucucaaagcauacacuuaaacaugugcagcuugcuguacauaaauuauccauuacgaagccaugagaaagcuaucgccacuaagaagcaccguucacaguaugaaaaccuccagcccccuuccacuggugagacacagaaauccuaggcuggaugggaccccaaugaacgagcagaacaggaagucaugagaccucccugcaacagggagucacuacuucacagagaacaugcagauaugacguucagaauucagaggaguucaaaccagucugcacacacacagaaaauucucaguaaguagaauuuugaauagcagaugauuuuucuccuuaaaaaugucauggggggggggggggcacuggguacugcuguaagggaaaccaucacagcacgccuagagcugaagacggugggcacaggaauacacuccuaguuuaccuuguacaaagauguuucugagcucccaaaaaaugaggcaccauucaguaucaguguggggccacugcucucuuguggaaugcuugccuguccaugacacauucugaaagucaaaagaucucaggccaccguguggaugguaucacagcagcgcccuucccaaagccauccucuccaggcugggaggggaucaucaggaugcuccaaugauacucccaacugagugugcagaugugccucugcuacccuggcaacaagggagacuaaaggaggaggauacgaagcuggaggccagagugggugauguagcgagauccagccucaaaaaaaccuaguagcaggaauaguaauuacuuacauuccucauuaauuaaauuauagcauaaaauacuuuuuuagcaagaggagugucaaaugggaagugagcggucucaaugucuaaguaacucaugcuauagcaaagaccagcaucugccaaaaauuguauggugacaacguggagccaguauuccucuuugugacaucugagggcaaacgguaccaucaggaaccacacccaucaucacagcacuuggggguggagucaagagagucaggaguucaagaucacccaccacuagacauaauuugggaacccugucucaaaauaaagauacaggaaguacacuaacuuuuguucccaccucuugcauucagcagaggaguggcgaucuuggcaauaaugucuaaaacaauggccauucacaaguaagaauguuaccuaaagcuaaguccuuucuacugacaaauuugacuuaaaaugucuuauguauacaguacucaaguaagaauaguuuuguugggcuaacaagaugacucagcagguaagagcacugacugcucugccuaagguccugaguucaaaucucagcaaccacaugauggcucacaaccacccauaaugagaucugacgcccucuucuggugcgucugaagucagcuacaguguacuuauguaaaauaauaaauaaaucuuugggcuggagcaagcagggacugagugagcaggguugacuggaguagagguucuaaaaauuucgauucccaacaaccacaugaaggcucacaaccaucuguaaagcuucaguguacucacauacauaaaauaaauaaauaggucuuugaaaauaaaagaauaguuuuguuaaacuaucucaaacacugaaaagaaugaaggaaaaagaggugguggugguggugguggugguggugguuguuguuguuguuuuacuuccaugaggacagauacaacagcaggcagcgggucccggcuaugcaagcacuaagccucucccagccaccccagaggugacucuccaugucugagacaugcuucugcucuuagaacuaaaaaaucuuacuauguaacacaaggccagcagugcugagugccauggaccagugucacaacaucaggaugcacacguaacacauugcccugggcaaauaaaguaauaccacauaaauccccaacugggauuacacagacagcacaugacaacccgguguguacccugggaaggagccuccaucugccucagcucuugcagccuugcucggccagccucuaugguccaacucacuccaccuucugaaaagcauaugguuugacaguauuccuuaaauacuauuuaguuuuucucacuuuuauagggaaaguauguaaggauauagaucagagcuauaauuagccucagacaaccaauaauauuccugcccuaaaagggauguuuuaucccaauaagucucugcagagaaaaugaaaccuuuggaaauaaugaaacuaacugguggacccucuucucacauuuugcuggguggaaaaaagugggacuuaagggccuaccuucacacccaggcauagggucuaacuucagagucgggcuaggcuacccaguccccagagccuagcaauuccagacacugccuaaaaacucccuaucaguauuucgcccaacugcagggaugggccuccagggcagcuggagaaagaccaacaacagugccgucagcagaugagggcuggcaccuggcacagaaaaggcccauccauccccaacuguaaauaccacacuguuguuccccugggccaggccagaaaacaaagcaaugggcuacagacucagaagccagaagcagcaggccccagcuauuccuguagcuggugcgguggccccaugcugacgucugcagcugccucucuuccaccuggacaugcugccaaaaucccaucaggccuguaagcuggagaggcugagagguggccacugcacagcccuagccccuguuguaagcaagacucaggacauggaaagcuaucacagguggcccucgcugcaugggcgaaaagaugccacuccacccacaaaccgaaauaauacagggaggggucccaaugcaguuacaaugaacuagcugcuaggggagaaggcgagaagaguccucagcgcgcagccugcagacacaacguccgaggccuggcauucagucacagcuaccugcucuucaccaccaacauucaccauaauuaucaagucaauaagccugaccagucagacaucaaacaggaccauccaccauauguucuauacugaaccgacugcauggcaaaacuacagaugaccgucuggcaacugucacucuuauccccccgcaacuaccaucagagcgcagccaagcgcuaucugugcaugguggcgcuccagccuaaccuuccagaugaacagacugaacugaguaggaaaaaaauggccccucacaguaaagguuauucuggauggagacugugugugugugugugugugugugugugugugugugugugugugcgcgugcgcgugugugcgcgugugugcgcgugcgcgcguguguacaagcacauguguggaggucagagggcagacaacuugcaggaaugggguccaucggggucugagugauaggacucggguugccagcuuuggcaacaagagccucaauacacucugccagcucuggacacacuugcugugggcacuuucugaauuuaaaaguccaacuuuaaaaaaaaaaaaagggcaggaaaaauugcauacagaaguaaacaggggcgauugaggacacuuugacagacaggugucaccaacagucaaagagaaaauagcaagcucuugccagagaaguaaaaagcgggagccucacacccaacuuggugucccaagcucccgcugucugcagcucagcguucuggcaaccucagauuuucacaauguagcugagaaccaggaguucguuggcuuccaggcagucaaaauaaauguauauacugccugcauguauacugggagccucaacagccucccaggaaguaagaaagaacucugcuuuggagagaacuuccuccuccuacuucccgcuucccgcuuccucccucacagcucccuugccugguccagaugucaacucuccaguuucucaaacaucuaucagaucuggccuuggcuuccccuccucccacacaccaccaucacccucccccugccccaccccuuuguuccccucccaucauucucguuccauacccacugcuccuugccuucaacagcaacggccacaguucagccagacagcccaaauccacaccacaguuucaaauuuguggaccuuccaccuucugcguggcuggccucgaagcccccacggcagcauauccaugcuuguguugacuaccugagaugccaggcguucaaacaacccugccuacccaaagcuuuuuaucccugggacccacccaaaaagcugccuccucccuaggccuucccaaaccgccucuuuugaguugcuaaguugcuaccuaucauuucuaaagcacauagaaagagcuguauaacugcccugguaacaucacaucagggcagauccuaaugucugaggcaacgugccuagaaagcaggccaggucgcuuucccaccucacaguacagcaagcuuccuuuccaggcuuccagaguuuaaugugcaaugucaaaccuaagcuaacaggcugcaguugcaggcacugagcuagguaccgucugaagggagcgccucucucaacagucuguuagcuccucaacagacacugugugacauuuauuuugacugccuggaagccaacgaacuccugguucucagcuacacugaaaaucugagguugccagaaagcugagcugcagacaguggcgguaucacuccauccugugacagcaggaaagguuagggacucaugugccuggacuugguacccucacgucacgcugggcagcccuucauucugcccucggagccccggcaggcucagccaguuaaucauuaccuggcuuugauuaagucuccucuucauagagagcaaugcgagguaccauaaaugcuguuuaaugaaaacagacacaccaguggcucuuggaacuaaauucuucucccuggauaacacacaggaagccugcagaaggccugccugcagucaaccuuaccgggaaagaucugcuuccagcccugcaguagcacacucagaugucuuucuccaggccuugccuuucucugaccugccugauaugcaaagggccucgacuauuuagagcauuauacuauaaaaucauguuuucacacugacccaagccccgguaggcuccaagaacaacaaagcaggacuuacugccauugucgucagaauccucacugcugcugggaaggcgaccucguuucaugaucuccccgggagacagcaggcagccugcaaagcaaugagacagcacuuaacccaagaugggaacacgcgaucaucaacuugugcuucagauggcagccaggaugcugcaaacaaaagcaaacacgggccucaaguagcauuugaauugcaaacagugaaaagaccaaaggcacauaauuagcugaaaucauuaacagagcagguuaagaguggggggggggugagugguaaagucacaugugggcaggucucccaggugccacccuucccuccaguucccagacaccacuacaacuacuccaggagucucgucagccccggcagccagcacuacagaaaacaauccuccagcagugagcucccucagacagauccaugcucugugcuuguuggggggcagggauggggcugugccuacugcuguguuuacaaugcugcacuggcaugaucaggcuuccuuggcaaggccugcuaaaaugagccccaaauuuugccaaaaugagcuaugcaacaagcugcagcucuagaaugaaccaguggggugaugggaagacacccaucuucaucugccuuccccaaccccucagaggaaccacaggcuucaggaaccccgauccggaccccuuccuuugcuccuuacagcaacccauccaaggucguacuagucggggaaaccccacuccuuauuacccaaauccuuucaggacaaguaugaacuaauuaauaaucagugguacaacagccuagccuaccuggccaguccuucagcucaccucaguucagaaaaccacugccuucaugaaacagaacagugggccaagacuacacagacaguuacagaagaacuuggacagaacuauaucaacaguguuccaacaagucacaaaagcuucucuacacuaaaauuauugauugccuugacgucugugggaccacaaccuuccugccaggucaaugacucccaaagaaaagggagagcuuuucagggcaggagaauggcagcgcuucaccgccccauccaaccaaggcuccuugcugggaaucaccacaaacguaaugaggucuguuuugcacagaggggcaguguggagagccacugcaguaaagcaagggaguaauuaaaaccccaaaguuccacuccggacagaccugcaaaagggaagucaaaagaggcagaaaacaccagaccauagaggaacaaaacaugccacuugggccuaaagguuauuuugaguugccuucuuccugccugaucauaaguuuaccuuuuguaaaggaaauuuccacuuaggugccccacaaaaacagcucuuauucauccccaauccucaauuaccauuaaucucauacauacuucaagguccucuucccucaaaccuaaccccuccucuugucgagguccucucacaauguacugcccuuuuuaaagagcagcacgaggggcuagagagaagcgcugugguaagguagcucuugcacagcaccagagcucagcuaccugaacccacugcgcgcccccccccgcaccccccacuauguucuguaacucuguccagccucugugguacugacauucccgugcucauaccaacccagacacauaauuaaaaauagaccuuucaaaaauacaacaguuuacuaacuccauaucuaaugcugcuggggugcuucucacucuuuuaaugugacacaaaccacacacacacacacacacacacacacacacacacacacugauguuuauauaccucuguuccugaaucguugacaacggauaguaaguuuccccuuuuggaacagacccacaggauucauucaggaauucaggcuccuggacuuuaagugcaauauuuuauauguuccuccagagaaacucacucaauuaaaaaguuugugggcuuuuuuguuuaccaacugauuuucuaagaucacuggaaggagacugacuguagagaugguuugguugguaaagugcuuguaaccucgugugaggaccugauguccacacccacagcccacauaaaaaggcaggguucccagaaagcagguagaggcagaaggacccauaggacucccuggaagguagaccagacuaaccuaaccaguaaggcccagaccagucagugagagacccugucuccuaaggcacacaugcacagccacacaugcaguaaaggaaugcccuguaauuaccaggcguccacacggaaucaaaagcccccuucagauagacacccugugagcuacagcuucauucacagaaugggcagccacaguccuaagauccacccauucauucuucccagaaaggacucucaccuguaacucugguccaucuaacaagcagucuacacucugaccacuuacguccauaacguccacgacugacacacaccugugacccucuuccgcuuguaauggcucucuucccugccaucccugugcuugaagcaccaacugcugacagcuuuacucucugccagccuuugagggccaucccugcuccccaggggcacagagagaggacacaccucuccucacagcagcuucagcucucuggagccugaguuagaggguuuuaaaauucgaaaaucgccaccugaagguggaaugccuaaagaguaacagugugaugcagccccgccugaacggagugcaccaccuccggagcaggugaacugagaacgaugagagaguccagggagacccagagaacuugccugcuaaacaaagugcggaaguuccuccauccucacucaccagucaaccuacauuuuccuaaacaaaguggcgagaacuuggagucacugaccaucaaaacgcccucaucccagacuucagggaacaaccucaagcuagacugauauuccaaaauucaagcaacagcaagaauaaaauuaguauuuuccuucugaugagucuacugguauucacccugaagacccugcguaauggagcuaagaacagugugcucugccuguggugggguuaauguucagcaaaauucccuccucugugacucuaauguacuuaaaccuugacaucaggcugauuuaucucacccagggcuacuuacuguaucagaaaaucaaagccugcguuacuaucuuuaacacacacaauagaggcuguauguugcaagccgcuguccacuaaaaggcagcaggaggagagccucugcgucacuauccugcugucuggagcacuggcugguugcuaccuacgagaugguagggagcaaagugauaaucaauuaaaaggacuccucacaaaccuccagagaaagcaguaagaugcccaccugcaugagcggcaaacaccugaaaaggugggaccuggcuuugcagagcuucuggccuacagaaugaagacaggcgaaaaaggaaagccagcauccccggugcucaacaguggugaacacuaacaagagccuguaugaacccagaaggcugaggaauggacguaagcaucaagguggcguagccagagaggaaaagcaugucugcauaugacuccagacaccaucugcauacuccacacacacaagguuuaaguacauuagagucacagagugguuuccuuaacaguggaauccauuuccuuuuuucauuuaguauguauggguguuuugucugcauauaugacaaugcaccacauacaugccuggugccugagagggcauaagauccccuggaacuggaguuauagaugguugugagccaccaugugcuggaauucaagcccgaguccucuguaagaacagccagugcccuuaaccacugacccauaccaacagcuccuagucauccuuucuuguaugugacugccaaagcuuacugauugacaucguguaacucugucaagucccccuacuucccuauggguuuggucuucaaccacuaucaugguuugaauucauccuugaaacaagaaaacauuccugaacagaaguauggagggguggagagucaugggagaugcucacagcccucaggacuacacaaaugcuucucucuccaggguggguaccacagaugugaauuuggccaguuuggcucacucaccuuguuaggaaggcucucaccagauguggucccucauucucggaauuuccuaggcucuaaagccaugagucaaauaaaggucuacugcccugcacuuauccagcaucaguuacucuacuguagcaacagaaaacagacuaaaacagccacuucaccuagauguccuugccacaaccaacuacgaaugaaccacuccugagaugugcucaagucccacaaaucccccucuccagucuauacuuugaacgcacgccgaagugcaaagugcccagaacccuucccagcuuugcccaagcauccauccuagggacucccagacaaugccuuggaugggccaggccucuugucguuggggucucagaucucagccugugccaagguugcucugcugucuuuccaagggcuaccaguucaaagacaucagacaucacccugcacucuaacuccacacagcucacucuguaccaccuaguucagcaauuuuccucuugcuaaguugcuguucaagaucaguauuuacuuuaauagucaaugagcagggcaugguagcauaugcauguaagcccagcacaggaggcaggugcaggauuccaggccucaaggccagucaggaguucuuaagaucucuucucaaaacacacacacauggggccaucaagaugguuuagcaggcaaaggagcuugcuaccaaguauuaaccugaguucgaugcccagaaccugcgugguggaagguaaguacuggaauauacauacacaggcacugugcacaugcgcacagagggacacauccacacacacaugcauauccacacccacuuguaauuaaaaaguuuaaacacaguaacaauaauggaaaagagaagacauuacaguagauuucuucaaaggagacagcagcacccugugaagugagcaagcaacagagucuugccgugaggaaagaagaugacgucaaggccagacuggcuuacagcccggcugaggaacaaggcaggauggagugauguuccuaggagggacuccaggaaaagggaucuaacgcaacagacuugguaagauuagugcagaagcccagccaggaguuagugcuggaugccucgugcaggcaacuuuuucugaacuggcugagcacaacucuccauuuuaugugugugguguuuugcuugaaguacaccuguaguaccagaaaacagaacuggaguucugcaaaaagccauugcaucugggaauuaaccuguguccucaggaagaacagucagugcucccaagccccaagccaugccucuaucuaucuuucuugguuuuaaacuaguuuucuaaguuagcauacagaccaaugguuacauuauggccuuuccauguuuggguccuuauauuugguguuuauuugccccucuccugccugcccucuucuuacuggcccucuuccucccuccagacagcgaccccugcuuucaugucacauguauuccauuagccuuuggcuccccuauuccaagauuucuuuccuuaacagggcugauaaagacagagaggaaggcucaaaccauucugaggucugagaacagccugauaaccccugcuccccagcauacaguguucugaguucccugcagugcgccccugaagacuacaauuucuggagaacaaugacuuuuuuauaaugccaccaaaccuggcuuaaauggauccaauguacaggagcccagaguccacucacugaaacaugaggaacaugacagccauacuacuagggagcaggcacgucauauggagcauuaggaagucaguccuuccuagauagcuaaggagaaguggcuggccaaugaccccaacuggaccacuaaucggccaucuggcaucucuguucacugcaaggugagauacacccagacagcuagacagcuguggugggagcgcagggcaccacucugggucaaaugugggggcaaacacauucaaucuguggcaugagcuaaaacacagucuuuaccaacacagcaacucccagaaaacuacaccuaguagaaggcuacacuuugaacaagcuguagacuauuuguugcugccuuccuggauggaguaacccuugaagcuacggucuguguggcuagcaaggucccucaaaaccuucaagcuuuaguuuccuuugacugaaacugaagcagcugccaggcaguaacaggaaagagccagcagcugccugcucugcccuaaaauagcuccagaacuggagucacugaguucaguggcccaagggucagaggagaagaaauuucaccgaagauuaagaaaggggguuguucaacgcuacuccugagcuaagggacucacaggaagagacaaaucagccaggacuggaccgaacagggaccauuuaucaggccauaaacucuacagcucuaauaaggaucacaccccagugauuuuacuaucuuauggcuccuaugcaaaaaggcugccuuuucccucaaaugucaauuuuaugcacuaugucuccauuguuauuuaugucacuggcaagaaguuccagaagggacucaauuaaaaccucuacacacuuccuuagccagucaucacccaguucaggaugaugucuacaggacuugccuccuggauaaauggcugagucccugcagugaccauggcccaugcucgcaggcuugcuggccuuacucaccagucagguaucgaaguaacccuuaacuggagcaccaucuguuaugcuagugugaaacuuauugguguccuuccacgcucugucagugaaaugcacucucccaaggcuguccugucaaacaccaggugaccuuacacagagcugaaaucacaccagcuacucugcuguuugcccguuagcacauuucaguauuacgcaauugugagccccuaaaagauucguguuccccacccccaggccaucuccuucuguuccgaagugcguacagauuucuaagcaaccagaugcacucaguaaaaccugccuaccugucccuagauuaaugugaaagaaaccaaguguuaucuuaacuuuuaaggcaauggggcauaaaauuacuaaaacuaauccauaugcucaagucuaauacagugacaacagcuuacacauuucccauuuuaacuaaaaugagaaaccauaauacaucuaaagccagaucuaacccacaagcaaucaggaaguuaaauagaucccaguuaaacuuacgggcacugcagucuaaauauuucaaccaaaauaaaugagcuuuaaaauguguguaugucauauaccaaacuuuaaagaaaaggcugcccaagcuacuagaggaccuugcuguagagcugaugccagcguaacuauguccuccaaaaaagaacucugacaacugagccgguggguacucacucccguuucuaguggugcaaacauucacacugcccuguaugugaaagcaccaacucauauagauucuuuaccaauuagucugaacucagauuuuaaaagccaagaaaaccagcugggagaaucuuaaggaauuuauaaaugaaggcuccugagcaaaucacaggcugcucucacuugccaauuuauaaaugauucaaucacugcuuacaccuaagacaauccuuuaagcccccgagaucuaugacugagcacuuaauuaagagucagaagggaagcaggucaggagaagaggacgaaacaagaugugaguguaaagccagccuggguuacauaaggaguuccagguuaggcuauacugugagacccuagauuggggguugggagggcugaauaagagcggcuaugagaagcacuguaggucaucggugccuuggugcccugauguauuuuaacuucauuuaacaugaaaguaaaugaauucacacccagaaaguaacaucaguagucacccgggccucgagcuugaucgucccaguccuaguuccaucuacagggaaucccuuccuguaagacaugcuaacagauggaaggaugagccggcacagacuuaaagcaaaccaggcaagugguagguguaaaaacuccaacgagaaaacaggcucgcucacacauacaggaggacaagggaugcacgcgacuucuuaugcucaaagggaaagucugaagaacagaaaagggccauggugagucuaagaaaggggggucguggcccgcuguacuguagacagaaaguacuaagaacuuucauaguucuggaagaccuuuaccaugaaugguugccaugcuucuaacaguaaaaaccucaaaucugaaguuucuucucgccagaacugaaugagcagaccuggaccagaagcuaagcacccauauggcaagcagcaccagcaagcuacauauacauauacacauaccugcacacacaaaugcacgcacacaugaacaagcacgcacaagcacacccguuccucggaugggguacuacccagauuaucucaagaguaucugauacagaaagcauagaagaaaaucuugcuuuccaaggcauucagaaguuaccauucuguucugccucgagguccuugaaccagguucuaacacacaggccacacuaggagaucaucaaagaaugacauuuuagggaaggugcaaaaggguuccaaacccacuauugcaccauuaguggaauacacuaagagauaaaaucucuacuggguaauuuaaaggcucacacagauguuccuacugguuacauacaaugcagccuuugcagaagcuaggcucgaacugcuaaugacaauuacgcccuacagacugacauguggcugcuucugaggaacuuugucccuugaucagagccaacuaucacuagcaaugcuaagucacaaaaaaaaaaaaaaaaccaacucugcagcacuguccuaguggaagccagagaaacaaacacccaguguguguguguguccaaagagccagacagcaaguguagugagcacugcacuucucaucccaaguuccacgugagaacaaacacuucaccacaauuacacgccacacugagauggcuguagaaacaucagauggucugaaaaccuagcagaaggucugcaaagcaccaggcuggagcggacgccucucacaacauuacacggcuacaggaaaguuucccaaaaggaaccauagagugaaaacugcagugcugaaccagacuccagagaugaaagaauggaugcacgcucgcaacuuuaaagagagcacacagaauccugcagagggccggcagcacaggaagaauacagaggccacaagcugagccaaaggucccuugccagguggcaagcacacuuccuccuggguccuggaccauggucuucccagauuccuggaggacuacuacuagaaucggaacucccuaaagacugaagccacucugugcuaucagcgagcaguuacguagcaugaaguccaaacagcaaucugucaaaugaagcauggcuccuugcaagcuaauguaaagguggcugccacugccacccgcacaggagagcacacuccaagucccauagcccucuccaccacaggcaggcaacccucagagcagcaggcacaacugauuuagacaggacgcaugcgcucugcuuggcaucgcuucccccuggcgaggggucucaccagggugccugcugcucacccaagaccucuuauccacacaggugacuacaaaagcacauagcaccccuggagagggacacaggagccuaaaaccacaacucugagaacaccgauuccaugugauggaaugcagcguuacuccagucugauaugacacaauaaagucaauuaagguuaaauagaugauugacugacagaagacagauaaaggaagaaaagaccgcccucagacuaaucaacucucucuauauuuaaucaaacuuuuugggggggggaaggugaggggaucccagaauggccagcaaugcccuaaacaaccucagaugaccuugaacuucuaaugccccugccuccaccuccuuaguguugagaccgcaggcauguaccaucaugccuaguuuuauauggugcuagggaccaaacucaggguuuuguggauguuagguaaaggucacacuguacagccugucucagagagccuggauuauggacuguuuucagauaucugaaacagugaaggagaaaugauucaccauucaaaucacuggcaaugugcugcucuccuguagcugcucaguagcuacugugacccagaugacccacagacaccccuaccccuucacaaaagcuccuacuggcccuucaaucaaucaucaggcaggcgauuauacaucuacaaacauggggugugucugguuaaagggaucaauuaccaggucccagauagagaucuuaaggcucagagucaaggauuaggcaugcuaacuccuuaagaagucccagaccagaagaggaggaaaaacaaacaagagaccagugagcggcugagacaggaggcauccauaauggcgugaaucucccucaaagucaacccugcaggcugcuguagggaccagugggcccucuguaauaaaagcaaccaaacugcuuaucugauuuuccagcuaauaacagaaaaauaagcaccccaaacagcaauuuaacagaagaaggcaaaggaugagagagagagagaccuacaaagucaccagaaacacuuaaaggaauuuugacuucuuuaaggagcacacugaagccacucugaagccaaaagucuauacuuccuacccuccugggggacuccagcagccacaagccccaaaccaaggcuuggaaggagagccuuggauaacugagaaauuuuaaacuuugagaguacuacaugcugaacagacagaaaccaggcacuugcgccucaagaagcugcuaaguuggcucuauuucuuguucuuuccccuguaguagaaaggaaacaaaagcuaaccaguguacuccucagcuugaacccucacugcugaaacaggugcuguaaauagcuguucagaaacugucuuggguaagggaacuuccaggacaggagacaccugaugcucgguauuauuucugcuuacuccaauugaggcauucaacaagaacacacuacagcuuucauuuccucgcaaaagagcccaaaagaaccuaagcuuuuaaaacuaacgaaaaaaggagaaaggauggagguguggcucggugguaggacaggugcuuaguaagugugagacccuaggauccacccccagcaccgaaaagguagaaguaaucuaagaaugaacugacuucagcaaucucaaucgccucacuauucuguaccugcagagaauaaagcaaaaugguaaacacuggcuuagugcuagaguaacaaaaguguggguacagcccagagguagggagggcacuuguuuagaacacaagaugcccagagcucuucuucaacacugcagaaaaaccaagacuggccucuaaacaucugcuggaugcacacaccuaccacuggucuaguguuaauaaaggauucaaaauuuaaaaugugcagccccucuccuagaaucaagccauccaccucaagucuaguauuuuuauuuuuguuacucaggugaguaaaaacucccccaggaaccacucaggacuuggacuagaaaaggaucaugugcuaugugcgagcauaaacccugcuaaaucugacugucacacucagcugcagggcaaagggauccuagggccaagccuguauuuagaaggcagaguaacuuaccaacugaccccaacccuccuuaaauacacaaaaauaaaaauacacaccuaccuucuucacagaccuaaguuugugcgggaaaaugucagagaaacaagagacuaucaacuaaaucucagccugagauuacauucuacaaauaugaaaguaccugccccugguacuguuagcacagaggaaaaaauaaauaaaauaaccaaacaguaguugucaaauguagggauaaucucuuguggacuaugagcacaggaggaaaaaaaaagcauuccccugucacucaggagcuaaauggccaaugacaacgcaggagaauaggcaggucauccggaaaagagaggcgcucuggugagaaccagagagagaggggcuucaccaugaacauucgucaccaaggagucaccgguaggauaccaauagaguaggagcaaccaggacaaaacuaaguuggcaagugccagggcgguggccgaguaguaaguaggguaagcagccacaaacagguuagaauagaugggcaacuaccucaagcagcuucaguauacagaaggucucccugucuuuauuugggaacucgaacaaguguagaaaagccagaauucauuuugcagucaaacauaguaguaauucuaguuuuaaacuucuuuguugagccuagagccauacagugcuaggaaagacccuguucuauugggcagaacacccagcccaaaacucuuaagagcagaagcagaaaaugccacaagauccuggaaagggagagaauaaacuuaaacauaaaacuuccaggaaaacaaacuauucucaauuaaacgacugcuaauuaauguuguuacaaggucaauguauuuuacaagcgaaggacucgaagcaaguuccaagugucacagaggaaaucggggaguaagaacauaaugcuguacgcagugccaaccuccuaagggagaaccugacaaagaaagauguuuaagaugcucagugucuagccaaagcucaaugccauuucaaaccagaagcaagacaugcugccagcaaugucccaguaaccuucagagacuacccaaucuauaauaaaccugugggaaacuggcuuaaguaccaacucuugacagcccacugacaaaugauguaacagguacuuuuaauacuaaaccaaaggacaaguaagagaaggggacaggagacauagcuguagacagucauuuagucccuccucacucagcccugucaaggaugcaauccccauccgagaccuuugcacaggcuacaucccagccacaucacaacugaaacuuaagacaacucuuucuccaggugaucugaaaacacauacaccagaaaaccacacuuccuuuucaaacauuuccaaaucuaagauucccaaauuacaaugaagacguuugauuugaggaucuuaacucaguuuacuucacggcccuagguucguccgcucacucucaggagcuucgucaaaaaguuaggucacaugcaaugaaugguccuucaagggccagugguuucaaaaaagcuggccuugugaucagggcuaaaugggaaauggguaaucaaugagacaguucaacaggcuagcagacaagaaaaagucauggauaugaggcuuauuuggauucaagcacacagacacuguacuggaguaaaacaucuguauuuuccaacaacuaacaccacuaauaacuuucugacccaagggauagucuaucaccuuguggggcacacgaaacucugcuucugucugugcauccccaugguugguucacugucucccccaagccucuaggcuaggcaagcuuugucucuaaauuacaacuccuuaaacuugucuaugacucugucuacugugcaaccgcagacuacagaguaaagucauuuuucauagaguacagagcuucuucaaguuguugaaggaagacaggcuaccccugcccccuuuggcuaugcugaggacugaauccagagcuucaggcaguguaggcucgcagcuccagcaucacuuagcuacaguccuguccugcuuuuccugacaguugagaucccugcuacaaggaagcaacaugggacugugaaggagaacaaaauucaagucuacuacacacucugggaaugacuauccacucugcaagcauggacauaaaaaacgcgcaaaccucggacauuagcaggaaacuguauuuguucuagaagaugaaacucaaggucaaauacauuuacaaacauacgcaaacuuuauuaagggcauaaaacagcaaacauucaaaaaauguuuucaguugaccguaguugauaagagaauguuggacucuggggcagagcuagauuuauacucaggcaaugcgugguucaauauuuucaagaggccacuuacggcauuuaagacagguuugaaucuaaggugaguauaaaccucuacuugcuucuaagcagacauaguacaugcccccuucaucuacguuuuucaguuuucugugacaaugcccuuggucaacaauacuaaauguaauaaaggucaacaauacuaaauguaauaaagauuuucaaacauguaaaaaaaguuauaguaagcggaacuuaagaccuuugugguaagaaagacuaaaaauucugaauugcacagagcaggucaccucaacugcggaugugaucgacuacuaccuacaagaaauccccaacgugaaccgaguuaaguccaaugaacccuuccuuucuccagguacaguccauucuacggacuuaacuaguguggucuaaaaaccaaugaaucguuuucaagaaaauuauucugucuugaaaugaguucauuagcuuugauaggcacuaacuagccuucagcaacaagcggucagagaguuaccuccuccaccacagguauucuaaaaagaacaccuaagggagcccuuugagaaggaaccccacaaaccuucccaggaaugaggaccugagguccucuucuacuuuccuaaaagcugagcucuguggccaaacccaaacauuucacauaaggaaauauuaaauuccccacagguccgggucaacaaagggcggaagaccuucgccaccacguuucuagaaagcaagccaccuaaagcugcuuuaaaugggucucguagagaugacgagcucaaaccgguuucgaaggcacauuuaaaucgcccgcuuuuuuguuguuguuugcucacagcaauucaccagcgccgagagugcggccgcccccgcgcgcccagaagggggagcccgggugugaagcccgagccgggagcggggaugcggagcccggaaagccaugggccgcagaggcggucacagagugagggucucggguguggggggaaccugaagccagggaauaaguggugggaaugggaggcccucgacccaggacugggggggggucggaagugcggagggaggcccgcacagggaagcucuaggggcuggaaaguggggggaaugugggggaugggagggaacgauagcuccguuaaaaggggugcagggcccgaauccccgcuggggaaggccgggugggguggggaaacaggcuggagacccgggguggggccgcgaaccgcgggcaucccggccacccgcccgcccgccaggcgcagggcccggcuuggcgcggcgccgcccccucgcgcucccgcuccucccgaggcgacaggaacaacagcgcgggaggaggggaaaguaacuccggccccggugcggggaugacaccgccuccccgcggcgcagccggccucgcgcccgcgccgccgcccucggcguuugaaaguggccaccccccgccgccgcucccgcccgccgccaccagcugcaccaauccgcucggccccaguugcaaaucaaacgcucccucgcguccgcacgccacuugcgccgcugcaaacggcuacgccgucccuccccggccuccccgcgggcccggggagcagcagagcggcgguggagcaacgcggcgggcucggcucgcgcucccgcccccagacaguucuggaaacuguggaucaccucugucacaggaagccauccggcgcgcagggcggcgcgcaagcaacaaacaaacgccugcggccgccgcgacgcgggaacagggacggcgacgggcggcggccaccccgcgccgcgggcuuugugcgggacuccggcguggggacggggccgggccacccccgcgcggacccgaagcgccugggaccguuaggcgacgcucgggcagcgacaaggaaccgccuuggggccgccgcccggccccgucucugcgccggccaccucuugccugcgcgggagggcgggcugcaaaaguuggcccuggggccaaccagcaccugcccacgugccgcguaggcucgugccccggcguacccagucccuucccccgccgcccgcgagcgccaggucaccuauuaccggugggaggggagcccggcugcuauuuaaacgcccgcggaaguugaggcacccccaccggcggugcugugcaccugccucccgccgccgcgcuccgccacuuugagcagcagcggcguccucagccccgccuccugcccgaaggcgggcgggagggggguggggggggcggguaggagguggaagguaucgaauuucuccagcaaaugggaccguuccgaaaggauucgguucuccggucaacauuccacauuccaucccucucccgcauuugcaagccuacgccgagccgacccagaaagccuacuggcuaccgaacaacagcacccaacucgcaaacacacucacaggcaccagacacgugcacgggaagguuuugcaacuugcagucccggggugcacaccgcaugugcaugugcucauaagggagccaggagacacagagaccccacccccacaauuugcagauggugccaaagguugcaaucugcaauccguuuuuaaguucaugauuaauagguacuuugcucuaccaaugaaguccuccucaauuucaccgauuaagucuuuuacacuuuacaagcagucucgcuggaaguaaaaggucucaucauuggaaacccauucuagaaaaaucuaauugccaagcugucccuucauccccuucucacugcccuugaauugaugcaaugaauauuuuggacauguggugacgcggugacaggaaccagggcugcggccacuucacacagauguacccccucacaccuauguuugggaaaacauacccucacagccuccuucccccccaaaacacacacugucaaacacucuggaaacauauauguacgcgaaccugcgcucuaccauugccaucugucuaccaaguugcuacuaugcuuuccacuuucaugcagccuaaggcaguugggcuuuuuuuuuuuaauguauaaacuaaacuggguuucugcugcugaaaacgcuggaugaaucaccugaaaaccucauguucuucguacauuuaaaaggaaaagcucuaaaccuucgcccuccuccgaucgaaaauaauaaucggaauagaacuuacugauccgacaccgaucaauucucgggcuccgcggccaucccggccucguugccggcccccacccggcgaugcccaaguugcuggugggauagugccgcggcgcgggcggccgccuccucccuccgcgcuacagauccacagcccaaucuuuuggcgccauauuaaugacguacuauauuauuuccacuaggcagcgaccuucggcauuacauuacucccgagaacucccgagcgaagcaacaaaaccaucaaauauggcugagccucucggcucguccugcagccgccgcggccgcggccugagacgcgcaccccgacccgcgcgcccccgcgccuccgcccccgcguaccugcugcgcacgggcugggccuccgcgggcugcgcgccgcgccgcauggguccgggccaccgaggccccgcggggagccgggcgggccccugcugucgcccgcgcgcucggccggcccggcgcgcccaggcccucccgguagggcgugcggcuggcggcggaggaagcgcggggacgcagacucauuucugggucacugcugccacaggggggagcacuuuaauccccagccaaaggagaggguggggacgguggggcggggagccgcugguaggggcuugcucccguuaacucuugggguccugacugcagccagaggggcucuccccccucacccaccucuggagcccgcaaacccuccaggugucuccuaggaggaagaagguuugugaaaucacccccuccaaaacugcugccccaguuccaacuccgggcgacaugcagaaaugcauuuauugcaaauuaguuuuaaaucaggucgacuaggaacauggguauuaaagcgaauaguuugagugaaauguuuuuuguuucuaggaugaauaagaaauaguuguuuuuguaguaacaguuuugaaggaguuaugaauucgaaugacaauuuuaaacacaaucuaauucugggauggggaacuccagcuuuaccuaaauuuguacugaacucauugaaaauuagcauucacccacuaaaagacaaccaccuucugaaaaaugucuugauuuuuauguuagagcguucuugucagaacuggacauuuuucuccuuccaaauaggacugagaauaacacuuaaacucaaacuuuagacuaguaugaaagcaaucgccagauuccuguugauacauauguguaaaaaaugaguggcuguugguuuuucauauacuaaaaacuaacuuuuuuauggagaauaauuauuuucauggaguccccaaggaaauacauuuauauuacagucaauauccaaaggaggaaaauacacauuaaaauuuccauuuagaaaauaagaacaaugauuauuaauuacaaaaucagauauugaacccaaaagacaagaucauaauucugaauaaaacagguuugauucacagacgucauagugugauaaaugggagaauaaaaccuaacugugccuuucaauuauuuuucaggaaacaaagcaaagcagcagaaauccuaaaugugugugcucuuucucccucucccauuuccuuaacaaggagcauaaagacucccucccugacaggaucucugcuucgcucuuccguccugcuaagaacaagugaggcgacaaaugauggguagaacccuuacuaguacuguguggucuacaguucacacacacacacacacacacacacacacacacacacgagacacagagagagacagagacagagauagagagagaaaugagggagguuuucaagagaggugucuccaucaccacugccaucuuguucauccaucaucucucugugacaaacugauugcacccguucuaaccuccagccagccuuuauucauucuaucuaaauaaguaaguacuuucuagaaaccucuguugggccuggagguauggcccaacauuaagagcacuugcucuuucguaagacuuugguuguucccaucagccacauggugguuucacaccaucuggaacuccaguucuagggacuccaacaucaucgccugaccuccacggauauuaggcauauacgucccagaagaacccucacaccacacacauaagcuaaauaaauccaagaagguguuuaaaaauaaaauaaagccacuguuuugcaugcuuguuuguuuuccugacaagucuauugccuaaaacauccagcaaaaaaaaaaaaaaaagcaauguauuaguggagcacaaaaggaauguaaaauggcucacucuccccacaauacagaggcuaugaccucucaauucugacacagauuaagaauaauggucaauaggucuucugcauuuauguuguggcuguauagcuugguguucuugugggauuccuaauggugggagcgggggaacucagaaauccaccugccucugccucccaagugcugggauuaaaggugugcaccacgaccgccuagccugaaacuuguuuuuuugggaaguuuguuguuguuguuuuuguuuuucaagacaggguuucucuguguaacccuggcuguccuggaacucacucuguagaccaggcuggccucgaacucagaaauccgccugccucugccuccugagugcugggauuaaaggcgugcgccaccaugcccggcuuacuguaacuuguuauugccaaguuugguugagaucucugggaggcaugcucuuuucugaagggaaacagaaaaagaggagaucugagggagaggggguggcaggggugagagacugggaagagaggagggaggagaaacugaaguugaaauauuauauggagaauuaauugguuuuuuaaaaauauuggucaggggcuugaagcuggagugucugcuuagcaagcaggaugcccaagauuugauccccaggagcaaagaaaaagaggaggggaggggaggggagggagagugggaggggaggagagaaugaaaguuguacuuguacacaucuucagacccagaauuugggagaggggcagaaggaucaaugaguuugagacuagccuaagacacucaagugaggcuguuucuuaaguuaaaaauagcccuggccuagaaggaggaaaacacacacacacacacacacacacacacacacacacacacacacacaccagcuaccauaagacucaggacuaaacucuuugaucccuguuuucuccccugagauuauaagaaagaugacaucuaaaagucucuuuccucauuaacaguugaugauuuaacuguucuccuuauuuugagccagggugucacuaugucaugcuggccgagcgaccugaaacucaagagaucuaccugccucugcuuucccgguccugggaugagagcuaugcuucacccgccugcauaauuuacuugccguuuacaaacuuacagaugugacggcacuuugaagaaauggagcgcaacuggaauccacuaggaacaggaaagaaacauuuagucguucaugaucaggguuggcauaucuuaaaauaauagccaucuuuuaccaucaucccacaagaagaacuuucauacaaccaauuccucucugaucugggaaaggcgaugccacucgguuugccucuccgcaacacaagcagcacagcugaggauggagugugcaaguguguaagugagaaauuugacaacgagaaagaaacucucauuccucccugucacucucccuuugccaaaucauccagaucaccguuuccuagucucuggaaccuucuguuaugucccacugugccaucagagauggaaggguguucaagaaacuugcugcaaaguagugugguagaaaccccaagucgcuccucuuuccugcagcucuguucccaugugacaauuacaaugccauccguagccccuguugcauucagcucuggucaaacauaguucggccauguucuuccauguuaauggauuuuuaaccaauuaaaaacuuggauauuuguauucguauuugugguguagaaaccauaccuaauuaauccucugaacacucacuggguuauguuguuugugcguuucucuucacauaaagaauugaaaggccuuggcaggaggauaaauuguuuauaacucaugaugauacagcuugguggcagagcuugugccuggcacucacgaggcccuggguucaauuucuccuacagaaaaaacacugcuuguauuugaaacgaaaagagucuguagucauuccuucgggaagauggauggaaaguacuguugccaguugguauguauguauguauguaugcauguaugugacacacagauuuuucuuuuccacaaggucggucuuagauagaaugguugcagucugucaaacgguuauuuguuuuuguuguuuuaauuuaaauuugauuuguauccuaaauaguguuaucaaagggauuuuuaagaauaauugucacacuguaugacugccaaggaccacuuuguuauuguuaaccuguuuggauuauaucacauggaagagggcucuguuucacaacauguucuuccacauuaaaauggauuuuuaacaaacuaaaaacuuggauauuuguauuugugguauagaaaucauacaaaucauguguauaaaauucuuaacaaauuaagaaccauauucuuccacauuaaaauggauuuuuaaacuaaaacuuggauacuuguauuuguauuugugguauagaaaucauacaaaucauguguauaaaauucuuaacaaauuaagaaccaucuuuaguuccugcaucauaccuaggaggagagaugguagguuaagggauuggacuagaguucccuagcuggcauaagagaugaggucacuacuccugaacagcuuaugaagccuucacauggauggugacaguuuucaauccacagacugacuaguaacaaugcccacccaggacucuuguguugggaucaguaccgacuacagucucuuccuccaccccaacaugauucuuccuuuucucuguugucuucugccaacucuguugugguuuugguugccuucauucugcccugcuucauaguuuuaacauaaugugucaaagagagauuaagugugaagugggagaagaugugaauaacuuaauccagccagguggacacguccaaggcugaggauguucaaaggaagaaaagcaucuauuaucuauaaauaucacaggacuuugaaaguuuaggaauacaaaggaaauaagcauucaaucauagacauaacuuuuguaaacacugccacauuucuauguuuucccugccauuuuccugaaauuggaaugaggccaaacaucacaucuuauagccaugcuuuucaccuacaauauucacuucuggucaggauuuuucuuuucagaugguguguauuaucuuugggucuuuggccaccucuguucagaucuuucucugcuggacacuucccuccccggccaucaucgcuuguagaaaugucuggcguuuuuaucaccaagcucaacuaucugcccauuaguuaacuaccuuuagaacuuccacaaccuucaugccuugccccacuuuucuuuuuuuaaagauuuauuuauuuauuauauguaaguacugucuucagacacaccagaagagggagucagaucucauuacggaugguugugagccaccaugugcuugcugggauuugaacucuggaccuucggaagagcagucgggugcucuuacccacugagccaucucaccagcccgccacuuuucuuuuuaucugagaaccgacucuagcuuuugauccagcuuuauccagauacuagaaaagauguaguuaaaaagacgaucucuaaccaacuucauggucagcagcacugaggacucgguagaaacccauuccuguuggccccaucucagaccugaagauuuugaaaguaaaauccaaccaccuacauggucaaaaccuuucaguaauucuaacccagugguggcucaaaaaucacuuugugaaacccaugugugguagcauccaccaauuauuuuugcccuugagagguugaggcacagggaucuugagcugggaggcagcccggccuacacagaaagaagcgcuuguguaauuccuguccccuccccucacauuccaagugcuuucucaaccgguuggucuacucccagaaaauggcgcgcuccucggcauucacuaaccccaaccuuacucgugauagaaccuggggccaugccuacguuaaacaagcaagcauucuaccucuggacuacauucacauguuuuuauauuugcuuuugaaacagggucucauuauguccacgugggucuguaguucaggcccggaauuuacaauccugccucggccucuccagaggcugagauuauaggacuaggccauaacagucagacaaacacacuuucugaaccccggaacuugagggugaaaaaugaaggccugaccaggcggggauugggucggaggccccugcaaguuacuaggucagagaugaaggaggucuggcguggaaucggucauaguugggaggccgcaggcaaaccagccuagauaaaggcguggccagcugcuccgacaagaucaguuccucccuccuggucccuggaagagacagugggaggccccacaugcagagggauccugggucauggcuagggugcacacagggaaaagcagagaagagcagggcccaaucagagagaccuccagguagugggccccuccucccacagaccaggauuccaaggggccugcugggguccauuuuaguagucaccccuaagagcucucuuaggccguuaccagagagcuccacuuucuccuuuucuuccacauuauacuucaaugguaugagccuacuuccuuagcaaaugagaaaaacaauacagauuuucuuucuccugaagaagaacuaacuaggaguuaggagauaaaagcuuugaggauagcuagguccaccacuuacuugaauguuugugaagcgaaggaucccaagucuugguaugacggccacacaauucacucacuuuuuucuggggugguguguguguguguguguguguguguguguguguguguguguguuuaagagagaggcgggaggugaagggggaggggaaagugagggagagagagagggaggaggaagagggagggaggggggagggaggggggaggggagggggagcgagggaggggggaggggagggggagcgagggaggggggagcgagggaggggggcaggggagcuccaucacgcacgugcuugccuuccugagccaucuugagggaagacgcccagaacuuccagaauucaaauucuuucccguguuugaaagauacugacuucuaagcuaaggacaagugagauggauaaaccaggcucuuuacaggccuccauucuucugcagaaagguccccacaugacuccaaccuagaccucuagacauccaagauacacagaaaauacacaggacgggagaggaaggguauuggaucaagagcugggcuucagguccuagguucgaaguuaccgcagagauuaacagguugugggaagcggaggaaugaaauaauuugaaagaauuaagaauccagggcuagauucagcagaaugagccgcuaagcguuauggcuuuccugacggagucuuuugggguaguuccaagauggcugaaucuggaguggaagcagagcuagagaagcaugggacagggguguagcccacuugguagggugcuugccuaacaggccccaaagccaucgcauggcgcagaccagucccgcagaccagucccguaaacucacgccugcaaucccagugcucagggccaccgaagcuccaauccaucccaacgucaaugcuuuuucccuccagcuuggacuaccaaagaucuggucucaaaauggugggcgccaagggaaaggaaggcaaaaaaagggcgggaaggaaagcccagaccagggcggaccggcuugagauuuacgcucacugguuccaggauauuauccccccuaccucaacuaauccuggaagccucugcccuucccucaccagugucccccuucuccccgagaccuaucuccaagguggaccaccuaccucagcacuuugaguagagccccgaguuuccucagagguagcaggcgagcggacaaggaugucuucugccuucuagaacccaaagagca

SEQ ID NO: 1412 - RNA, 2000 nt, Mus musculus
auuuuuguugcuuuuuuggugccaauuuaaguaguuuuaucauuccauguuauuuguuuuggguuccuguggaacaaugcuacaaccucuucuuggacugacuuaauccaccucuucaaugguggggccugaagaagcaccaccagaugggggagcuccuccaccagggaagccaucaggcauucccccaggcgugccaccagcacucugguacagcuugauaaugauaggguugcagacuuuccccaguucuuucugcugaugcucaaauucuuccuucucugcagucugguucuuauccagccagcugaugauuucauugcacuugucaagaaucuucuguuugcccucacauugaucuugccuugaaguuucucaucuuccacaguugcuuucauguugaaggcauaggacuccagugaguucuuggaggaaaccuuaucucucugcuucucauccucagcuuuguacuucucagcuucuuggaccacucacucaauaucuuccuuacucaagcggcccuugucauuggugauggugaucuccuuuucccaugcucuuauauacagcagaaacauugaggauaccauuggcauugaugucaaaaguaaccucaaucugaggaaccccacggguugcuggagggauacccgugaggucaaacuuuccaagcagguuguuguccuuggucauaguccuuucuccuucauacaccugaaugaguagaccuggcugguugucagaguagguggugcaagucuguguaugauuggugggaauggugguauugcccuugaugaggacaaccaugauuacaccagaaguuucaauaccaagggaaagaggagugacauccaagagcagcgaauccugagcauucucagacuuguauccagauagaauggcugccuggacaguugcaccauaggcagcagcuucaucaggguuaaugcucuuguucaguuauuuuccauugaagaagucuugcagaaguuucugaaucuuggagauucugguagaaccacccaccaagaaaauaucauggaucuguaacuugucuaguuuggcaucuccaagggccuucucuacaggguccagugugccacggaacaggucagcauucaauuccucagaucaauuuccucauagagagaaucaaucucaauauuggccugggugcuggaggagagggugugcuuguuccgcucauaggcuguguggagauggcagacagcucucuuguucucacugauguccuucuuguucuuucacuaaaacuuggcaaugaaaugguugaccauuugguugucaaaaucuuuuccaccuaagugugugucuccagcuguugauuugacuuaaaaaauuacauccucaauagugagggcugacacaucaaaagugccaccucccaagucaaaaaucagcauauuucuuucagcucccaccuucuuaucuaagccauaagcaauagcagcagcaguugguucauugaugacuugaagaacauugaggccagcaauaguuccagcaucuuuuguugccugccacugggagucauugaaguaagcuggcacugugaccaccacauugguaacagucuuucagagguauguuuuugcaauuuccuucaucuuugucagaaccauggaggacacuuccucugaguaaaaacuuuuuguuuccccuuugucccacuuggaccuugggccugccugcaucauucaccaccaugaagggccagugcuucauaucagacugaacaacagcaucaaucaaaccuaugcccgaucagacguuuggcaucaaaaacuguguugggguucauugcuaccugauucuuggccacauccccaauuaauugcucugugucagugaaagcaauguaacuuggcguggugugguuacccuggucauuggcaauuauuuccaccuuuccauugcuggaagacacccacacaggagugccaagaucaaugccaacugcaggucccuuagacaug

SEQ ID NO: 1413 - RNA, 2275 nt, Mus musculus
gggaggagggaaugcagauucugcagaaaguugcugggcuagcuauacgguccggaccuggucaaggccaucacagguuguuuccaggacuuccaggaucccgaucuuugcuugggagggcuggcguggacaaaacagaccggugggugugggugugggggugcgcgcgcgcgggggggagcagucuggugguggguuucccggccacacccccagacguuuucuccacccaugacaccgccucuuucccugagcccagcugcagaggcuggggagcgagccagaggggcgggggaggagcaugguacccccccaaaaaagugugaaagagcaaacagugcuagccagcgagcuccggguuccugccgccugcaguccauaaccuggugagcuucaguuuucagccaggaucgucccgggcgccucuggccaccggggugggggguggggggugagggacgcggcccaggcgggcucucagccgcagggcgggcggcgugggucgggcuuccugcgcgggacagacgggggccuggguugcacgccccccucugccuugcucuccccaggcuuggcugaaaguuuaagccagcagaacacaggaacacagcacagggucugggccuguuugugcuccgaaaccagccaccagcgccugggauggaggcagaugaagggccuguccuggccagccacuuguaaguuguugcugaguuggaagggaaggaaagcugagaggugaaggcagauugccaacuaccaggagaggacauggguuucuggcuuuuuuuuuuuuuuucuuuugacuagguauugccuggaaagugcaagugacccuguagcuggaccucuaaguggucuuuggaggccacugugcagguccugaguuuugacugcgcuuccccucuugcaggaagcuacagccuugagagcugcaggcuuguagaguuggggucaaaaaaaggaaauaaaccaaacaagccaagaagaaaaagaugagucuggaagcuaaguaccgugcagcuucccucuacgugggugaccuccacgaagaugucacggaggacaugcucuucaggaaguucagcacaguggggccgguguuguccauccgaaucugcagggaccugauuucccaacguucacuaggcuacgccuaugucaauuuucuccagguuaaugaugcccagaaggccuuagucaccaugaacuuugacgugaucaaagguaaauccauucgucucauguggucucaacgggaugcuugccugaggagaucgggagucgggaauguguuuaucaagaaucuggacaaauccauugauaacaaaaccuuguaugaacacuucucaccuuuuggaacgaucaugucuuccaaggugaugacugauggagaaggcuccaagggcuauggcuucgugcacuaccaggaccggagagcggcagacagggccauugaggagaugaauggcaagcugcugagggagagcacuuuguucguggccagauucaaaagccguaaggaucgggaggcugagcucagagacaaaccaaccgaguucacuaauguguauaucaaaaacuuuggagaugacguagaugaugagaagcucagggaaguuuucagcaaauauggccaaacuuugaguguuaaggugaugaaagaugccacugggaaguccaaaggcuuuggauuugugaguuuugauagccacgaggcugcgaaaaacgcaguugaagacaugaauggacaggacauaaacgggcagacgauuuuuguaggcagagcccagaagaagguagaacgacaggcugaguuaaaggaaauguuugagcagaugaaaaaggaaagaauccgugcacgccaggcagcuaagcucuacauuaagaaccuggaugacaccaucgaugaugaaacacugcgcaaggaauuuucagucuuuggguccauuugcaggguuaaagugaugcaggaagcagggcagagcaaaggcuuuggcuuaaucugcuucuucuccccggaggcagcggcgaaagcaauggcugagaugaacggccgcauccuuggcuccaaaccccucaacauugcacugggacagaagcacugagcccaacaugauccuaccucgcaaucugagaagcagcuaggagaacgauacugcucuccaucuuuccggugcuauaaggaaggguaaucuugaaaaaacccaguggcugcuuaauuuacugcaaucgugcaaggaaaugucuauacgaaaacauuucguuuuaugug

SEQ ID NO: 1414 - RNA, 914 nt, Mus musculus
ggaaguucugauucuuuuuauuucccacguugccaguucauguugugguuuuggugggggcguggagagcgcaugucaccugugggugccacugccugcugugcuucucugcucuaaggugaccacgugaacuggucgcaguguguaagguuagcuuuuccuuuugcugucuagucauccuccuuagucuucugcuucuuggcgucgacaucauuauccucaucagacucagcuacccgcuugcccgucggagccucagcuuccucaucuucaucccauccucuuccuccccgucaccuuccuccuccucuccuccuccuccuccccuuccuccucuucuucaucuaccucguugucugccuccugcucaccauuuuccucauuuagagcguuccuauuggcagguaccauucucugccuccucuacaacgcccuccuccuucaaguccuuggugguggucucagagcugguguccacugccgcgucugacuugauggggcaugcugguggucugaugcugcgaguaagaaauuagucgaguucgaggacucuggcgagaaagcugccggaguccgcauuagaggagucggugggcagcgaaaguggcugcaugaccugggaacagcgcaaagauggcuuuucagagcagccguagggcgaguuaagugacuuuuuggccucaauuucuaugugaucccaccaguuucuuauaggugcucuaacaaaugaagcaaccugaaacacuacacauuuauuaccuuagaaguuuuaugggugcgucuuacuuucaccaggaacauucacguuguuccuugauauuucuuggcucuugaucuccuucaaacccggaaauggugaagacagagcuaagggggugcuugugcgacacguguaaggcccuagauuggucauu

SEQ ID NO: 1415 - RNA, 2935 nt, Mus musculus
cauagcucucuaccucaaacuuaguuuuuuuuuuuuaaauauuuguuuauuuauuauauguaaguacacuguagcuguccucagacacuccagaagagggagucagaucuuguuaaggaugguugugagccaccaugugguugcugggauuugaacuccugaccuucggaagagcagucgggugcucuuacccacugagccaucucaccagcccucaaacuuaguuuuuaaagggccucacagauuugaaaagagaacccguuagccucuugaaaagaggcuuuuagccucgauacuggccggcuggucaggcaguccccacgcuacaaagaagaaaacuucccugugcacacugggaacaauggccugggccagguccacaaagccucuuuaacccacaaugcaaaguugaaaaaaaaaaugccgugaaauucuaggaagugcaaccugggggaugaauaagaaacauauuugcccgaguaucuugaauguugugagagggaaggcuuugaggcgguguggggagagggagcaggucgcugaggaaccgggauggguggaagcagaaggccaccucagccucagcaucagcugacucggggcucagcgcaggacugggguuuggucaaggccuagcuguuuggggcaggucucagcucgccuaagggaacauucccuuacagccccaagcuccuggagcaggcagaggcugaugccaauguuuguacucauugaauccuagaagcuggaaugaauaugaaagaauuauucgcaacaccgacauuugcauggggaguggaggcaacucaggagcuuuugugagaaaccccuguaaggaauucuccaaguaugaacaacucgacagacagcuuuaaaaagaacggcucaggugugaggguuguaccucagccgaggcucucucuggcuuugauuuguagcccacaaacuaggagugguggccacacaccugugaucccagcauuggacagauggacggucacaaguccaaacuuacucuucuuuacacaguauguuuaaagccagcgugggaugcaggagcccugucccacauaacaauaaacaacagcaaaauaauaguaacaguuacagguucaguuuguuuucaucaacauuguuugcuacaagguaauccugaguguuugguuuuuuuguuuguuuguuuuuuguuguuuuuguuuuuuaaaccccuuguuuuuuauguguuuuuuuuuuaaaacuucuuuauuugauuuuugugcuguuuuguuuuguuuuguuuuugaggcaaaagcuuuugcuccauugaaagucuucacaaagcaggagcaguauccuauaugggagacuaaauaaaauucugaagucauuuugaggaaggacucuuuugagaaggaccuaccaauuugaaauuauuccaggcaauacuuuggaagccuguauagaaaugaaucgagacaaagaaaguggacucaguucucaguccguaaaagaagaccucucaacaguuuucuuuuuuaaacauauauuuuauucauuuuucuuaugugccugugugucugugugaguggguauguccaaugggagugcgggugcaggaagaggcugucagauccucuggagcagcaggcaguugggaacagccugguuugggugcugggaaccgaacucugguccucugccagcacacccaggaccugucgagacaucucuccaggcuccucaauucagcguuuuaaaggucaucaaagaguugccgaguguggugguguucuucaggagacagagacaggcccaucucagcgagcccaguuuaagacagugauacccuuauuuugaaaagcccuuaaaggggcuggagagauggcucagugguuaagagcacugacuguucuucaagaaguccugaguucaauucccagcaaccacaugguggcucacaaccaucuguaaugagaucugauacccucuucuggugugucugaagauagccacaguguacucauaugcauaaaauaaauaaauaaaucuuuuaaaagcaauauuuuuuaaauuaaagauuauuuuauguaauggugaguuacuuugggaagguuguggaauucugaggaggcggaagcuuguuagaggaaaugagucccuggaggagggcccugaggcuauauagccuggcccuacuuccuguuuuguguucuacuucuugaauguggaugccagccaaccucuagcaccugccaccaugccuuaccugcccacugccauguuuuucccaccaggagggaccuccagaauuguaaggcaaaauaaaccauuuuaccccuugauguuguuuugguauggaauugugucacagcagugacaguaacuaugacaacuacagacauuugacuuuuucuguguacaucccccaaaguuaauauucccagccaggcuaauuaaggcaggaugaugauaggggucaaauucuauaugccaccucucuguuuuggggcacagaugucuuguuucaauaguagucuguuucugaaagauucaaagcccacuggaggagggcaggcucugggcuaucacaguggcuaugcccucuggggagucacuugucucacugugucucaguuuuaucaacuggaaaaaaaaucagaagcaaucacauuucuucaagucauuuuaaaacucauuuuuauuagaaauaugcagauucaacuacuaauguauauucucagcaggaagcggagccuggccgauuccacaccgauauuaauuuaauaucauuuuagauguuauuaaugguagcuuugccuuugcauuuuguauguaccucuggcuuauuuuucaguuuuauuugauauaaguucuuucuguguaauugugcuggccuggagccucagccuucuggguuacauauggcuaccacuguguacauccugcaacuguauua

SEQ ID NO: 1416 - RNA, 2217 nt, Mus musculus
cuuuacuauaacuacuuggaaacuuagguuuccuuagaacaauuuauuuauuuauuuauuuauuuauuuaauuuuugagacaggggaaagggucucucuauauuagucccuggcgucuuggacuuacuauauagaccaggcuggccucacagaaacuccaccugccucugcuucuccaggucugggauuaaagaugugagccaccauacccggcaagggcauaauuuucaaaucugaugcuuucauuuuacauugagguucaauaaacuggacaaguccgagcugcgggaagaggugggacagugcuuucagcuuugccuaccacugugguagggggaguguuugcugucuuugagcucuacugucuucaaaaauaggaaaaagaacaacauuuuauuugaaaccauguccaauuuugugguucuagaaccaccuguguuaacucagcaaggacgugucuggagggguccuuuugguucaagaaggguggaggaaggcaguuagcuacagaugaggcccagugucucauuauuuucuucugaugcuuuuuacauauuuaguacuugcuauuuugagaugcgugaccaaccagccggccaagguagauggagauuauacagcgaguccgcugacaguguuucccccagccaagaucgaaaagugugcauacgacaaggcuggaaagggaaucagaagcauaucugagcuucuucuugaaauggagagaucacacucagucuagagauaaggaaaaaucuccacgaaaaacaaaaacaaaaccccuuuucagcggccccuuaguagacagaggcagaaugugaccuggguacugcagcucuuuccaaaauguuacgggcgacccugauggagagggaugcuuccaaugucgccauagggcugcuaucaaguuuaaauuaaaucccacuucaacaaaugucacucacugaaaaucuucgaauaagcaacauggcaaagccuuugcugauggauugcagauucgagucaaaauugaacacaacaaaauugcaggggaaaacucgugucaggcucuggaggcuugacggcuguccuguagggaugcggcacggucuuccucagaguguuuggagaacuuaugguaguccauaaggaaaaauuacugguuucuuuuuaaauauuuauccuuucucuaauaauauuauacacacaaaaaucucagcauugccccuccgaggagagccccgggguccagcguucagcugacucugcguggacacauuggcugugugcggagaauaaauauuuaaaucucgggaugagcaagcauuagaaaaauccuggagaagccuuccuuuugucaaucuacuuaagcuugaauuucugccuuuuaguuuucgccugucauccuaaccaguggccauuuugaagacaagguauuuucaccugcuaaucugccgcagggacccaggaugagaacacccugugguugcuuccuagucgguuccguccggugcugccgauagaucaugggcguuccgaugaucuuaaggccgagacagcauuaccuaccuggguaauuuuagaguuucccagccuccaucucugcugacaccgccgugccuagggagguaauaaugaugaugauuuuuuagcaucccugggguuuaaaaugucuccuaggagaugaggcuggcccaguggcaggggguaagcccauagcucccccucaagcacuucgccggcagcaguuggaagccugcauuuggaucucaguaggcuaggagaugaggguagagagcccagagggaggggugguaaaaugccugggagcuggagaacagcacaggggccgagaugagguaaaggcaucauucuuuucaggagaugcgggcaaagugggugaaaaugccagggggaaggggaaaauuaggaagagguaggugggcuaagaacggcaugcuuuggaguagcuauucugagccuggccccauuuucuucuguccugcuaauaaaagcugguuuuggcuucccauggcguuagucuccaccccaaggggacaggcuuucccagucaguuggacaguguggggcaggucccuuccaagagcccguguuguguuuguuguccaaagccacauacaucauuguuuaucaauuagcauugcgauuuuaaaauuguuuaauccccacccuucucaaagaugccuuaaguuacugcuguguggcuaguguacuauu

SEQ ID NO: 1417 - RNA, 2555 nt, Mus musculus
uuuccuaauguguucggccuucuaaaauauuagucaugggcuggaguagaggguagugacaaaacauuugccuaguacacaggaggucuuuccugaaaauaaguaacagccguagcaacagcaacaacuaucuauggauagaauauauggaaccagacguaggcuuacuagcuauagaaccguggucaaggcccgagaccauucuugugccucaguuuccccagcugaaaacaucccuaccucccugguuagcucugaagaugaaaugagucacugaauguuuuacugauuaguacagcacauacuauaaauaccacaugaguguuaaccaauccacgggugaagaccgggcauuagaacaaagauuauggcaggcguccuauuuacgccaguaugaaagagugaguuccuaccaagaccacagugugcaacacugaaggguuucagaaagccccgguucauuccuauggucaagaguuauauuacagugcugcaccaggggagacaacccaacaguccccagcuccaaaaguaacaucugugagagucacuucagagccaggcccagugcuaaucagauucucuuucauugucccacacagcaaaggaggacacaccagggaaggacacugggcccugcaugcacaguguaauccuuuaaaccaaaccaauuauuuuccuaagggauguggggacaaugaaagcuugacaggaagagaagugacagacggacacagcgucugacaaagguaaccugacucauauucuaaucuccuaaaauucggggagcugagcccagggucgggcaugcuaagcacacacucugcccuuaauacagcuacuaacugaaaauaaucuauggcugcauuucccacagaauucagucaaaggccagguguaccaucagggcaguuucaaaguucaccuaauuaggccaaccucaagauuuugccuuaaccuccgcucuggccagaaaaacagagggcuugucaugauguaauccuuucuagaggccaucaaaaagauguuaccgugaagaguuuuaagagcgcccauaaccguaaagagaacuaagauucggccacugaggucuccugucagaaaucaauguaauuacacuccucugauagcuucuuaaauauucauuucauauuuucuuuucucaagucuggagauccacucacacacagauacaucaauguccugcauuuuguuacacauaacccuguucccacguucuaauuuuagaugucguuaguccaccagaauuaaucuuuucccauauaaagaccggucacagcuccaauccgguaguuuuuccuuaaaccuuuccuccuucauagaaaagcacgugggccaugugauuugcuggucuuuuugcucggaaauuaccugcagcuaagaaagagacaccuuccuuacucauucccggagcugaagauuacagcaaacucaaguuuacaucuccacugcauccuugggaggagccaguuacauggcaguggguuuuagccaauauuuaaaaaaacaaaaaacaaaaaagcaaaaacaaaaaaaaacccacagugguuuuaaggaagaaguacuucugguaucaaaggaaaucuuuuggacuaaaacucugaaucccagcugaggggcugacuuaacuuuaagcuucugacagugucuguguguugcuaaguuuacagacaagauguuuuucuugaaagccuggcugcuccauacacuguagacagaaacagugagagauggccacuuucaucuggacccacaaugacgggcugcucaauacugacuguucggcuccuuaaaguuuuuguuuuucagucuugugcauuagucucccaagcagagacaccugcuguccccgauuacaaauaggaauaugucacccacuccaauucaccccauggcccaggugaacuucaaaaugcuaaacacuccuuggcaugacauagaugacccaaccuuaaaagacagacagacucuucaguacaggguacaagguacugucggguuccagguucuguagguaagcagaaguguucuuccgcuagcaagcaugaauaggccacacugugagagguggggagaguugugcugagcgggcucaucgggaaggccucugcccaggccucuaccuaucacuguuggagcucgugcugacacccagggugagaaacugagaagcagagcuacacaaaaggagugucuggaaagacacuguguugucagggugacacccgagucagagcggguguguguguguguguguguguguguguguguguguguguaaauagacuagaugucuauguacuuaauacggauaaggcugaugaucuagcucuaugccagggcuuagagcuuagcaucugagaggcccugaguucaauccccagugcuaaaaagaaaaaaauaaaaacaaacaaaaaucaacucuggggaaagaaugaccaaauuucucucuguuuugcaaaaccauguuguaagucucaaaguguccugaaauaaggaacaccaauacuucacuaaagauuaggccgggacug

SEQ ID NO: 1418 - RNA, 1003 nt, Mus musculus
acauucaacaggcagcagcgccgcugucgcgcggccgcggagagcuagagcggcccgcagcguccgcccgucugccuuggcguccgcggcccuugucagcgggagcgcggugcccgagcugccgggcuccgcggccuggucggugccccguccuaggcacgaacucggaggcuccuuagacaccggugacccagcgaaguuaaguucugggcgcguccguccgcugcgccccgccgcgccugacuccggcgugcguccgccguccgcggccccccaaucucggagcgacacucgggucgcccgcuccgcgcccccgguggccgcgucucccgguacuucucugcuggugggggaggggcgggggcaccauggccgaagcgccccaggugguggagaccgacccggacuucgagccgcugccccggcagcgcuccuguaccuggccgcugcccaggccggaguuuaaccaguccaacucgaccaccuccaguccggcgccgucgggcggcgcggccgccaaccccgacgccgcggcgagccuggccucggcguccgcugucagcaccgacuuuaugagcaaccugagccugcuggaggagagugaggacuucgcgcgggcgccaggcugcguggccguggcggcggcggcugcggccagcaggggccugugcggggacuuccagggccccgaggcgggcugcgugcacccagcgccgccacagcccccaccgaccgggccgcugucgcagcccccacccgugccucccuccgcugccgccgccgcggggccacucgcgggacagccgcgcaagaccagcucgucgcgccgcaacgcguggggcaaccugucguacgccgaccucaucaccaaggccaucgagagcucagccgagaagaggcucacccugucgcagaucuacgaguggauggugaagagcgugcccuacuucaaggauaagggcgacagcaacagcucggcgggcuggaaggugaacggccucug

SEQ ID NO: 1419 - RNA, 1003 nt, Mus musculus
cagaggccguucaccuuccagcccgccgagcuguugcugucgcccuuauccuugaaguagggcacgcucuucaccauccacucguagaucugcgacagggugagccucuucucggcugagcucucgauggccuuggugaugaggucggcguacgacagguugccccacgcguugcggcgcgacgagcuggucuugcgcggcugucccgcgaguggccccgcggcggcggcagcggagggaggcacgggugggggcugcgacagcggcccggucggugggggcuguggcggcgcugggugcacgcagcccgccucggggcccuggaaguccccgcacaggccccugcuggccgcagccgccgccgccacggccacgcagccuggcgcccgcgcgaaguccucacucuccuccagcaggcucagguugcucauaaagucggugcugacagcggacgccgaggccaggcucgccgcggcgucgggguuggcggccgcgccgcccgacggcgccggacuggagguggucgaguuggacugguuaaacuccggccugggcagcggccagguacaggagcgcugccggggcagcggcucgaaguccgggucggucuccaccaccuggggcgcuucggccauggugcccccgccccucccccaccagcagagaaguaccgggagacgcggccaccgggggcgcggagcgggcgacccgagugucgcuccgagauuggggggccgcggacggcggacgcacgccggagucaggcgcggcggggcgcagcggacggacgcgcccagaacuuaacuucgcugggucaccggugucuaaggagccuccgaguucgugccuaggacggggcaccgaccaggccgcggagcccggcagcucgggcaccgcgcucccgcugacaagggccgcggacgccaaggcagacgggcggacgcugcgggccgcucuagcucuccgcggccgcgcgacagcggcgcugcugccuguugaaugu

SEQ ID NO: 1420 - RNA, 3941 nt, Mus musculus
uagaaauuuauauuuuuauuuuuaaaauuuuaaauuaauuagguuuuauuuuuugugugcagugacuaauauauauggguuccagugauauuuugagacacauauauuauacgaagacagauuucaaguaauuagcauaucuaucacuucaaauauugaucaguggcuuugaucaaugacucucuccacccucauccacucccagaauccuuaucuaaugaggguagggugaguaggacucuguauauuucauaagcugucuuguuauuccuucuuccuuggguaagcagugucuuuuuuuccuuuucuaauauguguuugauguaugugugcuaguguacacacacacacacacacacacacacacacacuugugugcccucgugugugugugugugugugugugugugugugugugugugacuguggagaccuagaguugacacuaaguaucuucccugauugcuuuccauuuuguuuauugagaacccagagcucaucaguucugacuagccuagcucgucagcuugcucugggauccuaaaucucuaccuccuugaauguuaguaucacagaccuccacugccuguuuauuguacaaaggucuuggggaucugaacuguggucuucacucuuuauugucacguguuuauccacuaguccacugagcaauuucaaguccccagacuccuaccugcaggcuuucagaccagguuucgugucucccugggugaccuauauuuuucuauauagcugacaauggcuuugaacuuccgguucuccuguguccuuauccgggauguccuuaccccaccaugaccauuuuuaugaggugccagggauuugugugcucggaaagcaacugagcuauaucugcagacugcuggaucucaaaugaugucaaacuagcaagucccuucuuccaagaugcugaacaggaucccucccaaauucccagaauucaugugguaggcaggaggguaaugucacauucgcagaguccauagagggaacccugugaaagggaaagugucuggaaaaaaugcaauuucacugcucccuugcaaagcagcggcuuauuaacugcuaacuaaguguugcccucugguugucccagaggggcuggcuguaaugaacaagguggaagaaucuggcucauuuguaauuacacauuagcaccacugaagugcaguucacacccacccucuccuuacggagcaucucucaggccagucucugugccccagggccaaacuuuccauugcuuauucaauuauguuguuccauagcuaaucacuuuugcauucgucuaauucuuccacagugaacugccucuggaaugggggacccauuugcauaucugugucuuaaucacccucugcuuaggggcggaugggagcugccauucccccugccucgcagcugggcagauuccggcugggaguggaaggagauuggcccuggcuggagauuggggaguuucugcaccugcugacuuccagcugcccagcugagcuaacugccaggauggagcaacaggagaguccuuugcuguggacaccacuugcaugcuuggcccaagaauguguguaaauaguucagugguauagccuuugccucgucugugugguaaggccuugaguuugauccacaugaugaacacaaaccaaauugaaccaaacugaaccaaaaccucaauccaaccaaaugcaaaccaaaaccaauaaaaccaagcaagaaugaaacaauaagcaaaccaaaaccaauucucucugcucaaaaccaaagccaacaacauaagaauguguccccuucaagcgucuucuccaaccgugacacuagacagggaaauggacaaacuuuuuucuuuuacuuuauuugauauuuucucuauuuacauuucaaaugcuauccccuuucuugguuucccuucugaaacccuccucccccuccuaccucccccugcucaccaacccacucacuccugguuccuggcccuggcauuccccuacacuggggcauagagccuucacaggaccaagggccucuccucucauugaugaccgacuaggccauccucugcuacauaugcggcuggauccaugagucccaccauauguacucuuugauugaugguuuauucccagagagcucuggggguacugguuuguuuguauuauuguuccuccuauggggcuguaaaccccuucagcuccuuggguucuuucucuagcuccuucauuggggacccuguucucagucucauggauggcugugagcauccauuucuguauuugucaggcacuggcagagccucucaggagacagcuaucaugcucugaggacaaacuuuuuuccacgaauauuuacuuaaaaauuuuaaauuaauaaacauguguguguguguguguguguaugugugugugugugcacgugcgcaugugugugugugugaauaugcaugccacagugcauguccaaggacaacucuucaggggucuguccacaacuccccagucguuguuuuucuguuucuccuggacgguugguugucccgucucugccucccaggcugucuugggaguccuggggucacagauacccaccacuguaggcuccaggcauugaacucaggguuccaggauugugcagcaggcauuuuacucaccaaaccaucucuccagccucggaagacaaggcauuuuaaaagggaccuuauagaauagcuuaauuguguuagugggguuucccuaccaagaauuggaaucucaguguggagggauccaacaccuagcuugggguucugauguuacacuaagcauguguugcuccacugaaugaacuguucugugguaauggauguuggugugguauccacggugcucaguuugguagccauuagcugcaaauggcuccugaacaccugaaacugguuauugugucugaagacgcaugcuuuaaagugcacuugauuuuaauaauuugugauuaaaaggaagccacuccauuugucucagggcuccugguuuacugucaggcaaggcagggcaaugugaagaguaacuagcccuaggugugacagggacacaauguccuguccacagaacagcucugcucugcuuugauaaacagcuguggugugaaaccuccguaggcuguguauaggugcuccacuugucaugagguuuuguccugagaggacugugagacaguggaaauauaaauccaagaugcauuuaaugagcccagccugcagagcgucguagcuuaccuguguagcacacggaaccauggcgguuguuucccguucugaucacaaaugacuggaugggagcuacccggcaugcucagagaggaauaggaaaagaucaaacuucagaaucugccacaugagcucucguggaugugcauccccaucacaugaucuuaaaguuggaacaucaucagggaaaugacugaaaacuggggcuguaucuuuaucccguuuuauccucugggcaguuuugcuuugccagacugacaugggaauuuauucauuccucuuauucuuccaggcaucucaaauaccccugugggaggaaagagggacuccgccucuuggcuucaaggagcuggaaacagucuugucuagagggcugcagugucuuugaaguaucuaaaaauggcaugaaaccauagcaggccauucuucaauauauuugcucuuacuuaauauuaagaaaaaauccuauccaaaucuucaaguaaaacuacaguuauaaagagagacagcaguuuuaucucgugguuucaugaaucaucaugccuguggucugucacagggagccccaucccgccauuaggcaaguguugacaugcgcaaaugcuuuaaacagucaauuuaaauuucucugucaucucuacucaguacuaguuaacagauagguaggauaucuuuguuu

SEQ ID NO: 1421 - RNA, 1797 nt, Mus musculus
uaaaguuguuuuagcauaacaaauacuauaccuuuauauaucuuaaucccuucucuugacucugugcuauucaacucaucccuggaggaucuguggaaauuucuguuuuuacccugugaccaauggaucucugccaauuagcagguguucgaugaaaacuuuuuaagagauguaugggggagucaugugcuauaccuacagaggcugccaagcuucaaaaaugaauccaagcaaagcucuuuguuggacucgagauucauggauucaagguugcuuagcuaaauugagaccaugaaaagucuucggauugaaugagaaagagaguccggucuuuuuccuuuggcuucugccccagaagguugcacucaguuucaagaggggacauugaagggggccaaacagaaacaugacaaacagcugaccuaaggcucaggcucucucucaguggucccugauuauaaauagcaacugguucuuucaaucacuuaguacagagcccgagguagcauuuguggguaacuaguaaacggucugugguuauagugcaauuguaacuacugguacuuucaguagcaggguucuugaaugaugugugacaagugaauauuauuucauaauucacagcccaucugcagagccuaaacacuauuccugaugggccugguggugaaugccuguaagccccucacuggugaguaugacauaggaggauugaaaguuugaugccaccauaggguauauagcaaguuccugucucaaagcaacaagauaacaaaguuacucugucuuaaacuuuuuucuuaucuggugacaucaucagggacaguuuccauaccauucagggacagccucccuacuggggugcacucauaguaggcaaaagaagagacucaggacagucaggaaaagaucuaucugaccccacuugacacuaagagagaggaagagagaaggacaugggcagagguguuaggauuuagaagcaccuuggcggguuggagccaagguuugccucagagaaaaaauaccaugcaaguucucacacaagagauuuauugggagagagggaagcgaaaggccaucuugguguggggacaugugagguaguguggagagaauaucuuguguauuguguggguacaucacuugucaauuaaaaagucuaugccaugugacuuugacagaaauagaaggugugacaucauggaggcaaaaagaauucugccauagagucaggagcagaaagaucuacccuggaagauguuggagacagaugcaagguaccugcacauagauaaccaaccacauggcaaaaauguagauuaaaauaaauggguugucuugaguuaugaucuagucagaagagagccuagcucuauggccaagguauuuguaaauauauuuugagucugagucuuauuucugggagcaugaaaccgggaggcagaaccaggacuaacuucuacaagguagagacauacagacagaaagacagacugaaagacagagaggaugugagagagccaugaugucaggagagaccuuuuaaagagugugaguguuacagcuccuagggacuguggaaaugugcugcaccuggcagugccaggugaugauguguccggucccugaagggcacacugguggagugccugauuucuaagaagaagaauggggcugucuccugaguguuuuuauguuggagguguggugccaaugaauuauacuaagagauguuuugaguucuuuguuuugguuuuucaagacagaguuucucugcauagcucugauuguccu

SEQ ID NO: 1422 - RNA, 15400 nt, Mus musculus
aguggccaggagcaccucggcguggggaccagggucacucgcugggcgccugacucggggcggagcaaggagcaggacacccggaauuagucuucggcgguucuccggucgaguuucccggugcuuuagucugccucugcccuagagccggcuucaggccucgcugacuuucgccucccagacccucgcgauggcgagagccugggucugccuggcgggcgccgccuucuuccuuuccugucugguuuugcauucgcgcuucuguggcucgcugguaaauagcaggcagaaggcugugggugugggugccaccgagggguacagccccuggggucccaaaccugcuccccuggggcucagcagcugacgacucguccucucauuuaguguaaaaagaaugcacguggggcuggggagguggcgcggagguugggagcucgagcagcuuuuucagaggacucagguucgauucccagcaccaacuugaaggcucacucucucacuguaacuccaguuccagggagccugaugcccucuucuggccuuugugggcacauggugcacauaaacucacccgagcucaugcacacaagucuaaauaaaaauaaguaaacaucacacacacacacacacacacacacacacacacacacacacacuggauuuuccccagcucuuacuacacucuuaagucacacacacacacacacacacacacacacacacacuggauuuuccccagcucuuacuacacucuuaagucaucauuagacuuuucuuaugguuguuuugaucuuuagauauacaaucuuauuuccggcuaccuucugguugucgaacugaaucugaguauuuugauuuuauuugagguuucaaggacauuuucuuuucacguuuccuggagaauggaggacccucuuuuccggcuggauuuggguuggcccaagaauucggaauacuucacuggugcaacauuuuguguugcaguugauucccucaacggguuaguuuacguagcccaaguaaguagaaugcauuuuuuuuuuuuuuuaauaugugagccugugaggucaagagagaccagaguguuaaugcgguuaucaacuaccagugguuuccaggauugaacucugagugucagucuugcuuagcaaacacuuucaucugcucagccaucucuucaacuagagauuuuuuuuuaauuuuaauuauauacauucaguuugaucacaacagacaggaauaauaaaagaacagucaaucugagcaugacaaaaaggaaaaaaagaagaugaacagaaaggaaagaaguguuucccaccuagauagccugcugcauuuauaguaugcuaacuaugcaauuuaauuuugaguuggcuucaagugcacauuuuagauuuguaugcauuagaaauuauuaaguuuugaaguuagugcuuuuuuuuuacacacuucuaaauuucuuauuauacuuucauuuugauuucucugacaaaaguaaagauuagcguuccuauugagugauucuaagcaguuguuuuugugugccuucagagaggggauaacauccccaagguauuaguguucucagaggauggcuauuuccuacgagccuggaauuauacaguugacacaccccaugguauguuugucuccggcacaccauuugaacaguccgucuggaucacggacguaggaagcgguauguguaguacuaucuauuaaauugccuuccuagauagagucacaucuuugcccauguucuugcuuauacacuuuaaggcuagcauugcugaaucuaaucauaauuuccuuaauauuucauaaaaucaugucuuucuacaaauuugcaccacacuacuguauaaucaagaaauucaauaacacuauaaucccgaucuuuuaaacuugucaagggaacuuuauuugggugggggugggauggggggcagacugucauucuucagggcuaucuaucuugucuuuugaaccaaagucucucucucgcuggccuggaacuaaugagcaggggaggugaacuggccagugaguccucggcaucuuccuuucuccacucgcccaaugcugguguuacagugcacacacucauacacagcacgguuuuauuucuuuguuuuuguuuuuccugguauuggcucuagguacagaacccgguccucauucuugagugacagguauuuuccugguagucugaacuauccuuccaguucagagccuuucuucuuugacccuucgcuugcugaucucagaguaagucugugccucuguaaagucaggucagaugccagucuuuagagaaucaggggacucucaacuucucucuauaccagcuggcucuugaaagggcaaaugaggguucugaagccaccauuugcugcccugagauuagcagaaacugcuauuauuaacgguuuugaaauuccacucacuuaagcaugucugaaacuuucccaccagcagauauuuuuaguauacacuguugaaaaacaagguaggcuaaguagcuuucuagcugcagaaguuguaggagacaacuguuugccugacugcugguguguccuacuugacacaagagaccguuccuguugucuugaggaccuggcaggaaugggagagucagggcggauuuggcuaguacccuucuugaucugguuauggcuuggaggguauccuguuuccccggugcuugguaacucacacaucacucucagcaucaggaagguuggguuuuuacguugucacucuuguuaacagaacguaaagaguuucugggcuucagguagucagggggcuauucguuuaguuaagccuuuaucucggaagguaagugcugguuaaacauuugaagaguggcaacugcagaguguuaagcugcccacuuagauucuaaguaaagacucaggacuuuucgucuuucuuccucguaucucuuuucccucccuucagauacuugccagagccugcgcgugauucucugaacacucacuucccuuuccuccaccaggcugcuuacaagcugcguggcuuccucgguuccucuucuccagcuuccuuccucaggaagcugucaagcuuuacaguguggguagccuggagguuuuccuuuacaucccaguaaaauugcccuugaacuuaaaaauaaaucuaggagauggauuagauggaucagugguuagaacacuuugcuuccagaggaccugggcgccgucccaagcaccauguggcaaggcagcucacagugucguaaguccagguucagggaagcuggugccucucugggaacuacacacacacacacacacacacacacacacacacacuugcgggcaagcauucauguacagaaauaaaaugaaaaaaaggacucuugaaaguaucuccgaguuuauacaauaauguaaugagauuugacuauuuuccucucucuucugccccgagaauucgcugugagagccuuucauuuuaauuuauucuguucaugucgcccuuuuaaaaagcagaaacaaacgucacugguucccagaaauaagcgcagcauagaugaccucauucuuuucaucgugucuuguuucccacccuccgaucagagaaacuauuuuuaagcucuucccauuuucaaaugaauugauuuccucaagugaagaucuggcuacaaaucaaucacuuaacaaaaugauaaguucucuguccccuuuuaaagucuuuagaagcguggaggugugcucucucuaacccugcguguucucuguggguaagcccuuccgcauuagcacccagauccagugcagugucgcacucggcucuccagggagagcuggcgugcaggcugccucgcuugacuucagucucuggguaccugucaguuaguuuugccuccugugccucugcuaacugcuuccuaguuucccuuauuugcucuuauuugcauuauucuuuaacuuguaaggucauuuuagcuccaagauuauuuuucuuuuaagaaaugaguucaauuuuuaauuugcuucugcugugagaaaauauaauuaaacaaauagugcuaguuauaaagaacuuuuuguggauguacuaaaauuuaaaugacugauuaaaauaagagcuuugaaugucgguugcuuguuuuuuaguuccuuauugauuucuuuuacaagcaguggguuguuuguuuguuuugggguugggguuuugggggaguaggggguuuuuugagccgggguuucucuguguagccuuccuuggcugucuuggaauucacucuguagaccaggcuggccuggaagaucugccugcuucugccuccuagugcugugacuaaaggcgugucccaccaccaccuggccaaacaguguguuuuuaaaaaaagaaguuaaauuauccucagcuuucucuguaaggagccaggguuuuucuuguguuuuuauuuuggagugauuagacuaaauuagauuaauacaucuccagguuugcucauaccguaugaaaggcugcuaguugccaccugucauacuuaaguaugggaaucucuuggcucccauugcuguucagccuagugagagauuugccuuuagcuuauggaagaugugaacgcuguguaauccuugugacacuugcuugucuuucucuacaggacccuacggccauacuguuaaaaaauauaauucccugggugaucuuguucaagucuugggaaccccaggcaagaagggcacuggcuugaacccgcugcaguuugacaacccugcagaauuauauguagaugacacaggggagauguacauuguggauggagaugggggacugaauaacagacuggucaaacuaucccaagguacgugccuuaccuggguaugucaugaucagaaagauauuauucuauaaguuuaauuugucugcuguguaguauaauguaaccguauuacacgugaaguuguguguaaagauuaauacaaggaagucuguugcugaaaauauuauuuaggguuuguaccccuccuuagaucauugaguucccaaauaaaagacacaaaaccuuuauauuuauagcaagccuuagaauuagagcuggguagaugucaccucuaugcuauuuugucuacuugucugucaauaaucccuaggugucacuugcuauauccugccuaggccgcuccuacucggacuggcaggcccuccugccuaugugcucagauccaccuacccuuucuccucucuccccauuucucucugccucagaccccaaaccccagccuaccucuaucugcugagcuacagguuguaggcaucuuuauucaaccaaauaguuuuaaauuaaggagcaaggcuugcauaagaaaagcugguauaggugagaauuccaucggcuuuaggugacucgaccuuggggaacagaauuuagcauuacaauauauagccagggaccaaaccuccaccuaaaucacauuggugggauuaccaaccggaggccaggagauccucacagggaccgagguggugugaaauuuaaagaacuucuggagauuuucuguccuguuuauuguggggaagucaggaagcgagagaucccuggcaggccuccugcaggcuaacaguaaggcucuaacuaggcccucuguggccaccacagcagcaagucuguuccuaacagaacaauuaaacucaucugugacaaagacuuucaagcuaggauaguaaccagaaggcaaaccggaauuggagaggcacagcagaguuccugaagaggccacccuuggcugagcuguagacagggccagcagggccagugguguccagguccaugggagcccugagcuggaauggaaacagcauggcuuucucagcggccagaaggaaagguggcggccauugaagcugcucugaggaucucagaguugugcucugcuagcagucugagggguuuucaggaagucagagauaguccaaaugcguuuuaaaauaagcaaaaugcugggaguuauuucuggcaagucuguccuucggggugaacguggucucuaacacaggagguaaagcaggcauccagagauucuguaaaagcaagaagcagcaaagucagggacagacacacuugcuccauggcuacaaagaaggugacuuuagacaagaggaauuuauugucaugguuugggaauccagaagucacagaaccugaaauacaaaggguaggugauauucccacugaaggcuccgagggugagcccuuccuuuccucccccgagcucuccuucauguggucugaggccacguucccagguacagugugcuaggcguggacuagucuugugagagaucaauccacuaggcucuagugugucccucuagugaccagagggaggccauaaacguuuauccaccguagcgggugcuauggcacucacuugucauuccugccuuccaggagcacugcuaggagucugaggccagccugaacgacacuggacaaggccagucaggacuacacaauaugauucucugucucgggaagagaaaaacaaauugagcaaaaaugagcuuuuuuuugguacaaagggaacuaguuugaaggaaacgguguaggaacucugagcagugcccuugaggucagagcagcucagguugagcuaaugaagcgguagacugaaggagcaugaguuagacagacagacagacagacagacaaagccagggaauauucaaggccucagugugugauacauuucuuuuguaguuugcaagacaaaaucaacauggaaaugcauauguuucacuauucauaucacuguucacguguauuuauagauuucaugauccucuggcugcguggagagaaugggacaggaccugccaaguucaacauaccucacagcguuacacuugacgcaguuggucggguaaagccugugucccuguguuuggaacuguguggcuguggguggguggguuggugggcacgucuugguguauguguccucuuuuuguuucuguugcugugagaaaaacaaaacagagaccaaaggaauccgaggaaaaggcagguagggagaaagagcggucaaggcaggagcuucagacaugucugcugucaacucagcagcagggaggaaugagcacacacacgugcuggcucgcucacacucacacguuaucacacacgugcuggcucgcucacacucacacguuaucacacacgugcuggcucgcucacacucacacguuaucacacagcucagcucuccaccuccgccuaggaaagggugccacccacaguaagcucaggguucccggguccaguaaagcaaacagcacagaacccggucagaaguucccacaggcagccugcugcacgcagugcugcuugagugcucucucccugggcgguccgagggugcacauuggccauuaaaggcaagcacaguaggcaggacuaagcaauuucuccagagcuggcugugcacacagacuccuaaaauguucgggcccuauacugaggaaguucuccaaauauuuagauaugaacaagauagauaauucuauauagcuuuuaaauggcugagggaacggguaaugaaucuaaaaccuggaaaagaaacuuugucuucuaguaggaaaaccuuauuguaaguguuugaaagccuucaguucaggccggacgugguggcgcacgccuuuaaucccagcgcuagggaggcagaggcagguggauuucugaguucgaggccagccuggucuacagagugaguuccaggacagccagggcuauacagagaaacccugucuugaaaaaccaaaaaaaaaaaaaaaauguacauacauacuacacacacauguacacacacugcacaacacaaacacauaagacacacuacacauauccacauaucgggaggggagcagcacugaugggagugcagggacugcagaggcugauccugaaggaaggagaagagcccucccccagcuccugcucuuccauuuccuccuuccagcccuggccccuccacugcaccuccuaggcuuuuacucacuggauaaacagaggcgcugcuucuuaggaccuuaggggucaccuucagcagucuuaagcaaguccccaucagcaggcuuaaacucgcuaccuguuuccugugggaaguguacuuugcauuccagucgcugcuguuacgucacagaugcuccuguguagagugcaggcuuugaggcacgcgcugcugaauggaauuugcuuuaccuccaccacgagcucugaggggucaugccuguguuaaauaagugagcuuguggacaugcagugcugggccaggcugcccucugacaugcagugucuuccuugaugcuagcccuauuuuuugcuuuaaaaaaaaaaaaucccauuuugcaaagcacgagagauauggauauaaugagauucauggugaggacagaucuuaggggccagcaagaggagcaggcugagauugcugaguugugaaacugacagcucauucucauguacuuugugauuuaguuuguccguuguugcugcugugggggaggacugauggccuuacacaugcaggagagcaucuuaggacugagcuacgucccuggccccgcgcccugauguucuguaacaguuuaguggcauuccccacauuguaucuaacucauuucaucacuaccaugagccuuuccgaaaagugaauuuacuccacaguuaaggauguauuguuucucagagaggcuuuccuauggucaaaauacugaagaagaaagaaaguaaucugcaauaccauuccaucuugagaugugaguguuucuuccuuggucaucugaggcaggaaucucccugagcaaacccaucacagcuuaggacacuugugugggcaccagccugucuugugccugugucuguaacagccaguggcuaccagaauccacacacaccgauuagaauaaagucagggucacaccaagcuauacaaacccaagaacucugaaggaccugcgagggguguggucugugcuguaaucuauggaucccugugaaugcuauugaggaaacugucugagcucccugcuuuaugauaggagugucuagggaacucgucguaaucuauaaaaaccgcauuuaaaccuauuaugcccucugugcuacuaacaugcccacguuuccuccucaugggugacucucuguacuuuggacccaucccagugauaacagauacaaguuuagaaaugacacugagagagccaacaccuuagccucugagaacaaguauguaccuggcucugucuuggaccuggcuuaggagcugcugcuucaguugucagugauggugaugagacguaaagagacgggagagucugcacccugucagagucucugaucuuuugcacuguguggacgacucagguuuuaucugcuuccacguucaauguagucgauggcucuguuccuuuaggcugacugaugcagguguugauuagacuguagcauuugcacuuccuagugcuuugcagacaagguguguaaccccucugaaaauggagcuuagugaugccaucuuccuugggguccuccgagcacuaacugagaccguguaugugcagcugauaagacuacucguguuucuucucgugcugugggucucuccccauugacauuauuuucuugguuucucagguguggguugcggaccgaggaaauaagaggcuccaaguauuugauaaggacacuggagagugguuaggagcaugggacaacuguuucacagaggaggggccuucugcugugagguaaucgcuccugguuguguuaaaugcuugcuuuagcuggcugugagacccacuucuucugaagaguggccaaaaguuuaaaguguuuauuguugauuuuaagcaagggaaaguggaaggaaacaagaguccaaagagguuagauaucugagaguuccgaauccuuugagagauuccuaaucauaggaggaucucagccggaguccacacugcugaacccgcccaacuucuaauucuccuuucauuauguuauguuguguuuuguuuuaaaguaggcauaucuuuagcuucaucuauuaucacagaauucuauacaauuuaaauucauuaaagaaccccucagacaaugauggccacuguuguugagcauuggcgaguguaagcaccccacacuuaccugccaguaaguacugggccaugauccccugauauggccaggaggaaugaaaccaggccauuaaaggguccacagcaacacuuaagcuguggcaauuuuguugagagcaaucagaucuucuagaccuuuaucagaaguagaaugcaauggcagucgccaggaucaauauaguuguagucaggauacauagauguuugccaacuguacaggcuauacaagguuaaugucuaaggccaacuguccgguuaagcuuccaggcucccuugccuuccaagggaacuuacugagaaauacaaagcggccugaauccuucccugccugagggagugcuucagucucaggaaccggaaggugcauugugccccaggagccaugaacucuaaccugaaaaucugcagcaugccucuccaggcugcuaagccaguccacuccaggguacagccaagggcacacagugaaggcuugguccuuauuaugaauucucuuuccucuuagguucaccccagaugggaaguacuugauuguggcccagcugaaccucaguaggcugucaguguugcuugccccacccuccggaagcaucggagacugcucuguggucagcacuauccagcuggcagaucagguucugccacaucuuuuggaagucgacagaaagacuggcgcaguguauguagcagaaauuggggcaaaacaaauacaaaaauacaucccguggcacagccgcaccccugccuucggcgcuuagugcuuccggcugggaggagcuucggguagcacuucagagccacagggucauuuucaccucuucugcaagaaaaguguguugcugggucaugaagagucauguuuucucgugguuuugggacuugguuuuacaacuaaguguguuucuuucugguggcccugggaguugaacucaucacuuccuaagugcuaggcggcugcccuagcaggggcuacaucuucacagaagcaccuuuuaaaggaagaaaugcaguucuaaaauggggccaugacgggaacugugguuguaaccaagcugcuugccugcaucgauuaacucucucuggguuccugggugacuucauaugaugaguggaaacuacuaguugguuuagccuauguguauuagacuguggaagagauuguguuggggugcgcugcugaguuacugauucauguggguaccaacccaguccagaggauucugaaguggggagcaguguggucagccuugugguccaauagagagauaagugggcgugaugacagcaggagcgaggaccaugaaggacaggaggagcuguguguauguggggggaugggaggauucauggagacggcagucuguggcagccugggccaagagauccgugacaaagggaaacaaaaccguccagguagagaagggcugagacgcacuucccguggauuccgacgagaaaacaacaaaggguuuggucuuuuugguacaaaguauuuaaugucacccuuuacaagcaagacuacaacaaacagccagcguguaagcacuguacugaaaggaagauuugcaggcggguguuuuagagcuggucuggcacuaaguccccuccucagugcugcccuugccacugugcagugugaacucaugucauuacuagcacuuaccuaccucagagacauuucaggagaauuagaaucauuuacauggaagagugccaaaugcuugagguaugacgauggaaauggucugcccuugcagcccacucucgcacuauguauguccuucguaugcggcugcugcguucuuucaguuuguucugcuccauucuagguuuugauagaaccccauccuaucagggucuuuuggucgcccaccccuuuugcuccuaucagugucccucccugucccagaguuugacuuugacuugcacagcacuuuaccccaccuacuccagcugaggggcuuggaucuaccuguccagggguggugguccgugcagugugggcggaaggccagccuccagcagcagaguccuggauuccaaggcuguuaacugugucccuaccucucaccagacugacugagaaaagccaccuuagcuuacucuucagugacgagggagcuucguucuucccucagucacugaugcugcgcuagcucacugacgcugcuuggacuggaugagcagcaggcauaggugucuugauggagccuggggugcauuacaguucugagauggccuucucacugccuucgucauuauaacacaugccagguuugccuggcucuguucaaggcuccuacagagcaaguccucacggggcccgugcgcuugucacgcugcccaguugacuuggacgagaagggaaggugaagcuuguuuuguugguaaaccagacaggaaaugcaggugcccuuuggaaggagaggagacuaguugaacugccuuuguucuuucuacuguauuuuauuuaccugguuagucucgaucauuguuauugaggguuuauaguagauacuguguuuugaucaguuccauccugcguucucucccuuucaguuccucccacccuccaucaccuuuuccucccagugccucgugcacguguucauuccaugaccucggugcagccuggaugugcaugguguaggacacuccucgaagcagggucaccuuuuaggaaaggucccccacagcuaccuccaguagcuucuuaguucgugguaggcuucaugagccccucccugcucugugcugggauuuugacuucugguuuguggguucaguccagcagaugguguucugcugcagacaccuaccaccccuguccucuucugcaguaguccccgaggcuuucaaggauguccuauuuagagccugucaguucacauucucuuauucuccgaggccgaaucacuuguggaucucuguauuaauauccaucuauuccaaaugaagcuuccgugaugagaauugagagaggcaguaacccauggguaugaagauaagaacuucacaguggggcaggucauaguauuagauaguccccuggggcuauggccuugccagccacagguguuuagccaguuagcagugccaagcaagcuuccaucuuuuagaacaggcuuuaaauccagucagaaauuugaugcaugauauuugugcaacucuugguccaguggacacaccuuuaugggccaguccuuacuguagcucucagccuccacagcugguuaugauugcugaacauuuucuccuucagugauauaaauagaaccuucuagaacugugagagcuagcaaguagggaugaagcuuccaggccagugccagcaugauuucuuuacagauucuuacaaaacuugcugcagauauuguucuuguuuaucuuguguggucagugagcuuacaaucaaaacaucucacaccccacacacacacuggaucagugaguuaaagaaguaaaaguuguauuuucuauuggaacauuaaaguugugcaaagaaaaauguauguaaccuggcuccuuguuuuaaguuuuguuauuuuaauaauagaagaauuucaguggccauaagaucucaguuuggugagucugggcauggugguagacaucuguaacucacaacucuggaggccacagcaagaucucaaguugcauaccagcccaguuuuacacuaaaguucacugcauaaacccagggcuaacgacauagcuggcacuaagaauauucuuugucuguggucucauaaagcauaggcugcugagcuguaugagcuaggacagccugggcucacagggaugugugagcuguaugagcuaggacagccugggcucacagggauuugugggccuguccugcuccuaugugggugagcauucgagcccagauccucaugcccacccagcaagugcucagauccagggagccaucucagcuuuauaacuuucuauuguuuuggauuguguucauuuguguauguaucuccuugugggcgugugcacguggaugcauaugucuguggaggcugacggcauuggaguccccuggagcuggaaugacaguacaacucaacucaaucuucuuccgagccgucucagcuccaggagucuggauuuugugguagcaguggaacucuugaaaccucugccuccuaggcuuauucuugacacagaggggaucuagucuauauuagaggaccaagggcugugauuaucuuuccuuccacucugagaaugaacaagucuuuaaaguggaguguuugucaaucagagaaaacauggcuacaguuuaauaaugaacaaauaccgcuuauauuacggucaugcaccaacugcuccauauaccauugcuggaaggcuaaggugacaaagaaccaacuuguugggcuucuucugguuuuaaaaguuuuuuggguuugacuagagagcuaaucaaacugggaacucuuuaaagguuuaaaucagaauuaaaaaacaaacaacaacaaacccugagcuuacguggcuggguuguuuuauuuucagcuguguacuuucagcaauaaucaaauaaaaauuuugauguaaaaauuuauuggcuuuauucauuuuacaaaacauaguuacacgcaugaagguuuuugggcuagugucccugagagcagucaccagcaguacuuccuaagauguaguugguagguauguuacagucuucacccaaaagagggcaguagagugcuguguuuuauccuagguuuaucuugaacuagcuggugaaucacaaugccaggcuuccuuguguucuugacuuuaaaacugaaguuacccugcugaacacccgugugcuuuccuuugucucuaugguauaguuacuauacuuuccuuugucucuauaguauaauuacuauacuuuccuuugucuguauagaauacuuauauuccaaggaagcugcuguacaccuggcacaguuccagcaguugaacauuguucugacuucauuuguuuuucuacaaguaaaagggaaaaaguuugaacaguuuucaguaauccagacauagggaauucaugggcaugaaugugguggauuagucuugcugaucgggucuuugaggcuuguuacuugggcugguugauuauuuuacaaacaagaaaaguggauuauuuaaaaggccaaauuauuccucugccuggcccuuagccaucauaugaguuuauggcauaaaguaauuacuucauaac

SEQ ID NO: 1423 - RNA, 588 nt, Mus musculus
gguguuaaguauucuuucuuuuuuuuucuuuuuuuuuuuuaagcuuacacaaagcaauuuauuaacagaaaauaaugagaaguccuguucacagacggcgaccacgacgaccccccuuucuuccagugcuaucagagggaauggggugacauccucaauccgcccaaucuucaucccagagcaagaagagcucugagggcugacugggcuccagguccaggggucuugguccuguuuccuccuguggcccggaguuugaugugcagggcggugaugcccagcuucuugcaccucugggccacauccugggcagccaacauggcugcauacagagaggacucaucucggucagccuucaccuucaucccaccagucacucggcagaugguuuccuugccagaaagaucgguaacauggacaaaggugucauugaaggaugcaaagauguggcagacaccaaacacauucucucccucagccaccugaggucccaggcugaugaccugcucuuccuucuuuuccuucuuccccuugcguggugccauuucugaucgucgucuccagacuccuccaccggaaagaguaagu

SEQ ID NO: 1424 - RNA, 29944 nt, Mus musculus
ccagaucucuuccuggacggagcucagggcugaagaugguuccucuccugcccuuauaugcucugcugcugcuguuccugugugauauuaacccugcaaaugccaacaguuacuaugacaagguccuggcucacagccgcaucaggggucgggaucagggguaagucccuggcuuguuuuaucuuuaugucucacuuagcuuguucuagaaauaugcgugaaguuccuuguaaaugcaccacaggggagcuguuuuacuuauugcaagguaauaggaaaagaaacaauuaugggucuucuauaaauauacauauauagauguagauagauauacaguuacuaugacauauauaugccuuaaacucauaagaagugcuaucaacauagcaaguauuuuuaauugauguggguuguuaauuuuaauguaauuaacgaaauacaguuugguaauccuuacuaauucaguuuacuuggcauuuuauuucuuuccauuacugcagaauaugguuuucaaaaucagagugucugcucuuuaaugguaucaugucaaagguuuuaagauguccugcaagauaucagugcaaauuuccuuuguuuuguaugugaaaauuuaacucugggcuuuuuggaguauuuuuuuaaucuucuaggauaaauguaggauuuucaaaaguuauuagaaacaucuuaguaacucaagcaaacaucugcacacuuugcaugagacucuuggcauuccucccuaagccuuagggggauuuucauuuuucugaguucucagagcagucugcuuagcaguggaguagaauuuccaucccuuuaagagaaagcaagcuuaaaauugcaauagagaaggauacucuuacuuguucucuuuaaagaaacaaauuucauuuguguaaaggcauuguucaaaaguuacuuuuaacaccaaucuacuucuguaagcaccuagggagucacacagcagagugugaaguaaaaccuguguccuuuaccaucagucuccugcugucgagaaaaauccugaagcuacccaucucccaaaugaauaaaugcuuaguuuuaaaauaauggaauuuuucucuauuaacaguaguuuguacauaaaucuaaacucuguuaagucuaauucuguuaaaauaucccugccagguuaacuuuuugaaauacugguauaagucucaaguauacaguggucuucccugccuuccccuuccucccccuucccuuuucccuucuccucaccccuccccucccuacauccucuccucccuccuauaccccucccuuuuuccucuucucccuccucuuccuaucuuucuuagacuucugcuuuugccagcagcucaauagaacugggacaggaguuagcuuuauacaaaguugagaucucaucuuggaaugucaggacuucacccaaacauuucuuucagucaccugaccuguaauugggaagaggcaggugccauagcaauuaacucuuuuuuuccucgcccuccucccucucuaucuccagcccaaacgucugugcccuccagcaaauucugggcaccaaaaagaaauacuucagcuccuguaagaacugguaucaaggugcuaucugcgggaagaaaacgugagucucacccuuuucuuuauugaaaguuugaagagccuacaggaugguauuugccucuucuugggcacacaccccaguugaagauacuguccaaacucauguguuuuuaaagcaaggcacaugcacaggcagagaagcucccucucaacaccacuguuauaagaguagauuucucucuaagugcauaagcugaagaggccaaagcaggcccugugaccaugugauauguccugaaucuaugugaaaaaaaaaaaauguggucucuacucauuguacacucuuuguuguuuuguccucuucugucuuaagagauccuaauacacucuguguuucauuugcuugucuuauaucuauacacacacacacacacacacacacacacacacacacacacacacacucagaaucaaggagaacaaauugauaugaaaugucaaauuguaaaagcccaaauagauguuucuccagucauuuagacaucaugauaaagauuccacuucaccccugaauuuucacuaagcacaaagugagaaagauguugcacuuuccacaggcugccugauccccaggaaaccauuacagugacagugaagcccaucacuuggucgaauauuccuguagcuaaaaggaugauucucccaugguucugcuguauauuucacugaucaacuuagagauggaaaacaugauugacgauguaguagacauguuuguugauuuauuucacuauagcuauugguaagaaaaauaagaacacuaggucuauaaaaguuaaucacuugcccaauuuaucauuuuacaaagagggugcugucucaaagguaggauagcucaugucaucccaguguugaaaauaauggaagggccccuugcugccaucaaccugauccucuaugagguagccuugaggacuggaggaucugaauauguacuuaagauaccauggugaacuucauguacccucuaaagaggcugaggcaagaagacugccccaaccucuacaaccucuaggauaccuugagcuccaaagugagaaaccuuuaaauacauacauacauacauacauacauacauacauacauacauacauagaaagacaauuucuauccucgugccauugggacaaacacucaaugcagaacuauuuaagcuugggaagucagugaucuuccuauguugaguguuuaaggaaaguauuuucauguucuuucuggaaguuaaagucaucuuauuuucacaauguaacuauauuagagaugccaaaguugucacacaaccaaagucgagucucuuguuuuccauuaaccaaaaguugugcugguagccagacauuuuaccaaaacuuuaacaauguacccuuggcaaaauuuccuccaguugcuuccauuucaaaaucacauuuacaucucuucacugagacaaauacaaaugcuaaccucaacuaagcaaagaaaccaauggaauggacagggaggaagccuggcuugcccuccacucccuuccugacacguccuugccagcaucuucugugucaugcagcuuuuuaaguugucuucugguuaaucagcgacauugggaauuuacuagaaagaaacaggccaggucucaagaaggcaucagcaucccuaggcuuagguuuaaggcacuguuuauaguaauguagaaucccuuccauaaagcauuccacaggcucccuguuggugcaagugacauguucaguuggcuuucugugacauuuuuguuacuacucagauagugagggcaaauuccccaccuccaagcugugcagagcaauuauuaugcuuuuuucuugcuuuaugugacuuccuggccauauagaaaaauggauuuguguguagcauaugugcuuucugugaacaaaaccuaaacguuuuuguuguauuugaaacauccccucagauaaacacauuguccacuucucagcugaggucccaggccacuguucugcaagcucgccccuuccccagcaugacuuuuucugcuucagagcugauuaucagauuguauuaauguuugguguagacauuugucucauaaacacaguguccuguucucaucuuauugaucuucaggucucuuccuauagacauaucuuauguuuauuguuuacaaugugcuuaaaucaaauucacaagaacauucaauuaauuucuacaaagaaguauaauugucacaaggggggcaaaugaagauuugcauuggggucacacgcaguucccuuguuucaguugagacaacucuuugacauuacaaaaaaagaagcuaaaacaaaauaggaaaguuuaaauuuguauagaacaguuaaauuaauaacaauaauugauaaauuaaugaauaauaaaugaugauaauuuuuaaaaguaacucuguaucuuaguuauaaauagagcuuacuugguugacugcuuuccccaaaugcacagagcccuggguuugauccccaacaccacauaaauccacucugauggcuuucaccauagagaaucagggguucagggucauccuuaaguucauagggagcucaaggucagucuggucucaugagacacugucgcaugugggggggagcgaugaaauaagacagaagaggguaaaaaugaauaaacugaucaaaguauaucauguguauguauguaaacacuagagaaaucuauaauccauacuaacaauuuuacaugagauaggauuucauacauuaaagugggcuaguauauuucuaguuucaagguaccauacaccaaugagcauuuugcugguauuuagagcuaacacaguuauccuaaagacaaucuuucgguauucacaacuauuuguauuuugauauuaucauugcucuucccguauuauacuguuggaagacugaauucugcuauaucaagaacauuguuuaaguacaucugucuaguauacagagaaaaugcacacuaaacuccauccuucaguaccaagauccaggacuuuccccccacugccucaagggugcagagaaaaaucaaacuugcauaacuaucugguaucuauaggguagaaacaaaagauggcuucuacaaucuuagcacauuauaggaauaauuaauauucugcucaucuuaugugaaaguacaugguuugcaguucucucuuuuaauauugaaauuucccccccucuaugcagcacugugcuauaugaaugcugcccuggcuauaugagaauggaagggaugaaaggcugccccgcagguaaaaucuacauuucuggauuguacaugggagcuuuuccucugugaggaaccaguucagcacaccaacagugugugcaugcaugaaugugugggugugcacaugugcaugaguguacagguguguguaugcacggguuuggaacaaucauaaaccuaagaaaauucuucaugcuuuugugcuaaucacaugcuuaccauaauggugaaauauuagacggcucuucucacacacagggaucugaugguacuagauacuaacauggagucuaauugaaacuagcucagauccucuucuuugagcucauuuacaagcagggcaucuacuuacgaaggcaacaucucuagcucaccagcucugaauguguaacggcccucgcuuugcaaugugauugccccuaauuuugccaauaaaagaaguugcuuuuucauuuccucuggauaugcaauuccaaucaucacccaucuccagguuccuucuccacaacagaaggaucuccucuuggacauagguccuccccucuaauugcacauaaacucuaaagcacuuacugucauggacaccaacccauagacagucccuggcauaguauuauguucagaaugaggagcuaagcuggugucagcaacgcacacaggccugagcagcugaaaggcuaucgaggaccucacuugcugagacccagugcuugguuaaugcuguuggugaugaggucuuguuauaccacaggcuuucucccaugaaaacuguugggcucaguuuacucuaggauguguuuuguucaauguaggcauggacuugcccugaaaccuuauuaaauuuaaccuuauugguguuauuuugcuuuaugauuuaaucuaauaauugucucagggaauucacuaaaguagucauuuacuuuauggcuaguuccaaaugacucuaauuuuaaaaucaacggcaucugaaaagcaggcagccugcagagugcuagaucuaucuuuucagauuggcaucagguuggcuccaggacaaccuucuaaaaguaguagauauguuuuccuuaaaucaaaauggagagagccauguccaucuauugcuuuagggaccaagaaccauaacaauuauagguauaaaccuaaccugcugcucagagacuugacucagcauugccgcgcacacguuauccuugccagucucaaugaaggcaagaaacaccuugucuuuuggcaaaauaacuaguuauauucucuaaaaaugcugacugaacuauuagugagguggcaggauuuacuaaaugcuacuucaguuugauauuuuaaaacucacuuccuuaacgccaagaauauaagaaauacuggcgugaauagagcuuuauuauauaauacucaaaaugcacauuuuguguauuugugcaaaauaggugauuccugggcucuuacugcuuaaauugagcaguucaauauauuggugaguagguaaaguuugaaugauugugaaggaacauucuggaaaucaacuucuaagcauuuguucgauucugacucuuucagugaugccuauugaccauguuuauggcacgcugggcauugugggagccacuaccacucagcacuacuccgaugucucgaagcugagagaagagauugaaggaaaagggucauacacguacuucgcgccgaguaacgaggcuugggagaaccuggauucuguaauucagccuuuucgcucucugaggcacuuacugugggaugcugccauuuucauguuaauugaucaacuuaugaacaauccaagaacauuuaauauuucucuauuguauacuugaaaacauuuuuaaaagugucauugggacaguggcauguguucacucugucauaggaaacaaucucuuuaaugggaagaucaaugaacugaaagaauauuuaguaguaguaguaguaguaguaguggugguggugguggugguagaguauuuuauuccucuucucuuaccuucuuugcuguaagaaaauauaugccauuucagauagcauguccauuagaaaggcaaguuaaaaugccuaccuauauuuaaaaaucuauuaggaacuauauuacaauagcuguauuuuauuauaguuuguaaauaacauagcuauaaacauaguugcauuaaaugagaagcuauaauaaauaguuuauacuuacuuauuuauacauacaugccacaugccacaugccacauagauugcuguuccaagauugucagaauaguagaugucuaucucuguauauuuaaaccaaguguuauaaacaauauuugauuuuaugaacagacuaauucaugacagaguaaccuaugaaggaaggaucccuuaauuuccggcuuuacauaacuaguagagaaauguguuucuacacuaugcucguguggagaugaacccacaaugucaaggguggcucagcgaagccucucaggcacaguguccuguagcuuugcuguguuaaugcugagucauggacccucaucugcucugcaccucagccccuccagguuccuucagaccacgccugggcauccucacauuagugguaaaaguuagauauuuccucccagaacuguagccugcccauugcccgcaccuuaaaaacuuugccucuugccuuagugugugcaacuaugaaagcugugggauugguacugguuucccuaggaagcccagugauucuaaucugcacauuaauacuacuucuucaacauaugauauggcuacauaaaugaagauugucucuucguaaauauauuuaaaaggcuuuuuuuuuuugcccuaaaauuauccaagcauucuaucagauuuggaacccuccagugacaccuuggaauuccaaaauuccucagucaauugaaauaauauaauucucuuauuuuugucaguuuucuaugaacaagugauaauguaacaggaaggucacaaaagaguagaaacagggguuuggagagcugacccaacaguuaggaaugcuugcaaaggagccaaguuugguucccagcacccacguuagcagcucacaaccaccuggaacaggugccagucuccuccacacacucucacacacauaguguauacagacaugcgcacacacacaagugaaaauaugucauagagaagacuuccauagcaaaccacagcagauuaacucuuauuucauucuuccuaggacauucgcagaggacuggagaacaaugucaauguugagcuacugaaugccuuacacagccacaugguuaauaagagaauguuaaccaaggaccugaaacacggcaugguuauuccuucaauguacaacaaucuggggcuuuuuauuaaccauuaucccaaugggguaagaacuuaucuauuuauuuauucauucauuuauaaaauuucuauuuuugagucacuuuuuuuuaaaaauuuuaucugcucccuugagcagaaauuguucacaggaaggauauaauguuuguccaugugaggucaaugcuuguauuaugauuaagaagaaaaacacccuguccauguaaaauuucaauccaacucuuaaagacagacugauuggcaguuaggggcaauguguguugagcagguucuuacagacagugaagugcaccaucagcagggugauugauggcugcccucuacucgcucucugcauagcaugcuccuugagcuucuugugucuuuguauuaguaagacuauggcaaguugccaguaggacaucaggaguuuuuuuguucgacauuaaaauuuccagagaugaaaauaaagcuccagagaggaggcaguacuauuuauuguucaguagaccucaugacaguuuugcaauggugauuuucauuccucucucagaauucauuucagagcuaauuugaauucuuuacacaagacucuggucuacaucagagauagucuguaacuguuuauauucaagaauaaaaguaaauauaaauuacucaaaugaagaaaauuauuuggauuuccagaaaugcuuuugacugacugguguucuaaacaguucuguuuucucuuaaacaauguucaagccuuaaucgagagcaucagcacucagcaugcaggcuucuuacauuauaccuacuagauccccagcauaggcacucagcauguaaugccuuacaccacaccaacuaguacaaaugggaagguggaaaucgccuuccugucuuagcagucaaugacuagaugugacuucuuucacaugauugcagguugucacugugaacugugcucgagucauccaugggaaccagauugccacaaauggugucguccaugucauugaccguguccugacacaaauugguaccuccauccaagacuuccuugaagcagaagacgaccuuucaucauuuagaguaagaaccguggcagaauccucuaagucacugaaacgcuuccuuccccugacaagaucuguagacugucagaaaaugcuacucaacagaucuggcaaacugcaccaauauauucaaugaaauaaccauuucuauuucacaaaugagagaccaucccacauauaguaauaguacauguuuaaacaugauugauaaagaaaggcucuuuguguggcuacacuaugauuggaaucuuuagaacauguugguucaaugacuaugcauguuguuggauuuugcuacaggcggauaaacacuggcagacuuuccauucuagccaaugguuugaggagaauuaguugggccaaaaaguauaauuuuaaccaucuaacaagagcagaugucucuggugaagcugugaacucccuccugacacacuaggccaagugugugacaaguuuccuuuggauuugccaugccauccucuaaaaguccucuguguuucaggcagccgccaucaccucugaccucuuggagucccuuggaagagauggucacuucacgcucuuugcucccaccaaugaagcuuucgagaaacugccacgagguguccuagaaaggaucaugggagacaaaguggcuucugaagguaagaaaaugucuuccucucccagaauucucccagagacuuaggauggaggcaauggaaaaagaccagucauugucaaugaugagagcugugauaggaaagaccaaaagcauuuaaugugaggugcucuagaaaacaucaugcaaaggauuggaagaauaggcaaguaucacuguuaacaaaaacagcugugaggcugcagucauuuguguuguuuccaagcaaaucaguuacagaugugaugaaaggguguaaggagccagggggauggcucagcacuuaagacugcuggcugcuccuacagagguccugcgaucaauucccagcacacugcaggauuccaaggaauaggauucucucuucuagcuucuguaggcaccagacauguauauggugugugaacauacauucaggcaaacacucacacuuauaaaacaaaauaaauaaaucuuuuuuaaaaucaaaaaggaaaauuaaucaagugugggggaguaauuuugggagugguuuuaauauggaaugccuauuauacaauacuuuucagcucuaauuuuaugcugaacugagaaaguuauaugguucuuuuagccacuacauaucgauucucaaauguacuuggaucuuuuccaaccucccuuucaagagccaaauagucuuugccuugugcuaacuaauuuuauacacucaaucuccaaauuaagccgacaagcguugaagauguaagccucaauauaauaucaagggucagagagauucccccaggugcuuuucaugaaacugucugcauuuucuaauguugucuggggaaaauggccugccuugcccucagguucuaaaacuauauucucaaucaugaccagucuuuuggaaguaguuaauacaacauucuauuugaguguuuuauaagagucaugacuaacggguaauuucauaaacugcucaaaggcuucuccuuuuucucuuuucauuccuuuuuguccuccugauguugcaaagaauaaguuugauuuuuccaccccuucucuccccagcucucaugaaguaccacauccuaaauacccuccagugcucugaggccaucacuggaggagccguguuugagaccauggaaggaaacacuauugagauagggugcgaaggggacaguaucuccauuaacggaaucaagauggugaacaagaaagacauugugacuaagaauggugucauccaccugauugaugaaguccucauuccugauucuggugagcagagcccagccaccauuccccuuaccaguuaagguaucuggagagcaaauccaugaagaucuaaugcauagcucaaagaacaaacagcaaacugucugugcgcucacuaagugcuaacuccaaagccugggcagccaugcacagcccaugcaggaccuuggcccagcaucuaguauuuauaaaggguuuuucacacugcuaguguauugcuuggcaacagaaagaugacaaacugaugguaaacauuaaguaaaagaaaggacuugccacucacaauguagaacgggcugaaaguugaguaauguucacgaaaacuacacuaggacgacagagaaaaaacugccuccaaagugauuugaacugaucaaaccccccacgugaaaacuagaaccuucauaauaaggaagggaaggggguguuuuacugcauugacacucaaguaaauagcuuacaagaguagaaaagagccaggcacugauuuaugaacgcugggagagggaucguaacaaugaggacauuguugaaaugggaacuguuuauuuuacagccaaacaaguuauugagcuggcuggaaaacagcaaaccacuuucaccgaccugguagcccaauuaggcuuggcauccucucugaagccagauggagaguacaccuuauuagcaccugugaacaaugcguucucugguacgugcuggguucuguucccacucccuucuuccuuucuucccccuugauuauucucaacaagaaauaauagauauuuuagaaaauguugguuagauuuggugaucuagaagauaccggggucaaguuauaaauguagaaaaucaagagacgguuacuugggaccaugaugugaaguauguuugugucaucuaguuauugguacucacugacaauauuuaggguauaugguaagaucugguucuaaaaccuuauuucacaggcauaugaggaggaaguguuuagugaacaaaagucaaauuuuuaauauuuuuaaauacuaaguuguaauauauaaaaugauuaauuagagagauuagaacuucuagaaauacaguauuccccuuagaaugauaaugagcauguguucuggaucuaugacacauucggagucugugugcuuugaucccuuagccaguaguaaguaugaacuuacaugugacucaucaacagucacccaugugacuaauggacaccugccagaaaaauauugguacacuauaaagguuuagauuuugccaaugaccaccaugaaaguaaacggucccuauguagaugaaguuauuguuugccaauaaggguggggugauaggucaguguguacugacagauggccauguuggcuuugggugucuaacugacucuuucaugaugugagugagggguacacuugcuugaauagcauuagagacauccaaguuucuucuccugccaugcucucuguaggugauaauauuccucccuaauaaauuuauucacagaugacacucugagcauggaccaacgccuucuuaagcuaauucugcaaaaucacauauugaaaguaaaaguuggccuuagcgaccucuacaauggacagauacuggaaaccauuggaggcaaacaacuccgagucuuuguguaucggacgguaggugaaucagacucgaaacuaacauccaucuacaguggucugagagucacauggcauaugcuggucaaagaauugucacuaagaauauuccucacacacaugcaaaugcaauuguaaaauuaacuguccauaugaucagagauaaagacaucucagcagaaggaacuuaggagagaguaccaaugugcugugaaucgcagauaacuagcauuugucccaguuaacaagaaacuauguucugaaauacucauuuaaaucccagaagauuccccauagcguaagcauuugccucauagaauacuuuguauuuuauaggacugauuuuuuuaaaaauuaauuuuauuuguaauucauuuuuuuauacuccauauuccauuccccgccccuccccauccauccucugacuguuccacauaccccacccugucuccacauggaugcagcuaaaaggcuucauggggagggaagcauugccuagaaauggaaguggcaggugguagcuagcucuuuacuaaggcuucaggauagcaaggcacacguuucaaauaauucagaaagugagcuucacuucuaauuauauguguacauauauuaaauuauacauauauauauuaaacaacacauauauacacauugaauuauacauaugaauacagugauauaugcauguacuuuauuauucuuuauauuagacaucugaaaucauuaaauuauacaugugcacauauuaaauaaagcauaggcauacaucaaguuuuuaaaaguggaauuaaauuaaggauuagacauauaauugauuggucuuacagucaagaaaauuuaaugaauguuaauauuauaugacucacugaauucuggaauauuuauagcuaauauuagcauaaagaguagcuaaacauggaacaggaugauggggaaaaaacagaauuagaauucuaugcaaagucugcagucugcugacagaaugcagaagccugaugcauaacguggcugggcuggaggcaggaccagaugagaaaugcacagucaaauguucaagacauuacaaacaagagagaagaaacugccuucucuggccuaguuacucuagugaccuccuggaagggcuaccucccaucaaacacacaaaggggcaucauuggucuuuccucccacugcuaggcuaucugcauagaaaacucaugcauggugagaggaagcaagcagggaaggaauggugccauucacauauuccgagaaaucauccaaccagcagagaaaucccugcacgacaagcugcggcaagacaagcgcuuuagguaagccuaccaccugugccuguauugcucacuccaaugauacacccacaacacgacccugacacccaagacgaaaacauucacaagacaguauccguagauugggaauuacaggcaauuaauggcuggugagggaaggagaaucagccuucuccagugaagagcccccuaacgggacaucuaaccccaugccagcccuaaacacacacgcauauaucagcaacaguaaauggacucauuaggcucugugugugugugugugugugugugugugugugugugugugugugugacaguaauuaaagaacaggaggucaugaauuuuaaguguggggacagcaacacaggaauaaauagaggggagaugggggauggaaaugauaugaauacaguacucacuaauguaauucuaaauaaaaauuaaguugaaaauuaaaauuaaauugaaaaaucaugcaaauauuuuaaaauuaacacguuucaaugauauuugguuuguuccugggguaucauaguaugauuugguggguagaaaaaaaaaucuaauaaucugauuuacuccuugagauuuuucuuauucuuguguacaugguaauaaaaaaaagauuuuucaauaaaauaugaaaugaaacaagggcuuugugucacagaaaaugugacuuugaugcuuuuauaagaaaagcgaagguggagaaauucaaauuauauauuucaguccuuuccccauuauaaaucuuuaacagggaaauugcaccuacaaaaaaugugucagugauuucucgcuguuucaauaauauguggauuccacccugcgcuguacaugguuaagugaaucuaaaucuaacucuuaugucaaacuaaaugcauauucucugugcuuagcaucuuccucagccuccuugaagcugcagauuugaaagaucuccugacacagcccggagauuggaccuuguuugcaccaaccaaugaugccuucaagggaaugacuagcgaagaaagggagcuucugauuggugagugaccaugaauggcagauucugauuggugaggggcagugaauggcagauucugauuggugaauggcagauucugauuggugagugaccgugaauggcagauucugauuggugagugaccgugaauggcagauucugauuggugagggacagugaauggcaaagugguuuccuuaacugacuuugguuuccauuauccuacgugggaugugaggagagccauucguuaauauuauucacaaauugcuuacugucauacuaauuuauugaaaaacauacaauuguaugguauaaaggggaacuguuuuauuuucaagacuaaugggcacaguuugaauugauugaaaugacuaauguuuugauaaggcauuggaaucggugagaaaauguugaccuugugaaaaaaaaaaaaaaaacagaagaggaaaaagagacaguguaauguuuuauuccuuagaucuuguaucaaaaugucagagaagcaacacauuauuaaaucaauaucugucuuuucugcaggggauaaaaaugcucuccaaaacaucauucuuuaucaccugaccccagggguuuauauuggaaagggauucgaacccggagucacuaauauccugaagaccacacagggaagcaaaaucuaucugaaaggaguaaguugcuagaaggaguuuaugaagugcuuaugaucauuaaauggucuacacacgguuucuccuuaccaucaccccuuauuuugaaagguaaacgaaacgcuucuagugaaugaguugaaguccaaagaaucugacaucaugacgacaaauggugucauccacgucguggacaaacuccucuauccagcaggucuguaaagauuaaacacgcugauagacugcucaaaaugagcuuggguuguuuuguggguuguuguuguuguuguuguuguuguuguuguuguuguuuuucuuuaaucacccauuuucuuaccauacucacugaguguuuaucuccguagauauuccaguuggaaaugaucagcucuuggaauuacugaacaaacugauaaaauacauccaaaucaagguacagaacgcuaucagauuuuauuucuaauaugucaagacuguauugugggguuaauauaaaagacuagaaauuaguguaguggauuacuaguauaccacugguauaauguagaaaauaggaaaaauauaggauauuauguauauuuaacauugguuaauuacuuuauaaucuuaaaacucuuaguaauaggccugauuguuuugauggcaccugaucugacuucauuucuacugagugaccuuaacuauuuuuauuuuaguuagaauuacaguguucuuggugugcaauacacuuucuguaacuaaacauaaacauuuauuuucaguuuguucguggcagcaccuucaaagaaauccccaugacugucuauaguaaguauaugaacagcuugggcuacaaauagagaugauaugcaaauaacuucucuuugcauauacaaagucugcugauaaucugguauuuaggauuccaaauucucugaaacucauuauccuucaaacagggccugagaucagcagaagccuuaaaggcuuagccacacccuccgaguccacugaaccgagggaagucaauuaaaagggcauaaaaaggacaggauacuagaagacaccccagagcuuucuggaaauguuaaugaguguacauaaacacagcagcacagcagagggcugccacuuauccugcccugggccugagcugugcauaggaagaugugcagagggugcuaauuuuucccauuaauuaauuaauuaauuaauuaauuaacuuuacauccccauugcagcccaccaccucccaguccaagccucacauagccccuccccucgcccuccuccuuccccucugagaaccugagaggucccuccuggggaaccagcccucucuggcaccucaagucacugcaggacuaaguacauuucucuccuaauucuuaugagaugcugguucaaaaaauuaccacauccaaaacugggcaaaggaaccucaaaucugcuaagcaguuauguuuuaagccccuacaguaccagauuaucaagaucaaaguucaacuucuuaaccauggcaaggacauuucacucuaaucauaaaugcugcugucaaccaucaaauagcuuccucauugugguuucucguuccuaccuaccucucuacccugcuucuuuuacuguagcuuuuaaagcugaaguucuuuucauuuuguuuuggcucuacuccaaaacagucaaauauggugaaauguuacuccccuuuauucuaacuagaaaauuauucuacucaguaucaugaacauccuuuuaucuauuaugagcauuguccuucaaaauuaaugcuggucaugaaaaggagaaaagccaauguauggagcaaaacaaaaugucugcuucucuacuugauauaaccucugccaugguggugccagacccugagagcuaucuaagggauuccacuagaaucaugaugauuuagcauuuucuaaauuccagccauggaaauauauaucuuauaauaaauacaagaguccucauggccuccauccaucagauauaaaugacaccauccuucuccccugugccauaaauccuuaggaaaguaguauuuauccuucuuaguuuaucuacauccauucuauuacuggcugcacauggcaacauggcuuauaaugaaccaaaauacuauuauaguauuucauaaacuaugucuacaaaauuauguaaaucuaguaacuugccagcccacucaaaggccuuacggagcuaugggauuuauauccuuaugcuggcuguuucaaauagagguacaggccgaauaaaacaaagauuccauuuucagaaucauuuguuaauuugucucuauuauuucuucuguuuuguugguacuuauuuuucuuguccccucaaaaauaccacacauuuuaaauuuuuauugggagcacacuuuguuauaaguugucaaaugcaaaaugauuuuacauagaggacaaagaucaggaaaucuuuagagcuguucaaaugacuuaagccuucacaaaagcaaaacugucaauuaugacccucaaguucaaauucccuagcacguaaaaccuuaaaagugauuaauguuuccacuugaacaacagcagcaggucucuguguugcuccaggggcagaguccucuauggcagaaccacuuaugagaucaagaacugagcaugcagauuugacacauuuuagagcuuuauagucugaguuuuucaagagaugaucuaugguugaaagguaguccccauaaaagaggagcccacacccauucaagagguugacauggcuuagcauguaagagcaggggcagagacugguagaaauccacagugugcuacugacucuuugucacacgcaugacugaaguuggcaacccuucuacuggaaucaccuuuuaaggcuucuacuuaggagugcagaggccuaaguagaacuggugaccuggcucuuacauaaaaauaaaauaaaaacaaccaacaaacaaacaagcauaaaaccauccauccaaccuaaauccaugauagccucacuugggagaugauauacauucaucauaaaaccuuuacauggaaaccuaccuuaaaauuaucaaaacaaggcuaaaaauuaaauguugaccaacucacaucuguugcaaaaagcucaugacuuccuggcugaaauuuauccucaucucaaauugugaauucauuuccauauucucuuuucugugccaaaugcaugggaguauuccaugggucuuuuucuucccauauccuccuuuuaauugagaaauaagcugacaaagcaauuuaagauaguaugaacugcaugagauuaaucauguuuauuugucuucuguugcugugcagccaguguucucaagaagcacaaagggaagucagagccuuagugaugcaguugagagugguagauuucuagaugggauguggcauuuaguuagcaugucuuccccucgggaacguagccaagucacugaccugcaggauucagcaucuggauaugagaagacauuaaugugcugugacuauuuccugugacugccugacccuagcaccagagcugauaaauuaacgccugauagagaccaaaaaggacaacuuuauccgaguuguuucuaguuaaacuucguucaugcuccacuuucuauguuuucagcaacuaaaauuauaaccaaagucguggaaccaaaaauuaaagucauucaaggcagucuucagccuauuaucaaaacggaagguaaagccaacacucuccaugguuccuuacauucuggaaaaaacauaucauguaaucaacucaucucucugaauauaccuacauucuuuuugaaacuaacaugcuaaacguuucucuacaaauggcaugcuuguguaauugcagauuguggagugcaauauuuuuuuuagcaaaauagauggugcaucccuaauauuuucaguacauuugcuuguauuuauuuugaucuaauugagguugugucaacacugguacccagauaaucacuuaaaaauuaaucaugaauauuuuugcuguagauuccuucagaaaauauacuuucuguagcuuuauuuccacccuuucaucaccaucgcacauucacuuuauaccacugaaagaacauugcuuaaaacuacacaggcauccuuuccaaugagaauucuaaaaggguauagaagguguacacucaugaaagcuuuaaaaauuacaauuaacaaauccuuuaaaacauuagauuacgaaagcagaaaauaguguuauuuaguaggucaaacucuggauccuacaucucaucucugaacauacuuuauauaccucucauguuucaaaugucaauguguuucuauacuuacuauauuaacugaugucaaccuugagcaacaguguccacuuucaugcuuguugcagugauaauuugccacagcgaacacaucugcugucaucuuucuuccaugagaaugaugcaaacagucuuucuuuuuugugucuauauuuuuuuaaauucauguuacaucccaauugcagcucagucuuucaaaagaggaacagauuaugcuuuauugaaucuuaggaacucuguuguucuaauuguccuuguauuuggguuucuuugugcuuguuuuucauucuguggcaugagaugccaacucaaaauacaugugucucuucccuuaggcaacccugacuuaaacucguugaaaacauaaaguugauucucugacuggcuagcuaugggugucauucauucuugagucuacaguugagucauccuuuagaaucugugcuuagcuuaaaaaaaaagaauuucaauuauuccauugcuuuuuauuuauugaugaguaaaaaaaauugggguuuuaaguagaaauuaaaucuaaaguguuuugauggcaauauauauuugauuguuagugaaaauuaucaaccaaauuuaggcaaaaauauuggauguuuuuuaaaucauagucaauaaaauuugcuauaacugauacacagcuucuaaaacuaaagucauccgcaggugccauugucccauuuccaaacacuuuucuccuuccauucaacuucuucacucaacucauguguccucccagucuuugucaacagggguaugugugucccucuucaguugggagcauccuugagcaucagucuaccugggguucucccucauaauuaucuagagggugauagggucaucucaucugcaaauauucuucauuguaggaccauaaaacaacauuucuauguugcagcaucucaaagcagagaaauguccauccccagaguccacccauggcucucauccucucucagcauuugaacucuauggguucaaugaugcuuuuuggguucuuacuaaaugugucagaguccaagacauaauuuuaugauuuuuuuugucaaaaagacacuaaaucaaaauucagaauuaagaacaagucaucuaaaacuuaacaaaugaaauaucuauuucauauauauguauauaaaacaucuaguaaaaauuucuucuuuuguaguauuugauaauaggugcuuccagaauuucaacuuggcuuuuguaaagaaaaaaaaaugccucagucacagugcuaacucauuuccuugucuugagucacugggcauacuuccuuuugaggguuaucacauguuaaaaccuauucauaccuuuaugcuaaccauuccuacuggacucacguagaaaacacuacggccugaaauacuuacagguuaaaagaaccuuacuauauagcaauaaugucuuacauuauucaucauuuauuaccuaguucuggguaaugguguacuuugaugauuucucaauaaacaaaucaauccucucaagaugaguaauuauaacuccauucagcuauugagaaguacaaguuaaauguacugaacugaauaauucucacugcuccauaaaauauuccugaucaacuaauguagcaguaagcuuucuaacauucaaacugauuuucucugggaauaaaaucacuuugcaagucaaacucaacccccugugcuuuugaaggauguguaacuguuagugaugcugguccuuacauccuucuccuaguccagguaaguacacaagucaguuuuccucuaaggccuaaagcauagcaucuucaagguaaguagaguagauuucuuuauguccagugcuauacucauugauaauguaagaucaggaaugauaaaaagcauuaaauaaaauauguuagcaaagauuggcgcgugauguccucuggaaaagugugauuugaaccaguugccacuugagcgucuccaaucuguaaaugcugauucccagagaaagccacauaauacauucucuguaaucauaccuuauagucacuaacgagggaugacggugugcaugcacggcuugcucgugcaucacuguaaaugcuaaaguggggguggggaagcugcagcauacugaauccuuugguuccccaaauauugucuaaccuaaaaacaacaggaaauguuuaaaacugguuucauaaaaccugaaacacugaagucugaauaacaagaaacguggaaauaaauuuacucuuugggaaaguuuaagggauugcuucaaugcacuaaucugucuccucuaaaauaauaucucaggaccugcaaugacgaagauccaaauugaaggugaucccgacuucaggcugauuaaagaaggcgaaacggugacagaagugauccacggagguacuuuaugccuucugcuuuuucuuaugcuggggcagcauccccggaacguuuuaaaguaguuuugauuuagaauuuuucaacagcgaauuuuaucuugaucuaaacuuuacacaaguugagaaauuuguuuuacuagguaugaguucuugcuagcuaaucaggaauauaguguagcucguuuuuaaguguguucaauaauaaaggauuaagcuccuggaucacuucuuauuaauaugcaaaaauggcagucaugaaguauaaggaucacaauaaugucaacacacaaagacauauuguucucagaagagaagggguugaugguuuuuuuguaagacucugguaauaagggcuggugagauggguuaguagggaaagauaucuucuuccgagccuauguuagauccuugggucccaaauggugaaaggaauuaaguugucucgugaccuccacagguacaccauagcuuacacacacaaacacacacgcacacacacacacagaaucacauaauacauacacacacucacauaauauacacacauacagacacuugcacacacauucacauauguacacauauacauacauauauacaugcacacauaugaacacacguacauacacacacaaacaugcauauauucaugcacaugcacacaaacagacacacacauacacacacacacacacacacacgcccuaaguaaaaugaaauugcaauaaaccuuuuagagacuguccuaauaaaccagcacuggguuuucuaggaagguuuccuuuccaaugacagcucagcuugccaguuaacccuccugcucaccugagacacaagaguuacucagacugaccaggauuugcuccuagucuguuccaacaauggcuagggcugucucuuaaacaaacguguuaugagaaacacauccuugauuuaaaucuccagcucuggagguauagacacugugagaggauaagucccgugugguauucuuucucuucuuucagagccagucauuaaaaaguacaccaaaaucauagauggaguuccuguugaaauaacugaaaaacagacucgggaagaacgaaucauuacagguaauuuuuaauuuuauauaugagcuguauccagauuauaaacacaaguuauauuaacccuaggaugugugcauuacacaaaucuagccuuugucauggugacaauugaagcuucuccauuucccauuuuguuuuuugcaaacaaaaagaaaaaagaaaauguacaaaauauguuaccccucucuuacucuaagacuuuugguagacaugucuguaaacaugcauuuuuacucuguguacacauacaugcuuuaugauauucugccuuucuuuuacagcuucccaaguuacugaauacuaaaagaaacuuccuuugggguucuauucaugcuacagucuguacaucuacauagcaucguguauaugagucucucuaaaacagcugacaaauuuaguaaacuuugugugagacuuacaucgaugauuuaaccuaaaauucuaaauucaauauucuauauacuuuauuuaaagaagcccacaaauacagccugugccucauauuuugcaauaagcuuuucuggagcacagccuuggccaucauugguaucgugccugcagcuacacucacucagaggagcugaauggucgcagcacagacgugugcccacacagccuaaaacccucuuuccuuuagguccugagauaaaauauaccaggauuuccacaggagguggagaaacaggagagaccuugcagaaauucuugcaaaaaggucaguaugucuagagaagcaagaguguggcacugagccaccuguccccuaucucacaucagcuugaagacugagaacaugucuuauaccaccuugcuccaggauucauauuccacaccagcauaaggggucauucaaaaauagagaugaugccagauaugguacccacgcagaugguuugcugguauagcaauggcagccaucuuacauugccuguauaaugauuaacugcugaugaaaacacuguaccagacaccaacacuaaaaacuuaggaguuguugagaagugucuggaauucccuacugagcagguggcagcaugcauugugucaaauuccuuuuuauugugugacccaauuucugcugugaacauguguccucucagaggucuccaaggucacaaaguucauugaagguggcgauggucacuuauuugaagaugaggagauuaaaagacugcuucagggagguuaguaaacaucgaaaacuaacccccuuaacaggcgcuggaagagagcuucagcuuuuuaaagacuggacauguaggcugguccuuucauucgauuaaaaagacagcgccgucugcugucuucggcaaauugacucguguguguaaguggucaguccagaaagucauuaaaucuuaaaccugcuuaaacagucuuuaaaaaguuuuaugauguaaaaccuggaagcagugaauacuuuuuuuugccuugacucagaaaacgaaacagauauuuugacuauaugaaaaaguaaugauuuugcuaccuggcagacaaguuuaaauuugaaaaugcuuuucauguuucuaaaaaaucguauucacuguccccauaacaaagacaggcauguuugggaguuuguaagugcguaguuaagcauuaaaaagugcuuuuagcaacuugcauuuccaaagcuacauucuuacaagugaauauguauuccuucuuacuguuugagggacaaucuauacucaggauuacaaaaucuuuagcauauaaaauuaaucuuugagguauggaauguccucugucuguggcauuaaauugacuuacuuucaaaaggaaaaaaaggauucaaaauauacaaacucucagugauaguuauucaaaaauaggaaauguuuuaaaaaucauugggaccauugacagcuaaauaaacgcauauuuaguucaauuuacuaacaacaaaacaucagacuaaaaauuauucagaguacaagcaaauagauaucuacaacaaaucuguucuuuccaguauguuauggaucaagaaagacaguugaaaucugauguuuaccuaaaauccaguucggauggcuuuugguugauaauuuaaaaaguuguauaacuaugucuaagaaaauauaauuucucuuccaucuuaaaucuuguauauuucuggauuggugaaauaauucuucauucaaacaacaguguauuuuuaaguauacauucacauauaucuagaaaguauuagacuuccuuucagacugcaggaagccugugguauauccuuagccaugaugaaaccaauggcuucuugacgaugcagcaaaggacccacuaagugccucccugcuauaaaaccauagcagaccuuaaaggaagagugaacacauugaggaauuuaauuugaauccuuuguuuuucuuuauaacccuugccauagucagcagcuuuguggaauggcugugcuuucuagagaauuuauuagagcuugucccuauuuauauuguuucuccuuguaggauuaaauaauggguaaguauguuuguccccuuuaauuaguaagacucugaaagucuucuuugaaacugaacuuaaauauuaaaaaaaacuuauuccccuucccaggauauauguccauuuaaaaaaugguguuuucucuuuaauuaaugggguuauuuuaauuucuguuguucucaguuucuuuacuucuauggauaugaccugucuauagaucuauggggaauggguuccaagagugccaauuuagaagguuuagcaaacuauuuuuaaggauuuuucuuuucuuaaaaaggaggaugugggccuggagagauggaucugagcuuaagaacacucauugcucucucaggguaacaggcucuguuucucagcuuccacagagcagccuggacugccuuuaacuccaguuccaggggcucuggcauccuuuucuggucuccacagguacuacauacaaaugaugcauauaaacucacacccaugcacacacauacauacacauaauaaauagaggaggccuuuaaaagauguacuauaguaacuagugugugcgauguaguuucuagcaucugggccugagcuagauaaguuaccuuucucuuucuagcucucuaaauguuucuucucccacauccacuggagagucacuuccuaacacuuucauguugagauaucugagagccaggaaaguaaacucgggcucugaguuuuacuagaauuucauucugagauguuucugaaccucauugaacauuucuaauuuggaugcugccauagcagaguaauaauaauugguaaaaauaaaaaaauaaaaaaaaacaccucauugucagacucuaccaaauuuuuguaaggauaucugaaagcaguuguccauuugaaaagggaaucuagaagauucuuuuugaaccugauaucaacuuuucaaucaaauauaauuuaauaaacuuacuauaaaccauacccuuauucaauauuuaagguuacaucaucuauuucauugugaugauacuuuauaaaccauuauuuuauuaucaaauaaacuuuuaguuaaggaaaauguuuauuugauaugcuuuaacuuagauguucuaauucaauggcauuuuccucuuauuagccaaucucaaagggguuucugugguucugugucuaaccauagugcuaacauauuaugacaaauaguugcacgccuuauggagaauucacauguuggaaauguauuaagacugggacaaagcucauaaauuauuuaaaauauagugggguuuuuuuccauuugcuuucuuuuguacaucuugcacuaagucuagugcaagcauuuuucaaauguacaaaauugaaaaaaaaccaauaaagaaaaaugguuuuauuguuaaauauugaugauacacacaaaccaaguaaaguuuuaaaggaaaguaaaauggaggcaauccaaaaaaaugaaacuaccauaggaaccaaucagucuuuaaucccaguuacccucaaaaugaagguaaagugugaucuuaggcuuacuagguagucacgacaggaguuagauuaaaacgauuagagaauuguuuucuaacuauaaaaacacaaaccauaugaacacuuugaaaaauggagaacacuggggcuggagagauggcuugaugguuaaaagcacugacugcucuucccaagagucuagguuugagaccaagcccccaaaugacaguucacaucugucuguaacucgagaucgaugggcucuacacugcugugcucugcagacacugggcacacauguggugcacagacauaugugcuucuaaaacaucccuaaacauaaagaaaauguaaagaaaagugaaaaguuuuaauauuuuuauaccuaguuaauuugucaaugguuuauuggauggaccauggaaucagggggaauggacacagguacacuucuaaauugcucauggucuauaaugaaaauuuuacagaggcacauauaugcauauaauaacugaaauauggguagcucucuuggaagguagugucacauuuuaccaaaaugucagcgauaggaaaaccaauuaaaggauuccaagagacacaauaaaacacgcuauguuggugaacauucacuaugaugcaugagaagcagauggcuuggcaggaagugaaagucuaaggaucaguaaguuuacuacucaaacaacuacacauugaagcaaugccuacauauacuuuacacuuuucugcuuggcaagggccuccggauuuuaccaggaaucccaaagcauuucuaacuaugugucuuuaauuuuagacacaccugcaaagaagauaccagccaacaaaaggguucaagguaggugaaucaacuaaauuaauacauguuugagauauguuugaugauguuagugacagagagggguguuuaaugcaguuuguugaguuuuggguuuggacagacagaaaauuuagugagaucugaugcaaaguuugcugugauaagugucaagaagucaacaguauauguucuccuuuauuaucugacuuaaguugaacaaaccuuaaaaggauggcagauagacuuguauaaaugguuaaaagugccgaaccacugaguuaagucagaaagaaaugcuggcgcuacaguugagacagaagccaauuaauaguuaaauaagcacuuaucuaacuuaauccucuauugcauauaugauguuuacaauauaauuucuuccauuuaugucaauuuucuaauauuuucucuuaaguaaguaaacauauauguacugaaagagcaaagauuuucuuuguaguacucacaaacauugaauugaaagucucaaauucuugagauaauugcacacuaauaauaaaaagaacucauaagauucauaaauacaguacaugaagaucugacuuuaagccaacccagcauauagaauguugacacuaagaagccaguugcauauguuuuuaauuaaaagauuuauuaagaguuuauauaggcacacaagacuacuucaaguuucuagaaacucaaaaucauugaauuuuauauuuuaauacaccuuuaauuaaggcauucagucuuucuuacccuaaagugaagauaguauucagacaacaugaucuaaauaaaucuuauuacaaggagcaauggucacuuuugacagauaugugugugccaugagauuuuguccuagucucuucuaacugcucucauuuccuucuccucagggccuagaagacgaucaagagaaggccguucucagugaaaacccagaggccagaccacagaguuuauauaauccuaaaucaacgaucugauuuuaagggaaauuguaagagccaccacacugacuucagaaucugaaaugacaaccaacagaagccaaucuucaagcaaguccaaacacagaguucaugucuuuguuucugcaugagaaauauaagaaaaugauagcuagucuccugugggguaggaacugaggaaauauaggaccaugcagggauuuuaucucaaugagaaaacuucugauuaaaguagaauccaccaaagaacaucauugugacuggguccauacagcuaagucuuugcacaguaaaaaccuuccgccucaggaagaggcuggaaaaacccaaagcacacaguuaccuuuccaggggaggcuaagguaucaaaagggguguucaguuauacaacaugcaaacaaaccuaccaaauuacgaacagugguguuacauauuucucaugcaauguggguuuccugcuaaauuuuguuauuuuuacacuugauuuauauccucgagaugauugucauaagcuucuugcaauacaaauguuuucucucaaacauuucaauaaaaccauucuucagguauaaagagaauuacugcagaguugguaauucagaaaacucaagguuuaaguuaaaagugaguuuagacuuuggaauaggacuucauaccuuuuuuuauuguuaacaaguacucaauaaaggaaacugaauaaacuaaguguuccuca

SEQ ID NO: 1425 - RNA, 27916 nt, Mus musculus
agaagcugcagagcaguagacgccauggccgaccggaucagcacuggggagcuaggccggaggccugggcagguaggaccuggagggaggcgguugugagcaucacccgcaccuagagcugcaggcccagcccugcaagggcucacccaggacaggcuccaucaagggccuggggccgcgugcuccugaguggggauguuagcucccgcaagcaggccccagggccagacuucgaaccccugacccuggagcucgggaacagaaccccgcgggagggucuuagaagugggagacccggaguugagcuuugcuucggggaagguuugggcuucaggaacggaacgcgcauucaucugcguuuauuuccggcuuuccugucccuggacuguuggccucgcgaagauggcgaccagaaguggccuugcucaaacaaagccugccugccaguguacacagggcaguguccgcccccggcagacagaggucccagaaacgcaccucgaucagacccuuggugacccacaggguaacuguacuggauuaucucaggccgggugacuuuugcccacgauggccgcacuuucauggccgaaaggguugcggcgaauuccaggccuggugugggcucuggugugaggcccagcuuuugagacaaaacaaaacagcaggaaaacggauggccuggcuagagaagcguagagggccauuacucaccccggaaagcaaagccgguggagguaucuguuguuccacagagcuuuuuggacaauacgaagggacacuuuguaccuagaugaguuguuaaaauuccccaggagccuuugucuguuuagucuucugaccccuuaaacacaagcuucuggaaaccgaauuauuucuguagcucauuuaacgggauucgaggauucuaggcgagggguuugugcaugcgcgaaagcuccaaggaaagggacuugaguggcgcuggacgaagcaaggcugcgcaagauggaauucugaguaaaauaccugccugucuagaacacagauaaguguggauccugacacuacguaguguggagcccccgcugaauuuugugguccucuggggggggggggaacccaacaacaacaacaacaaaaacccagcagcuugcuccgucucuccagauagaguuaaaacccuagcuuucugggaaacagggaggccagugauugcccucugagagcucaggccuaggcagccgcugcugcuacugauugucagcgcugcucucccugauaagagugacauaaauaacagcucacuaaaacgaaggagugauuuguucuaagcacuucagcaucugcuauuacuaauuaaggguuuagaccgucaccgauugcagauggaaaucuagagccucacagucguagagacugcagugcccugguugugaggucagaaacgagacagaguagauaaggauauuggcuguggugcggccuuauaaaacugcccauaauuaaagaauguguggcaggguauuaauggggcauaucccaagagagcaugggauuucauuuucacuucauuuuuuuuuuaaauuucccaaugaauauguauuuuuaaguacacuaagcaauucauacagaaaaaaacuugcugucaaaugaaaucuagucaauuguguucuuagguagaaaucguagggcuguuaaaaugcaauuuugcaaaugagaauaugcuaggcuuuuccauuucuuuuauuauaggcaggccuuauuuauugccuguguucagauguuacaccaucaacaagauacuaaguaaauauucaaaucuauguugcauauacuuuauuugcuaaauuuacaugacuggauuguggacuugacuggcauccuccguguucuagucugugugacugcugacacccugaguacauuguagcucugaucuccucggccagggaaagaagcucagaucuuuugggaacagcucuguuuuguacugcgugccucagcacauaccacucagcaaaccuuagacuccugcacagagcauggcuucccaugccgccgcucucccaccccugucugcuuucccuccccaacuccucaguccuucccuuugucucuguucuagcucuugacucuugugcacaaaacuggggaugcucagaguggagccugggaggggacucagguaguuagagcaccagguaccaccuagaaaaagguuuaaguagguaacugcuucucugcucucugcuucucugcucucugcuucucugcucucugcccuucucagagcccuggauuccggaugugcagagcacagagcuacccagagcugucucugcugcccagccuaagugcauccucccucuaauuccuuuucccauccugucugggcguguguguguguguguguguguguguguguguguugugcccagguuugguauuuaaggaaauauagaggugucuaccaugcacgguggguuugcccuucagaugcaggucaugucccuuacauagagccagcagugauaccuggcaggaaccgagaggcagaugcuggucucugccuggaaaccuuugcucccuuggcuccacggcagaguggagugggcugguaaccaaggcucacacacuguucugcauuugaaugguucuaagcccugugcccugggcuacagagaagguaugaaaggcccuguguggggggcuccuggcugucccuucaccuguguucacugccacugcucaguagaccuuaccuauggugacaguaauuaucaagcacaauuaagccagaacacaaaguggaaagaugucugagaagacgaagagaauagaacuuccuaauggaaagguuuacaaaucagucccuccccagaccacuggcuuauaccuauuuuuaaaugucauuauucuuaccacauaguuuuauucucaaauggcccagugagagaaaacucaaccauaucaaaauaaaagaaauauuaggaggcuggagagguggguggcuuaguugccaaagugcuugcagcuugagccugagagccugaguuuggcaccuaguacccacauagaagcugaugcagcagcauccauuuguaaccccaggacuggagaagaggggccugagacagggagaucccuggggcuuguuggccagccaguggguaccaauuuaguccaguggguaaacccaaguuuggugagaggcuuugccucaaaauacaagguggagaguaaguaaggaagacacacccauacccaucacauacacauuauauauacauauacuaccuacacauaccacucacacgcaugccacauaaacacucacacccaacauacacaccacauccagauacuauauacauaccacauaaacacauaccauauacauacuuaacagaaacauucauaucauuuaggguuaccuuaucuguauuauguagauuauauuugcacauuuguaguugcuucaacuaaauccauuauuuaaaaacaacagcaaaacuauaacccucauauagcugcucucacaaccacuuauuacugaguguuacagcaucuuggcuuuagggguuucaggaagguucuggaauggaauuacuuguguaauuacaguaucguuggacaacagacacuaaugaguugcacccgaaaugcaacuggaccuauggugugguuuucagaggaagucaaagagaucagaagggccuugguguucuaccuaugucacugcaguuuccagaagcugagacaggaggauagcaucuuuaaagccagccugggcaauauaccaagggugucucaaauaaugaaugaaugaaugauuuuuaaaugaaaagguuaugguguguuuugaaaauauuaggguauuugaggaaaaucgaaguaaguuuggugaaguaggcugaguuuagauugcaaaaaaccaaaccaaaccaaucaaacaaacaaaaggccccacacguuaacgagugggcauuuuuuaucuuuucugagguugguggguguuggugaguggcuccggccuguggagugagcauaagugcuuccuccaccgccucuguccuaaaccacacagcagaaggcacuuuugaaauaaugaagccuccagccaguaaauaucacagaauaagagagggaggggccacccuauguuaaaaccuaaggagagucggcuacagaaggcaaugcauggcucuugacagaaucuugauggcaacacagcaguuucuuucauaaccuaaaaaaaucugcggucagacuuaaaaucuagacagcgauggaucacauguccacucagaggaaggcuacaccucuaagggagagaagagaggcuggggugaagcagaggguggacagguccacacgugugcagaggcugaucgccugcuguggaaguagcugcaugcagaacaccuggagcaaggaugcuuuaguuccaggauaugccugugaacuguucucuauggaaaaugagcugcacgugggacucagguuucccagcguggggaacugccaguccgcuguguggccaggaacaggcacagccacgcagcacuaggcucugcucuucagcccuuuuuccaguuuacugcucacaguagacccaaaucauauucacagcuacucaguccuugauucauaagauuuuuagacauagagagcugcaccaguuacauacaucgugaacugcuugauuaugaaauucacaucccaauguguugaagugagaagguagagcuguuccaaggugauuaggucacaaagguacauugccauuaggaauaagauuagugguccugaaaaagaggcccacgguggacuugucaacucuuguacugugugcucucacaugguaccaugaccuucacuccaugcugggccugccaacaccuuaaucuuggacuuuccagucuucagaguggcaagaaauaaauuuguuuuguucacaagcagccuugcuuuggugcuuuuaaaaagcuggaaaggcuaggacaaaagagaauacaaauaaauuuuugaauccuaauuuucaaggcugaggaaauagcaugguugguaaagugcuuauguguaagcaggaggauuuaaguccaccuacauaaagaccaggcaugggcauuccaggacccuccuacuccccugaacugggaaggcagaggcagggagccccugaaacucacuggucagccaguuuagucaaaucugugagcuccgggucagugaaagacucugccucaaaaaggagauggagaacaacagaggaagagaucccauacagacuucuauucaccgcaugcaggcaugugcacgcacaggcagucccacguuaacacagaaggcacgacuguguguucaugcaguucuagcucugucaaaguggagauuuggggauuccuggccagccacccuaucauacuuagaaaguuccaagcucaaaagacuggccccaaaacucaagguggauaauaccugaaaaaugacagaguuguccugugaccuccacacauagauauacaugcaugcacacacaaagacacaaguaaaaucugaaucuauauauucagagaaguaauuacauccuaaaauaacagguuauuuagaaaauaaaaccuuaaaaacucacaauucauaucacauucaguacuuuuaaaggaccaaagaccaagaaagcuuucuggaaagacucuucugucacagagauguggagagaaagacucuaccugggcuucuagcauuucacaacagauucccaaagagggaaagacaacagagaggagaaagugaucugugauugaagaaauguuaucuguuuccagaacagguaauaacugcucauacucagacacagaagauaaaaaaaaaaaauccaacaugaaaucacccaaagaaagccaaguugcuuggugccuucaacuaccacucugaauaccgcaaggugaugaaccaucaucuucaaaauucaaagacagugauuuugacccaaaucggcuagagcuagcccugaccugucagaacacugugacagcauuuucaggcaagaagaaucuccugagccugcacugaaauucaauaaagcagaucccaggaaggagcaaauauaaggaacagcacagaucaaagaaaugauaacaaaaaucauuauguguaaauauuaauuauaaauaccaaaaaaaucccaggcauucccagcagaagugcagcuuuguauagagagagagacaagggucucacugcaacccaugguuugcaugugaccaaggauuguuaugaccaagucccaacacacaaccauaaucucacuuuaagcauuaugaaauguuuuuguauaagaauuuugccugcaugaugcuugugcaucuuaugugugccuggugccuaugaggccagaagagggcaccguuucccuuguggagauagacagcaucuauuagcuuccacaggggugcugagaacaaaucuggguacucuuuaagggugggcagggcuuuuaacgauugaaccaucacuccagcaccaaauuuagauuuuuaaaaaaacuuguucucuggaauguguuuuuaacccaaaucaaucaugugugacucacugauaggccuuucucacaaaauccacuuuccaggagaaaguucugauuaggaaguuggaucaaaagaacuuggccuguugcugggugauggcucaugccuuuagacccagcacucagcaggcagagguaggcagaucucauaagaucaaggcuagccugaucuacagaucgaguuccaggacagccauggguacacaaagaaauccugucucuaaaaggcuggaaauaauaaucauaaugauaauaaugauaauaauaagaagaaccuuaccuguuaauggaauaagagagaaguuuuuagggaaaccacacuauaauggccuuagcggacaggaucuuaacaaaguacaggaugcucagacccaagcccaggccugggcauggaggcagugaagagcuuccugcccucgagugcuuagggucgacugcccugcuccuugaguugucacucuuguuugguaguuacaugugaccucuacuuucuuccuucucuuuuagggcagaguaaaucuuuugcugguuggagaugccacaagauacuuccuggcuggcucuaugcagaaauucuuuccuagcacagcacagaucacccugaccaucagcaaugugaagaaggucgccgugcuuuuggcugcuaacucguuugacauaauuuucuugaaggugacuuccacucuaacugcagaggagcaggaggcugccaaguuaauuagguaaaaauuuccaaaucuugacauugucuuuaaaauugcucuuaaaaccuauuucuuaaauacauaagauauauugauauauuaaguacauaagauauaauauguuaauauacuugauuguuauacaauauauugauauacuugacaucaaauuuguccccugugaguuuuaagauaaagcauaucuucauggguagaaguuucguagugcagucaguucucuggcugauuugacaugucacuguaagaauuagcauggcagucugagcaggaauaggcaggagugacaucagaggcguugauugaucauagaaaauuaucugguguguaaugcugauauuagucccauagguaugcuuuuuaaauaacugucauuacgauggcuccucuuuucagaguuuauuaagaguucugguguauauuaaagcaagugagcauuaucaauucuuuaauguugaaauaucuagucagaguugagugauucuugcuuaugauucuaaaaaaacuugacaaaaauucaaaauucuacuuucucuuccuuguauuauuugggcuuuuuuugagggaggugggggucuuuuuuuuuauuuggucuuaaauuauacauguauaucuuuuucaaacacacacagagguauuuguuuuaaggggguuuuaguuuuaugcaaauuuccccaauccagauuuugccgauuuuauuccuauaguggucuugaaauguccuccauuccucaaccuuuuucaaacuaaugaggaguuugaaaauguggauagaguuuagauucucuucuuuaguuaagaaagaagagcccaucacauccucgcugauuugagaugcugaguuuuaaauauuuuugcaucauuuuaaauucucaaagugaaaggcgucuauaguucgguugcuaguaaguuaaggccuugagucuggucuuucggacugauuauuuugcuucauuguaacacuuuccccucagaucuggcaagaagaaaaacacacauuugcuguuugcuuuuguaauaccugaaagacuuaaagguauguacuugacugccugcuauaacauggguuucauuuucagguagaaaugaccagguuugugguaacaugguuuuuguaggcuauguuucagaauauggagcugacauuaguuucagugagccgcugaccuuggaaaaagugaacacggugauacacuacuggaaaacguauuucacaaauacgggugaguuagaaaugcauucguaaagcuuuaaaauguucacuaacauucuauaaaccauguuugcacaucucuaaauuaaucucccacuuaagccuuuuauugugaauuaacaauuugcuauguauuuuauaagaguguauauuuuaucauagccagaaaguauguguaaauagaggaaaaaucuuuuguuuuuauuugcaagagaagcugaaauguucagaaauuucaaaugaguuaguugcaugauaguugugugaugaaggguucuguuuguuuuuguuuuuguuugggauuguuauuaugugucuuuucauuugguaacuuagcuaccaucauaucuuuguuuuuaaaauaugauugaucagacuacuucauuacagagauauccaaaaaguagggcauuaacuuggaauugcacaguaacuccguugcaaaacauuuuuguaauuauuuaccucuuucaugccugaagggucauucuuucucuuucaucgucugagauacaaagcauuaaugacaaugccgcaauuagaucucuucuuuguaauccucuuacccauuggauugugugcauugcaacauuuaaacacuaauucaauuagcuccuccuaaaggggcaguaggcauccuccaacuccuggaauucauguaguucaauaauuauuuuugcuugauagagguugggauacuagcugggaaauccuucaggauuaaguccguaucacauggagaacauugggcaaggaguggagaguuuuugcuaugucauacgaguaaaaucuggagaccuaagauaaaguuugauggcuguauugacaauacugcauggacauuugugacuuauugaggugaaccauuuuaaguguuuucaacacaugcacaaggaaguaauuauggaaggugaugaacauauuaacuugacuguguuauuuuuacauuauauaugcuuaucaacuagacacacugcaaauacacacacacaucccacauucaccauuauauuucuauaaagcaauaaaccuuuucaaaauuuaaauuucauauuuucuugaaccauacugaggacuguuauauauguuuacauucuagagucaaugugucugccucuuuauagugcuagcuuucaauagucagagucgugaguucucuuuguagcaccuucucucaccaugccaucuuccccaagcccuacccaguguggcuucagaguucuuccuggguaugacuaagcauguggucagggccccuuugcaaucucugcucuggucuucagucaaacagcagcugcccaucaccugucccgcaccuuugauggaucccaaccauucuccaguugguuuaucuuugguccgaggacuaacagcugcagaauuuuuauggcucugaggccacaacuugacagugcaguugcuugacauuuacuuauaaauaggaaggugauacauaaacucaguuggggacacuauaaacuaugucgcuugguuagaagguucuuacugguaagaggauguccuggcgggcagugugcgcagccuuucauugaaacuuucuaaucuuagugguuuuaugcuucauggacugaaaccuaucacuugcuuucuauuuuuaaaacccugcuuuguaaaaauaauuggcagugauuuuauguuuaaaacgagccucuuuccaaacuuucaauagauauggaaaacacugaguugccuccagaaugccggcuguacuuucagacgucccgcagugaacucggagggcguuuuucuacagauauguuucuuugguuaguuuuuuuuuaaauguuuuuucuauuuuuccaugucauguauguuuaccauguacauuuuacuaaaagauacugcagagaacuuaauaauaggagaccaggccaagugcugagcacggugcagagagaagggcucuuccuaggaagacaggugacagccuucuguuucagauucuagaguggagaucaugaguauaccucacaagaugauucaacucauuaucagaaagcacacugauguucaaauaaaauaacagcagacucccucuuuuucaaacacacauucaaaacucugauauuugcacaagcacagccuuaccuaguuuuguccccauuguguuuugaacucagaaacucaaaacuucaacuagucucagauaucccaugaaggaagcgcuuuguuuuguuucauagggcaaucaaucauucaaucucccucccuccgucccucccucccugucucuccgucucccuccacccucugucucugucucuaucucucugugugucuugcuuguucuccugcaggcuguugaucuugggucagacucuuccuuuguuagcuuugcauguuggauaaaaaccagcuuuguguggcugcugcccucucuuuuuacaccaaggccauuuuaaauagagcuuagagcacagggguggacaaaugcugaaacccauggaugcugaugauggugaaaauucugagucgggcacuucuagaauguguagaauguagcccucugcuguguagaagaacaagggaggggcuuggcagccaguucuguggcaaaccaaagaugauuucacuuaaguggcacauggauagcaaaagcuuugugaaucuuauuuagcagcugagccucaaagagcuuuuugggacgaugacuccuuaacuggccuaugagguagggaaggguauugugagguuucaugaauuucauaugcuacguugaaagcauucucagugucuacuaacuuugaaguuuucuuuauccucccucauaaucaaaguaaaauuuccagucaaguuuugcccuuuuggauaaagaacauggaauuacagggcuagagaguaauaaagcacuugucuacaagcaaggacaugagcuucagacccaggacucagauacaaaagcuuuaaggcacgagugcucagaaucccagcacuggggaggugaagacaggaggaggcuccuugaggcgccagccagccagcccagcccacugggugagccucagcccagugagagacacuggggaacagugccugagcacagacaccaagguugauagcucucucucucucucucucucucucucucucucucuucucucuucucucucucuccccugccccauacacacacacaauuauuuuucaaaaaauuuaaaaacauauaaaacaguacaaagggggccuguagagauggcucagcaguuaggagcauuggccauucuccuagaggaaccagguucaguucccugcacccagucacccugucugugacugcaguuccagggguccuauucccuuuuuuggcaucccuaggguccagacacacauguauuaccuauauacccauaaaauaaaaauuaauaaaauaguucaaaccauaaaguucuagaucucaaccuuccuaaugccaugacccauuaauccaguuccucauguugcaguuuacccuaaccauaaaauuauuuuuguugcuucuucauaauuaauuuugcuauaguuaugaacguaauguaaauguuuuuggagauagaagguugucagaggggcagagucccacaggucuagaaccacuguucuagauagcagagucagaacaacauccauuaaaugacaaaauuuaaaaggagagaagccuuugcugaucaagcuagaacagaacauguaaaguuucucuauucuuuucucuuuaauggaccuuaacuuuuaaaaauguaguucauguguuugggugugccuugcugcacauauaucuauguaccacagacguauuaugcccucagaggccaaaagagagcaucagauaccuuggaaaugaguuacagaugguuaugagccaccauaugggugauggaaauugaaucuagguccauccagugcuguuaaucacugagccauuucuguagccccaugagccuuaacuuuuaaaggguaaauacagcuguggugugauuuacagugggacuguaagacccaguagaaacaauugugaauaaaaacuacguccaaucugccugccaucauagcuugcccuguaacaaccucagaacacuuaaaguuaguucacaguagagcaggagccaucuuacucagucugccugucuaagcaucaccuaggauaggugauuaucaaauaagcuggagggagaaauggacugugguggaugcuauacaccaccaugaaguuaacaaaauguguugccagugacugcuuggaauuuagaauagccaugauugauaagacaagacugucuuaguccugauuauauuuguauuuaaucagugcauuuuagaauuuuaaucaucggauuuaugauauuuugaaaacugaaggaaaagauucgguaccaaaugugucagguacagugauuuaauguauucuccucuuuuguaugaggcaggagacacucucuggcugaugagugaauuacugcuugaaauugacagaaaguugccuggcaaucuuucucuuuaauaagugacacgauucucacuugcuuguagcucugaacugcugaagaaugacgcuagacuuggauuaaaggccccguugucgagucuagacaaaagcaaacaggcgucuuuucuucacucaaccaaagaaaagcugagacggugaguggccguggaaccuguggucgcuggguuauuucuucacacagagaaaccacuuccacagaucccacaacuuucacacugccaaaagucugcaugaaacuagugaaugugaccacugaacauaugccacccauccagcauguggucaccaagagggacuaaagagcugccacagccugaugggagagcaguaacgauucuaaguggugggaauagaaauauucgucuucaguuccccuaaguucccuguguauucagaaguuuucuuaauacacaccgaaugaugugcaauggcauuuuucauugugaaagugacauacaucuaucuaucuaucagaacuauagaaaaggcagaaauuauugucaauagcugagucagcuauagauaacaauggcuuaaugucuuuguuuucagcccuuuuuguauuucauucuugcuucuaacauauuauucccacugccaaugaaauucugaagaucugacuugccauaauucacuauuaggcaacuucucauacucaacugagacugcucugcccacagagacucugcugugcguuuuaucuuagauucuuuuguaagugaaguuuuuaugugugaaacauucaaagccuuccaaguguccagcuguuggcuccucagugcuucccccuagaauaguucuugagacaacucugcagaaucccaaagauccugaagcccaauaaaacuaccgcuuauuuucuacccuuauauaugccaaaugauagauauuuuuagucuguuuuucuucucuucugaaauuaagagaaacuuagggacuuuccuaagauuccagauagugauuguuagucacccugcccaagucaaggcugugacuggacaaagcaagugcuaagggaaaaaugccaagggcuugaaucgauuuugagucaauuagaucuacauuuuuccaugugucucuccugagacacauuugagauuuaguguccuuugaaugcuagccuggacauugccuuguucaucuguuuaggaaaacuaucuucuugcuuuccuccggcucagaccacagcaugaucugugaaacucacgugguacaagacacacacacacaugauuuauuucuugguaaaaauaugcuccaaaccuagguccugacucuucuggcccacuaagcuucuacugugaauuuacaaaaugaugucuauauaucaugugauucuuuccugagggcagagugucugcaguucuucaugggcuuugagcggugugcuuguacugucugggcaccacagcagugggccugguugagggagcuggggcuggccuggcacagacucuguacuuuggcaguuaucccucugaguggggacccuggggguuuugauuucaggagcugugaauggcucuuggccuaugggaacauggucuuccucuuaaacaggggucagaugaagauagagacaguccauuucaacaaaaucccaggaaaaagaauuguuccuucagauaaacaaagaggagguaaugcuucguucuuuucauacaaucauuuguacagagaacgcaucaagucuugcugugagcagcugcgcacgcuccugccauacgucaaggggaggaagagcgauguggcaucaguuaucgaggccacaguugauuaugugaagcagguccgggagucucucucuccagccauuauggcccagguacucaguuucucaagucuuauucaugcuuccaugcagcaguuuuauuuuuguuccuguuacugcacauccaugugugugucuguaggucuguuuuacagaugcaucuuuguacuuguuuagguuacagaagccauucagaacaauagaagguuuucuaagagacagaugcccaucgagcuguuccuuccauucucagccacaucacagagguauggcaagagcaugugaauccacagucuguguguuguuuucccuccuguucaugcuggaugaugguacaggaacugaagacauacauauuuguuagggauucacgacugucucccacugccaguucugaucaucuuauuacugugaugaacacaucccguauccccagggcugugggcuuccauccuaugacacacacccuguuagcccugagaaccuuaaaauggggccucuugacuccaucucagugacucugcauguccagcggggucagaauggauucuauaaauccucuacagggguugagggcuauggaguaucuagaacuaguuaguacgcaguccugaaacucacagguacaaaaugugacaugccaaggaaugacuuccuuacucaagucuuauaaguauaugcaagcaaagagaaacagaaacaaccuuugaaggauccucaaaggucccaaguaccacuauguuauauuuaaauaaucuguagcugaaacuugucaggguuuuuuagaucuugucuaauagaaaaucuuuaaagaccuuggagcgacggcucaggaguucagagcacuuacugcucuugcagaggaccuggguucaguuccuagcacccucauggaaacuuacaaccaacuguaacucaaguuccauaggaccugauggccucuucuggucccuguaggaacugcauagguaugguacacugauguacaugcagacaaacacucauacauauaaacacaucuuuuaaaaaaaaaauuagguauuuucuuauuuuacguuucaaaugcuaugucaaaaguccccaauacacuccccaccccacuccccuauccacccacucccacuucuuggcccuggaguuccccuguacugaggcauauaaaguuugcaagaccaaggggccucucugcccaaugauggccaacuaggccauccucugauacauaugcagcuagagacacgagcucugaggguacugguuaguucauauuguuuuuccaccuauaggguugcaguucccuuuagcuccuuggguacuuucucuaguuccuccauugggggcccuguguuccauccaauaacugacugugagcauccacuucuguguuugccaggcauugcauagccucacaagagacagcuauaucaggguccuuucagcaaaaucuugcuggcguaugcaauggugucugcguuuggaggcugauuaugggauggaucccuggguguggcagucucuagaugguccauccuuuugucucagcuccauauuuugucucuguaacuccuucccuggguguuuuguucccaauucuaagaaggagcaaagugaccacacuuuggucuuuguucuucuugaguuucauguguuuugcaacuuguaucuuggguauuuuaaguuucugggcuaauauccacuuaucagugaguacauaucaugugaguucuuugugauuggguucucacucaggaugaugcccuccagguccauccauuugccuaggaauuucauaaauucauucuuuuuaauagcugaguaguacuccauuguguaaauguaacacauuuucucuauccauuccucuguugaggggcaucuggguucuuuccagcuucuggcuauuauaaauaaggcugcuaugaacauaguggagcauguguccuucuuaccaguuggaaugucuucuggauauaggcccaggagagguauugugggauccuccaguaguacuauguccaauucucugaggaacugccagacugauuuccagaguggauguaccagcuugcaaucccaccaauaauggaggcuuguuccuauuucuccacauccucgccagcaucugcugucaccugaauuuuugaucuuagccauucugacugguaugagguggaaucuugggguuguuuugauuugcauuucccugaugauuaaggauguugaacauuuuuucaggugcuucucagccauuagguauuccucaggugagaauucuuuuagcucuguaccccauuuuuuaaugggguuauuugauuuucuggagccuaccuucuugaguucuuuauauauauuggauauuaguccucuaucugauuuaggauuguuaaagauccuuucccaaucuguugguggucuuuuugucuuauugacagugccuuuugccuuacaaaagcuuugcaauuuuaugaagucccauuuguugaaucucgaucuuacagaacaagccauugcuguucuauucaggaauuuuuccccugugcccauaucuucaaggcuuuuccccacucucuccucuauaaguuucagugucacugguuuuauguggaguuccuugauccacuuagauuugaccuugguacaaggagauaggaauggaucaauucacauucuucuacaugaaaaccgccaguugugccagcaccauuuguugaaaaugcugucuuuuuuuccacuggaugguuuuagcucccuuguuaaagaucaagugacuauaggugucuggguucauuucugggucuucaauucuguuccauuggucuacuugucugucgcaauaccaguaccaugcaguuuuuaacacaauugcucuguaguacagcucuguaguacagcauggugauuccaccagagguucuuuuauccuugagaagaguuuuugcuauccuagguuuuuucuuauuccagaugaauuugcaaauugcccuuucuaauucguugaagaauugaguuggaauuuugauggggauugcuuugaaucuguagauugcuuuuggcaagauaaccauuuuuaccauauugauccugccaauacaugagcaugggagaucuuuccaucuucuaagaucuuugauuucuuucuucagagacuugaaguucuuaucauacagaucuuucacuuccuuaguuagagucacaccaagguauuuuauauuauuugugacuacugugaaggguguuguuucccuaauuccuuucucagccuguuuauucuuuguauagagaaaggccauugacuuguuugaguuaauuuuauauccagcuacuucaccgaagcuguuuaucagguuuaggaguucucugguggaauuuuuagggucacuuauauauacuaucauaucaucuacaaauaaugauauuuugacuucuuccuuuccaauuuguauccccuugaccuccuuuuguugucgaauugcucugucuaggacuucaacuacuauauugaauagguagggagaaagugggcagccuugucuagucccugauuuuagugggauugcuuccagcuucucacuuuuuacuuugauguugccuacugguuugcuguagauugcuuuuaucauguuuagguaugggccuugaauuccugaucuuccaagacuuuuaucaugaauggguguuggauuuugucaaaugcuuucucagcaucuaaggagaugaucaugugguuuuugucuuugaguuuguuuauauaauggauuacguugauggauuuccguauauuaaaccaucccugcaucccuggaauaaaaccuacuuggucaggauggaugauugcuuuaauauuuucuuggauucuguuagugagaauuuuauugaguauuuuugcaucgauauucauaagggaaauuggucuaaaguucgcuaucuuuguugggucuuucugugguuuagguaucagaguaauuguggcuucauagaaugaauuggguagaguaccuucuuuuucuauuuuguggaguaguuugagaagaacuagaauuagaccuucuuugaaggucugauagaacucugcacuaaacccaucugguccugggcuuuuugugguuggaagacuauuaaugacuacuucuauuucuuuaggggauauaggacuguuuaggucauuaaucugauccugauuuaacuuugguaccugguaucugucuagaaauuuguccauuucauccagguuuuccaguuuuguuggguauagccuuuuguagaaggaucugaugguguuuuggauuucuucaggaucuguuguuaugucucccuuuucauuucugauuuuguuuauuaggauacugucccugugcccucuagugugucuggcuaaggguuuaucuaucuuguuaguuuucucaaagaaccagcuccuccuuugguugaugcuuugaauaguucuucuuguuuccacuugguugauuucaccccugaguuugauuauuuccugcugucuacuccucuugggugaauuugcuuauuuuuguucuagagcuuuuagguguguugucaagcugcuagugugugcucucucuaguuucuuuuuguaggcacucagagcuaugaguuuuccucuuagaaaugcuuucauugugucccauaaguuugggaaugcuguggcuucauuuucauugaacucuaaaaagucuuuaauuucuuucuuuauuccuuccuugaccaagguaucauugagaagaguguuguucaguuuccacaugaauguuggcuuucuacuauuuauguuguuauugaagauaagccuuaguccauggugaucugauaggaugcuugggacaauuucaauauuuuuguaucuguugaggccuguuuugugacaaauuauauggucaguuuuggagaagguaccaugaggugcugagaagaagguauauccuuuuguuuuaggauaaaauguucuguagauaucuguuaaguccauuuguuucauaacuucuguuaguuucacuguaucccuguuuaguuucuguuuccaugaucuguccauugaugaaagugguguguugaagucucccacuauuauugugugaggugcaaugugugcuuugagcuuuacuaaaguuucuuuaaugaauguugcugccccugcacuuggagcauagauauucagaauugagaguuccuuuuggaagauuuuaccuuugaugaguaugaagugucccuccuugucuuuuuugauaacuuuggguuggaagucgauuuuauuagauauuagaauggcuacuccagcuuguuucuucagaccauuugcuuggaaaauuguuuuccagccuuucacucugagggagugucugucuuuuucccugagauggguuuccuuuaagcagcagaauguuggguccuguuuguguagccagucuguuagucuaugucuuuuuauuggggaauugaguccauugauauuaagggauauuaaggaaaaguaauuguugcuuccuguuauuuuuguugcuagaguugggauucuguucuuguggcugucuucuuuuagguuucuugaaggauuacuuucuugcuuuuucuaaggcgugguuucuguccuuguauugguuuuuuuuuuuuuuuuuuuuguuauuauccuuugaagggcuggguuuguggaaagauauugugugaauuugguuuuuuaauagaauacuuugguuucuccaucuaucguaauugagaguuuggcuggguauaguagcuugggcuggcauuuguuuucucuuagugucugcauaacaucuguccaggaucuucuggcuuucauagucucuggugaaaagucugguguaauucugauaggccugccuuuauauguuacuugaccuuuuuccguguugcuuuuaauauuuugucuuuauuuagugcguuuguuguucugauuauuauguaucgggaggaauuucuuuucugguccagucuauuuggaguucuguaggcuucuuguauguucaugggcaucucuuucuuuagguaugagaaguuuucuucuauaauuuuguugaagauauuugcuggcccuuuaaguugaaaaucuucauucucaucuacucuuauuaucuguagguuuggucuucucauuuuguccuggaauuccuggauguuuugaguuaggaucuuuuugcauuuugcauuuucuuuuauugcuguguccauguucccuauggaaucuucugcaccugagauucucucuuccaucucuuguauucuguugcugaugcucacaucuauguuuccugauuucuuuccuaggguuucuaucuccagaguugucucucuuuggguuuucuuuauuguuucuuguucccuuuuuagauccugguugguuuugcucaauuccaucuccuuuuuauuauuguuucauguaacucucuaaggcauuuuuguguuuccucuuuaaaggcuucuagcuguuuaccuguaucuuccuuuauuuccuucuuaagguccuccaucaucaucauaagaagugacucuagauccauggcuuguuuuucuggugugaugguguauccaggacuuguuauggugggagaauuugguucugaugaugccaaguacccuugguuucuguugcuucuguucuuaugcuugcuuccugacauuucauuaucucaaguauuuguuguccuuaauauaucugauuggagccuguccuucuuauaaucccaguugauucaggacuccucagaguccagcuuucucugugauccuuugcuugugggcuccugugaaccugagguucugggugugucagaguucuuggcagucaaguuccccugagacccugaaauacuggugugaccaagcucuuuuauccugggauccuguugucaaagauccugggcauuuuacagugccuggaaguggugucuccuuugaggagcguggagcugucuggucagugguccuaagaucgcguggagaguccucuagggaacuuggggguguccgacgacuccaugcccaaggugaccaggugcugacgccgaccggaagggacuugugacccuggucaggccagguuuuuugcuucccuaaugcugucucaggucccgagauuggauuggaacagaaguuguguuccacucaccagagguccuaagaucauguggagaguccucuagggaacuuggggguguccgacgacuccaugcccaaggugaccaggugcugaugccgaccggaagggacuugugacccuggucaggccagguuuuuugcuucccuaaugcugucucaggucccgcgauuggauuggaacagaaguuguguuccacucaccagagguccuaagaucauguggagaguccucuagggaacuuggggguguccgacgacucugcguccaaggugacccaguuaaacacaucuuuuaaaacacaauucagaaaagccuuugaauccagcacuguugguauuuucuaccuggagggaugugugaagugaaucuuucuugucuucccagggaagaugccaugcugaccagcgcuuucucaccugugcaagagauucagcuccuggcugaucggggccugaacguguauuccaugacugcugcaggaggagcuuuggagggagcagugagagguaagcagugccuaacacugcagcucacagagcaugugaagaaaggcucugcagccccuggccccugacucccuauucauuuccuguauaaucacguggucaaguggaguugaaauaucgcccagugaguccuggcuucaccaucuugaaguacuuaaauugaauauuuuaguuccuuuugugucaguguggcagaauuccuaacagagagaccccaggaaggaacggcuuaucuccuaaugcuagacgauuuagucuugagauggcagagacaagcauggcaccauucacacaguaggacaucacaaagcaggggaccaggaaucagagcaggauuuacacaguaggacuuguacccauguagggcugguucuaagucccucugcagauaccagaucuucagagucucaagucccuucuauaaaauggaauacauuugcauauaaccugggcauauacugcugcuuauaugaagucuguuguggguuggaugauaccugauauacaauguaaauuuacacagaugguuguuacauuacauuguuuaaagagccaagucuguccauguuuuguauagccucacuguaguugauuuaaaaacagaacaaacccuuugacuccaugguuaguuaauccccagcucgguggugcagaggacugaccgugcucacuguaucagugcugauggugugcugagcauuuagaaccuuaguuuauuuacuuuccaggccuuuauuuagaggcucuacucugaguccgucuggaccaccuaguuaaaggcacucuuuccuguguguacacacaguacagcccacucuuagcccacguuuccacuuggauuugucuucaggguacucaccacccgugcucuuaauaugugugcuuuguuauuggcugccuucuuccauuacugugucagccccaugaaggcaggaaguuuccccuccugcuugauucauugcuauaguuuuaguagagcaaccacacuagagcaguggaggucaagaaauacauauacuacaaauacccauguggacacaggcaccccuccuuccagaggcccuucuguuauacuuuuggcagucuuuggcauucccacauaguuauggaaauaauggugggaaugaaccaagcuggcgggaaagaauccagguccaguuuguggcuuuugguguuccugaaggcuacucuccccauagaggagccaguaaaaugcagaccuucuaaucgaguggcuggugcugagugacaggaagucuccuguccucagcgucuuuugugacucuuucugauuccuucccccuaagaauuguguugucauggcauccccccgugcugggaauauccuugacuuucacucucccaacuaauugcaaaacugucuucugguucucagcuuggcaucccugccuccgauggcagugcauggagagaugagaugcaguccuucuuuguaugaaacucaguggcagacaggaucacaaaagcaaacugcacugcucaguguguuuaagagcacaauagaugccccaugccaugcacagagacaugccaugcaugucuaggggaacaggggcaguucugggacaaaugauauuucuacgguuguguccaaagucagaagagaaggggccaacuuagaacacagcccuccuugguccugaaguuagggaaauaaaugcaggacacuucaguggucuauuuaggccuuucucuucaucaccugggagauuggaggagacuagggaaaaaaaaaaagaaugcaguuaagcuacucagagugcccuggcucagugugaaguggaaggauuaaagugauaaaauuaagguggggccaugcucaggaccucuuaacgauauaccuuuauacaaaacacuauuuauguucuguaaaaacaguguugaugacagcauguucaggauuuucuguacuugaauguuuugugaaauuacaucacccagagagaccacucugggaaagacacaguuaugcuagaacuguauauaauuuuccccucuagauuggucaucccauuuuuaucucuuaacuuuaaaaaauauuuaucuauuuuaugugugcgaguguuucccugcuuguaugcauauguaccauguauacgcaguaccuguggaggccagaagaggguguugaagcaucuggaacugugagcugccuguugugugugcuggaaaccuagcucaguccucuacagcaguggggugugcucuuaacacugagccagugcuccaggccuggaggcuacuuuuaaagcauuacauguuuuacaaaucuuugaauucuagcuacuuuguagaacuaaaauauaacuguguguuggucuaaccuacuuuacuuguaagaaaaaaauaagccacguuuucuuuguagcuuaauguauuuguuuuuugugucuuuguuuuguuuuguuuuguuucucucauguucuuccuugcuuuagaggcguggaguuagggguuguauugcuaugguaagacaccaugaccaaaacucagcuugggggaggaaaggguuuguaucauuggacagcuugcauuguaaggcuguuggagcaggagcucaggguaggagcuuggagacuggcacugaauuagaggccauggaagagugcugcuuccuggcuuuuucuuccugcuuccuucuaaucccagaaccgccagcccagagcuggcccucccacaucaauaagaaaauguacuguggacuugcuagucuuugggaagaauuuucuuuauugggagucccuguucccagaugacucuagcuuguguuguguuaacauaaaacuaaccagaacagauggucaguuugguuaugaugguagccaaucacucacacacacacacacacacacacacacacacacacacacacacacacacacacacacacaccacugccuguccucugaaaucucuugagauacacgaaugcuaacgugcaguguuuguaucgagcuguuacaggaauaggcacuggguuauccaccagugguuaagugcaguagcugugucaauaugaggaaaugagauagagagccaugcauuuccaauacgguagucagagccacagaggugugcacagugcucacagauuccuguuuuccuuccuguuacaggucagccaggcucuguuuccgagagcucuauugaggaucuguauaagacucgcguccccagcacagcccgaucucugaauuccuuccacucugucaaauacacuucuggaacugucucuccccaugaggcagcugccaggacaaaucagaacauuuccacuuauuugccacccacugcacccaguguguccaacuuuauuccucagcacugcaaugccaugcuuugcccagcacgcccaaccagucccaacugccugguaagugaguaagagacuucuguggucugugagugagacuggauccucuccagccuccgaaggcccugagccacacucggcuguuaaugcccuggucccaaagcucagcuugcaccacaagagcugagccgauuucuaagucacuaugggaacggugauaauugcuguaguuaaaccaguccccuauucuccacacugcagacccggugucuggaugucugcugucaugaaucuggauguggccuagcuagucuagcauuaggugaccagggggaaacugacuuuuuuggaucuaguuacuucucccucucugugcuucuacccggaauuccuuggaugugacagcccauucuuugaucuucauucucagcugaccccugacagccucuguugucucucggcaucaguagauucccucacuggauuaaaacccguccuuuuuuuuuuccauuagacagaguucagaugcugguuuguaugcaccagucauuuggacuccaucaugcuuugaugcugugcuuacugguauuucugggaaaguagugucuacagacauuaugcucacacucaugaggugucggggauacaaccagagaagcaggcagcugugauauggguugaagcaugaugguagaggacauauaguugaguuaguuacugcugacucauggagaaauacuugcagucuaauccaagaucuagagacaaagaauuaaccucacagcgggucuggaaucagagcugagcagagaagaaguguuggguggauggaccgcacuauagagugaagggcaucucuucauuuuaguuuuuaguugcugacauguacuuaccuuauauguagaguuagcauaagaaaaucauuauuuuuguuauuuuuauuguguuuuguuuuuugaaauauguauguguucauguuugugugcaugugugucugugugcucgccacagugcacauguggaagucagaggacaacucuugggaauuguuucuuccuuucuucccuguugaggcuucucccuugucucugcugcagugcacuccgggccaugagcuugcagccaguucucgcgcugccucagccagcaucuuucguggauuccgugcggcgucagcuucggaucaccaggccucucagccaccugcucugccaucuccacagccucacgacaguaguuacuuuuaagaaacauuaauauuugaaaauauguagguuugguugccugaaguuagcuuuauuaacuuucaugaugcagacaugcauuugugacguuguaagaaugggcuaaacucaauuaaugugcacuucucccuccaacagucugggucguauuaacgguccauguguggggcucauauucuagaucacaugccgggcacaguuguucaguugaggaagaagggacaaagaaagauacuugaaaucugcugcccccguugucugauaaaugugcuagaaccauccaaagguaccuagaaagauuguugacgacagugagaaccuuguguucucaggcaucuucauccauguugggauuucccuggccagugagcugcaagcagcgcagccuaagugacccacacacacauuaauucuaccaaaaaguaauugugacguuacugugaaaaccauacuacaaagaaggcccauguggguguaagcuucuacaaccaggcaggccagcacgcacggcuccugcagccuggugauuggcucugucauugauuucuguugguaucuuuucuagauuggcauuugaaagagcccccuucuuccaucaucauccaaacuaagauaagcaggcuauaaggagcggcagcccugcccucuuggcgauguggguagauugcugugcuuuccgcuggguuugcaggcuugugaguagaauggcagccaggaggggcauugcuuuccuugcugaacccacacauuucuguccuugccuuaacaggguguuugagcaacuguuggaaacaaggggagagaaggauggcuguuuuauauuucacugaaauguucuuacacaaacauuuuauuguuaaagugucuagguuuacccugcaauccauuguuuuguuuaauaaaauguuuucucuuuuauaauaau

SEQ ID NO: 1426 - RNA, 2783 nt, Mus musculus
cuuacacaaaccaacagcagcuucuucugacagacacacacucacccccgacgcacacucugcacacuuuuccucuaccugauuaacaguccugcacacaccaugauuacgggaaaacguaaauaaauacggaaaggggugauuauuuugacuacuggaagagcuuugcugggucucagcauaacuuuuguuuuuauuaccgagaaggugcucucuccacgcgucucucucugacacggauucuuuagcggaggggagaaaaggggagagcucagccuuucacuuuaagacccgcuagucucgagcgggggaaaaaaggccagcagggcagggcggcccccugcugcagcuaguccgagagaggcucggugccuuuugagcgugguccccuuucuccaccgaaguuggcuccagcgcuagcagccgcauuggaucccacagccuauugcgagacuccgguguacaauccggaucucugccccaacaugaucgcggcccaggccaagcuggucuaccaccugaauaaguacuacaacgagaaaugccaggccaggaaagcugccaucgccaaaaccauccgggaagucugcaaaguggucuccgacguccugaaggagguugaagugcaggaaccgcguuucaucagcucccucaaugagauggacaaccgcuacgagggccuggagguuaucucucccaccgaguucgaggugguacucuaucugaaccagauggggguguuuaacuucguggacgacggcucccugccuggcugugcggugcugaaacugagcgaugggcgcaagaggagcaugucccucuggguggaauucaucaccgccucuggcuaccucucggcacgcaaaauccguuccagguuucagacacugguggcucaggcgguggacaaguguagcuacagagauguaguaaagaugguggcugacacgagcgaagugaaacugagaauccgagauagguauguggugcagaucaccccggccuuuaaaugcaccgggauuuggccgcggagugcugcccacuggccgcuuccccacauccccuggccaggacccaaccggguggcagagguuaaggcugaaggguucaauuuguuguccaaggagugccacucccuggccggcaagcagaguucggcugagagcgaugcuugggugcugcaguuugcagaggccgagaacagacugcagauggggggcugcaggaagaaaugccucucuauccugaaaacccugcgugaucgccaccuggaguugccaggccagccccugaacaacuaccacaugaagacucugguguccuacgagugcgagaagcauccucgagagucggacugggacgaaucuugccugggcgaucggcugaacggaauucuucugcagcucaucucaugccugcagugccggcgguguccccauuacuucuuaccgaacuuagaucuguuucaaggcaaaccccacucggccuuggaaaacgcugcuaaacaaacguggcgacuggcaagagagauccugaccaacccaaaaaguuuggaaaaacuuuagaggaugaucuaauccagggcugacaagaaugagcauucuucucaaagucccgacgaaaugaaaacuuccugguugauuccuauguacuauuucucgagacagugcaaacaaucucuuccuuuaaaaggaguaacaacacaacauuuaaccaucaucucacacaggggaaaaaccacaccacaagcaucuuuauggaggcaucccccagcucccccgaaaagugcacaacaccccaaaacagcuggcugcaaugcaagaccauggccaacuccagcaaaggauuauaguaaucuugagacuuaggugcggcugccuuccagcaaacagggcccggauguaccaucggaagcaaaguguaauguauauuuugaucuguaacaaaaguugugaucucauguugucuuugaaaguguggauauugguguuuugugauuuggugaucagaacugaaauuaccauuuuggaaacuuucagacauuucccacagaacagagaugcauuuaaagguagauuuccuccugguacuuuaccugucuuucaagugucugaacuuaaaacaaaaguuuacauuuuguuucaaauauauugcuuguucuaacauuccguaaguauacuugaaauguuauuuaaauauauucaaaaauuugaauucagcuuauauaauaacgcuugaauaucugaauuauauauauauuugaaaaugcacuugaaaauacacuggauaauuacuuuugugauuuagaauuuaauuucuguugcugauuuuuauuuaauuagaagauaauaaaugaaguaaaauaccaaguuucuguuucucuuuaaauuguuguuguuguuguuaaaugagguaaugaugcuauuuaaaagucaacuugagaauuuuaaacauuucgacaaacagguuaauaaaaucacuaaaauuaaauguuaaaagggcucuuuuuagaacagcuauagaaaauauccacuuccccaguuucuaauuuacucaaugguucuuuucuacaaugaauauauuuauagccuacuucugagacuuugauucugguuaguauuucuguagucguuugacaauauaagggaaaaauuaccauagcaauagagaagacugaguuuaaaagcagcaaaaucugagaaaaauuaacuuaaaccauaaugcaaaacucugaaguuuuuauaugaaauauaagcaauaaaauggagauauauuuuaacaca

SEQ ID NO: 1427 - RNA, 16380 nt, Mus musculus
ugagaugcuuuaugaggucuaccaguaagugugaggaugucaagggauaagaaaucaacacugguuucaucuugaaccuagaauuuuauuuuaacccaugaacaaagugagcugcaguuuaaagagggggaaagccggguggcugugcguuaagaccauuuucuacugcuucuucucaacugccccuucgccugugugucaugauuacaguuucaaauaaaggaaacuacagaccaccuacauuaguagacuccaacuccagguaagcauuagacucacccacuggggugugcuucuccucuugguuucaggcaugaugacugagcacagugacuucugucauguguuugcagagcugcaguuaacugugcaggacucaacaggugugaucucugaugcagucguaucuagugacacucagauccuucagaaccugcucugggcaccgucucaugacucaaagaaaagguacagcuauauucuuucauguggacugagaaaguagaaccagguuuguucagaaaaccaaguccuacggacagagagaacaaagaugcaggaaggaauaugacaaaggcccucuugcuccccuuugcucccgagucccaugguccuaucuguuauucucaucugaaauuucauaaugaaugcuucuauagauaaggcagcugagcuuguauuuguuacuuauagucauaaacucuaacgagcauggucacuacauaugaguuauagcacuugucauacucacaggaguaagaagccagugucuucuagacaagcaagggacauauauguagauacaaccaggagagagaagaucugaguaugaaucuaucucuagacucucacaaacacacggaaauauaggcuucuaauuuuaaguucuuaaagguuaccaaguuccauugccaacaagcuaaacaaccuuugggaaagauuuuuguuguuguuuuaugcuguuaacaucuucaacucuaagauguccaguguggucuaugaaaacacuggcagucacucucucaagacuucuuucaacauaaaaagcuauacuaacauggcacuuaguaucguaggaguuuucuguggaauuauucuugaaaguauuguguacauuagauggagugcccaaacaggcuugugaaugaugaguaagauuuaagugcuuuuaaauuuaaauaugauaauuuugagucuggggagacagaaaaguugguaguacuuucaguucaaacguguggauccccaucuaaguucagauccccagcauccguguaaaaacauaaggcguuuggcagcaccugccuguaaugccagcccuggcgaggcagagacaggaggcuccuggagcucccuggccugcuagucuaaccaguuggugaacuucaaauucagugguaguaucaaaaacuaaggugaauaaaaaauuaaggaagaauuugcccucauaccccugaccgccaugcacauccgcucucauccacacacgugcacacguacauaaacaugaugaaugucagcucugccuaacuuuucaagcuauguugacuuuucuuacaugcaaacaaccuuagaaccaaacauuuucaacuuccaucuauuucugugaacaaauauuuacucauuuggcaaauguuuauugagagccacugaaacgccugccauugugucgaguguucugcucuuaugaggugagcugaaguuuccagauaucugguagcucugucucauuuuacgcuggaaaggauacagauucauacauguggucacauggugugggccacaauugggcuugcuguguuuaaaacaaaaucaugagcaggcauggaagaaguggggugguacaguauacuugaaggcaugcucgaagaaguaaugaguuuagcccagggaguacagguagggugggucagggaaaaagaaacagaacuuucuagaaggagcagcauacuaaauuauggguuugagagcuugagaccagugcucaagaaucuacaguucuacacuauaguuaaaaauaaaaacaaacaaacaaacaaaaaaacauuucucccagaggcauccguucauugauuccagaggugugcaggagcugggugugagccagagcuguugggaugcuaguauuuaaaaacuaaucaggaacaauaacaauaaacaaaagcaaugacgucagauugauggagccccagaaaaauaaacaaaacauauuagagaugaaguuaaagugucuugccuggaagaguggguggcugaaauuagugaguuaaugguaaauaaugugaacugugcuguugcuaaaugccgcgugcgucaggauuuacauagguugacucguggcuucacaucacgcuccaugagauaaaguuuaucaucugucucagagagaucuacucugucguguccuucaccugacccccuucucccauucaccauaaucuuagaugcucuguaguucacuuauuaaaaacaagucuuucucaugaauggaugcucuauaauagcaaacaaacaaacaaacaaacaaacaaaaccuuguuuucuuuaccacuguguuucccgccauuuuauagaaagacauaaugugaacacaauaaauaucagggaugaauagacaauagaaaccaaggaacagauaacuugaaacagacuaaguagccagguggugucaggaccaugaaaaaauuaccugaguagcuaaaaaggcuuucaaacugggaucuugaguucacagaagguacugaaaacagacggacuacuagauuuucaugccauuaacaaguuuaaaagagcaugaaagcugggaagauggcuuagcaguuaagggugcuggaugcccuuccagaggaccugguuugauucuaagcaccuacauggcuccuaacaaccaccuauaacuccagcuccaggcagucugauaccauccucuguccuccucaggaaguaggcaugcacacacacagugaacacaugcaggcagaacauccaucugcuugaaauaaaaagaaauaaaccuuauaaacauacuuuuaaaagaacauugguuccauuguuuuaugcauucaaguacuuaacaguauuuacuaagcacuuggacuacaacagguguuacgucaagcauggugacaaugguagacaacgcagaggugccugcagucugggagagaggagugagaugggcaaccacacaggauaaucucaggggaugguuguucugcacuaggugugaugggauggagaauagugggggugggacugggcaucagcagacaggucuucagaaaggcuucugggcaaauuacaugggguugcauuccuuuauucaacaccugagcuuccagauuacauauuugaaguauguaauauauauauauguauauauauaauuacauauauauacauauauaugguaaguauauauauuuacauauuuguauacauauguauauggaauauguaauauauaugaauauauauguuuccauauucauauauauguauauauauaugggauaagacucaagcuugaacaugaaauauacuuaauauuuuguguguacaccuagcacaauacacaugggcugaagcuaauuauagcaguaaauauuuucaauacaucuuagguuugguggcucuauuuuauuuuauuuuugucauaguagggaucaacuuagugacuauguuacgaccuuccacaugcugggcaagagcccaaaagcccauucccaggcccuaugccaguguuuugauggcacuccacuacaugggagcaaauauggaauuuuuccacaugugcugucacaucagugcugaaaagauuuuggacuuuggagcauucugucaggacuucagauuugcacauuagggaaguucaacuugcaugugaguagaagccuacaaaauggugcuccaaggaugcucagagcagaaacagaagugggguagaggaaggaccagcaccaaggguuaugaaccgagaccagaaaggcucuguggagguggcaauugugcauaucaaacaguuuugaggccaaagaaaggccaugauuaucucccagcuaaggucugguuaguaacauggccacaugguuaagaaauuguccccucaaaucacacguuuuuuuuuuuaaguuuuaagccagaguccuaaacugagguuaggugaucaucugcagaguggaagcacaggacacugaaggagacaggagggcgaguaaggagaaaauauguauuauaaaggccaggcaugguggcauauuccugagaccucuacuaucaaaagguugagagcagagaaucacagguucuuggcuacccugugcccuucacuuuguuauuacaaaaacacaagacaagguugacauuucaucugaaaauuccuuacaccaaagcuuugcaacagggccaggucgagcagcuauauuccauggcuucuggccacagcuaaaggucguuaaagaagaaccucagagggcuggugagauggcucaguggguaagagcaccugacugcucuuccgaagguccggaguucaaaucccagcaaccacaugguggcucacaaccaucuguaacaagaucugaugcccucuucuggagugucugaagacagcuacaguguacuuacauauaauaaauaaauaaaucuuaaaaaaaaaaaaaagaaccucagagaacaucagauaugagugaacauuaucugagguuuugguucuuaaacuugagagaacaaaaagaauucauguagggaacuuucuauucauuguauugaggguagguccuaaaucuucaugugugauuaaaugaguagacauagaaaaugaacuaccaauuggcuucaauuagagcuuaugaaucucuagaaauaaugaaaaagugauugauuauauacaagggcauugcuuuuuucuuucuuuuccuuuguuuggauuuuguuuuuuuucuuuuuggagagaaucaguaucauagcaacacagucacagacuugguaaaucuaaccauugguucaggcucucuucuaauauaguugugcagacaaagggacagucuuggaagguaaaugacuugccacaguacacaaagcuggaaggaagggauacugugucuuacuucauacuuuuugaaauauccaagccccacagccucucuucuuugcacuccugaucacaggcaugggagaaagaagacagcagaggauuucaaaacuaggggugagggggcaaaguccucaaauggacacuuucccccauuuuggcuauuaaugggacagaucaauagaauagcagauuauaaugaaaacacuccaacuaaguguaacugggguuaagggcagaauaccaccuggcucaauaugccacuuagagagauaaaugaucauaauuauuuaucacagagaagugagacuuaaucaauauacucugaacaggacuaaauaacauuguccaaagaccgaaugcucaucuucagugcacugaggcgagcuuuauauuuagagaaagaacuggggcaggggauaagagugauguuucugcaaguauucagaagggcccuuaucacucgagagaacaagcugguuccuuggagacuagugcuagggcuccagaguauagccuccuauuuugaauaacuucccucaucuggaggguggucuguucuaucaggcucugcucuuuuugcaauccaugaugaccagacuagagaccaugagaugccuuuuagaggccuagaagguugacaguaagaugccagcucuuucaucuugugcuuguccccuugaaggagaaugauauaggcuagguacuagcaguuucuagagagacacaucaugagugauuuaccuaucaguaugugcagguaaguaggagacccaaaguagaggauaggaaugccagacaaagguaaagauggcagacuccagucugcuuccacuaaccuuguaggcaaagcaaggaguggaugccuuuuaggaaaaucaguuucuaagugcuuugcuauguuuuaagagaauucagucauuugccuauauugcucuuucagccuuaucagcgaugggaugcuaucuagacaggacucacaaaccagaacagagaccauacacccuguuguuagaagugugcuggagacagagugaggcuuuuauggggucuaacucugcacacacccagaugguuccgguuuuccggcauuuacauuuauuuauuucuucaguccaguugggaaugugaccucuucacuuauuguuagucuccgugcuguuuaguggcuagauuguauccuuuucuauagcuuugagauaccacugaucuaagcuggagucucuagauucuucaguuuuucucagcuuccuuaucugaccuaccaaggaagggcaaaugaguccccucuucuuccaucuuccacccuaagccgugccgugggccuccuucaccuuuucuggcacugcuuugcuacacggcauuagucaggaauguuugagcuguuguguuguuggauaccaucucucucugaggcagaugcccucagccgcgcugacccagggaacccagcuaugggaucuguccugccuagcuagccgcaggcagaggaaaagaagccacucuguaauuuucccagcagccuccuuaaaucugugggugacagcuuggacacguugccucgaucagacacggaaaugagcucagagcuuaggaaacuugccccaggucgcaaauuaaauucgugucaauguagaagugaacacagccucagacuggaaacgguccaaaaggcugcaagagagagaucacagcucuuuccaaggcccaaagcauccgucucuaagcaguuacuggaagacugugccagacuuccccuucgucuuuauccugugagcaagcgguauaguggauuagucauuuucucucuugcaggugacugaggauguuucucacauccuacuacugguuucguugucccaaggauuucauuugaagggcggggcacuccauuacuucccuccaccccaaccggagucugaagucuggaccaaugaaagcuuagaaccucguuuacuggcacuaagcacuggcacuauuuaaguguuagcaggaaugggcugugagcaucggcuuucuccacaaaggggcacgcuaacaucugaucuguggaaccgcugagcugaagaaagggaacagaggaaagccugcaggacuccuggugccacuaugugcuacguaaagugugcaagauacaucggauacucucuggugugggcugcugucuucugcaucguagcuaaugcuuugcucuacuuuccuaauggggagacaaaguaugcuacggaggaccaccucagccguuucgugugguauuuugccggcauuguaggcggaggccugcuggugagucacucagaacuauuaucacuaaaacuuccucuccucucgaauggcagagaguauucuucucaugcgaaguuuucuauaaugcccaucuguaaaaacuggauuuugucguuguugcugcgcucucucuuugaaagcagaauauucuaagguuguguuaaacuuuugcugaccuuauuagauguugcuuuaguaaaaucuuuugccuuagagagaagucucuuuucucagaagcuuuuacuuuacagcuugaaaaaugaucacuguccaaggagacuugagagacuaucgaguuucugagugcgggagcaauggucaguccucauuuggagcuggagagaguuggcuggcuccgagacaaaaguuuggggucuaaauuacucucugcugcuuacuuucaggcaucuaugacaugggaaaacauuuagggagugaacugguauuuucuaauaacuguaaguggucuccugagguuggaguuagaagcagguuagcaucucagucuaaggauggaaugugcuggcuuacucucccucccccuuacagguuguuuguuguugaaguugggaggaauuuccuuggcacaaugggaggugaaguauuaguuuccaucucgacacagauggaauguagacacauuugacuuuguccacuuaaaaugcuagacuuaagaacugcagagagaaauuuuauggaaucguuacuauugcagagaacacuaucuccuuugucaacuaaaauuaagacguugaaaccuaauggacuccucguggcauuggcguggcaaaugugcuuugaacuuuuggguuuuguuuuuuguuuuucgagacaggguuucucuguauggccuuggcuguccuggaacucacucuguagaccaggcuggccuugaacucagaaauucaccugucugcuucccaagagcugggauuaaaggcgugugccaccacugccuggcaugugcuuugaacuuaagcaucacuaucguucauguucccacaaucagugcaaauaauacaagugagcauacucacuguuuaacauauaguuagcaucuacucugcuuugcugcuuuggggcuuaaauuucaaguagcucauucuuacaugaagagcaucauugcugaguugaacuggagccuuuguaucuucaaagaaacagaucaucuuuuuuuuuuuaugaaaaauguuuacguuuucuacguacucaaaauguuucagccguucuacucaagauuugaucuucuauguuugaugaggacagauuuuacauuuaacagugcugacaguucacauuuacagguuauuauuucacacucugugugcucacucacuguacauggaagcaagcaaauguaauacuugcgacucuucuuaggccuuuacaucauucaugauaucugguugaccuaaucagaagacauagauauaucuuacagaaacgccugaacccacccauagggaaucaggaaaggccauggcuugauucuguuugccuucugagcagaugcuccugccagcguuuguguucauugggauggaugaagaggacugcugugguugcugcggcuacgaaaacuacggcaagcgaugcucgguaagccuccuggugcugcgcccugguggaugugcuucguuccugacacaggauggaggcucacuucuugcuuuuuccuuuccauagaugcuuucuucuguacuggcugcucugauuggaaucgugggaucugcuuacugugucauuguggcaucacuggguuuggcagaaggaccaaagugcagcgaugcccauggaguauggaacuacaccuuugccagcacugagggacaguauguaacuguucuuuaacuaguaacacauucuuaaccacaaugcuuaaaacuaaguuaucuaucuauccacccauccaauauuuccuuacuccaaaucaugcaguauguaaggcuagaugggcagucaugaaccuggggaaauucuaaucagugaauauacuauugcauauauucacugauuuuguucuuaccacgaccguauggagaugcucccauaauuccuuuucuuuuacaaaugagaaaaggaggcagggaaggaugaagugauuuguccaaggucucauugcuagaaaguacuagugaaucucugaauccagguugucugccucauagcguuugugcucagcuaguaugugcugcaaacccccaaugacacucaggucaaauguagcacauuuuacuaggucauaggacaguauuauaguauuuuuauguauucaaaaccuaggacaaacaauucuuccacccuaugccugcauauugugaagcauguauaacacacacacccuugauucaaguuaccaagagacagagcaaaggucuuccccacuacuccagcuucagugucguuaagagaggcccauugucuuaugcugggauuuucuguuuuuagucaguuaugacagaagaacagaaucagaaaagcuggugauggaugaguaucgauuguucuuuccugacuugccuucuuuaaaagaaaagauauuguguguguucgcgugugcgugcaugcguguaugcauaugugaguguagguuccaacagaguucagaaugaagugccagauauccccggguugagcuccuuacucacucucuaagaacaggaaggugugaacuaauuuucccgucucucagugacuucaucuagagaauggcaguugucaugagcauuaaugaggcgauccgugugaaaugcucaugugauggcugacauauugugaucacugucagaauuaguuuaggaugaacaugaaagaaugguagccucugaagaaaacccaguacuuauuggaguuggagucuuaaugccuccaacugucaucaacuuugcucagaacauaaugugcucauagaaaaugaucucaggugcauacaggguuaugucuauuacuaaacagauuuuaagagcuguuuguacaucugucucacuacucauuuaugcuucucaaaaaaaggucuuuuuucuucuagaucauucuuuauuugaaucuguuuagggaucucaauacauagaauaacuaacaguuccaagccaccgauuaaauuuucaguagcuaaauagagcuaaagaaaauuuugacucugugugaccugaauaacagccuuuguuuuacugacaagcagaaacacggggacagaaugccauauucuuguucuguuuugauuuuuuuagggguggagugguggugguaaguuuugucuuaaaccaacaaguugacucucuuauuggcucaguguacuguuccaauguuagauguuugguuucaagcuggggcaggaagaagugauaagaaauuguaccaggucuuguuguuggguuaagucacuccuggauguucccacaugauugaauccuacuuuacggggaauccaaauucuacucuggaguagcaguggcugacaugcuaggaaagagauccaaggcaugccuauguuuguauguauguauguauguauguaucuacauacacacauacacacacacacacacacacacacacacaugugcgagaagaaauuucucacguuguguauauauaaagucacauaugaccuuaauauggucuggugauuuuuuaacaaggagaguucaggguguuauuuaucauucugugauuuuuaaacauacacaaugucccagauacugugcugguagcuggguguaagaagaauaggcccugccccugccugcauggaacugagccuugcagaguggguauaaacaggucuucucuugggaagguuuuuuuuugaugguagccuuucacuuuguuucccugauccccauacuuggcauugauguucucaauccguguucuucugcuggaguccauguucuuucagaacagaaugcuccuuacggugcagcucuagcucaauguugcacucacacagcagcagaucagccaucuuggucuaauaacugaauaaaaggugcucuucauugcuacagagcaugauaucaugaaaguaaagaggcugaacucaaauccuucuacuuucuauugggaauuaacuuuuugcuuaaaaauuuaaaaacaauuuauaucaacaaauuucauuugaaaaugaaagccucuugaguuuuaacuuggcagaauuuggauacuuuucaaaagaggaaagugcuuaauaucuuaauaaagugauaauuaagaucccaaaguuuaaaguauacuguaaaauauauuuuccaaauaaaaaauuuacucaauagcuugcucauagacaaagauuaagcaaugauaaaccuggguaacagaacagaaauaugcuuuguaaguuuacuaccccagccugaauuguuuccauuuuuccauuuuuacuuuuaguucacagccauaugauacaagacaugguguuaaucaugaugcuaauauauguuugcuuuucuuucucacaagaagucauaugucuuuuaaagaauauaaaaaucucucaugugugaauuuuuuaaccacagaauccuagauuggugucaaaauuuguguuuuaauuuuauguuuaucauugggauaaucuuugggcuaaacccuuccauuuguuggaacgguguagcuagcacauaacauuguguuaauucauuuccauguuucugaaugaaaaucucuaaacaauaaaggcaaguuaugagauauccucuuaaacuguggccacgugucugaaguuccucuucuguccacagguaccuucugaauuccucuaugugguccaagugcuaugagcccaagcauauuguggaguggcaugugacucuauuuucuauccucuuggcuuuugccgcaguugaauucaucuugugucucauucaaguaauaaauggaaugcuuggaggcuuauguggcuauugcugcucucgccaacaggugagaacuugugggacuguguggaggucuagcccuguaguggcaacaaggccccauucuucuccguaaaggcaaaaccaggcacaggcaacaaacuagaaccuacucucacuucaucuuuguggggaggcauuucuuacauucaauuuuggcuacaguacugagucucacagacuaagucgucuuggcuuguagaucauucugugggcacagaaacacuugccuauagacacaguuccuccuucaagucaaguccccuguauguuccacccacccagcucugguuacagguaugagugucaagauacuuaaccuucauguuccuaaguacacaggaauaguacccaacacugauuccauaagauguagcacucgucucacuccccauucacaugcucaacucaagcacugaacaagaugcuuaaguucacuuacucaggagguaacagacuucaacuccucaguuauuuuaugcccaagcccuuccucuuaaccuuggugcugcauuuccuguccuguuugguucccuguaauucuuuccuaauaaggaauaacaaaaaugccuuacccuuacucuguaagcauggagugcaauuauuagccuuugaauguccuugugaaagaaacucuaugugaaagaaagccaggaagcucucauuuccuguggauaugacucaggaaugaaauauccacuuguuuguaacagagaaaguuauuuuuuuuucuguuuuauugaaauauuuuuucuaugucucuauaaaucauauauuauugaacagaugggaaguuaaaaucggcccauuuugggaaguugcuguuuuaugucuuauuauuuaagacaagauaaaguaaacuuauuucacuuauauuuucuauuucauuccauuuaucuccuaauucaaugucuuuugacuuuccuuggaaauaaggcaaaacaaaaccaaaacaaaacaacacccccccccccgcaaauauaaaaauaaaaaaccagcaaacaaauaaaaccuaauagaaacuaaaagucagggcuacugggaaacccuuugcuauaaauauaugggaaaguuuuauucauuuugagaggaaguuacaauuuauuucuagcuuuaucuaucaggcaaauccacaagguuaagaauuucuuugggauccugccaaauuuccaggaaaacagccuagugggaaaacuuuuguauggcauuguuuuuuguaaggcaacugaggggaagaacaaaaucaaccuuugagauugauuccuaaacgcaaaccuaugcuguuccuugaaacgcagacaaagcagagaauaaacucagcugcugcuggccuuuggugcuggggcauuuggggcauaggcguaaggaguaaguagguggacaaaauugguucuguguuuugugaggagagauaacuuccugagguggaggcaagcauguggucuguggucagagucacuguagaaagugcuguuucuuaacauuucgaaagaucuaugaccuuuguuugcaagacaaaaggugcucucucaggacaggggauuuaguuuaggagagcugacuccuaacuugguagcauuugauuugaaagguuaacuaggguaaccccacaccagugggaaauucccacggcauuauuuuaaguuacuccccaagaauugcgacccaacacaaacacacuacaagccaauucugugucaguauccugaaguuuccaugaacacuuucuguaaauuuuccuggggaaguaagugggucugguuuguuugggaaacauuuugugagcucugucugaucccuaaugguguggcgggccuaguuuugaugaaaaaaaaauuauucuauguuauguuugcuuugaauaagacugugcauuuuguguugucacugguaauaagcuaauguaaauuuuauuuucuuuacagcaauauaacugcuaaaaaagaacacaagacagaagggcgugcuuccuguauuucacuguaauuuguauauuuucccuguguugugagacuuugcaccuugugccacauccuacccuuucugcuuuuguaaggaaaugugcugacgucaucacaugaugucaguguuuacauucacaaaacaaacaaggcagcaaacugcacucucuccgaagggauuuuacagacuuaaggacuguucucagcauagcugagauaaacucuucaguguuugagauaaaaaucagagcuaacuauugugcauaugugcauuuuuuuuuaaauaaaagaucuccgauuuccuuuuuaagaccaagaaggaccaaaauaaaaaaaaaagaaaaacaagaaagauauauuuuacuguucauaugcuguuucccauuuguaugugaaugagucucuaagaaacccucugaagugagauuuucucuuaccuggauucggaaaucucauugagagcgugcuaacccaaguaugggagaggaaauauauaauacugacaaugucugugaaacacuacucaaggcugaaguugugcagcuuguagaaaccuuuuugccuuucaaagacaaagacuguuucuguaaagaggaaggucaggauaguuagacaaggaaaaugagaaauggugggaaaacagaagagagguggggcagggucaggaagcucacaggggaaugcuucccaagcuugcuucugagcauaaaauuaaguauucaauaccauucagcuguggcuuuaguuuuacgucugaagugacacccucucucaucaggcaauuuaucggagucacguagagaggacuucuuccuaacacauagaaagaucuauuaccuuuccuggaagacaaaagacguuuucagaguacaggcuucugggucuggagaucugguuucuaacuuaauagaauuugauuugaaagguuacacacagugaauacacucaguaggacaagccaaugucauuguucacagcuucuguuuuucccucccucucagugaccuguggucuacagguuggguagcaucuaugccaaggucuugcuuuccucuggguccucucuccugcuuucccugccuuauccccucuucugccuuuucuaucaacagauaaccauggcuaugcuaucccucgaggcucucaaaucagcuagauaucuuucuuucugcugggugcuccaguuaucaaaguccuggguaagguaguauguuuuucucucuuggugcacaaauuacaccuuguuauuuauuuauuuuaauguaaaaggaucccuuaacccacugcuuggcagaauuacuuagagggggauagaacuauguauuugcucaugguuccggagcuuuuagucugggguuacaggcugcacugucauaggccugugggaaagcagaaccuccuucugguaggagcaugcauaacaggacacagaucacuucaugguagauaggaagcagauagagaaagggacugggggccagauguaaccuucagauucacguccuccaacaacucacuuccuccaacaagguccuacuucuaaagucccuacuaucuccuaggaccauccaaggaccaacuauuaaagaaacacauucagauaauagcaauugggauuuuauacagaggacuuggcuuugguuauucauuguccugcauaacagacaagagaguuaguggaguuuuguuugcuauuagacaggugcacgcuuccuuuaggcaagauaccugcugugguagcugauccaacuaacaucuuugugcuaugaucccucugacaaucuagugaaacuuggagacuuuuucuaauaauaucuauaaacacauaaaauaaaauauauagacguaagaaguaaaucaaugcacuagaauauuuuaucaaauaaauuagaagugggacuagagagauggcucagugguuaagagcacugauugcucuuccagaggaccuaguuuugagucccagcacucacacugcagguuauaacugucuguaacuccagugucaguggauccaauauucucuucugguuccacaggugccuacauguggugcacagacaugcaugcagguaaaacauuuauuuacauaaauaaaauaaaaauaagucaaaauuauauagua

SEQ ID NO: 1428 - RNA, 9096 nt, Mus musculus
caugccugcuaccagcggcauugcuuccucugcuguuauacacccuaccccacuggaacugcaagccagaaguaacuuuuccauuuaaaaaagaaguuuucuuuagugaauauagauacacauuuuguuuguuuuaaagguaauuuuaccuuugacaauugaucuguggcuuugaugauugauuugcaguagaacugccuugaaaauucauaauaauaaagcuaauuugucauucaauuauacuauuaaaacuauaaaccaguucugguuauuuuucugcucucuuuuugucuuaaaauuaucuuggccuauaugacaagcucuguagucauccuaguuagggcucuguauuaaauucaaauggcuuuugucuugucugaacaagucuaaaauuuggggaugaauuuucugauaccccucacugggucccaucugcagaaauuaagccuugugaacccaaaggcucagcugcuugcccagaagucuucugcacuucagaaagaaagaacagaaaagaaaauuaagccuugacagaagcaugccauagugcaugacucuagaccagugguucucaaucacucggcuucaaccccuuuuggggucaaacgacccuuucauagggugacauaucagauaucccucauaucagauauuuacaccaauucauaacuauagcaaaauuacaguuaugaagaagcaaugaaaguaauucucugguuggaggucacaacaaugugaggaacuguuauaaaggguugcgguguugugaagguugagaagcacuauucuagaauaggaauggcugggaaauacuaaggagagcuccaaagacuaagugcucgccacaucuugacacauccugacacccugaacagcuugccaacuguagaggauauguggaaaggguguucccucccugcagugagucacaauaaaauaaaagcaaaugaagagagcuucugaggcggcgccauuuucggcuccaaacaaccggccaccuuccuggucagagcacagguguccgcucgauccaagaggcuucugccucagguuccucgggagccaccuugauuccgggacuccacggaaaguagucuacacaggugagaguguggacuacugaaacaauggcuucugugacaggccaaagcaacacagcuucugggaaacauacuguuuugggccuucaucuucagccaagaggagguccaaacaccagauaacugugcaccuucccugaaagaggagagcuugccugcagagacugcucugaccacugaaacucagaggagagaucuagucucccaggucugcugauagaggguaacaaaaucaccagaggaacaaucucuaaacagagacaacuauagcaacuaacuccagagauugccagauggcgaaagguaaacguaagaaucuuacuaacagaaaccaggaccacucaccaucaugagaacccaguacucccacuucgcccaguccagggcaccccaacacaccugaaaagcuagaccuggauuuaaaagcauaucucaugaugaugguagaggacaucaagaaggacuuaaauaacucacuuaaagaaauacaggaaaacacugcuaaacaaguagaagacauuaaagaggaaacacaaaaauccauuaaagaauuacaagaaaacauaaccaaacagguagaagauauugaagaggaagcauaaaaaucccuuaaagaauugcaggaaaacacaaccaaacaggugauggaauugaauaaaaccauccaagacauaaaaagggaaguagacacaauaaagaaaacccaaagugaggcaacgcuggagauagaaacgcuaggaaagaaaucuggaauuauagaugccagcaucagcaacagaauacaagagauggaagagagaaucucaggugcagaagauuccauagagaacaucggacaacaaucaaagaaaauggaaaaugcaaaaauauccuaacucaaaacauccaagaaauccaggacacaaugagaagaccaaaccuacagauaauaggaguggaugaggaugaagauuuucaaaucaaaggaccagcaaacaucuucaacaaaauuauugaagaaaacuucccaaaucuaaagaaagagaugcccaugaacauacaagaagccuacagaacucuaaauagacuggaccagaaaagaaauuccucccgacacauaauaaucagaacaacaaaugcacuaaauaaagauagaauacuaaaagcaguaagggaaaaaggucaaguaacauauaaaggcaagccuaucagaaguacaccagauuuuucaccagagacuaugaaagccagaagaaccuggacagauguuauacagacacuaagagaacacaaauuccagcccaggcuacuauaccuagccaaacucucaauuaccauagauggagaaaccaaaguauuccacggcaaaaccaaauucacccauuaucucuccaggaauccagcccuucaaaggauaauaacagaaaaaaaccaauacaaggacgggaacuacgcccuagaaaaaacaagaagguaaucccucaacaaaccuaaaagaagacagccacaagaacagaaugucaacuuuaacaacaaaaauaacaggaagcaacaauuacuuuuccuuaauaucucuuaauaucaauggacucgacuccccaauaaaaagacauagacuaacaaacuggcuacacaaacaagacccaacauuuugcugcuuacaggaaacucaucucagagaaaaagauagacacuaccucagaaugaaagauuggaaaacaauuuuccaagcaaaugguaugaagaaacaagcuggaguagccauucuaauaucuaacaaaaucgacuuucaacccaaaauaaucaaaaaagacaaacaggggcacuucauacucaucaaagguaaaauccuccaagaggaacucucaauucugaauaucuaugcuccaaauacaaaggcagccacauucauuaaagaaacuuuaguaaagcucaaagcacacauugcaccucacacaauaauagugggagacuucaacacaccacuuucaucaauggacagaucauggaaacagaaacuaaacauggacacagugaaacuaacagaagugaugaaacaaauggacuuaacagauaucuacagaacauuuuauccuaaaacaaaaggauauaccuucuucucagcaccucaugguaccuucucugaaauugaccacauaauuggucacaaaacaagccucaacagauacaaaacuauugaaauugucccaugcauccuaucagaucaccauggacuaaggcugaucuucaauaacaaaauaaauaauagaaagccaauguucacauggaaacuaaacagcacucuucucaaugauaccuuggucagggaaggaauaaagaaagaaauuaaggacuuuuuggaguuuaaugaaaaugaagccacaacauacccaaacugaugggacacaaugaaagcauuccuaagaggaaaacucauagaucugagugccuccaaaaagaaacuagagagagcacacauuagcagcuugacaacacaccuaaaagcucuacaacaaaaggaagcaaauucacccaagaggaguagaaggcaggaaauaaucaaacucaggggugaaaucaaccaaauggaaacaagaagaacuauucaaagaaucaaccaaucaaggagcugguucuuugagaaaaucaacaagauugauaaacccuuagccagacucacuagagggcacagggaaagcauccuaauuaacaaaaucagaaaugaaaagggagacauaacaacagauccugaagaaauccaaaacaccaucagauccuucuacaauaggcuauacucaacaaaacuggagaaccuggaugaaauggacaaguuucuagacagauaccagguaccaaagcuaaaucaagaucagguuaaugaucuaaacaguccuauauccccuaaagaaauagaagcagucauuaauagucucccaaccaaaaaaagcccaggaccagacagguuuagugcagaguucuaucagaccuucaaagaagaccuaauuccaguucuucacaaacuauuccacaaaauagaaacugaagguacucuacccaacucauucuaugaagccacaauuacucugauaccuaaaccacagaaagauccaacaaagauagagaaauucagaccaauuucccuuaugaauaucgaugcaaaaauccucaauaaaguucuugcuagcugaauccaagaacaaaucaaaacaaucauccauccugaccaaguagguuucaucccagggaugcagggaugguucaauauauggaaauccaucaacguuaaccaguauauaaacaaacucaaagacaaaaaccacaugaucaucucguuagaugcugagaaagcauuugacaaaauccaacacccauucaugauaaaagucuuggaaagaucaggaauucaaggcccauaccuaaacaugauaaaagcaaucuacagcaaaccaauagccaacaucaaaguaaauggugagaagcuggaagcaaucccacuaaaaucagggacuagacaaggcuguccacucucucccuaccuauucaacauuguaccugaaguccuagccagagcaauuagacaacaaaaggagaucaaggggauaaaacuuggaaaggaagaagucaaaauaucacuuuuugcagauaauaugauaguauauauaagugacccuaaaaauuccaccagagaacuccuaagccugauaaacagcuucagugaaguagcugaauauaaaauuaacucaaacgagucaauggccuuucuguagacaaaggauaaacaggcugagaaagaaauuagggaaacaacacccuucucaauagaaacaaauaauauaaaaauaccuuggcgugacucuaacuaaggaagugaaagauuuguaugauaagaacuucaaguuucugaagaaagaaauuaaagaagaucucagaagauggaaagaucucccaugcucauggauuggcaggaucaacauuguaaaaauggcuaucuugccaaaagcaaucuacagauucaaugcaauccccaucaaaauuccaacucaauucuucaaugaauuagaaagggcaaucagcagauucaucuggaauaacaaaaaaccuaggguagcaaaaacucuucucaaggauaaaagaaccucugguggaaucaucaugccugaccuaaagcuguacuacagagcaauugugauaaaaacuguaugguacugguauagugacagacaaguagaccaauggaacagaauugaagacccauagaugaacccacacaccuauggucacuugaucuuugacaagggagcuaaaaccauccaguggaaaaaggacagcauuuucaacaaauggugcuggcacgacuggcgguuaucauguagaagaaugagaauugauccauuccuaucuucuuguacuaaugucaaaucuaaguggauuaaggaacuccacuuaaaaccagagacacugaaacuuauagaggagaaaguagggaaaagccucgaagauauggguacaggggaaaaguuccugaauagaacagcaauggcuugugcuguaagaucgagaauugauaaaugggaacucauaaaguugcaaagcuucugcaaggcaaaagacacugucaacaagacaaaaagauuaccaacagauugggaaaggaucuuuaccuauccuaaaucagauaggggacuaauauccaauauauauaaagaacucaaaaagguggacuccagaaaaucaaauaaccccauuaaaaauggagcucagagcugaacaaagaauucucaccugaggaauaccaaauggcagauaaacaccugaaaaaauguucaacauccuuaaucaucaaggaaaugaaaaucaaaacaacccuaagauuccaccucacaccagucagaauggcuaagaucaaaaauucaggugacagcagaugcuggcgaggauguggagaaaggggaacacuccuccauuguugguaggauugcaagcuuguacaaccacucuggaaaucagucuggcgguuccucagaaaauuggacauaguacuaccagaggaucccgcaauuccucuccugggcacauauccagaagaugucccaaccgguaagaaggacacaugcuccacuauguucauagcagccuuauuuauaauagccagaagcuggaaagaacccagaugccccucaacagaggaauggauacagaaaaugugguacauuuacacaauggaauacuacucagcuauuaaaaaaaugaauuuaugaaauuccuaggcaaauggauggaccuggagggcaucauccugagugagguaacccaaucacaaaggaacucgcacaauauguacucacugauaaguggauauuagcccagaaacuuaggauacccaagauauaagacacaauuugcuaaacgcaugaaauucaagaagaacgaagaccaaaguguggacacuuugccccuucuuagaaauggaaacaaaacacccauggaaggaguuacagagacaaaauuuggagcugugacgaaaggauggaccaucuagugauugccauauccaaggauccaucccauaaucagcuuccaaacgcugacaccauugcauacacuagcaagauuuugcugaaaggacccagauauagcugucucuugugagacuaugccagggccuagcaaacacagaaguggaugaucacagucagcuauuggauggccacacggcucccaauggaggagcuagagaaauuacccaaggagcuaaagggaacugcaacccuauagguggaacaacaauaugaacuaaccaguaccccagagcucuugucucuagcugcauauguaucaaaagauggccuaguuggcaaucacuugaaagagaggcccauuggacuugcaaacuuuauaugccccaguacaggggaacgccagggccaaaaagugggaguggguggguaggggauuggggggauggguaugggcaacuuuugggauagcauuggaaauguaaaugaggaaaauaccuaauaaaaaauaacaucugaaauaaaaauuuauagaagauggguauauaaauaaaauauuuuugauggaaaaagaaagaaacacaguagaaaaaaaaacauuaaaauuuuuuuucuaauaaagugaaaauguuuuccaaauucauuuaaugucaaagaaaugaauggacgcucgucagagauucucuugaagaaagagauuuuuagguaauaucauuagguuggcuaugguacuguuuuauuucaugauagggaugggcagucgaucuucuuguguauaggaugccaggugauuucaaggaaaaggacaacguuacauuguguaagaacuggcuucagauauuuaaggaaaauaauaugaacaaauuuaaugugauuuuguaaaaucuacacucaaauauacuuuuacucaaaguaucuuuuauucaaaguaagaaugugauuuguuccucauacuucagugagaauaaaaacuauguagauauuaaaaugcuucaaugauagcugaauuuacuuaaauucuaauauagauucuuuuaaaaauaauaguuaaauaaaugaugcuaugcccaaacauauuaucucacacaccaaaguaucagauggaugaagcuuugggacaaaauaaguagagaacaauaaguacaaaucuuccaauuuuauuacuuuguauuauaauuuauucaaauuuauguugcaaaaacaagauuuaugcccauuuauucauagaccaucucuuccuuuuacuuuuuaaaaaaauacuuuuugagaauuucauauacgauguguaaacacauuauuucuaucccuuccucucccccuccaacuucuccugugucuuccacccuaccuagaguugaugacuuugucauauauauaaauauaaauaauuuggcagaacgagguucugguaaccccagccacguucguuccuuugucuuuucaccuaaccacuggcguacccggcauacccaccccguccugugccaggaaauuacugcaccacgcccuacucauacucagaacugaccccagagcagagggagcugucugacaucgcucaccaaauuguggcuccaggcaagggcauccuggcuacagacgaguccacuggaagcauugauaagccccugcaguccauuggcaccgagaacaccgaggagaacaggcacuucuacugucaacugcugcuuacugcugaugaccgugugaaucccugcauuuggggguggggguuugauccucacgagacucuguaccagaaggcagaugauggacgacccuucccccaaguuaucaaguccaagggugguguugugggcauuaagguagauaagaguguggugccccuggcaggaaccaauggugagaccacuacccaagaucuggaugaccuguuugaccgcugugcccaguauaagaaggauggagccaacuuugccaaguggcgcuguguauuaaagauuggggaacauacucccuuagcccuugccaucauggaaaaugccaauguucugacccguuaugccagcaucugccagcagaauagcauuguacccauuguggagccuuaaauucucccugauggggaccaugacuugaagcgccgccagcuaugacugagaagguacuggcggcugucuacaaggcucugagcgaccaccaugucuaucuggaaggcacauuuuugaagcccaacguggucaccccuggccaugcuugcacccagaaauuuuccaaugaggagauugccauggcaacggucacagcacuucguugcauagugcccccugcagucccuggggucacuuuccugucuggagggcagagugaggaagaggcauccaucaaccucaaggcuaucaacaaguguccccuacugaagcaaugggccuugacuuucuccuagugccgagcccuguaggccucugcucuaaagaccuggggugggaagaaggagaaccugaagaguucaggagccccagaggaguacaucaagugag

SEQ ID NO: 1429 - RNA, 120269 nt, Mus musculus
cguggggcaggcuggcuccggccaggaggucaugcauaauucaacagcuccacuuucggcccgccucuuuccuaagggugggaguuugcuucaaacuuuguuuaugggacaguccgggagccgcggcggcugcgcucgucuacgucuucucugucgccuccucgcgcagugggagcgcccgaggccgguuccggggauguaagaggauaagccuucggcugcugggaauccgcucgggaucugccagccgggaccggguuccagcucgucaguucgggaggcgcccaggcuuggcuuccccgaguccccagguagcucccgccgcgccccgcacccucuguggcguccggcucuuagacgaccgcagucgggacgccugggguugccgguggggguauugggcaggggaagcugcgacugggucuggugcaggcaccccccccccccuuccucccgcggcugccugcucaggggagcuucucuguugcgggaaaguugcauaaucucggaggccaggggcgcccccucccccaccggcuggucccuggacccauaccuaacugucucuagguucucucuguccuuccccgggacuacccccuccuccucugacuugcaccaaaaggcugaucugaucuuucuuuuuucuuguagaaagaugaauccguccucggugccccauccgcucccgccgccagggcagcaagucauccacgucacgcaggaccuggacaccgaccucgaagcccucuucaacucugucaugaaccccaagcccagcucauggcggaaaaagauccucccggaguccuucuuuaaggagcccgauuccggcucgcacucgcgccaauccagcacagacucaucaggcggccacccggggccucgacuagcuggcggcgcgcagcacguccgcucgcacucgucgcccgcaucccugcagcugggcaccggugcgggagccgcuggaggcccugcacagcagcaugcacaucuccgccagcaguccuaugacgugaccgacgagcugccguugccccccgggugggagaugaccuucacggccacuggccagagauacuuccuuaaguaagucugccggcagucaagaggggcaaaguugugaugcccuggacgcucguguguucguggcgugugugugugugugugugugugugugugugugugugugaaagagagacagagacagagagagagagacagagagagacugagagacugacucuuccaaggugcuucagagaucugcuaagauaaaaaaguaggggaugaaucucugggaguuguacuugacuagaacagagaacguuucaugaaguggaaacugcuuaagcccuaagagauccaggccauuggaaaacuuaaacuuggggaaaggaauuuugagcgacuuuggccuaaaucugggucuuaggcccuuagcgccuucacuuaaguuagcuagcucacagccaggugaguagguggucuggguucuucagucacucaggaaaagcaaaccggaaaagaacacagugccuggugggcuuuaccucucccagcugaugacguaaugaccacacagcacaguaauguaauuaccaaccgcacuguaaaguaguuaugggcuggaccaacaaauuguguggaaauugggucaggagucuuauguuacacuugguaaccuaaaauaccgucacggcagggcaguagugugcguugucauccuucaugcccuaucugccuagcuuuuugagguugugaauuuuacauuagauccagcuuuuugaauuagaucgaacagagaaauguauucucaauugcuagagggaguucuugagggaaagccggggcuggcacuugaauuguuaucagaaccagugaggucauaggggucagguuagaaaaggccuccgaagaaguuguggcugagccauugguguagaaucacuucagcucggcucggcugcgcugccugcccaaagggaagacaucuaagaacuugucuuaaacuucaucuuacagccccguuccuuugcugaaguagccuugcuuugaaaggcucaaauguaagauagcacguacuauuuuaaaaaauguaaugccaagcuccuccuuggcauuaacuaucuuugguccuuugauuacccucuaagaaugagcggauggcaguggaugcugugggcauaucugagacucauccugguucccagcucuuccucaucccaaagcuguugacaucacgugcacuuacuuaguuuuauguguaugugugugcgccuggauguauguaugugcaccacauacaugaagugccuguggaggccagaagaggaugucuaauucccugggguggcagugugagcuccaucccccuccccuaauuugggauuucggugcuaggaacggaacuccaguccucuucaagagcaccaagugguuuuaaccauuagccaucucuccagccucuuggggauauacuuuuuguuguauuuguaaucuuuguuuuggggcuuacuguggugcuggcauccugaagauaacucaauggcuuuggcacacaguuggugucuggauuauugagccaugcaugguguagacacaugcucagggcuuugauuucuaaguggagguugaagucagauaugcaauguaauagcauggcguuuuucuaagucuccaaaggaagauauuaguguccguacugcauacauguucaaaauagcauuguguauaaaugcagcuguauguauuucaccaugauuuuuuuuuuuuuuaccaaugugaacuuugcaauaaauacaaguagcgucucaguaauuuucgauggucccuuuuggccgcagaugauuuuuaaacugcucaugaaugcacacguauauguggaagagccgggcuugccuaauaucugugggaaccuagaaaaaaaaacccaacuucuaaauaaaaucaaauucuuuucuacauguguuuuuaaugauugaaguugcucagauguguuagugauuuagggcaaaaaauagaaguuagccuuggacguagggaggguugcugugauccauuucuguccucccaugcagcuaugggcccuccuccagcuaagccagagugcuucuucauuucauuuugaaugguagauggaguguaaauagugugcuggcaugaccugaugccgucccuggaaauuucuuggcuaagugacuaagaauuuaaggaauuauguuuuugugaauauugucuuguagaauacgcauucugccaagaauucuugauuccuuuuagagcuuuguuugaacuuugaguaagguacguguucugugccacacuuuguuacacggccuuaagaaaaaugguagcuguucacccugauuucauucucuuggaacccauccauuucucaaagugggacuggcaggagacucccauucuugacuauggggagcucaaggcucugucagucagaaaucaaaggacuuuauaaucaacagggaucaguuugagaguuuugggguuuguuguuugugugugugcguuuuguuuuguuuuccaagaaaggguuucuguguguguagcccuggcugucuuggaacuagcuccguugaccaggcuggccuccaacguagcaguuugaggguuuuagugacuuuuguauuuuaucuauccuagaggaggaugaaggugugauuuggcagaagucauguuuuuuaacggugauaucugacugaaacgauuccaucuauuucaaagcggguuuucucuucccuuucaaaacucccccuuugccuaugccaccugcaaagcugaacaguggcuuuaugggaaguggagcugagacauccaagcuuuuaacaauccuuugccguuuucuuagguaggauagauuacuccuagguacauguugucauugcuuucuguuaccuuucuuuuuaaaacagggucucaccuuguagcccuagcuggccuccaacucacagauuugcuuaccucugccugaugaggauuaaaggcagcccuuucuguuucuuaaaggucacuuuuugaguacccacaccuuuucucugcggugguugucuuuaagguaccagacagagagggaaaaccaagugugggaaagcugaaccaggguuucucuaaagcccaagugugcccugguuuacugauaacugaacccacugcaggcuacuuuuuaguuuauuucaugggucagaguuuucagauccaguugugcugggaaccccagugcccuuggaagaacagcaagcuaucuaaugaccaaggcaucucuucagcucuccuacuaagguuuucauuuauuuuuaaauuucugauuauaauggcauaauuuuuuguauaugaaucauaaagcagaauuauaaagaaaaugauguccuucagucaacuuuuucaguuuuuauucuauaaauguagaaauguuauuguagaacacccauaacaguuucugcucuuaauacaauaacauuggccauucuuaauuuuuuuacuguuuuucuuuuuaagacaaggucucaugauguaguuguggcuggccugggacuccugccuugccacugccuccugagccuuggaauuaaaggcgugguuaccacacccugcugcuguuuugccuuuucugaaaucuauguuaaaauauuguuuuugauuaagccucuucacacuugguaacugaucuaguagcccaguggucuuugguugaacaacacugguuuccuuuggccccuuagaucucacagguaggaaucuuuaaacuuuuaaaaauugugucuguaucuaauuuagguuuccucuuuaacccucagcgguaggcucugauaagauagagagggcauaguuccugaaucuaguuuucuuuguuuacauaucaauugucugauaggucaucuuuguuguuuguuuguuuguuuguuuucuaucuacccuccucccccucucuuuucagaccagggucucauguucuugaacucaugacugauauuucagccuuuucucccugagugcugcuagaauuucgggcacaugccaccaugccuuguguguacguuugaacccaggguuuccccuaggcugggcaaguacugucagcugagcugugugccucggcgcauucugucacuuuuguagacugccgguucuguaagacagugacguuuggcuugcugcugguucuuacaggucgccuguuugcaaggaccuuccacauuaccagagccuggaaccuauaaccagaacuuaugcuuuguuuaaaugguuagacaggaguucacuguguagcacuggcuauccugggacuugcucuguagguuaagcuagcuuugaacucucagagaacuccaucggccuuugccuccuuauugcuggcaacauuaaagugguauaccauuauacucagaaguuuuuuuuuuuuaauauuuauuauuacuauuuuuauuuauguguauguacucauugaaugccaugugugugauggcucucucagaggccagaauugagugucagcuucccuggggcuaggguuagaggaauuuguggccuaccugauaugagagcugggaacugaaccuggguccucugcaagagcagcaaguccuccuaacugguucucuauaccccucauaaacaauucugaggguuggaaaauccacagucaacagucuuugauuuuaauguuauaaaaugauuaauuuucucauguacuaguuagaauuggauuuuaucuguuguuuugguuuuuugaaacaaggucucucacuaggcugacuuugaacucacaggggcccaccugugaaugccuucaaggucugggacuaaaaagagguugcuugguuuagguuggauuuuaagcuagcgcuugugugugacauucuaaauccuuaaccaaucgggagagagugcauccaacccgcaugaaaugauuuuuuuucuuacucuucauugaucaauguuacaguccccuuucuucauaguuugaccaugauuuuuuucugacauggucucauucuguagcccacacuggccuuaaauucaugaugauccucucauucagugcccgagaaucuggauuauaacugugaaugaccaugcaggguuuuggacccugauuuucggucuuccagagggaacccuuuuuauuucuuauucaauuacuauacauucauucuauguaaugauagcuuucaucuuuacguuuucauacaugaccgucacauagugugaucauauuuacucucuccauuaccuucuccugacuucccuccuccagaucucuuccacuucccugguuaaucuugcuucugcuuucacgccuuuuccuuuuugagacccaguggauuuaauuggaauugcuuccguagcauggaaagggguuauuuauagggccccuacuaaugggaucguacuaauggugacaucacugaagaaaauggcucucccuccucagcagaccauuaacuccucauaugcccucagagagauacuggcuuuugagagcucugcccacuagcaacuguugacugcuuauaaauacucaggggaggugaaccaugacuuucugagaaaauuuuuuucuaguaugucuaaguaacuuuuaguguguuugugucuuauuuacccuuaugaucuaggauauauuuugugcucuguccaauccguuuggcaucuaccauugagcuauauaauuagucuguuauaugucaagauuugaauccaacuguggaugaggucccauagggcuucagagagagaaguccuuauagaucccguaaaggaccugaggugaauagucaggaggaaauuaaaaagaaaagaaaaaaaaagugugccuagaagccagcaaagaaaaugauaaggagaaggaaugguuagcucugugauccuagacauguucagggaacacauuccuccccacugaggacacuuuuuccugggcuauguauguuaauuuaguaauauaauuugggcaaaugaagaaaauaggaauucagauaguuguaggcaacauguucucuuacagcccuccacguucucuuacaagacccuacugucccugaagaagaguaagucccucacuucauagggcugaugcuuuguggagacaccauacauuugcuuaagcacucuacuacaaugagaucugaagccaguguuuuuauagcuaaauuaaaagauuggaauuccagggcuggaaaguugauguugcauagggcccagguucaauucccagcauccacauggaagcucaccaccucuucaggcaucagacaugccugugugucacagacauacaugcaggcaaaacacucauacucauaauguaauauaaauaaaccccuccccgccgggcgugguggugcacgccuuuaaucccagcacucaggaggcagaggcaggcggauuucugaguacgaggccagcuuggucuacaaagugagcuccaagauagucaggccuauacagagaaacccugucucaaaaaaaaaaaaaaaaaaaaacaaaccaaaaaaaccaaaacaacaacaaaaaacccucccuaaaauaagaacaaaacgagauuugaauucaaguauuauccuaauugauaaaauaaucacuugucugguuuuuuggucucugcucugcuguggucgaucuuuguaaguuaguggcauguaucuguuguugggguaugucauacuaaauuagccguaagagcagcagguuauguuuggagagugucauuuguacgugugguucuggaacucuaauacguaguuuugggugaggguuuaucuuuucugucucuugugguuuuuauuguuuguuugccagaacugguacuuggcaaagggaauucugagauuaaugcaaggaaauucuucagguuauauuugauucuaucaagcugaguuaggcuugguuacaguuuauaguuagagccuauauugagacuaaaaggcuauuucauggcucgggagacguggcuuagccuucacgagcccuggcugcccucgaagaggacccaggcugaguucccaguacacauaugguggcucacaacggucuguaacucuaguucuaggggguccucuucuggucuccaggggcacuguacauacgugcagguacaugaaauaaauaaauaaauaaauaaauaaauaaauaaauaugaaaggcuaucuuacuuguuuguauuuuguaaauuuaggagcaacuguuauagauuugggauuuguauagacaugaauuuaauaggagggauuaggguucauauaggaaacgauaaacuuaaguucuguucaugacauucuugaaguuucaugaugaugaugauggaggcaggguuucucugugucacaaccccggcuguccuggaacuugcucugcagacuugccucccgagugcugggauuaaaggugugugucaucacacaccauuucugaagcuuagaaaauucuguaguacagcuguaccuacuuuauagguuuuuguuuucuguaguguguaaacuacaagccuauguauauacagcuuugggaaaacagggauuuuuaaauuauaucaucuaacauauauuuggcuaacuugugccaaguauaauaucauauaauaccauaaaguccagccaugaauuuguauuguggaauagcuugaagaaaugaaaugaaaguuaggaauaaaggaguagcuagcuguuuguggguuaagcuauaacuaagugugaucuuucuuuucuuagucuaguagaaaguugucccauuguuggguaagaguucagcuugaguuagugauuuaacaguuucugcauuuugcauaugaagauggugagggugggcucaggcucagcaaagacagccgaaaggaaggccugaaucuuaauaacuauugaucagugaucaucagcucuuucacaguuggaacagcauagaguguggggcccuuauggaaaacugggugucagugcuaaacaaaugacuguaaagccugcaucccaaacuguggcugacucugacagugucagagcaaguuauguaguccugcagccuuuuguaauuauuagccacagugccgugagucaggugcugccccaugcuuuccauuuaaccuguuaauuguccaguccuagugaaucgcuuugaaaaucacuaagggacgcagauuucucacuugcacgugccucaggauacccagcuuaccucauaggugaauagguggcuccgggacagucaaagagcauugcuuaugugugccuuaaagcaaagugucuucaaggaguucuaguggcuucuacaaggcccuccuuaggccugguaaaccucuugggugacacaugucugcuuuguggauccuaggauugagagcugcaggaagaaaggauuauaaacuugucugugaauauggggacauacacugcuguuaugaaauuuugucagcugaagugaaaaugaguguuuauuucguuuuuauauuacauuuaguuauuuaauguuugucuucaugucugcgagugccacaacucgccugugccacagugugaguggaaguuaggacaauuugcagaaauugguuuucuccuuuuacuauguuggucccaggauuuaacucggguaugguggcaugugccuuuaccugcugagccaucuugccagaugauagauguagccuuugauauaauaauguagaccuggauauauuuagagauaaaguuauucuauauaccaacucauggguaugauaaaggaaaaucagauuuuuaaaacauucauuuagaagcucauauugaaugaaaugucuuuuuaaaauguuuguuugcuuauuuguuuauuuauuuauuuaauugaaaacagauucuuuucucauaucauagacccugauuauauuuugccuucucucuuccaaguuccuuccugcuucuccuucccuccggaucuacuccuuucuugucucuuauuaaaaaagagcagucuuguaagagauaacaaccaaacauuacauaauaaaauaugacaagaugaagcaaaaacuaucauauugaaguuggaaauggcaaccuaauaggaggaaguuucgagagucccaagaggaggcacaagagucagagacucauuuccauagucaggaguccccuaaaaauacuaagcugaaacggguaauauauccagauacaggggaccugguauggacacauguagguccuguacauccugcuucagucucuguggucucauaugucugcuuaguugauucagagggccuguucucuuggugucuuccauccucucuggcaggacagagucagauuuucgccuccuuuuccuagagguuuccugaacucugaggggagggauucgauggagaucuccaauuuggacucucuccaaguaaugucuggcuguggguuucugcaucucuucccauuugcugcaggaggaagcuucucugaugacuggauaagguacugaucuaggaguacagcagaacacuaguaggaaucauuucauuguuugguuuaauccuagauuuuggugcuaucuaguuucuguuucuugggcaguguuguguuuuggcuccuucuugaggagggagcuuuaagucaaaccagacauugguuggcuacuuccacauguucuaggccaccagugccuuagcacauuuuacaggcaggacagaucauaggucaaagguuuugugacuguuugguguguuucucuuucaguugucugcagaguaccuuccuacaccaaagaggcuagaauguagggaaaaagacucuauauagguaccagcucaaccucuccauguuuaaugaguugugugaguguuuuccuuggcaauggggccuuuacuggcaguuugcagagaguaaccuuuuugucuuagcaacagcuuggguuguuuagggauuuccaugguacccccuaggccaacagaucaauugaaugcaacccaguccugccacuggaagccuuucccagcuacaagagguggucaguuaggauucuauacucauuacuaggaguccucuuuaggaucacuggugguuugaauaggaauggccucuauaggcucauauguuugaauguuuggcccacagggaguagggcuauuaggagguguggccuuguuggaguaggugugaccuugcuggaggaagugugucacuuugaggccuucaaagcucuagucagcucucccuguugaccugaggaucaagauguagaacucucagcucccaguccagcaaguacugugucuaccugcaugcugccauguuucucaccauuacuauaauggacuaaacuuacucugaaucuguaagccagccccaauuaaauguuuuccuuuguaagaguuucuguggucauggugucucuucacaggaaagaaacccuaacuaagacagucaccuucauauaucuuuggaaguuucuauuccacaccacccuccaaauaccucucaauuucagccuucuauucccccaaucccaucccccuucccucaucugauccuccauuguauccuuaccaaccccagucugcuguaaaauuuauucuauuucccaauccuaaguuucauuguauugcauuagcuggccuauguagacacugacuggcucacuauguagacagggcuaaucucaaaaucauggagauccaccugccucucugccucuugguugcugggauaaacgcauagaagaggauugaauucagaucuucaggcuuggcauugaacaccuuuaucugcugagccaucaccaucagcuugcucucucucucucucucucucucucucucauacagggucuuuuuauauaggucagcuguccuggaacucaucaggcuggucuugaacucacagaguucuugaaugcuaagauuaaaugugugugucacccaccaccauaccuggcucagaguugcuuuuuguuagagcagaucaaaaguaguucuuuggcuagaagcaaaacaucuaaguuucuaaggucgcggugguauaaguggugugggucuguauucguccuaaccuuugucgguugacagaucagcuguuuuaaagauggugcaggcuauuggaacuuuaaugagucaucugaaaaaugagugugacccugagagacagacaguucagguuguuuguacuuggcagucugaaugggcuuugagcaugaggagagauagugcaugaaacuauaaauagucuuaaggggauuuuugcaagaaaaauggcaagauucguaugaaagggggcccuaugagaguaagggagacccaagaagcuguguuaggacucuugugcuauccugaacuuuuagacaaagcuaaauuuuugggaaaggcgaggaagguaauauaaggucgaacgauugucuagaacuagaaauacucauaaaagacuugagggguuuuguagauuuccuucguuacaggauagauaaucgcuguugccugaguuugcugggagauaaaagagcacaccuacuacuuuaaaaacauuuaaacaccagcugacccuagaacccuugaaaacagaacaggucuucagguaugcuggcaugcuggcuccucagggcaagccccaggaagcaggugguugcaggcagacugcuccuuaugcaauguugccugccuuuguucucaagcgugauguuggaguggccugcuuugguuuguuucuggucugcagccugcuugggugaauuuaaaaaccuguuuguuucauccaucagccagcugggcuuuacccauaauuccugaacuuugauuauggggguuauuauuggacaagagcgucuuugucaaggagaauguuuaauacucuggggucuagcgugacuagcggauguaaauuguauggaaguaauuaaaugugaaggaaaugucaugugggcugaauugaaauguucagacuuuguggcagucauuuuuuuuuuuuuuaaauguauacuaagaaggaugggaagagaaaaauaaagguucaaagaguuaagggagcagauacagagcucagacuccuugucuguccuggcugaaauucgaagucaagagcaaguauucugugaauuccauugcccuucaggugaacccguggagucuagaugcuggggcgcuugcucuucuucccaagugucuuuucuccacauagaugugaaugcagcaagggagugggcguuugauguuguuacagaacagacuuggagcuguggagaugauggcuguuucucgaguccuuguuccauuuuguacauaggaaugccagugucugugcagaggggugccucuuuggauuucugggcauacuugugauuuuucuccuuguaugcagugccuuuuaccacugugcuugaucuuuuaagacagcaaaccccucucuugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguuuggagcugagaugaaaggauggaccauguagagacugccauauccagggauccaccccauaaucagcauccaaacgcugacaccauugcauauacuagcaagauuuuaucgaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauaaaaaauggaaaaaaaaaaaaaaaaaaaaaaaaaaaaaaaaaagacagcaaaccccaucuccucccugacacccuagugguccaaacaagcagaaggccuuucuacuucuccccagccccagucguaauuuaaucugugccauguaguauuuggccauuaaaagguccuguagugcuuauugucaaaagaacgaacuuaauucauuucccugacauuaugaaaauauggacugggccuugaugcaaagaaauacagugcuggcauugaaugcuguaaaauugugagucucucuguguguguauguguguguguguguguguguguguguguguacacaugagugcagugccaaggagacgagaggcacuggaucccuggagcuagaauuauaaacugguuguaaacugccuuguguggguucugggaauugaacucagauccuuucaacugcucuuaacugcuaagccaucucaccagcuuuugaaaucauuauggugucacuggguguucagaggcagacauggacacauguuagauuugaugcaauagugcaaguucgguuugcaguugaguuugguccuguaggcuacccuggucugcucugauggaaggcacuuguguucuauuuuuguuuuuuauuuguaaauucguacagcuaaggaucagauguuguccacuuuguguuucuugagcaucuagcuuaaaaccagguauauaguagugauucggauaaugcgucgauuuucacuucucuacuugaucaugugauaauuuucccauugauguuuggaguucauuuuguguccugcuguccuuagcauaguagcuauguauaaaguagauuucauucuguaauauguucuacuauucuugguauuuauuuucuugucugaccguaugugcuaagacaucaccuccucagacagaacaaugaagauccaggagagagaucguugcugugaguagcacauuguacauacccauccccacauuauuucaugaucuauuugguggaaguuuaccacccuaacccuucugcuuucaaagcucuugagacugaaacuuucccaggaauuuaacggaauuauuacauacauuuaauacaagagauuaaaugggaauuugggaucguugcuguaauuaagcagguuaacuuuaucaauagugagcuuauugaugucagaggagcuagucagucuugaauauuaagcauagccucggccaccgcggcgcacaccuuuaaucccagcauucgggaggcagaggcaggcggauuucugaguuugaggccagccuggucuacagagugaguuccaggacagccagggcuauacagaggaaacccugucucaaaaaaaaaauaccaaaaaccaaaaccaaaaaacccacgggugguggugguggugguggugguggugguggugguggugguggaacauagccucaaguucauucucaguggcccaccauuacccauaaauaaacuuaaaaggaaauuuagucaauguagucagauaaacccaggggagacuguacuucuggggacaccccauucuaaaucauucacuuauuacuaauauuuucauguagagauuuaucuugagacauuuaucacuaacaugucauugaggauuauauagacugcccacuucaucauuuuuagggagcguuucauuauccaaagacauggcacucaacaaguuuaauuaguaaauguacauuguguuugcacgauaguuuacauuuauuuauuuuuaguuccuucuuuuuuaagaugugugcgcaugugcacaugcaagcauauauagaucauguucaagcauuuaugauggucggacuuugguaaggaauagucauuagucuguuggcucuuuuucucucagaagucccauccucaaagaucagggcuaagucuuauuuuugucuagaaccuaagaaugaguaacugaaccagagacugaaaagggauguuuugaugagcggcugugagguuuucucuuucuucugcuguugucuucgggagcugggucaccuaguuccugaugcacccaccuccacauugacuugucuaauagaagccccacucugucauuguaugcauguauguauguauguaugcauguaaaaugguuuagacagcauuuuaccauguagcucugguuuggaacucacgaugcagaccgggcugaccuugaacucaugggaaucuucuugccucugccuccugaguacugguauuaaagguaugagccauuaugccuuuaugcauucuuuuugauacuuucuuuuuuuggggggaggggggguucgagacuccauaccccauaugauacuuuaaucauuccuaaaaugguuuauccccauuucacucaggaaaccaagauagagauguuuaacuuggccaaagucauaugccagccaaaccuuggcccugaccgcccuuuuccauccuugacgugguugacugugcugucucaccucuuugggaucucgucuuuccuuccugcuucucuguuccuguugccuccacccuccugugacuugauuguuccuuugugaaggcuguauuuccuuauaccagaccuuggucucuugugguuguaacuagacacucccaucucauuguucucaauucuaccccuguuagaggaguccuguccuggcagggcugaccuuccggccggguucuuacccuuugcaguaugaacaccugguucugcucaucuaggcuuacugcuugcuggccccugggugguauuuaccuccuugccguaguaucucuaccucuugucugaucuuuuacccacugcauucuaugauguaggccuaucuuggcuuuauuuccuacccaaaugcucaguuuuuagggucuuugccucccuugagucuaguacaaaagguugcugggcauaacuucaguuuuucagauuuugaaaacuccaacaaugcuuauauccuuuuguggggucauaccuggucuagcacugaagagggccccguauuugggggacauugaguaguguauccaguaggcagaggacauuaggaaacugauuucgaccugaauauuggguuuguuacuugguuuccucauucuugagugaggaaacuugaagauuagcugagguuccuuuuaauuuuaguaauggauuuuuuggggggggggguuugguuuuuuggauuuuucgagacaggguuucucuguguagcccugacuguccuggaacucacuuuguagaucaggcucgaacucagaaauccgccugccucugccucccaagugcugggaugaaaggcgugcgccaccacgcccggcuaguaauggauuuuuaaagaaagauuauugggauaugauuuaaauaacauaaucuacuaaaguguauauaguccaauauguuuuauguauucauagauaguuggagcuauccauuuuagaacauuuucauuacugcaaagaaaagcccuacuagcuggacaacuauuagcugucacccuucucuguccucccuccuaccccaucugcuuauccuucuuagcuuuaaacaaucacuaguguguauuauguuucucuccauuugcuuauucuggccaccuuguguaaagggaggcaugucaucguggacuuugacgacagguuguuuuuugcuugguauacuguuuucaguguagcacgcagcaacggcaccucauucgcuguguggcuaacugauguucuaagaugacuauuguuaaugcguucgucugcuggucuguuggcgaguacucagguugcuuccuuugguaguuucuucuguuuuuuugagagaaaaguggccucuuccuucucuucagugguuucuauggcugccaguuacaguuuccauucgcugcuucaaaugcaggaaucuggaccuaaugguggugugggcauaguguggauagacaggucggauacuuggccagcgucaucagcagagaccagucaggcagugcucaugaguuuuguaguuaaacauucugguuugaaucauggcugugccacugaaugagauuagguaaccagcaagcucucauuuccuuguuuguggagucucuucugacuguuuccuuagacucagaacuaugcuagaaagggguuggagcucagcagugcagagggaccuuauuaucacuguaaaagcaaguaaguacgcaaguaaauauguaaaaguuauaaaauaagugcucaaguuguccguuuuuagaauaguaccuucaagccuucccucucaucaacugcagugggcaaguaugugugugcgugugcuaugugaguuuauauagauugcaugagugaagaaggugucugugaaguccacaggaggaugccauaucugcggaaacuguaguuauagggaauugugagcaaccauguagguguugggaaccuaaccaggguccucugcaagaacagcagcuaaugcucuuaaccauacagucaccugcccaacccccucguagccccaauucaccuuccucuaguuuuaugcucuggccccugcuucaucagguccuuugagaauggcucucaugccugagguaccugccauuguuuggaaaagauagagagggugcaugucuuauucagaacaagaugggcuacuucuuucaagggauuuacuuaaagguugucucccugagcuaaauuucuaaaaucuacuuguauauuucuugagauuaugcuacaauuguaucauuuccuucucccuucaucccuucaaauccuccucccgcacacgcgcccccauuaaauucguggccuggaacuuucuauguaaauagggcuggccuccaagucacaaaucugucugccugcacgugccuccugagggcugggcuugacggcauggagcaccacccuggcuguauauuugggguuuguacacgaagccugaaauauuagcgccccccccccauuaguuggaugagaaaugaaauguuaguuuggcccuaacucuauuuguagguuguugcucauaacaauuccucuggcugaagaaguuagucguuauuguggaaauuauaaagaacccuugaggauguagcuucagauuuuagguaaaauuuccugcacaugcagaucaaccauuguaaaaaaaguauuuuaaaguaagguuuucgccaggcagugguggcgcacgccuuuaaucccagcacucaggaggcagaggcaggcggauuucugaguucgaggccagccuggucuacagagugaguuccaggacauccagggcuauacagagaaacccugucucggaaaacaaacaaaauaaaauuaacguuuuuggauacauauaauuuuauauuuacagucacuggucuuuagagagaagcgaaaauauuuuuuuuucuaaaaauaaagaaauaaauccaaacaguuucuaccuccacacucuuugugggaggugaaugaaaagcucaguugggucuguaagucuagagucccuugcgccaggcuagugggccaggcccggcuucagcuccuuugcaguccguugaucuaugcucaugcaugcgcugugagauggucacuuuccgacuaaccauauuuuguguaggagaugcugauagaagacuaucauuaacucuguccuuccuaccacuagauugugacccuuuguaguuaaacagaauuuagacacgaagugagaauggacaucucuuacagggaggcuucugggccucuuggucucuaucucggcccugcaaaaggaaggcuuagucauggagucauuaaccauucuuguuaccucaggcuuaggcaccaugagucagcuuccccucgcuugcucugcuucagagguuuccugauuuacauguaaacuccuguucaccugcccagcagggcucaggcaugugagcagggcucaggcaugugaccagggcaucaccuggaguggcaguccugggcccugguuuacauagagccuagcaggacugcagagagagcaagggggaaauucuuaccauccuguuauuucuguccucagaugaaugcauaauacaaaagggaguggaaaauuuuagaauuuuuuaucugaugcuauuaccuaaguaguuuuauuuucuuauauuacugaugcucauuuucagagcuagaggaagaaacaaaacuucaggccaauuuuauauguuauuuugaggagacuacuccuuuuauaaguagccuuuccucaaauaucauccuuuaaguuauuguaaaaauagcaaaauaaugaaaugggauuuaaaauaaaaaauaaaaaaaaaaccgugugugugugugugugugugugugugugugugugcgugugugaacccugccacaggcuaggugaguacuuugccugugaagcuggaaauuucuuuggggguuaaggugggcagguucugcagcccagcaaacagugaucuucagcaucuuuucuugcaaggcuuuaguagccucagggaguaggcaggagacaugggugcaugggcuuguguuugugacccggaggagccccgcccccccuaagaucaaaggcacuuauuuuaguuugggaaagauaugaaaccuuuuuuuuuuuuuuuuuuuuuuuuugaaaaauaaacacuaacauucauuaaauaaggcuaaguacggugguacauaccugugauccuagcccucagaagucugaggcaggagaauucauaguuugaggcagguuugggcugccuagugagaaagacucuuaucucaaaacagaacaaaacaaaaagaaaagagaaacugggaggccgaggccuuugcugccuucagacuugauaaugguguaggaguugggaaacaccuuuucuuuuccuugagcuguucuuugaacuauuuggcagagauaacugcaagacugugucaucucauuggaauuuuucuugguacuguuugaaauagauacacuccuucuaaauaaccauuuuuccccccagccucugaaaauucacauugucucugcucuugugaggguuauacacauucugccagcuggggaagacacuggcaagaaugggcuugucgccugagguacugaagcguaccaguggccaacguugacuccaguggcagugucuuagaauuugcucauuugguuuucuuugcugcggagggugcagcucauaaaaagcuucuccaaacugucuuaaccguaggccuuuaccacaaacauggcucaggggauaugaaaaagcaaggagaaccugaccugggcgugaaaccuuuguaaaucucauagaugacaagcucacguggccucaagggcuaugcaacauggaugucuccaguuggcuugacaucacauuugacacuuguggucugagagugcccucucuagccacagugcuucuccuuaggcuguuacggugaauucccuuuucccggcuuagcuguaaggcaccugucauguguuucucucucaagccucuucaccuuuaugagcaucaggaagaugguauugacaucaaauuuuuggguucaucugcuucauuucauugcuuggcauaaauaugggguugacuuccucacauaugacuccuuacccccaacagugaaaaugaggguaagugguuuuuaaauuuggauuguagucaagaagaaggugaacaauaaaaguucuugccagauaaaauacugauguccacuuaaaugugaauuucugauaaacauuggaugaauuuuuugcaugaguacaucccaugccgggcaguggugguacaugccuuuaaucccagcacuugggaggcagaggcggguggauuucuaaguucaaggccaaccuggucuacagagugaguuccaggacagccagggauacacagagaaacccugucucaaaaaacaauacaaaacaaaacaaaaauaaauaaaauaaaauaaaauaaaauaaaugaguacaaauuuugcaugggacauaugguaaaaauaauuauuuguuguuucccugaaauuuauauuuaccugggcauacugaguuuuucuugagugagagucucaugccuaggccaguuucauguagcccaggcuggccuccagauggccuugaacucaaaaaucuuccugcuccuaugcccuuucuccucaucuuccucuucuuccuccuccuccucuuccuccucuuccuucucuauuucuaguuuauguggcccaagauuucuuugcuguggcgagcugcuggggaguggcccaaugggcaggauauuacacuagugugaauuaagagagggcggggcauaaauaaaaaguauuggccaagcaacugcuugguggccucaggacagaguggguguucaacuaccugcuuacuaugugacaagauugggcaacaccuuguuuuugaugcuauuuuuggauguucuccuguguugcguguguuucaccaucuuaucaccacaccuucagugugggcgccuuuccaacugaugcucuuuugcccacaagggcaagcaccugcaggaucuuuccuuggaacguauuuuaaaaaggaguagaauuuuacuucuaaccaagaacguagagucugcuuuggggaguuuaaauacauaaauuaauaaagugagagccguuuuuuuguaugcuaaauaucaccuugauuauagucaguuuuucccuuuaauauguuacagaacacauauaugguugcauuagccauucucuuuaaauucugccucauacaagaugaggguuguuuuuucuucuuuguuauguuguugcuuucucucucucucucucugucucucucucucucucucucucucugucucucucugucucucucugucucucugucucucuuucuuucucucuuucucuuugagacagagucuuucuauguagcccuauauguuaaggaacucuaucuagaccagguugaccugaaggucauagagauccucuugcaucugccuccggaguguugggauuaaaggcgaacagcacucugccgcacaggcugucaaguuuuuagcuuuguuuaguaccaccugguuugcucuggguuacugucuacugggcuuuuugggaaucccaauuauuaaauaguaggguucaguaauacagaagauugacagaguagaaagaauuaguauucaguuacuccaugcagugucuccacguuaagacuugcccacuuuagcugacgauggcuuaggaggccaucugagguguuuuuauuucccuuacuccugcagcagccacacacagucucucuacuuuaagaccugcccauuucagcugacguuggccaagguguuuuuauuucccuuagcccugcagcagaacuccuguuuccugagugacaauuacuuugcugucauuacugugugguuguguuuaggagugucaccuugaucgugagcucagcugugugucaggcaucuggggugggacuugguagacacauaagguugaguggaggugugucagugauuaagaagggagcacuugguuugagucagggaauuuagugccaggcuugcuuguuuccucacgaggaagcaccuccuuugcccgucgccuuaguaucugcuucgcuaugacaaaaaucaaagaagagcaggguaguuuguuuugucaaauucuauuucauuaauaaucagcuuuucuuaauaugacugauuugguuucccaauuuuguaagaaauagaacauacauauacuuagugcaaacguugguguuuuauuacuuuaaaaaaauacuagucugucucucugucuguuuucugagauaggauuuuucuauguagcucuggcuguccuggaacuccagcuguaaaggaggccggccucaaacucggagaucugccucuucugccuccugagugcugggauuaaagguauucaccacugcccugcuauuuuuauuuuuuaaacauuuacuuuauuuuaaauucugugugucucugugugucucuauguggguaugucugugggaggugaggggcaucagauuccuuugaucgggaguuacacacacacacacacacacacacacacacacacacacacacgugugagcagucugaugugggugcugggaauugaacucaguuccugcauucucuuaaccucugaggccccuuuuccagccuguuauuuuagacagaugcagcaaauugggucauuacaggggaugcauuacuuccacugaagagcuagucccgcugggaguauccaaucuguagggcuugggucuuuggccauaaauguagcacaaauuaauagugcucuacuuugcugccugcucugaucaaaagugagccuguuccagcccaacaagucaggacuguuccagcugaaacugcuggauguccagugcaauugaggcccagguugacucuggauggagugucuuuuggacucuacagcuguuuucuuggcgucucucuuccccucggccacauucucuuuuccagcugaugguccuauggauucaggcagcugugggcucccacaucccaggugagcaauuuuagaagggacgagagggauuucccccagcugcagugaaugucauaucuguuuauguguccucccuaugucucaucagggcaagguaguggauuagucacuguccaagaaucacauaguuaccaugaaguaagagcaguuuccucaguuggaauggcuauguuggugggagguaggguggaaaguucuguggccaggagggaucgucugggcagauaauaaccacauauuaagaagaaugcaagccaugcaggaggugaggaaccuggccugaccuuguguauaagcuguaaagaacugaaacacaccaguguaguuuguggcauuauccaaacuauauagauguaauaaggaaauccuguuaaguguaaagaaccuuagucauucagagggguuugugaguuuuuacaucagacacaguuucccauguguggcaacguuacauuguacuucucuugucugcggucucucaggagauuuuuaguuccgaaaguagcaguccaacuucugcuuuugcaaguuggcauuuacccauagagaagauuuuucacucauucaaauagguaugucagaaugcaguuucauggaaaugauguuguuauucaguagauaaaggcuuugauucacaaaaccaaagucagucuguuugguaaaaauaaacugggcuguuucaucgcucaggcauuuuuagugacuauccaggauuccacuuagagcuguaugcuaauuuguucauccaguuucucaaguucacauuuuaaauaagcaaaugggauaaacauaguuuuaagaagauguauacucauugauuuauuagaaaugauucuuaaaacuagaauuacuggacauaaagcuauugcugcuguguguuuuaauagagaugaggggggggggggaagaagacagucaacccagagccauuugaauacugaaucaaguguauuaauucucuuccuuuacaaaugauuuguuucguauguauuuauuuguaagugugugugugugugugugugugugugugugugguagugcaucugccacauauaugagggugcccacagagaaccagaagaggguuccagaucuccuguagcuagaguuacaggcugcugugagcugcucugugugcugggaaucaaacucauguccucugacagagcagccagcacucuuaagcacucagccaucuuuccaacuucagcucuauuuucuuuuacuacauguaauauugaguuuaauuuuaacuaccaaaauguucuuauuauaauuguauuauuuauaugacuuuauguuauuaguauaaaucuaucauuuaauggcccuaauauuuuucuaguuucuaaaaaauauguuaauuauuuuaauuauuuaacuagcuugagagaaagauauugaagaaauaauaacagccuuugauaacucgacugucacuaagcaucauugucagaaacaucaugagaggcuacaguaagccccuguuauauuaaagaaggaguaaugacuaauaucaugucaugggcguguuaugugucgauaagucagacagcaguuuugcagguauaggaugugagagauggacucauccacccacuguuuuuuuaggugaaagugagugacuugaagcugacacuaaagagaggaaagcauaggaguuggcagacauuuauguucuuugggaccugggcaaauauccucauggagcuugugagaaacugcccauuguauacuaaaacggggcagagaaaccgagaguuuaaugucauggcccuguacuauaaugcauguaaaucuuuuugagacugucugcaauacauaauuuuauuauauaugaaagaugcacauaguucuuuaaacacugaacuguaguauagugagauguaggccaacuuaaugacuucugucuucugccaaguucaguaauuuuuuucucuuaauuucucacuugauuuuuguuucuuccauaaauuuucuauuaucuggcaaacaguuucuaguugcaccugguugcuuugaucagcaucucaagaagacuggaaagucuguuugcuagucuccaguccugggcaugguaccguacaacaggcuacuguggggcaguggcuuccugcucagagaauccuguuuauuaacagcacuccuucuuagcauucaucacuucuguuugggaacugugguuuucugcucccuuccaauaacauuacuugaauuuaagagaaaaaauuacagaaauaugguuuuacaaagucuccagugauuagaauuacugucugggauuuuuaaaaaguagacagcaaagaggcaagaggaaggugcugaguaguuuaaagacgagaaccguuucuuuacaaaggagguuuaaaaaccaugagguuagugaguuuuacccuuuaaaaacgaaauuuagugaacuucaaauccauucaagcaaauugccaagguagagaaaucucgccauucugucacauuuuuagcacaauaaaguaaaauuggcaacaacguuguuucaggaucuguuauucuuucaggagaaauuuaauucuggcauagaaucguuccuacugugaguggcaugaauucuuuaaagagcuucagauuucugguaguuuauuugcuuguaucuguuuaccucagucaccacaaggaaacagaaugucccaaagggacaguucuagauuugugugugugauccagaaauauauucuugcauguuuuuuucuuuuuuuuuuugaauuauuuauuuauuuuauguauauguguacaguguacacugcaucagaucccauugcagaugguugugagccaccaugugguugcugggaauuaaacucaggaccucuggaggaucagucaaugcuuuuaaaccacugagccaucucuccagcccuguuuuuuuuuuuuuuuuugcaauggaaauauuguuaauggggacucauagauaucugaacugacauuugagguuuuaaaacagacaagaaucaaacucauucccauuccuauaaaaauguccugucauguucauaguuaagauugauugucugucuuaacuaucucuuucaguugugucugucugucugucugucucugugucugugugucuguguggugugguguauuuuacagagcaaaggaauauggguggagcuguaagaugcuugacucuccagagagucauaaugaucuuuggagcuuaauuuguaggcaccugacccuucagaauuggaggcaguccuucucuucuucauccagaccucagugaagggaaggaauccuuuccgucagaccccaccuucaucuuaguaggugaauucuguaguugcuucagccuaagggcugacugaccaaacagguuucgagaaaauucagcccugcuugcagccuucacacuacuaaccuugugaccuuugcauguuccacaugcugaguuccaacuuuauauaauaaaaagagacuaggugcucagacccuucuuuaugggauguggccuaguguagugguaaguguauggcuucuggccucacaauguuuggguuuaauucugaguccuaugucucauuuccuuaucucaaaauggagaugguaagcaucuuggaaacuaggccauuaaugugguugagagagccaguuuaucuuaaaggacauaagagugccaguggguagaguuucaggaccaagaacuguaucuauguauagguguuaaauggagccacauuccuaacugguauaaugauaagaucuuagaugcuuauaaggacuccugguuuuaagaacaaaauuuagaaaucaucucacaugauccugaaagguccagaccauagcaaaaaugugguccuuagugucagagggugggaagacaaauggcagccugugcagucaguguuucugggguugucaggucuuugggcaguacagcuaagcugaggggccaucaguucaaggggaaaggaaaacuugaauagaggugucuuuguugucuccaggaguguguggagguugaauacguuaucagcugguucccuuuucaguaguacugcugacagacacugccucaguuacuauaaagagucugaggggaagcaauguagcuuuucauuagggggguggggugggagaaagagacauucugggggcgcacucaugagagugccuucuccucgaaucuucacauuccucuuuggacaugauauaauccagaggugugacuaauggugagcgucaccacuccuagaaaguuguccugggagcaagcauggcugggccucuuucccuguuguuuuuagcuuucagucuggugaggucacuacaguggcagguuugucuggguuggaugucccugagugucuugaggauaccaaggaguuggaggagguguuguccccugcauugauucugccccgacccuggaguccagguaguggcuggggaaaggagagaagggacagguuuuuuuccaguuugcccucccagugggugcuagcuuuaccuuucuggguuucugaaguuuggagaaacauaaagacuuuaggucuagacagaauuggguucaaaucucagcucugucuuuuguaagguuucuuucauauauacacucacaaagcccccugcauuuguuuucauuuacccuaauaacaggcguguuacacauuucugcuuuucuccauuugucugcaagcaccagauguaaaggcauuucaguucuggcauuggcuaagagcacuuuucagugccugacuuacacauagccucuugccuauugugggugaugguauaaggaucaaggauaaacaugcuaaccucugguaccaagacagaugcucaaggauguuguggauggugguggggagcaccuccaguuugaugcuagcacauugccuucagauuauuucucuuguguuauuugacacuguuguccuaggcuuucauagccaggcugauuccaggagccuucacguuuuucuucauugucuucaaacuucucguuucaguucauccuuaaaacgcaggcaguagcuuuuuaaaaaguaauccuugaaagcuauuucaaaagaaauuuugcuucguuaaguaaguggggcgagguccuacuacaagggacuuucucucauaauuugcugaguuuuuccuguccacuuuuguaugucugcuucuaggaguucaauguguauguaucuauaauaauuguucuuuuccuuuggcuaaugauuuccuuugacuaauucuauacuuuauuuuuauaucuuuugggugggggugggguagaguccacugauacuuacaauuugauuuauauagaacauuauauuauuuauaaucuuuauuuaaagauuuuauuauguaugcaugugugguugggugggagguuggggcaugcucuguguuuggagguuggaggacaacuccuuuuuaagaguugauucgcuccuaucugugggugcuagggauugagcucaggccacuggacuugcuggaaaguacccuuauguccugaggugucucacuggcccugauuuauauagaauuuuagaagaauccacauacuuuuaaaaaacggggacagcuauaaauaaugauauaugacuaauuugugggaacucauagguuuccaaaaaaccuacauuuugcagcuugaagucuaguguaagggcuguuguguagcuugggcucauccacaugaacuuggagaaagaugaggacaggaaaagaagaugaauugauuacacgguguucuggucuuacagcgagggaucuuuguuguuuguuuguuuuguuguuuuucucuucuuuugaaaugaagucuugcaaccaaggcugaacuugaaugcccaauuguccaguuuaagacacuugggugucuggauuacagcuguagccaggugcuucgggaugagauaaaguuucaaucccgcuuucuuuuuuuuuuuuuuuuuuuuuuucucgguucauuuuguuugccagcagcccuucugagcgugacuacuuugucauggcacucugugauuccuaaguggaaaacagccauucauguuaacuaacgcuggagagaaaaacgggaugugugcuggucucgcucagauaaaaugcauucugauggcaaaggaaacuccgagggagauugcuaacagcaguuuccccugcuuuuuaccuaaugccaaacaaaaccaaccauccccuaguuagauucaugucugaccuauguaugaaaaguaacguuuccucccugucuccuuagauagaggcuuagaguaacuaaguaucuuucuuuccacaucgauccucaguaucaggaaacucugucaugugcuaaucaauuaaugcgugucuuaaguaaccaacaucuuuacaagucugaaaaugacuucuaauacuucaugucaagaugaaagagauuuauuagauuagagaaguacacagggagagauacuuugugcuagccuggggauuugaauacaggagcuuaggaggaagccaucccagagcugagacuuuaaagacagagccacugaaaagagguucaggaagcggcucuucucguuuuaagacaucccguggaggcuuugggggcccgggaggaugagguuuauagaggugaauuggauaugagacaggaagugucuacaggcacagagcaagugccgguugcuggcugucugaguguaggagaccuucagcuguacgguuuggaugcucacgcucguuugaacccucccggaauguuccugguguguguuaugaagggaugucucucaccgaggauauugacucagcgauguuuccguuuacagucaggauggccuccaccacaccaauauuguucucaggccuuuucuguuuuguuuuguuuuguuaucuuggauaaacacacacacacagagggugauucauuuuucuggaaaaacaggauacaguaaaauacugccagugacaacgcaacagacauguucauauacacuaauauuuauaaaggagccccagcaguaugcguggcagacaccucuaugguguggcccuucucccaaccaucccccuugcuugccuugcguccuuggcgaacuugcuguuucuuuggaucucaguuuccucggaagucaggcaguauuacuaccgaaugggcacacugaguguguagcugggaacaguuauggacuuagaguaauuggcacucuaguaaaccugauuauccuuaugcugggcauaaaagacucauucacauucacauacuaagaacuugacuguaaaagaaaauggccaaccauuugcaaaauggaaagaauuuucaaucaguggcccaagguguuggagucucuuaaugguacuccccugacaaggagauaucacuuaguugaugggaaauagaaguuucaagggacucauucaaauagcauuuauugcauacucuuagguaccaagggacagggagauuaaucacaagugaugucuuucucuuucaagauucuguuuuccgcuguccaaaaaugagggguauccaacugcccagguauagguauacugcauugguagguggggauuuuaguuugggguuuagcucucuuccuucucugaauuccggucaauccaugugcucauguuaacaaaauggugcaaauuggggagaccuugucaaagcguuuuaccucagaaucuuggucuuuggucuagguuuuauauagcuccaguuuuaccuacugcaaauaucacgccacaguugggguuugccagguuguaugaaaacugcauucuuguuugauuaucugcuuuuuuauuuuuauuaaauaaaaaucucuucagucucuuccuugguaaguuguagagugggauggacaacucaggggucuaauccaguccuuugccuaacucucuuuguauggaacaugagaugacucaccaagcuguucucauuugcugaaggaaauaaugaccaccaugacugugggcccagugccagucuaggcaguaaugaaaaguauuuuuauuuugaaaguuuacuaagucccagugggauuugccauggauaucaaagaggcuggaagagcaagagacuacucuugugguaaagucacaaaagcuaugcacaaccuuuguuaaacugguagaugugugcccuggguaagccacagggcaguuggcucagccccuccuccacucaucuuacacacaauuccauucauacugucuauucaacauucuggcuccuuuucucucagccauucugacucucacaauuuucuuucuccuacucugaauugggaacucuuuaguuuuuuuguuuuuaauuagacaaagaauuuauaggauauggagaaaaaccagagguuuguuuuuuuuuuuuuuuuuuuguuuuuguuuuuuuuuuuuuugcauauggugguagagaugaaaccuggggucuguauaugcuaggcaaggacuugcauaguaagcuguguccccagcucuuucaguauuugagauacaaucaccucuuacauguagucucccuuuuggcauacauaguugaauauguaucucucugaagcaaaugucaggaguugagguucuaaaagaggccagcuagugagcguuagugucuucaacaauugacaugguuucugcugugucuaaucaacucuguaacugaaguacugauagaccaaauauaaaugaaugagcacgggcagguuucaaaacaaacaaacaaacaacuccccaagaccccauauuuuaaaacacaaaaugagagcuggauagagccuguaggcucuuguuagccagccucugacccacauuaucuucuguguagcuuuucugguucugcacacaucuugccuuaguuucuguuuuuaaggacagugucaggucuuuuuccuccuguaauucaggagguuauacagguaggaaaguauucaguugauguuugaccagugaguggccagcagaugaauggagucuguguuugggagucggcaaccucagaauaccccggaguggccuaggucuuccagccuucucauguucugcccacccuaccccauccccgcucccaacuuguccugcuacuaagggggacaagaagacacccacuccuuuuagcaauugccauuuauaacucaaauaauucucuauuuauauugugcaggaaacuguuuaccuugcugaauuaauacuagguuucuuuaaaugugcaauuaaaacgaaaaggagccaguuuuaacuuuaagggcauaagagcuggauucaugauguaaauggacauagacccucuugaguuauuuccaaaggcucuaggaauggguuuauuacuaguauauguauuacaaggcauugcuuuguguagcgguagaggaaaaaaagcuaaagaaacuuuuagaaucauuuugaucacguaugaauuuuguauuguuuuccaauugcaucucaucauuuuccaguaucagaagaugggcaguuugcgaguuuugauuauuggaacaccaucucaaaggaacagaaaacguccuucauuuccauguaguguuaaaagacucuucuccccacacagggucaauuuauuagccuaguaucuuuuuuuuuuuuucuuuuucuccugccugucgaagugaacuguuggaauccucugaauucauguagggaaaaugacauaaacaaacccguguaaaugaaguguugcuuuaauuucaccggaggaucuuggcacaggaaggccguuguuuccucuguggaaacuuuaaucuuuguuuucuggugacuguaaaaaacaauagguugcuguggaguuucaguaaucaaggaggaaaauagcgagggacugcaagucaguugaccagcaggauaaggcugaguuuguggaaggugaaguugaacaaauccaguuagcuaucuccauuuucuguaaaucggcccagauacucaaaugucacaacgcuguauauucucuguugaaagugcccaccccugcugcuccagugugaaagauggccauucucaaucuauaaacaagucuaacacaccauguuagauuuuucaaguuacaaagaauuauuaauuucacgugcuucagcuauuuaaaaaucuagaaaccauucuuacauugucucccagaaacuggcugcacauuauaaucuccuuauuauuagcaaaauaauuuccugaagcagguaguggagaagguuguguguauuuuauuaggucauuugcuuauagucaguucuggggagccucaggagucuugaugagacuugaagaaucugguguaggccucgauucauaauauaggguugagcuaugaacuuuggcuaagcaucuggcuuaugcugagauuugacaucacuacuuggcuuuauuuuugagauguuugcuaagcugcccuccauuguuuuaccucgguucuuuuaccucauccucuuagcuggacugauuacaagcuuaccacaaccuccaguaaaccaugugaccuaccaggcucucuguagaucuuaucuuuaucacgugauugagcucucuuuuauacuuccuuccauuuaucuaucuaaacauuacuuaaacccugugcugagauguuuaauacuugcuaauuguuugagucuugauagugguagauuuguguuuugggggaaaggauugucagaaaacaagcuauauuucauuagcucagcugcuuuuuuuucuacauggcauuuguuguauagacuuucuuacugguaaaagcagcgugauagguaauuaauaugcauuaaagcaaaauaauacaauuauauuauucaagcuucauuaaaaaauagauagcaaugagaauauuuauauauauguuuuauuuuauguguguaaguguuuugccugaauguauauguaucauguuucuaccuggugcccaugaaggccagaagacggcaauggaacccauggaacugaaguuauagacuguuguagacugcuggggacugaacuuggguccucagaagagcagcuggugcucuaaaccacugagccaccucucuagacccucagcucuggaauuauguuccuacuuuccacauuaauugcuuuauucagcaucugcuacuggcaguaaucuauacuuggagggaugaauuuuucuucucucacuccuuucucuacuccucuaucucauuugcucaugagcuugcuucaguucuuucuuggcaaguuucugugugaugcuuuugaggaaaugcuaucagaagaaacuguagagccuugcagaucuuuguugugucuccuggaagucuccuaagugguuaaucauugagguuugugcugacuccucacugacagaaugaagucauuaauuuugguuauauuauuuaaauuggaaaaugcuuccauuaagauuuuaggaaaggccaagcaagugagucuuagaaaauugcuacaacagccucacgugguucuguucuccagcaauuguggcauuuggacauuugaggagcuuagucaggacuacugaagguucaaaucuagcccguguuaccuagggagagcccuuuucagcaaacaaacagcuuaaaaauuacuaugccacauucacaaaugacacagaagacaguccaugcuguaagccuucugugcaaugauagugaguucauauuuguguuauauauuguucuuuauuggaaaaaccgucuucauuggcaugauggcuaaucuugguugucaacuugauacaccugggaagggggaacccuaguugaagagugucucuuaucagauuggccugugggcauaccuguuaaaguauugguugcuaauugauagaaaaggccgaaagccacgguggguggugccaucccuaggcaggugggucugggcuguauuagaaggauggcucagugauccaggggaagcaagucuguaagcagcacuccccugugaucucugcuucaggucuuuccuugguuucucuagaugaugggcuguaaccgauaaaccaaauaaacucuugugucuucugaguuauggugcuucucauagcagcagaaugugagcuagaacaaugggagcuuauuuaacggauacuaaaaagucuuaagaaaggccaggugcgguggugcaugccucuaauaccagcacuaggaggcagaggcagguggaucucuugaguuucacccuauauaauaaguuccaggcuagccagagcuauacugugagaucaugucucaaacagaacaaaacaaaauaaaagugggaagaugaagaaaaacugaaaauauuuaauaaauacuuagcaauggcugguaaaguugcuucaugcauggugccacaggcccguaauccuauauuuuaccuaucaaagcagaccuggccuccugguucacucagcaucccucagucccuaccuggcauacccugcccccaaccuugaacuuuccagcccaggggcugggcugcacuucccccagaggcucuucccuuauauaauccagacaauaugcucucucuucccucccuccuucccucccuuccuucuccuccuucucucccugcauggaugcaaauguguguacacccuuucucucuuucucuucccccuucccucaucccucucuccccaugguaacccaaggucugugaacuccucagagagcagcuucccaauaaaccugccuuuaauagaauagaaucuggcuugaguuggugaagacacaaccgcucagugagguucaggaguuugaggccaggcuuugcccugcuccucuuagcuuugccuugauagccacauuuuucucucuucuucuucuuuuucuuaauacgggggugguguuuuuaggcuguuaggaugguagaacuguaaugauaauaacacccaauaggagagauggcaauucugucauuccucuucacacugugguccucucugcuuuuuugucagcgcugacuuaccagcguuucagaaucauaucaaaucaaaucaaaucuggcuucagaucuuucccacaauuucagccaucucagaaauuaauaacagcaaaacauaucucagaaauuaauaacaguaacacccccccccccaaaaaaaaaaccuucagagcgaccaagaacaaaaaagaucuucuuucuuggaauuucucccuagccuuccuaggggcuuggggacuuagaguuucccuuugguauccugcugucuuggagcaauuguaauuacauguaggaguuuaugucauuaucaugagcuguaggaagguggauuauauugcccagcauuugcuauggacaaaccuguuaagcuucucuacccccccccccccccaccaaagaagcuguuaaugugcaaagagguugaguagcuggcucagaccaccuccuuauacauaagagggcugugaugccaagcuaggucaugugacggaaucgagaaauauuggugcuuucuccuaaaguaguucuguaucuuuuguggccuuggacuuuuauaagcuguauguuuuauuuuaaaguuacugacaagauuggcucugccacuauuggaggggacauugaaacuuuuugcaaauacaaauggcacaaguacucauuggacuacacuauucugaaccaacaguaucuugggacaacuagggcauguacuuuugagaacuucaacuuuggggaugaagguggcuuagaaguaagaguacuaacugccccuacuagggaugcaaguuugguuuccagaacccaaaucaggccucucacagcuuccaacuccaggagaugcccucuucuggccucuggguauuugccugcacauaaugcauaggcacacaugcagacacuauacacaccauaaaucuuuuuaaaaacuucaacuuagguggcaggaaaaugcauguguaugaacuaauaugugucucaguauguucaggaugcuauaucagaugagugauaaauguauauuuucacaguucugaaagcugggaaguucaagaugauaguagauguuguugucugacccugugguucuuuguuucugaaucugucaccaaagggacauaucuuucugacuucuuuagcaggacacuaguuuugcuuaugagccuuuaggaucuaauccuuucaagaagaauucaucuugggaguuuauauuucagugcaugaauuuacuaaggccacagccauuaaugguaucuguucauauucuuaccuucuuuuuguucccaauacuucagugaacaggcuuuuagggucaccaaaauucagagugggaacuguuaguggcuuaugggaguggcuaggguuugggguguguguguauauguguaacguacagccacauuucaauaacucagcaacucuacucagacaugcuucuggucuaaaccuggagcuuaaaucuuugagugcuagcuccugcuaucuauuggccuuuggguauguccccuuaaaggagcugugcugugguucaguaaauuuuccucaagcugggaccucacacauacuuucuuccucauuguccauuggcccuuuaaauuccugguguaccuuucauguuucuuggccuaggucuagcucaucacugucuuugauuggaccauuacagucuuucuuucacuggccgcucucccgugaguggucuuauuuuucuuugacuuuuuuuuuauugucaugcugugacaagaauguuuucuaguaggauggauguccuacuauugugcuuaugauuuaaaugugauugaaagcacuuauuuggcauuuaggaugaagaccauguaucuucuggugcuugcucagaaggccaucuggugugacuaagcuauuccucaggcauacugaacuuaguuuuccuucucuacucugcauaguccuugcacacugggccuucucagggcucauuccugucucuucagcuccucuucccuucuuuaguggacaggcuuaaaaagccaccacucacguguccauagacacuccugccucuuggcucuaugaaggagaauguagaaauauaaugcuuuuguuuucugguuaggcuugguuucuccuggcaccuauccugccuugcucucugguuugccacagugugugauuggaggagggugugaagacgggucaguaacccuucaacaggaaggacaggacuugagggcucaaggauaggagcccugggcgggccugacaucagcacccaacgcucaauggagaaacagugagcagcuggucgucaugugggccgggaggaauggggcugggcuaggggcugggauuaaggcagccuuguggcagcagcugugguauugggaacaccuggcccuccuggaaguccaggggcucugucucugaccucuuuccuucauuuccugcauucuccaaaugacagcagaacauugaaauagaacucgaggcgaacacguccugcaaauauuuggguuuccugaaauuggucucucuuucaguugaggaggcccucuuacgaugaggagugaucaaagcuaguuuaggcgcccuacaaacucuugugaggcccuuaagaaccuguguagugugugugggaugggggugagaacugcacguugugagcuucagggagcaggcccuauaucgcagggaguuaggcuccagucuuggucuggcaacaauuuuaggcaaauuacagagcuucugagacucaaauuucuucaccuauaaagcaggacaguaguacuagaacguggaacaaagauuaggaggaucuaaaacaaauggguuucauguuauaaagugcgaauauuuuacauauaucacugucaguaguacuauugcugcuuauaaaguauggaagucuucugcucuuugaguauguucuccaacucauaguguguuguggaugcgcccuaaagccuguagccguagcaguaucccaucccugaccuuggauauagagaaugcgugugugucacagaucugugcagccucucggcugacuucuuguaugugacauuuacuaacaccacagaaguauuguuaccacaacagcauuucuuuccccacugacauuaucucauaauccaaucauuauuaggagaaaaaugucaguugauuuucugcaucaguaaggacgugaacaaugaaaaccguguaacacaaaaacuuucugugcggaauagaaaaaugucauugcuuucaugauuuugucaguggggugguucauggcucuacuucagaguuuccagagacugaaauggaauggggauugggaagggaauauaauuaugggaaggagggggagaaccccccugccuuauaauuauuagcauuauuaggaaguaacuguccuuugaauuauauuuuagcuaaagaaauuauaaagcaguauuuucaugugaacuuccccuuguguuugagacauucgcugacaauucuucauaaaucuuaauuaugacgucagaauuccuugugaagcgucucuucauguguguucccuuguacaguuauuaacaaaagccccuuuaugucucggcccagcuugauuucagucaugaacuccauguuccuuuauuacuucauagaagcugguuucuugacugacuuaguaaauugguucccaaggacuuggugggaagccagagggcccgagugaggagacgugcuuauaguccaggguggguagagacaaagggagacuggcugcugguaacccacuccuucccaggaaagcuucauaugcccucauggguucuuaaccaacuuuuaaaacuuuagcccaaaguuaguauguuuugaaggcuauagguagauuuuuacaugugccguccagaguagaaaggagccugguuaguuuuggcuuuaaaaaucuagcuuuucuuauaaaaaaauccuugagcacuggccccguuaccuuuaacaguggugagcugauuagccaccugaaggauuuagugaucccuucagaguuguuuaauggcagcuauggaggcagaagcagguggaucucuaaguucaagggcagcccugguuuacauagcgaguucaaggccagccaaggcuacacauugagacccugucuaaaauaaaccugcuuuaugcuaauguucuuauuucaguuccuaucgagggcuuccgcuuucugauguaacgucucuaaucacuuaugacccagucugacugcuggcauuucaaaaugucuccagacugaggcugaaaggaaaacuggcagaagaaugcaucagauugccucuguucuuggagccuuagcuguucuuuccuccgaguacuuagcuugcuccgaaagagcugaaagacuugugaaugcucacucggagcacacagaggauucuaaauguccucuuacgcgaugguggacgauaaaaaugaugaaacuuucuacugaacucugccuucaguguaccagagcuucucucacagcucuguggagacauuuccccaccccuccuccucugagaaggcuuuguuguuacuuuguccccuccccuaaacuacuugaugcgagaaauagaucuaauaauuuuuuuuuaagcccaguauuuuaagucagaaucuaugguacuugcaguuuuguuuacaggauauuaaaggauggagauuuggaacauauuaguuuugggaguauuugggcugacggugaacucaagaaaaacuagguauuagcuacuggaaagcuuugaggaguaugugaucauacagucucaagaaaaggggaacuggucauuguaacuugaauuuuuuucaaaccuuauuuauaaugauagugcuuaaacgcuuuaaccucccuugugguccacgacccaccagagguaguggaaaagaaaggauacagggaagugggcuuguuuagaaaugguucuuuggagcaacuccuguuuguguugucuacaaaucagcaguucaguucauagguuaguagguagcagccacagcagcucgauccacucgcaaacacuucauggauacaccaguaguucuguuugguagaguuggcuuagcaacaacagcagugauaagaccuagcagagacagccaggccuuagccuuggcuccagucaguaggagggaccaacaggaacaccaggagaaguucucagcugugccucguucagggaagcuaagaucagcgaagacucgagacccacaagcguugcacagcuagcuguaccagcaagccacacucugucucugucacuccaucacucuguggggucucauuuauacccuccaaacauuuugugucuuuccucagcaugugcauccaaucagccugaguccuccgaguccagacaaaugcagcuuaauuacgaaauguaagguggaccagugcauucgaguuguuagcaaagaauccuucaucacguguccuuucaugugcuugcuuuagcauagcauccucucuccugugucugcuucuguguuccuucaggaaucugccuuagucuuucaacuguguccacuucaagaaaacacucuuauguguuugcuucggcaaaacaccauccaauacaaccgacucuucaaagaacccuuaaguuuccacuuuaggucaugaugggucauuuguguuguuucuuuugaaauaguacccacuucuuaacauuuguguauuuuugaauguaggaauauugcuucauuagaaccugagcguuguucuguguucugagauacuaaggacugggguguugguuuuaaaaugacguuagucugcucucacaagucugucauuuguauagguucuugcauuuguauagauuuauccauguguugcuccacacaguaucuuuggaguggcagcaguaucuguuucaaaguggcugcuaacuggguucauugguuucuucuuuucugggcuucucucugauugcuugagcuccauuauggcaugguggcugggcuucaaggguaagcauuccuagagauagaacauagaagcuauagcuggguuuuggaagugcaugucuauaaucuguaacccuggaggcuggagguagcaagcagagcuuaaggugaauucuaguccaggcugagccaccuaagacuccgccuuuaaaaaaaauguuguguaaaugucauaauuacuuaggcaggccacagcucuuguagaaagugccaaauuauucauuuuuuuuuuuuuaaaucaguuaucagcuucuggaaaccaauucuguagucugugucucgcagauguuacccagacauaugaauagcacaaacuugugacuauaucccuguguguauccugaugucccuugacuaugcaugccuacaauuaaaguucaaauagguaguuucaugacuuguagcaauauguuauugagauaucauuguuaucaaauaaguaaccccagugagacccaucuugagaacaauuggccuuauuucaaccaagaagugagggagaguaucaggccuguguccauuuuacuguucucauucaaguaaguuaagugucaaaucuaaggggccugggaccccaguuuuggcuggcugagaaggauagagaaggcauaguuguuuuaguauaggcuuggcaggcuccuuguuucccuuuugauuuugucgacuuagcugaugauaggcuuauaaggcucuaagcacuuugcuuacgguacccaguuauauuugccuaggagacuaugguaugucugaaaucuuaguuauugcuauugcucuuugguagcaauauuaguguuugaaaguguuaucccuugccgguuuuauuaccaugcaguauagaguuuguugccuuuucauugucccaacgcuggaaaauuugauguuuuuaaacaaaaugaagcaucccuguuguaauuucuuguaucucuccagaauacacacauuaucuuggcauguuuuaccuuuuaaugauaguguugaguauuuuuuauucaggaagucaguacacugacagaguuggcagaauuuuaagucuucuuuccacccaacacuguuuaaauaguuggaggauuggcuauaauggacagacccuucuuuucaacugaguucaguuggcagccaguggacacuuuuccuuuauuuugguaagguuuuucccugggcaaauacuuaaccaaauccugcuuuucauuuguuuuugauggcaccagaccauacuucccagccauuugcagacagugucugucugguggugggauuuccugggcacagagccccuaauugguacuggcuggcuucuugaacuucacugcuauacuugauuauuugcucgcuguuuucugccaugggaaccaguaaguguacccuuuugagacagcaaagcaacaagaaccaucuguuguuaauuaguuauacuacuacauacuucagccugugaaccuggcuuagucaaaccuuccuucugcuagguauggugguacagaccugugauucaaacauguaggaagccgaggcaggaagauuguugaguuucagguuggccuggguuacauaacaguuuuaagguuagacugggcaauaugacaagacacuguuaaaacaaaacaaaacaaaaauaaagaccuuucuucugauauccaagucaguucaucagcacucugcagagaucugggugagacugcaaguuagaagcuacaccugaggagugggugaauauaguuaagagagggagcaggguuauugcaccaagcuguccucaucaguuuccuuacuggccaaccagcauuuguugugcaugccagagaacgcccacugauggacgacccaggugcccaccacugcugcugccagcgccaccauagccacccaacuaaucagugcuagcugugugcuugugaccaucucauagcacuugaaauaucagacacagagguguugcagagugaacuggaguaggacaagcucaaggguauguguaaguguggucagggaauucaggccugagacaaccaggaagagaaaauggcugccuuucucucaccauugcuggggaguggacuauguguaucgcuggaauuaugcaguggaacccugugcagcauucauccagcacaacaaagggccaacauucuauaucucuucagagccuaacucccucccuggggaaaguuuggucacuuauuugcugggggacacaacauagacacagcuauaguagcuagcaaccuuuuguaacuccagggguucugaugucugugugggugccaugcaugcaugaccacaugcaaauacauacaggcagguaauauucauacauuagaaacaaaaaccuaccaucuaaccaaacaaaaaacucuaugucaagaaugaauuugcugagagagaaauuaagggggagaaaaaaaaaagcuuaaaacaaaagugugcauagucaaugaagugcugcuauugugaaaacuuuaacacaccaaggaaagacauugaaggcacuagaugauggaaaaaccuuucaugcuccuggagugccagaaauaauacugagaaugccucuucuaccaaaguaaucuacagaguuaccgcaauuuguaucacgagucuaguugacgguuuucacagaaagaaagaaagaaagaaagaaagaaagagagaaaacaccaaaagagaacaaaaaaagacccuaaaauuaauaucaaacugggaagcacagauagccaaagcuauuuaaacagaaggggugucacuggagguauggaaaauacuugaccuuaaauuauaccacagucauguugacaaagacaguguggugcuggucuaaaaacggacauguaaaccaauggagugaaauagaggaccuaggaaaaccaucccacacaguagcuccuaauauuuggccgaggcuucaggaacacaucagaagaagggagggacagccuuucccacagauggauuuggggagacugggccucuaccugcagaaagugaagcuugaucugcacuuguuacccgcaaaagaucaguuuuaaauggagcaaggaccuuaauuuacaacucuaaauacugaagcuacggagggaaaaaaguuguagguccaugcaagaccuuucugaaggcacaggaaggagccccaagaauugauacuuuggauuccauaaaaacggaguucccgccagucacacggaacaugucauuacaucacuugcacaggccaccauuuguuggggggaaaggaagcaagcgcaguggugaguucauuacaacuucggagggauuccaccagacagccuagacagaaguuucaguaaacacguuaagggaagcagacaacugucucggggcucagacacacuuucuugcuguauuauguuguucgccgucuauagugggcagucaggagcgucuucuucaggacagcauggucacaggacugggacaaucccaaggggcugacagggaguaugagaaugggaggagggcuagcuugagcuguuucacaucagaaacaacugugacaaaguccucagaccugcgaucucuccucuuaucaucugguauggcauuugauguauucagccacuuuguccuccaaauccuccuugucccgcaaaugguguucugcagcuucaauaaucaguggaucaucaaaauucaagagaucaguaaauaguucaauccucaaacaacauccuuuaacauucuagugggaccccagccagugccaucaauugaauauccucuuaguaaacuuagacauauuuccccuguuucugugauguuggggugccagauuucagccaagcauuucaccuugggaggcaccauguuguaggcaauggggccuucaguuucaaacugaaauuuuccaccccuguaguaacccucaccugggcuuauagucagcagaaagcaauggagcuuguuugggucaggaaaguguacuuuacaugugcaagguaaauuagcgucaaguccugccaccucuuuaacaggcaacuugucucucacagaaacccuccgaguagagucagauguggaggcugauguccgggauccuuugagaccaucaugccgcuccaacuugcuuuucagcauuagcauuacugucaccuuucuucuggaagacaggcaagagcagggguuaaggccaugucuccagacauugaguaccucgaaucaggcgaggggagcuggcacccaaaaccaugccuggccaacuguggcacugagucgcgcuggccuucacagcugcaccggcuccuggcugaauaaaaugguuuuuauuuuguuuuguuuguuugagacagagucccacuguguaggcuucugccuccugaacacugggguuaaaggugugugaccacuaagauuggcccgaagaaaaguuucuggaagggggagacuguguuagggaaggugugguagaagguggcuggacggagcagggagcuggcuggcuguggacauuuuacuuguagcaaggcugcaccacauaaaaguuccaugaucccgugccccaccccacuuccuccccaaacagugucacuuccaggaaagcgaguuaccagcuauacuucagacuucaggauguuaauaugcagaauauauaaagaacuucagaauuuauaaugcagauuccaaacugccaaugagugaauggccugaugaacucaaaagaagaagcucaaauggccgauauuaaaagcuguuugacuuuaauagccaugagagaaaugugauuugcauugcuuugagguuccaucuuaccaggucagaauggcaaacauuaaaaaaaaaaaaaaaaaaaaaaaaaaaaaaaaaaaaaaaaggaaaagaaaacaaauacuggcaagggaagaggcaccuuuauucacaguuggugagaguguaaacugguacagccaguaugggaaucaguauggugguuucugaagaauuuaaaaauagaaguccuguaugacuuaacuauccacagccugggcauggacccaaagaacacuguccuaccucagagauacuugcacuugcaugucugaucuucucuucauaauagcaggaaaauaaaaucagccuggaagcucaucaguagucauacauaaggaaaauguggccuuagcuauacagugaaauuuuauuuaugugcaaaaaaaaaaaaaaguuugcagggaaauagauggaucuagaaauuuuuacacugucugaggucacccagacucagaaagacaaauucuucauuucuucucagaggcggauucuggcuuuugauguuuauauuuguauaugugugggugggagugugggcagacggcaugaaacaagaagggaaaaagaaguuuugaggaaggcauuuggcaagaaaguggauggaggacuuuuagggguagguacaagugggaggguggucagagggaugagaaggaucaacaaaaaugauguauuacuuuguauacuaaaacaaaauacuaugcagagggugcuaauuucuaaacacucuuccuaugguaucuugaccuguugaaauccuuagaccagcauauuucaagcauaguaggauucuggcaucagugguuucuuaguguucuacugcugugaggagacaccaugaucuucuaaaagaagacauuuaauugggugauugcuuaaaggucuagaaggcuagucuauucucauuauggcagggcauggaacacuugugguacuagaguagugugugggcuuuugaagccucaaaacccacuccagugacacauuuccuccaacaaggccacacccacuccaagaaggccacaccucuuaauccuucuaauccuuucaaacaguuccacuccuuggugaugaggcauucaaauauaugagccuaugguggucauucuuauucagacuaucacaauggaauaugauuaaaaauagguuggccagugagaaacaauuguauauugcaaauacuguuuaguuucucuuaugaaugauuacuuuccaaaaucuguauuuauuaugagccauuuguaaaauggcaacaacuuuuucauccuauaaaguaagugaauauaagacuauguaacuguguaugagaguacuaucuuaucacaugcaagaccuuggguugaauuuccaguauagaaaaaaaaaaagaguaauuaagagcagauaaaauaucugugcccuuucaccuaauaguacuaauccugggacucucgccuaaugaauacagguaagaagagguauguaaaugucuagaagugaggggcuuguuaagugaauugugauacuuaggaguuuuaaauagcauaagaauuucauuacaauauuguauuggauaguuuuauuucaacuugauacaagcuaaagucaucugagaguagagaaccuuaacuuuaaagaugccuccauaagcuuugaauguaggcaggccuguaacuaguuucuuaguuaguuaauuaauuucuuaauucgugauugaugggguagggacuacccucuuguggguguaccaucccugggcuggugguccugggcucuauaaggaagcaggcugagcaagucaugaggagcaagccaguaagcagcaccccuccauggcuucuggaucagcuccugccuccagguuccuguccugcuugaguuccuguccuuacuuccuucgaugaacugugauguggaaguguaagccaaacccccucuuccccaacuugcuuucgcaaugguguuuuaucacagcaauagcaauccuaaacaagacagauaauaaggaagguaguugcuuuuauugcuuagugucagccuacuuauguaauguuagugagcugagcuuuuuucccuguccuuugcagagaguucuuaggggauggaaaaauuuugaggaacaacauugcccuaguuagcuuuaauuucacagccuagagucaucugagagggaagccacaauugagcaauugccuagauuauagauuguccuauggguaccucugugggugacugucuugauuauucacugagauaagagucuaucuucaccaugguagagaacuugccagcaggcuuggagacaugaugguggagcaguagcugagagcucacauccauccacaagcaggaagcagagaauacacuggggaaggugaaaggcuuuugaaacuguaagcccacccucaguuacucauauccuccaauaaagacacaucuacuaaucuuuccuaaauggucacugaauggggacaaguguguacauguuggagugugcacauggggaacaaaccaagacauucuacccacuggcacccauagucuuguggcuguaucauaaugcauaucauguucaguccaacuucaaaaguccucgugagucuuuaguuucaacacuuucaauaucccaguucgccuguaaacucaaaaagcaaacuaaauaguuaacacauacagugguacagaauauacauuaacacuccagaagggaagaaagggaauucaagaggaaauaugggaccaaagcaagacugaaacccagcaggacaaacuccaaaucauguagcucuaugucuaaugucaaagggauuagauggcuccuuccagcuuugcugacuucaguccaucucuuucuugggcugguuccacucucugucuguaguuuucuuuguuagaugucucccagcucagguaccucuaacuaacaucuuugggucucugcuauaauucaugcuucacuuccacagccucauacaugagccucucagguccuccaugcaaggacuccacugccacaggccuggccuugguauaucuccuuaaccuuggaggaagacuccaaauaaacccaugcguuauuuauaauucuaaaacuagaccuccacugucagguuuaggugccuguuugugaugaagcuuggcccccuugaaucacauuuacagcaacuuuugauuuccuuuuucuucuuuucaacaaguagacacugccuuaggccuuuuucucuuacaaauuuggaaucuuaggugagugggguucuguccugagggcaccccucccuucauuccaucucaaaucuacucuuccagcacagucuuuggcuccaauauuaaauuuccugcugcucuuugucucuucaaacuuuacauuuuguagguuuuuuuuuuuguuccaguugcucuuucauuguagaucugcauaagaaugauugcuaauaaaaacacaacaaaguuaauauuaggcugucuuaaaaaucuccucugccaaagaaaguaguccauuacuuuucaauuuagccucaaguaacuuccuaggacaggagcagaagacagccauauuccuggcccaaauaccacaggaauggccucuagcacagcuacuguugaaauacuugcuuucccuagauaucccgagcuuuauguccccgccggcaagaacacacucaagacaaccggaaucuucugcggcaaagcuuuuauugcuuacuuaucagaagggaagaccccgaacagggaaaaugguguugcuuauauagcccgcagcgugacguuucagcaccugauguggcaugacagcuccugauuugcugcucgcccaucaccccauuacuacaccgcgagaugggcagugacuaggcgugaguucacucuugcacuugcgcauaaggcuuguuuacuaguuaggcgcaguggaagccagcgccaucuuauaauggugauugcucgcggcacggcucuccacaccuacaagccuuuugagcuggaccuccacaguccacauagcucuuaacacauugucuuuggauuauguuuagcuuauaauauccagcugcuugucuaguccaaaguuccaaagucuuccacauccacucuaaagaccacauagucaggucugucacaggauaaacccacuuccugguaccauuuuuaauuguaguuaccuuuucuguugcuguuacuaaacaccgugaccaaggcaacuuacagaaggaaggguugguuuguggcuuguaauuccagagggacaggaauucaucaccaacauggugggagcauguuagcaguuaacaacgcuaagugcucacaugccagucuacaaauaguaagcagagaguguacuggagauagugggaugcuuuuguaacuuuaagcagcaccaaaugacaucuugaccaacaagguuauaccucuaaucguucucaaacaguuaguaacuggggaccgaacacugagacuuaugaaugcaucuuauuaauacuauauccuccaagucgccuuugguugggcuuuuaucacaggaacaguuaaaagugggauagguguacaauaguagaaucauuguuacuaguuuagagagaagcaauaucuuuaacccuuucuaguuuuuguuuuccauuuguaaaauacuuacuggcauuauuuaccaguaguuauuaugaucccaauaagacagccaguguucauuuuauagcuguauguguaucagacacgagauuaaaagcuuggcacaccuucauagauuaauuucaagguaacuuuuuguguggauaccuuugucucgcugauaaugugagcugauguuuauugaugguuuucuacuguacaauuuuugcuucaaguugugucauagguauaacagaacaacuaaaguacugggaaugucuaagcuguuuaaccaaguuuauguagcuagugaauaugggagguagaguuggaacacagauuagcuacagguuuugaaccacuauccaccaguccauuguauaggugaagagucugagaaguaccgagaagcugaggaacuggcagagcuuucaaccacaaggcuguacagauagcuagcuaguaaaugguagagccgucugucaagcaagauucuuucuaccuagcuguccucauucuugccugucaugcaggauagaaucaaaguuuaagagaaucaaagucuuguagcauuagguauuuugaagcccuuuugcccuuuguuguuaaaacaacucauuaaacauguacugggguaaaucuccauaaggguagcuaaucgagccaaaacuuuauuaaaaucuacaguuccuugggguugaguaguauauagugugcuucacaugcauaaaucccuauacucaauuccguguccuucaucccuaaauauauuguuuucuucuucccgagguuagacaauuacagggagcuggcucuuuuaaaaaguuaaucagugcccuaguguggcagcagggccuuagaaguaucagagcuaauucuccaguggggaaugaugcagaacgaaaaaugaauuccugaagcuguccucuguuuuuacuggcaggucccaagagcucucagauuugagaguagacuuuggaaugucucuuaggucacuuccuaccucauaugcagcucacaacccucaaacucuagcuucaggagauccagugucuucuacugaccucugaccucuuuggguagcaguuaugcacauggugcacauuauacacgcaggcaaaauacacauccauaaaaauacauaaaaaagaaaauagaauaauaaguaaacuauaaugacauuuucugagagacuuaaggugugaagagacccuaaguuauuuuacuuagcuauugcugugaagagauacugugaccuacugugaccacagcaacucuuuuuuuuuuuuuuuuuuuuuuugauuuuuugagacaggguuucucuguguaguccuggcuguccuggaacuuacuuuguagaccaggcuggccuugaacucagaaauucaccuugccucccaagugcuaggauuaaaggugugcgccaccacugcccggccacagcaacucuuauaaaggaaaacauuuaauugggcaugccuuucagguuuagaggaagcaugaaggcacagaggcagucauggugcuggacagagcugagcauucuauaucuauuucaacaaggcaggaagagagagagaggagugagggacgacacugggucuggcuugagcauuugaaacuucaaagaccaccccuaaugacacacuggcauguccuaaugacacugguggaaacaaguccacagcuaccccaacgaagccauaucuccuaacaguguuaugcccugugagcuuauggaggccauuuuuacuccagccaucacaccuagucaggcaucauggcacacaacuguaaucccaauucuagaggccaaggcaggaggaucccaaauuguugauauauauaauauuaacucucugaucacacauuauauaucacagaacaaaccugucauccauccauccauucauccauccauccauccauccauccauaugguggcuucacuggcacaugacagaguucuaggagagucacauaaaucugucauacgcauagaauaaaaguaaaauucccaaaauagaaaauucauuuuaaaggugggcuuugugacucaugccuauaaucccggcacuuggaaagcugaggcaggacaauugccguuagucagagucagucuguaguaaauacugagauauugucauaaacaagcaaacaaacaagcaagcaaacaaacacacccaagaguaggugggaagaaugaaauuguuuuagcuaggaagccucaaaaauaauuagaaaauaauucugaaguugucuggcuugggauaauuacagugagagugccuuuuaauaauagugaacacucucaccguaguuuacuguuaagugcuggucacugaauccugaggacuuugugugcaauacauuuacuguaguaaagcucguagccuacauugugcuaaaaaaaacagcaucuagcagcacauggaaucggagguugaucuucuaagucucuagacuguguagugggggagugggggacuuuggugucucuccagugggcugaacugcagggaucaaugguagcaugguaguuucuggugucuggugaagucacugaucgcugguauguccucuauauauuagguugcguguauucugugaauggcgucugacugauugugguuagcacguaugugugauugugcuguguuuggaguuuucugagggggggggcguauagcaaucagugguguggguuuucaguguggcauguccuagugacacuaguggaaagugacuugcuaaaauagaaaguaagauugaacagcuggguugauagcuuguugcuugcuucccaccaguugucucaacgggacggaggaagagccacccagaguguuuucuagcagcugugacuucaaacuaagugaaguuuuguuuggauagcacccuaagaauagauguaggcucuugguuuuaaaguaaagaggaagauuaaaaguuuuccggauacaaauagcucauuuuuuaaaaacaccgcuuguuuucaagcuauaaagauguuucuauaugcauauuuauauauuuguugguggauaaacacacacauauguauauauaugagcaugcagaugucacucucauguucuugaugucuguucuucugucuaaucugugcuuguucugcuuuggggugcugguauugggggagcuuugagcauagcaucacgcuuuuguuugcccacgggcuccuuuucuuaguggugggugguuuuuguuuuaauuuguuuuguuuuugagauacggucucaugguguggacuucacuggccuauagaacucacuacguauaccaaauugaccucagacuuaacuguagucugccugucucugccucccaagggcuuugugugcaccaucaugcgaagcuugccuagggacucuggaaaggagcagccugugguuuuuaaacccuuguuagguggguuuaaaaacguaacuaugugaucucugaaaccuugcgacugcucagagagugaugcucaagagaaccaacaugucugggauaaauagcauaaaaaguauauuugugggguugaaucccuaaagcuugggaauuaagauagagucuuacuauguaguugagcccagccucaaccuauguugaguacccagcuaugagcauacaggagugcuucuaagaauguauuuuaauaggacauuaguaaauguaaagaaaaucacacuagaauaaauuaagagauauccggaacuaagccaauuaaaaaaaaaagccucuuauauccuuaaagauuuuucuaaauuuuagggguaacuaucuuuuagugauuucuaagcuacaugaagagaaccuuuauagguucagaauuacuuuuuacaaucucauagaaaaccauauuuaaaauuuuucuguuccaggacucagagacauucugacuaggcaucauggguuacaacgaauguuauacacauccccauaugcuuguauuaauauuuauuauaugcaugagcaucuaccaugaaccuuucuuaagaaagagccauuuggaaugacuugaaauccuuucacaaaauaaagucagucuuuuucucucucaucccuuccuuccuuccuuuuugugugugauauaaguguauauggugcuugccugugacugcguggaugugugcaauagugggugugcauaaggaugccagaggaaauuguuggguaucuuccucuuguucuuauuuccucaagaaagggcuacuuacugaacaagaaccuagcccauuuggcuuguuuuagucaugguuucuaucccugcacaaacaucaugaccaagaagcaaguuggggaggaaaggguuuauucagcuuacacuuccacauugcuguucaucacuuaaggaagucaggacuggaacucaagcagguuaggaagcaggagcugaugcugaggccauggagggauguuucuuacuggcuugcuuccccuggcuugcucagccugcucucuuauagaaccaagacuaccagcccagagauggucccacccacaaggggccuuucccccuugaucacuaguugagaaaaugccccacagcuggaucuuguggaggcauuuccucagcugaagcuccuuucuuggugauaacuccagccugugucaaguugacacaaaaccagccaguacagcgaggcuggcuacucaaaaagcucuugcgaucugucuucaccaacuucccauguuggugaugcagguguaggaagcucuuucugacuuuucgcauuggugcuggggauuccagcucaggucuuucugcauucacagcaagugcucuuacugaccaagccaagccaucuccuuggcccccaauuguuucuuccaauagaacacuuuuucuucauuuucucucuucuuuuuccccaaaacaggguuucucuguguagucuuggcuguccuggaacucacucuguagaccagcuggccucaaacuuagagcaguucaccugucucugccugcugugggcuaggguuaaaggugugcaccaccacugccugcugaaccauuuuucauuuuagcauuaaccauaaaacauacuuugcauaaaugaauguuaaauguuauaaaaugguuuagaaacauugggacuuaacuguauuuucuuuuuuaauuauguaggaaguauuuauuuuaauggaaauacuggggugggcagagacagguggauuugaggccagccuggucuacagaguuaguucuaggacagcuaagucuacacaaagaaacccgugucucagugagaaaaaguguuagguuuucguuaaggaauugcaguuauggucaguuacaaaggcuuauaacacaucaacuguauuuugaacuuuuuuuauuuuuuacuuucacauuugaacacuuauacuaacugacuggcagcuuugagagaaacacagagugaugcuggcguguuguaggacccaaaccgcugagcuacaggaggugggugcucagcacagggugaggcugggggcagcacugacugcccaugcccucuuuuccuuccugccuaaagaaccacgcuaaguguaaccucccuggcuucacaaggcaaggguuuugccugcaaagucuuaggagagugguuugccugucuaaucuguagcacagagacuuaagaguuucagucauuuaacuucucccacgcugguuucugggccuuaaaaauggagcuuaauaagccuguuauguggaucaaauuaauuuuugagacuuuaaaaucauacgaucaucagacauuguuaccaugaugauugcaaauauuacgacugaaacaugagucugcguuaguuacugugacuaucacuguuaauaucaguacugauuucuucacccacucacugugcaaauguguguuuauuguguggcuagcauauauaagauauagugcauuuucagggaccacggugugugguacaguuauuggcucagucaaccuguucacugaauugaacaaaaugcacuggucguggugugauugguuugagaugguauuguuuuauucucuaguuggaauagaauaguuuauuucuugguagaaauaaagaaaaaaaaucuuccugagugaguuuuaugaguguuuguugaaaaagaugcuuuagguaugaauaauauuccuuugaugcuuuuggaaaacuuuuuauuauuauuuauuuauuuauuuuuaaaagacagggucucauguagccaaagauagccuugaacuccugauccuccugacucugauucucaguugcugagauucuagccauucuagccauaagaccggaucugguguuauaguugaugccgagaguaaaacgguuuguaggacuauacucauucaacuuguucauucauucacucuucauccauuuagugcuuuauucauuuauucuguuaguaguuuuuaauacccacugcauguuaggccuucuucugugcucuuaauccauggcuagaacugcucagagauugagagccuugacaaucuccuuuaguuucaagccuaguggugguuggccaguccuugggagucagaggaagaggcuucaguguuuaaagccagcccccucuccaauggcauccugucucauaaaaucaaaaggggaagggcucguggaaaggaaaagccccaguguauccuguaaagaaaauaccacuuccuuuauaggcccugugaucuguaucccugcucagaguuccucucaagucagugggaauuguauaaggaaugugaaggccggauaugccuccuggucggaugagaaggaacccgguggcuagccaugagacuaaauuuaaacuguuauuuguagugaguauauaauuaacauggaacuaauggucagagauaagcaaccugaguaggcuucuuccuuuaauaaaagaaaaagguggggggggggggaggaaaacacaguuaaauaugcugcaugcauucucuuccaugagggcggucggaggagggccuggagaggugguucuuuauaagagccuugcugcucuuucagaagacuggaauucaguucccggcacccaccuuaggcagcucacagcaucuguaaggccaguccuaggggauccaaugccuucuucugguagguaccaggcauauacaugguacacacauacacauacauacaagaaaaacaccaacacacauaaaccauuuuuuuuuuuaaauuaaaaguugaaugauauuuuuuuaaauccuaauauuucuagauaaaaugugagcugcuuuuucuuggaccgggcaggugucaguaagagcaauccuacaguuggcgggcucgaggcuggcaggugcuggacauaagaugcuagauuguucuguggaguauagacagugcauacauuggcagucccugccucagcuacccaaggagagggccgcuuuugugucugcugguaccuccuucagauuucccuucucacucaagcaguugccauaggcagcugcaagaugcugcuuauagaccuugcccaguucuuugaauccccucuugagucaagucuucucccuuuugugacuccccgauuccauguaccuucaggcugagcaauaagggaagagucauccguauuggauuuccagcuagcagugaaggaaccgggggacugauaacuauucucuguggaaugauuuuuuuuuuaauauuuaauuuuuuaaaauucuuuuuuagauuuuauguguuguacuuguguaugucugagcaccaugugugugucaucccagaggccagcagggggcaccugauacccuaggacuggagguacaggugguugggagccaucuuggaggugcuggaaauucaaucugggucaucugcacaccuacuuaacuacuagcuaucucucccgucucacgauuugcuuaauauugaauuguguaugugcgcaugaaugcaggcgcccacaugggugggucagagucccggacucagaucuccuauggcugggguuacugguaguuguagccaucucauguggguguugggaaacagacucagguagucugcaauaacauuaugcucuuuaaacugccaaaccauuucucuagcccccuugcugugaaauuaauuuugggagguugagguuagauagcauacauucaaauguggaagacagcaucauuuuuaaagaagaaagugaauucuguugcaaggggaggaagugaaggguauauuuuuuccagguuuaaaaaaaauauauaaugcuuuaaugaagaagauucaaagaaaucuaaagccugcuuccuccucauucauauguauccuauuauccaaaaugggauuauguuuucucaguaauauaucauggacauccuucuguuaaaaauauauauauuuauagauuucugucauuuauaauagcuguucaggucuucauugccuggacuguaccauaauuuauuuauuguaucaacauacauuuaagagagaaagaagacugcaguguuucucuuuuuagaugcguuuguguacuuuuugucugcauagcacuucugaugccaggcucacuagcauaccaccaggguauccuauaauuuaaccucauucugagggcauguaguccagagguaggccacuugguuagcaugcaugcagaggucuuguauuucauccccagcaucacaaucuucuuacaaacuucuaaguacgcaaacuucuaacaacaucuuguuagagauagucacaucuuaugggcuaagggcucagcccuaagacuguaccucucuuuccagaugcugauggaaaaugcuaggcuuuuccucgugcuucucauugccugucaaucaugguucuugugagcccuuuugacuauuuuaguuuggcugcuggggcugugauaaaacucacuauguagaccagccuggucucagugcuuuucaagauauguguaggcaagaacuuugcuaagcaggccuccagcagcccaggaucuugcccuaggaaucaagagauggaccuuugugagaguaaaacauuguauuuauuuauuuauaauguuuuuagagacaggauuucucuguauagcccuggcuguccuggaacucauuuuuguagaccaggcuggccucgaacucagaaauccaccugccucugccucccaagugcugggauuaaaggugugcgccaccacugcccagguaaaacguuuuucuuuagcaagagaagcugucaucagagcaaacagcucaagagaugggaguaaaaguuuccuuccaaaugcuucugguaguggacuaauaaugagaauuuacaaagaacuguaaaaucuaaacauauaccagucaauacauguaauggaugauuuuuuaaaacagcaucucucuuuguguagucuugguugucuugggauugacuacguagaccaggcuagcaucaaaugcauacggagaugauuuugccucugcuuccugagugcugggauuaaaggcguccacuaccgcacucagcuuggaaugacuagaaugaauagacaguuccccagcgaugaaauagaaauggauaauaaauauguaagaguaugaaacauuacuggaaccagggaaaagcaaauuauaucugcuuuaaucuuuaccacuucaccuuacuuaaaaucugacagaggcuugagagaugacucgguguuuaaggguuccuuuuccucucgcagggcaccuguguaaagaaaaacaaaacaaaacaaaacaaaaaaaugaaacaggauccugauauuugcaggaaaauagauguauccggaaaauaaauuagguacugggacccaaauuuagaauaguggaagucauguuuucuuucuuacgcagauuucagcuaauguauauguaaauggugugauuguuggcaaaagacguguggaaaaugagagaaaagacuggugaggggagauuauagagcugucgucccaggucucaggucucaggucagggaagugagaggggagaauuccccgaguguacuuuguuggaaaaugccagaaugauauguagcauccaguauacuaacuuaaaaauuaaaaaagagagaacuaaugagagagaacucccuuuauucucucccuucuuggguucucuguucaucuaggguauuuguuuaccuuuucuuguuuccuuuccucugguuccccuuuccucucuacccucaggcaguuuauaccuggcauaguguaugguuucuguucaaugaaauacccaaaacagcacugcaugcuagaugcucuuaugcccuguugaaggaaacugaggcuuggagaagugacaguggccuccuaauuagacaaugacagagguggaguucagcgucucauuuugcuacuuuccacagaagaugucaggguguguguuauaaaacacuguggacugcguugaaauuaugaagcauguguuagccuggcgugcauaaaccccuguguuucgccccuggcaccacuaaagaacaggaaaccucgaggugcguacuucaagauccucgguggcaugauucaugccucacucaccauuucaguaccuuggcauuugucuuugacccuucugguuccuucuuacaaaaagggguugcggcugugaaaaacacuuugagucugucuucagacucuggguucacgccagccuucuuguuguugauucauguugcugugcgccuugaaaacacgaacagaaagugggucagacagcccgagccuguggcucaucuuccuagaauuaaaggagaaaagaaaccaaagcuaagacaaagggagcagauagccccaagugaggagaugaggagcguacuaacaaaagaaauugggguuuuguaaaaaaaaucauuauuggugcggaugugcguccagagggcggaugcugacgcuugccaggcuccugugccucuacugcucauuguacauagacaguacagaaaggucaugguuugcuaaggggaagauacagaggagguggagguguagcucugccguggucugcuuccuggaagccagaaagggagagaaagggcagagaccuucugugagguaggucauuaggaucguccuggacuccugccuccugcagaggaccuuuucagaguaugcgcccuuggcugaaugaagcucggguaggcuaagggcugccacucuuucacuuguuguucuuccuaucuuaauacuagaacauuaauucuccauuaauccccauucuccugccugggagaaaauggcuuuguccucauuuucuagccaagugacauuuacuucauuuggcccaauuagagggggagagaaagaaugauagcuguagcccaacuuggagacauuugauauuuggagugaguugagagcaaccaagcauugggucaguggaugccccacuuaagaacaacuggaaaaacagcacggagaaacaugugucagacacagagagccuggaaaaacacuuuucaaaguuacuuaagcauuuaucauaguuuagugacuuuaaaacaaacugagcugcuuuccagaugucagaugcaggcaguguggucgguguaucaaacaagaagccuugagacagagugucgguucuggaccuuuuauaauuaaaaacaauagcuccuagccaccuacgaucucuuauuuuuacuucuaccaaauccccacccuugacuuaccaaucuuuugagggcccacacacuguaggcccuuagaacaucuauauuuaaguggcaugaguucaauauuccacaccuagcagaucucagcacauuuauuuggagagugcagaauagcuucaucugaagcuaggccauggaaauaacacauauccuacggcuggaaagaacuggcugcauuggacuuacugaaagauaauaugcuaugcacuaaaccuuaguagauuguacguuuaaagaauuuucaugguaauuuccacuauacucaguggacauuuacacuauauuuugcagccuaugugcaaaauuuuauuuugguggugggguggggguggggguagggguggggacagaguucagugcuguguguauuuuaccuccagccccaaaacuaauucuacaguuggaucccugcagaaauagcaccacuguaaaguucauuaaaugagugaagggaugaaaauacuccauuuccuaugauaacagacuucaucuuuucuacacuuauguguuucugucauugagaaaauaccaaguguguauuuugaaacugucauuuagaaaaucagaaaguggagggagcgaaacaaacgucuacacuccgcuugagucccgacaguagagccuaacaggaccuuucacaucuuuaauaauauuauuaaucccaauguaagaaaagagggaaaaugcuggguguuuauagugagguuguuuacguagccaagcuucuuccaugggcuucuuggcuugagucgaacagacaaaaacagccaggccuuuccucuugugcucuuaguggguugugaaaaaugaaguuaagcaagaauuuggcacugcuugcagcggcaaagugagauuugcuuguccuggaugauacuggugauggucuggcucuacacuguggcuggaccucuuccccucuaaagacaggucuaugagucacacugcuaggcuagauuaaugaaccauuucccaaagugguuuugucugagaaaugguacauucauaguguuucuuucuuucuuuccuguccugagcacaaaacacugguuaacuaagcccuuuuaggagucacagauaguaagauauggucccaagcuggcucucacuguuuuccugugcugaggggccacccugacucccuucugccucgacugaguagguucagagggaagaaauaagagggaagcucaaguaaaacucaguagaaaagauccaagguagacagaucaccacagcuggcuccagugcaaggccuguucacaccgaugcugcuaacuuaaguggcuucuuggcaaggcugggguggaaguuaaggauuagagccgaggcuguuaaaaauacagucccuuccauucacuuagaauucuagaaaacuagaauucuagacuggaagccugcaccgagguaaugcugauaucaucuuuuuuuuuuuuuuuuuuaagauuuauuuauuuauuucauguaugugaguacguuguugcugucuucagacacaccagaagagggcaucagaucccauugcagaugguugugagccaccaugugguugcugggaauuaaacucaggaccucuggaagaacagugcucuuaaccauugagccgucucuccagccguugauaucaucuuuuaucugaaacaucuuuuuuuuuuuuuuuuuuuuuugguuuuuugagacaggguuucuuuguauagcccuggcuguccuggaacucacucuguagaccaggcuggccgcgaacucagaaauccaccugccucccaagugcugggauuaaaggcaugguccaccacugcccggcuuaucugacaucuuaaagauccuguaucuggguaugagcuggcacucgggugacauauacugcagcgauaccuguaugagcuguugcagugaaaauugggcuggaacuuuugaaccacaaauuccccgugguuucagaagcagagcacucucagauuucuguugugagaacagucaccuuuauuauaugucacauguacuuuuuuuuuuauagcguugggguuuagauguuuacuguuuugaugauagauaugucaacugugcacauuuguaguuggacucuuuucuccaggugucuuuuaucccagguuagcaagcguggagucauagguguuuuggaagauuggaagaagaaguguaaguucuugauaguuugugaaagcuacucuggggcaaaggguugguuggagugaaagcuaaaagggugaacuuagaagggagacugcucaccuuagcaauaguaguaaagcauuaguugggcaucuauucauccugggugccagcaaugcuucauuucugauugucagugugucuaaccucaaaagcaagcccccccccccccccaucaacgaaguagcuaaugcaggaagcagaggguaggcuucuaauugaugagcuguggagcugaguugaacauccacauuagguaguguuggcuucugcuguggggucccacugucaucacuuucuauggcauucugcuuuuagguguuaucagugugugcuugggccugggaggauuguucuuguuacuauuuuuuuuagauuuauuuaugaguacacugcagcugucuucagucacaccagaagagggcaucagauccuguuacagaugguugugaagccacuguugcugggauuugaacucaggaucucuggaagagcagucaaugcucuuaaccacugagccaucucucuaacacccuccaccccacccagagaauuauuaaaggucacggccaucaccuuuuucuuaugguuuaagauaaaaucuuugguaucaguuagcagaccuaaaugucauaggccagaaaaaaaaaauaaaacaaaagagagaacucaggaagugccagcacauaguaaagaauagggaaugcuaugcuguuucccaagucuugacacugaaguaagaaugcuucuucagaguauugaauuagauuagaauauggguaauguuugucucugaaaauauuggagauuuguguuguaauuagguacagucuucgaaauuucagucugggacaagccuugcuaucugcuccaggaucaacacuggcauagaguuugcugucugcuuauaaugggucuaauuuacuuggcaaacccugucugagaauuuaucagucucauucaaaugcauuuaaguuuuccuuuuuaccauguaccaagacugagucuacuugugucaauucacaaaaagcagcuugcaaggguauuucauuuagcacuguuuaauguuauugcuuuuguuuguuuguuuacuuauuuauuuagagacagggucugguuggccuggaacucccuauguaagccaggcuguccuucaagagcugagaugaugccuggcagugguggcgaauuccuuuaaccccagcacuuggaggcagaggcaggcggauuucugaguucaaggccagccuggucuacagaaucaguuccaggacagccagggcuauacagagaaacccugucucgaaaaaccaaaagaaaaaaaaaaaaaaaaaaagagcugagaugacauuacaucggggcuguuaacauacaccuuuguuauagagagcgguaaucaggaccggugaaucaaguucaucuauaucuaaauuggacuuauaaugucauggggauugcaagauuuaaaaacaaacaaacaaacaaaccuuuuguaugccaugcaguuuguuccauggucaugagaaaaguuuacauuucacuggaagagaaauaauucuacuccccaaaauaagacggagucaaggaagaggucaaagaggaacuucaucaaaauagcauuacgauggacuugcuccuuagugugccuuauuguuccugucucauggguaccguuaucuuuaugaccugcuagguugugguggguaaaggggcagggggaaggcuuucauggccugaugauuggagcacucauccugacuguagugugaaacugauauaucaaagaaagaggggcaaaggcauagggcaguaaaaagauaagggcacuuauaaucauuuccauuuuuauaccuuucuaugcuuccagcauauaaaacacauuauacauuauugucauguggcuuucuuccauaaacagaaguguacuaggucaaggacuggcaaguaaauccuuccacaaacaccagaccauuuauuugcugggcacugagaagcugguagauucuauuuuucagauaaggguuuaucuuggcuuuuaaugcuucuauauguauauguuguuuauauauaaaaugcuucucauuuuuuauuccuggccagagcacugugcaucacgcauaguagguauauagacuuugguuguugggucaacuuuguuagccuugaacuugaagcaggagaugccugacacuaauaagugaacuugggaauccuggucaugaaucaugaaaccuguaagugauuguugauaaucuaggaugcuuagaacagaccggcuuuccuugcauguguuuuugcuuagcauauuuacuauaggggcuuuguuuugcaucucuuuggcuauggaugccaaguuugggguggguuauucaguuaggugacacagggucugugcuaguguuaaaguucagguucccagguauguugugauuucaagauugugaucuuuuaggauuguaaagagucuguaguagguuacagggguaguaguggcucuggagagccccgaauuuguguguguguguguguguguguguguguguguguguggcuuuggagaucuauucccaggaauaauuuagauuccauauggacuugggauagaacaaaucuaagugggagaggagaggaaaaggagaaagggaaaggaaagccaucaagaccgagggcacauggucuuucucaucugaaggaaaaguaauauguaggacaaagcaguaggagaggagaaaaccagacaguccccccaggcucaugggcagggccaggcuuggaaguaagggguaaccuaagggcaagagugcuuccucucuuuauuguaguuaaucuuuacccacagacuuuaucucauaauuagaaucguuuuguauuaauccacggggaagagaauuugacacaucgguuucccaguagccauccuuuccgguccagaaucuuuccagaggcacgcuggccuuuucugucugcuggcaaaccccaggucccuggaugugcuccugcucauuggugacuagccaguucuggagccaaguccugcugggguuugaagucuaguacagguuuguccuuccaaggaaggagaacggccacuccuuccuuauuuguugugggcgcuuuucccaccacaugcuauucgaggcucgucacgggaaaccuuuguagggauuuuguuuuuuaagucuauggaaaaguuugugauugucaagaaaagcuucccuuccucuuaggaacugcuauucuuuguaaacuacauggggccaacagacugguuccauuuacucccaaucuuuuaagacugcaggaagauaugggggggggaguguaauuuuucuuuucauuucauuuauguauuuuauguuguuauugccuuauuuguuugaggcaagguuuguagcuuuggcugaccuugaauuuagagagauuagccugacucugccgggaguguugggacuaaaggcauaugccaccacaccuggcuccaagcuuauaucugaagaucaaguucuuugccuaugcuauaaggauuucugaauucuuucaaaaugaaguaucuucagucaucccuauuuuuuuauaucuuuauugucuuuaugugcuucaaagaacuuauauucuuuugggaaagaaauaggacuguucuucagacuaagggagugaaggggguuuggguuagaaggagcuucgucaaagggggaagacagcugacgcguaagucuacgguuuaucuucaguaguggcugucaggcaaccuacauauuugcgcauuacuuuuccuuuguucuuguaugugugugccuucaugaguauuuuagccuuuguuaauuauaaaaucaucucacagucacaaaaccauguacauaggaauacacaacaaaacaaaaucaaacaaaccccccacuaaugagcccguuauuugcauaugucaucauacacaguuaguucccccaaccccuuuacauuuggaaauagcauguauuuauagaguauauagaacauaaggagacuuaggauauaacaauauauagauguguugguguuaauuuccacaagagauuauacuuuuuaaauagaagaccuuuucuuaaaguagacccagcaggagaauaaagccaggaaggaggugggaguagaaaggaagugggauuaaucuaguuaaacucuccggcuuggcacacagcguggucacacugagaaacaggagaagggaagugacucagucauauuaauagaggcagccagggaugagacagggaauagcaucuuuuggggcugggagcugggugaggggagccaaugcugaagucucuaaaucacuuaaugauaggagaaguuaguuuucaaauuaaaucuugaacacugugguuagccuugugaccaauauaguuuuccuugagcuuuugcauuuagaugggaaagaaaucacauaagccagggacagguauccaacccuuugacagugugacaagauaugguuuacaaaggcauugucuccguucauagccaauuuuuuguggguaguuuuuauugcugugugugaauucgagaagaccacuggacuuccuaacccuugcacagcagccucgcugauggcagcuuagcuaucaggcuucucaguaaagcugcucuuuuauuggaggcuuggagaagacacugaaaggcacaauuagcagaucugggaacaaaacucuucaaaaaggugauggcugguuguagauuuggaagggugggcuuccuucagaguuuaccaaaacacugugugagucccaggcccuucagccuuaguuaucauugggucggauccaucuggaugaggcaggaguguccacaccagaggcuuuacccuccuugcaaaggaaugggagcuggaaagcauuaacuaccacuucauaugccagcuuugcccaggacgcucuaggucccacuauauucacaagccaguacccgcuuguuuagaagggaagagaggaggcucaguguugguuuccaguugcugugguaacccuucaacuuuaacccuaugucugaugucagcagugaccuaucucuaucaacagacccuguauacugauauaucucacucucugggggagacuuggggugcuuaugaugguucucaagauaguaucaguauucaugaugcuggcaucguagaacggcucacagagaaaggucuaugguaccagaacagaaaauauuuauuuaggacaaguguaccuuagaaguguaagagugagugugugugugugugugagagagagagagagagagagagagaaagagauagagagagaaagagagagguguacauuuguugcaugagaacaugccuuagucggagagccaccaccucagguguugugaguuuuagacuguuuuguuuuauuuagacuggcuuuuguuauuugcugcugcacaguccacuuuagccacauuccagggauucuucucucucuacuucccaucuugccucuggagcacugugguuauagacaauggccagcagcauuaugguuauagacauauaccacaauggccagcuuugcaugggcucugaggcuuugagguccucugugugugugcugagcauuuucaaccaauaagccaucuuucuagccugaaacaaguuuuugauaggacugacccuguaugaacaaucauuaagugccuuagcuuuaauugcuuugcuaaagggaauuuacuuuauuuugauauuuaguucagugaugucaacuauuuaucauuugugucaguuccuuauuuugaaggcuugugacaaagaaccuggggcuaucugaguuuucucauauccaaaggcugacuaaaagauuuuauucaagucuuaaaacagaauuaggcugucaaacugaagauauaacaaaggacacauucauauuuucucucucucucucuuucucucucucucucucugauuagggacauggauucucuuuagucuuuugcuuuucacaacauaacuuuguauuauuauucuagcuugcugcuuacuuuuuuuugaagauugagcuggccacugcauuugacauucagucaucaaaguuaacccugaccccaccucccuuucccuauguccagcacagagcuaugcuugugcucagccccugguuuauuguuuauuuauuuuuuuagaauuauauucaauaugaaacucuuagaagggcuuccaugucuucaauuccuggcaauggaagaguuccucaugcuaacauaucccagucuugggagaagcauuuaacuguggggaaagaaaaaacaaaacaaaauaaagaagaaggaaagaaagaagaaagagagagaaaaucuaaacuaaaugcaacuuuccagaaaggaaauuucuagaccuagcauaaacagggagaguuuauuguaguuucagacacuaaagauaagaauaccuuuguuauucgaaauucagaugugguuaacagaaagagcagccacauuccuuuuuuuuuuuuuuuuuuuggguuuugguuuuugagacaggguuucucuguguagcccuggcuguccuggaacucacuuuguagaccaggcuggccucaaacucagaaauccgccugccucugucucccaagugcugggauuaaaggcaugugccaccacccggcugagcagccacauucuuuuugugucuuaggaagaguguaagcagggcuugacaggaagaugcaaaccugguuguaagaccagaacaaagggguaauauuuaguuuugaauaucauagcuugcugucuuuaauggauacagaaagaucucugauuccauuuauaaaaagcaaaguaagggcacuguaugaauuuacucauguuuaaaguccaucuauccauccacccacccacccacccacccaccuccacaacacugaagauugaucgugauggagugggacagaucuguaaagcaguaagaaugaucugugaugugguuugggagcagaguauggggucagcuuuuggagggcagcucuccagcgguaucugugagggaauuuggugugugugugugugugugugugugugugugugugugugaggaagcagcccaggugcugauguguguguauaagcuacuuggguuaagccgucugcaguguuugucauggcucaaccagaaugcagggccagaugggcuagggaagucccuggguagaaccaaaagccguugguucaucagccacuuguaagcugacccaaggggaagacccagugucacugggauacuguuacuggugaugccgaugauuauacugacgauugaacaagaaacuaauuguuuuccuuccuuuagucacauagagaaaaucaccacauggcaagaccccaggaaggugaugaaucagccucugaaucaugugaaccuccacccguccaucacuuccaccucggugccacagagguccauggcagugucccagccgaaucucgguaagccccaagcucugaaggcccagcugaagaaggagucggaauguaguuaagaaugugaccacuucuaguuaugacugaggagaaggggaugguugaugguagauaugagggaggaggguucacccagaggcaucuggaagcauuuagacuaaaccuggccaugaguggagggagaaugggagaggggcuaagacuuagaggagaggaggcaaggaccaaaaggccaagagcuagccagcuaagagccaagaguagaggaccuagagagcucuggccuagauggcugagguuauauaggaaagagaagcugggggaagggaagggaaaggaagcccagccccugggcuggcagguuuaggaggugggaugggaggggccacagguacugagcaagacuuguccuggguuucuuugggaccugacagagucuacccaguggauuuggggguucagaaucagcucugcuugcccuguaucucuucacguaccagagaguuuucuuugaguuacaucuuucaguuuuugcugcauaauuugugacacugguacaggcuuccaguauacugcugacguucucuuuauuuccuuggccucaugucuucauucagaccaagcaaggcaaaggagggcauauacugucuuccuguaacuugguuccugacgaguacacacgugagccugcccgcaggcaaggugcuucgauaccuuuucucuuacgacaccaugacaguauucuguguuagacagaugaagaaacuuucugagucacagccugucgacagcagagccagagcuugaaucucaguugugcuggcuuuaguaucagguacucgcuauauaaaaugcagguagcuuuuucccauucaguauauauuuacugaauauauacuguguuucagucugguuuuuagaauugggaguauuuucugcuccuugacuucauuuuaacaacaguaagguaauguccacuguagaugugcagagcugaguaaacgcucgcucugcagggacaggagaggucagggacaggagaggucaggggcaggagacguuagcaguuuuuggugucacuccccuccaucccccugaagggggcaaaaaaaauaugagguucgaugaaagguuuuuauaaaagaugcugcuguuuucugaugaugcuuucaacuucugcuuagauauccaaaugaugccuuagcuaccaagcaguuaguuuuaggggaguaaaaggacucucuuccuggaucuucaggaauaaacuagauaaaaauggaagaagcauuguuccugggcucuuuucuuacccugugcuuugccaaagugagugcaaccucaaguugacucgagucuuccaggaacucugaaccuacuggucuaaagcuugcacacaucccuuauauccucaagcagcugaccccgauggcaaacaaagguggauugcccucauccuguaaccagcagucauaaaccaaagcuucccacauguuccaaaucgaugaaguguaugagaagcaaguguggggauaguaaagaaaugccaaauuagauuguccgcagacuaguuguaucauucagcuuucaucugugugugugugugugugugcgcgcgcgcgcgcucucccacacuuuugggcaccaaauucggagcauugugcaugcuaaacacuugcucugccacuguaggucuauccucagcucuugaccuucacuuuaaaaccagcaaucuuugggaaaugucuuucaugagcaugguauuuuaaauuggagcuuuggauauuucucaggagaagccgggaggcaucccuagaacucaucugaaaaaguugguuccuuacaaccucagugcuaggcacagggagccaggcaccagcccagccuacuuggccaguuguagacuagcaagagaccuccuuucaaagaaaagauuggcauugccugaauagcagcauccuuuugucucaggaucuuggggucccagggaaccguuaugcaucugucuggacuccaggggaugaaguguuaccgggugggugaguucugcuagaccuuggucaauggcgaaacagccuucuccaagaugguuuucagugaaacagcgcucuuuuauugaaaguaacaagacuguauaaaccuuggggaguuguuagggguuuuugaggugaguguacaucucuggcuggugccgagaugcaggaaaggcaugaagaggaauuccaggugcuggauagacauguccuuauugugagagaguaaguuaaaccuauaauuuggccaacagguuaauugacugucucaaggaugggagagguguuggggucguacagacuaugugcuacaggacgugcgggcccagagcaaagaggaaacaguccuacuccugccugucucgggacaagguguucagggguuggaaacauuugguccucuggagugcccuggauugacuuuugcagggcacuggauugcaaaaguggcgcccauagcacuaugauugugcucugucuucccuguauacauacacacuugcaaagaaauacauacacacagaugaacucacccacagauacacacacacacacauacacacacacacacacacacacacacacaccccagagaaguauucacaaacuuccuccaguugcuauuucuucagaccuucaaugugcuuccuagagccauacaguguuucuagucauguguguauggaugucuguguauguguguguaugcaaacacuugcuuauuauacccacuguucuguaucuuuaaagaaaucuucuauaucuauauauguguguguguguauacacacauggacagaauugcuuaguauuguagcacauuaauaugcuauauucauuuaauuuagcuagcucccaucugguagauauuuagguugucaguauauuccugauauagcugaugugaaauggcuuggcuaugccuuuuuaaucaguucuucauauuuuuaaaaguuguauaagcuaugcugacuuaguaaguaaagguacuuacucccaagcuuggugacccgagauuaugccccagaacccagagaauggacagagaguacucauuucuauacccugucaucugaccuccacauaugcaucaugacauuuacacauacccuauacagaauaaauaaauaacuacaaaaauugcagaaaauguaaaagcaagaaguggaauaauuaggagagguugaggucguggcacugaaggcacgugugaaucagucugugcacauaugcaugggaacacacugaaagcccauucgugcuagcaggguuuagcuacagaaacugugaucuaaauauuuugaaacacauuuacuugcugcugcauaaaauucuuuacuuuguggauuuuuaguuaaaguaggagagugguuaucuauguuuuguuuguuugcuuguuuguuuguuuaugauauuagggauugaacccugagucuuucuugugcaugcuaggcauguacuacuccugagccuggcugccuggcugccuggcugccuggcugccuggcugccugccucccucccucccucccucccucccucccucccucccuuccuuccuuccuuccuuccuuccuuuuccuccucuucuccuucuucuuuuuguccuuaagucuauuuguguauguuauauuacauuuauuuacauauauuuugagcuaaccuugugugguuggcauaagaccaauguggccaagucccaggaugacucaacucuuuucuuucucuucucuguuuuguguuugagacagggguuccuugguagcccugacuaguuuggaacucaugcagacuaggcuggccuagaacucauucuaccuucuagaagcacuggaauuaaaggugugcaccaccacacgucuuguuuugugcuuuugauacugggccagacugauccccagcucaguuuguagggaaagcugaucuugaacgugucuuccuguuuagaccuccuaaagguuagguuacaggccugaacaucuguaccugacuccugagauacuuuuuagccacauaucuaaugaguuccaagagcuuuggauguauugccaaagcuuguagaucuaaucaugucuuaguugugagagaggaagacucgugcuuaucucuguauuguagaauuaguggcuuuguaagacaggggcuacugcaggugacagagugccuguaugcuuagaaucuuuguacuuuccuucauaaaauagucucugaagaggaaauuugcaaaaaccaauuuucuucuacuuuaauucacauacuuauuccaugcacgguauaauuuuuaccacaaauuuuaauuuucauauuuuccacauuugguugacuugaauguuuuacucaauuugauauagucugaguagauucuugcccuuugugucugaauuaccagacauccccagggaugaaggaaggaagaugacggaggacuuuagauacuaaauaagacagaugacuaggugggagcccuauugguacuguauccaaguaucaaauguuuuucuuuaaaaaaaaaaaaaaacuucaaaaauccaaucuuuucccucaaugcaagaaacauaguuuacuugguaagaaaauaacagggaaauagcagaaagccuaaaguccuaacuauucagaaaauuagcauuuuaguaauacauagaugauaaguugauacacugaguaaauuuguuuucugaguaguaaaugucucucuugggaguuuugaaaagaauuugauaguuuaaauccugucugucacuugccuucuuugggaccauccuugccguggaggauuuuacccucauaacguuggauggagcuuuaccucgccuccacacccuccggcccugccuaguaaugcugggugacugacauucaggcacucgcuccauguuggugccuauugcaugacacauggacacugcucucuggucuccugggcaauguugucucugcucccgugugauuguauacucccuuccccauuccccaacucccaaacugggggaugaacugauuaauuucuuuuuccugucuagaagucuaaauuuauuccuggguguuuugcaguuggugaugguuagggacagcuguucuuucaugcuuugucugaccaguuuuuccgugaugaagucagcaaagcaauaccauaugagggccuuggaaaacagaaagccuugguugauacucuucccugcuuaagcacuaaagagagaaaacucacuuuuacuuuuuuuuuuuuuaaaggcaaugacaacaauaaaaaauaaggccuuaauaugcuuuuggcuguuagauuccagaagccugcccuuaugaaacaauugcuguucggucacuauuagcuaaugcuguucaacugucaccaagggaauaagaagcuacugugauuuugcuguugaaaauccuucuauaguuccuuccaugcuggucuugucuuggcgcagcgggagaagcauuugccucgaagccugauaaccugagugggaucucuggaaaccacgugguagaaggaaagaagcaagccuugcuaguuguccuaugacuuccacauggugcagggacacacauacacacaaugaaguaauuuuuuuauguguuguguguguuggaaaauccucuacaauuuuuuuuuuguggucuacuucaaaaauuaauguaucaugaauauuuugaaguugcaggcuuuuuuuuuucuucuucuucuguguaaugccuuuauuuuauuuuguuuuauuuguaugggguguuuuggcugcaugcaugucugugcaccacuuuugugugccugaugccgcagaagccagaggaggguauuggcacuagaguuauggaugcuugugagcugcuggugcugggaaucaaacccagguccucuacaggagcagccagcgauccucugaaccuuuucucuagccccaugcaugaugccuuuugaugggguguuuuuguuaaaaggaagauuagcguauggaaaagaagccuagaguugguucugagaacuuuccugaacaguucccacagccaccauugcuagcagcuuccuuggauuugugguagcguuacucuagcacacauggaugcauauuuccuuuuaauaacuuuagccuguguuagagagcuuucuaaaccaguguuuacagagugaugccgucuuaccaacagcaugucacagucgugcaguugauacgcuguauuuuguuuaaccaacuccuuaugcugacccuuagcugcuuguucagugcuaccauguacauccuacagccacauaaucuuuauggagaggguaauuuugcuaaaguagaacucuugugaguauauaugcauuuauaauuuuaguaauuauuauuuuaacuucuuuccuaagccagugaauauugucuuuucucauauauuggccaguaauaucuguuaucaaacuuuuuuuuucacacaauuuaaauuuuaauuguagauuuacuuuauuuuuacacauaugcauguuuugcaauauaauuuuugauaaguacaaacgaauuuuaaauuaucaauggacacagacauguuuuucuagcuuauaagucauaauguuuaugacuacaugaugagccuugugugaaugauuuaacuagugaggccgcuauuuuucuuucuaucaauuaauuagccugcuuuguuguuuuuaucuuuuuuugcaguaguugagauuguacucagggcuaggcaaaaacuucaucaccaugccagauucuagccuaguuauugauuucuugaggcagguuucuaaccuccucugaucucagaguccuccuagcccaguaguuggaauuaacauuuugggcuacucugucuuuaguuuuuauaauuucuuuaaccagucuccuguugguagccauaaggguuuauucuacuuuuuaccaucacaaguguuguuaccauauacauuuuaguguguguuugugccagccuuuacuucauccuuuuuuuuuuuuuucgguuucuuuggacauuugggagacaaggucuagaaauuuuauuuaaaauacagcuucccugugguuuucuuacagggaguuaaggaguauugucuagagauucacgguggugaggaacgugauuguccauucacguucguucucuucugauuuaccuucuaugugugugagugcuuugcucaccucucauggcuugugcacaugugugugcuggguuccaauggaggucaggagagggcaauggauccccuagaccucgaguuuacggauaguugugugguccaagugagcccugaaaaccacacugaggucugucauaagagcaagugaucuucacugcugagcucucucucuaggccuuggaguauugaucuuguaauaaaacaaucuucaguacagauggaaguaugucuucucaaggcaccuagcuuucuaucuggcuuuguuucucagccuguguauccagcugcuuccugccugucuauccacgugucuccuuuccauaugucccuauguuuccgaccugugugaccguauguuuccuaccuaugggaccguauacacucuaccagaugcucuauucagaugcuuccuaccuguucauccagauguuuuuccuaagccguagaugggaaucucagugggaguugcucugcuccccggcacuucucgcaacuucaugcccuguuacuucuguccuuucccgcuuucaguguuguauuucucagacagccgagaagagugaguugugagguuugaauuuugccaagaguuuaaauauuuacagagcuggaaagaauaaaguuggaaaagaaagagagagggggggaaaaugaagagacgugaacauggcugacugaguucuugcuuaguuucauuuggcuguuuucagugcuauacucaagauaucaagaaaaacauuuuuucagcuuguccacuauugucagugcuugaacuaauuggagcugugguuccucccucagugucauuggcucauucucaugcccggagcaguucuauccuaaaggccccugggugcuguuuuacaucguguaauguuuaguguauuucuguugcugcugccugggccaccaaaccuagagaugcucccgagagggcucucuucauagaccgcagcacacauuauaugcuugugcccucucuggggccagucuucucuuaaacaaacaauauuuuauauuauauauuguauauuuucuugcaaucugaggaaaugucagggccuaaauuauaugaauaacaaaauaaguuuguguaagauauuccuuacucuggauguugacaguugcugguuucuucucagucuuucuuuuggucccuuugugguguuuauuuguuacuuuccuggggcacaguggcacaguuacaguucugagcuuggauaaguaaaggcuuucauggcaggucuccacuguuacuaugagaacucugggugccacagcuuccucugaagaauuuccugaccuggaugucuuggucuuagugacuagugaccgcuuucccaaagauuucuuaugaaaggcuacuaguugugaacaguguaucuuguguuacuaagcuguuuguuuuuauuuaagucacaguuucguagggagcugggaggaacaguaaauauaaaguauaaacacacacacacacacacacgaaacccccccaaaacccaaaaaacaaaagccauaauguagccuauuacauaaccaggaugcuguuauuccuugcaaaugcaagucacuuagcaaacccaguuuaauuggggaggggagauuccucaaaguccaagacuaauggaagcaauggcccaagugcaaacaguuucucuggacccaggcaaaacuauuagucucugcagucuagacuaugucaacauagguuuaauuuagggaaaacaaaaucuuaauuuauuuugaaagaaucuuaaacuucagaaaaguuuuagguucaguacaaggaacugcuguauuugucuuuugucauauauaccuuuguuaguuguugguaauuugcuugucagcauagcuugauuugcuuaucucuguguauauggucuuuucuuuuuccuuccuuccuucuuuccuuccuuccuuccuuccuuccuuccacccacccauccauccauccauccagcaacaucucacucagguauccucaaacuaguggcucucucagcuucccagugccuggaauacaggcacacacuaccacacaccguaguaacaaaguuuuguuuguguugcugaagauuaaacccagggccuggaagauucuacagcuagccucccacuuugcuaccccucuagcucuuuccuuaaugguggaagguaaaacuggagacaccaugauuuguaacuguaaauauuuauagcacuuuagauuguguuuucugagcagaguauggguaucaaaaucaggggaccccaccacugauacuguucuguauuuaacguguaguccauauggguuuuguguuuugcuaacacguguuuugcuuaguuuucuccucuccuuucucccuuuucuuucuggggcuagaaucaaacccagggcccaagucaugcuaugcaaaugcuuuaucauugagcuguauccccagccugucauuaaauucuuuuaaccuggagugauucuucaauucuaguuuuuuuggaccuugacuuuuuuuuuuuuuuuuuuuuuuuuuggagacaggguuucucuguguagcccuggcuguccuggaauucacuuuguagaacaggcuggccucgaacucagaaaucugccugccucugccucccgagugcugagugcugggauuagagugugccaccaugcccccggcuuuuuuuuuuuaagacuauaggccagugauuuggucgacgaccuuuaacuuugcaucugucucaugcuuccuaugacuuagguguuggucauacuguuaaacucguuuggcaggaagcaacagggauguguuauugucacgugaccuuaagaggcacaccauggacuggggauguuaacuuuuaucauuuugguugagagauuuggggguggggacagaguugcugggucccuggcugcagugcauuuaauauucaguauggagaaugagcucugaggaaaagcauuuccaucuucagucagugaggugugcgcagagacauggcgaugcccgugggaugaaugaucaucaaaagauaauauccagcgugguucaguuaggcuucucagcguauuuaccugauacaauuuacauaacaaccaauacauuguauagcuaucugcauagauaaguuuaacuuuagccuauuaaagucuguuauugaauucagaaauauugcuugaauuugcuuauauuuucuggccuuauuuuauguauagcuuaaggacuugaguuaacucuccuuuuggaugugucuccaugcaugcuucaauucauucuggaaacauuaguuuggauauuuuuacgcuacuuauuuuuauuuuucauagcaugagagcuuuuggcauguuucaugaguucauucucaaacaugccugcaucauuugucaggguauuugaaaaaugguauaugcaugucuuuuguuguggccuuuuaacuauaaggacuuuuuguauagcuuucaggaucuuuguuucuuaauaaacuaugcuaguggucuaaguucuauugcugugaagagacaccauguccaagacaacucuuauaaaagaaagcacuuaacugggggcuugcuuacaguuucaaagauuagucuguuauaauccguggcuggcauggugcuggaaagguagcugagaauuguacaucuuagucugcuggcaugcuugcagagagagagauugggccugacauguucuuuugcaaccucaaagcuccuccccucacacgacacacguccuccacaaggccacaccucuuaauucuucuaauucuuuuaagcaguuccacacccuggagacuaagcuuucaaauauaugagccuacgguggccacucuuauucaaagcacuauuucuucuugguggggaaacgaagaggagaaagaaagaaacugauauuuucauucauuuuuuccuccucuuuuauaguauguaacauuuaagagaauaaaaguaaauaaccaaguuaaauuggacuaagaggaaacuauggcugaaagauggaaagaagaccaaacucauggagcuaacgggaaaaugaauaacaggaagcccuauuuggugaccgaauggauuugaacuugcuggucucugaugggucuaccuacaagagacaggucauucaugcgagauaggcccacauguuuuugaggaugaauaugcuucuuuuuuuuuuuuuuucuggguauaaagcacaaagcagugauuccucaagcuugucuggacacugucaagcagggccagugggaguucucaggagguuucuugaaaccuuccagaauagguugaguugcaggccugaucucagcuuaacgcggaucagauuuagaccguugagagccacaguugcugucuugaguaguuuccauuguuacugacacagcccuuuaaagcucacccuucccaaugaaauguagagcuauaggcauuuguucauuuuaccuggggccaaacuuggccgugugcuaaaagcaaagagccugcuacuugccacuccuuacaagacggaguuacucccccugcacaccccccccccuuuuuuuuuuacgaucccagccuccauguaggucugggagaggcaguugagagacauuaguucugagccuccuuugaccuaaugugacugaaucacuuggcaauuucuggugucauucaagcagggugucugaaggagauuccugugccucuggaauucaggcuaaagugcugccuuccauagcuuuuaggcagcagugaaccuguaugcugccccuugcccucugccuuggaacucauggacuguauccuuuuuacauaaguaccauacgucagggauguucucaccuuaauagcaucuuuauuaaaucuuugagaacuucacacaaugcauuuucaucaucuucacccccccacuuccuuuaacuccucccagauccacuuguacccaucucucuauccccuccaauuuguauccuuuuuaauuuuaauuuaauagcccacuaauuccaauuugaguguccacauacuucuguguggggcuauccguuagaauaccaacuuaccgggagccacauuguuaaaacugauuuucucucccucaguucccgucuacugucuguagcuccuaagugagggugagagcucaugagccuaugggggccacucuuguucagaacacuccauguuagaaugauugguuuguucaggcaggcacaguggcugugaguucacacgcgcagcauccugccaugcgcagaacauacuauuuaguugguguccucaugggcuccuuucuccucuuccugggcuauggucccuaaguaaaaaguuauuauuuaugugcuguuugucugacugcccuuuuccagaggggaagggacccugcugucuuuuccaucacugaaucuaacaguagaauaucagaaacgaaacgaugaaagggucaaugccguuuaacauccccaagucaccacuauucauauugauccuuucuauuucuaaggcaguugacucuuacuggacauuuguugcaagcuggguacaguagucugugaaauucacagaugugcaaagccacacaguuugaugagcuuucuucaucuugauacccuggguuaaaucauaguuuucuaaucccgugucuggucccccugucccccaagugguucuaaacugaaaagugcugaugucccauugcuaucuuuguuaaugccucaucuuaauuuuugugauaucucacagagccaauaauuuccaguguuugauuguuaccugcaaguucccuuuuauaaaacacuccaccugcuuggacugccucaugcauucuuaauguggauugugugaccucuguaaauaggcaggaaucggaguugucauguccuuucgggauaaagguacacuuacuaucuaaagguaguaaaacaauuuuguuuucccgagaguguccacccauggaaacacguucagaaucagaaggaugccauucuggagcagcgcaguaaaggucuuaguuucuacuguuccuuacuagaaauugcuaagcacaccaucuauguaguagugcuuccugcuggaucacuuuggguaaaucuugagauauuccagcaaguagguggaauugggguugcacacucugauacugcuuuaggugaacacacacacacacacauacacacacaccacacacacacacacacacucucucucucucucucuaaagaagaauucaggaaucaauaugacaaaaaugggaggguugguuguugugccccaccccauuuuauuuuucuggauauguuauaaugauaagagccagugaccuuuaguuagaccuuuaugguuagcaaacuauacauccggagagucugcugucuaaggagagcaucaaagccgguggcacaagccuuugucaucuuccuagcagaguagaggagcacaguuacuugugcacuggucuaagaauaagauuacuguuuuaaaugggcaagcaagauuacaaagcaggaaaaugauuucuuggugcuuaaaauucaagguugucugggaaguaauugcaaguugggcuguaaguucuuuuacuggaagagucuggaacacuugcagccuugcaagcuccgugccagucuuuggagauucuguuuagcugaguguauauuguccuugagcucugugcuuaucaacugagccagcuaagaacuaaagaacuaaagacuaaagacuugaguguaaagucgggguugugaaacuuacugguuuaauacuuuacagacguuuggaacuaauugcaccggaagugaaaagcugguuucuuccuguuuguuuguuugcugacgguguuggauguuaaauacuguuucugggaaguaagagcuacaaguggcuaacuguugacaaaagcuaagaaauacacaaggaagaaaagagaggcaucugcaguuauugugucaagacuaagucaaggcugcauuguggcuggguuuccuuuccucuguggacauguguuuuccaucagacagggcugcgugacacgugauguuggccagcaugagucaaaccaugcauagcauauaaacagagguuaggaaaagaccugcagcugcacucagacgcucuuccugcuggaauauuuugagaacuugguacacugggucuguuuguaagucagaaacgauuuacaccuguauguuuuggcuuggcuucuguaucguaacauggucaguucuagucuuaccugacagcagugauaugaauccugggauguaaucuuucaaagguccaccugacuuuaaguucucucucucucuuuuuuuaaauucaggaacaaagugcuguaacuucuguguguguaaaauuagaccacagucagagcaccaucaaaacgugacccagguuuucacccuuuuaaagggucugcaugagacuucuucaugagguagcacaaggggaacuagcugucguccucuccaaccuagguuaacaacuauuucugacuucugaaugagggcagggguagggauagggaccccuuagugaugccuauguagcguucuggugcaaacugcccuuucagauuuccuggggguauuagaaugucucugugugaucuuaaauucgugaguugguggaaaucauccguuuuaaaaugugucccaaggucugugcuagaacccuagagguuaugagcaguagcuaauauggaguauagucucuaaaagcuuaguguaaaaauuuaacauaauaguugacaaaugucuguauggagaaagugauccccagagacuugggagagcacaaaggggcugacauucuacuauggcuguaguaacagaagcccgagcuccuggcaagcugcugaaugagccccuggacauaggggaacccuggcuucaagcuagauaggggcucaugacaaaaaaucauuuuacuaaugaaagucugauaagcacaggucuaaauggacugaccccaucaccugaccuuuucuugguuacagcauacagaguuaauaaaauaauaugcccuccuccaauaauggguaauuugaagcacauuggcugccaauuuggauuugauggccuuagucuuaaauaucaacugguugugacaccugguucuauaagaguucugucuugaugagguaacccuggggcugcugagagucacaggccuaaagucacaagccauuccguuugguagggacuugcgcuaaauuagucccgucuccuaggaaaccccucaguuacagggaagccaggaugauuggucauaccuuaguuucaacacuuuuuaacucuaaggucugauuuuauagcucuuagcuuccccucucucuugguguacuuagguugcuaaaugugcuacugacgaugcagauuaguaaaccucuuagcuuacauuguacugaaagacacacuguuuuaaggaggaaguuucccagguuacaaguccuggguauuauccaauauggcauuggcuggcugcaugcuuucuguuuugaggaaguacuacucaauuuucaaacacugugucagccucuucugaauuccuguguucagagaugauguuaaaggguugcuugguguacuugguauagauucaaaccuggccuugaauuuauagagauucuccugccucugccucuggugugcuagaauuaaagcuaugcauaccacacuuagccuacaggcaugugccucccucccuucccucccucccucccucucucccuccccuuuucuuuucuuuucuucuuucuuucuuucuuucuuucuuucuuaauuuuucuuucuuucuuucuuuuuuuuuuugcauuaaagagauuauuuuauacagcaaaguuuuucuaagucccugugaaaacugcuaugggauaaaaccaucucugacucuuuccugcucccagcauguguguguggagacuggauaagaagaccuuucuuaaugcuuuaucauccuuuaccugcuguauucuuugcuuuuguuuucuuucagucuuuccguguucuagcuggucucaaacucuggcuugguuuaggucacucuccaacuucagucugucucccgccgaggccuguguguguguguguguguguguguguguguguugcuuuguucaucugugacuuacuaucuugcauaacauucucuagacccaugaaauuauuuguucaacauaguaggagcuuaauaauuguugauucauauuuaaacauuuaauucuaaucauaauucagugcuuugccaagacaucuacuaagcugggguugaccagcauuucuuagcuuucuuacucaggagagaguccuacaagguagagguguuguaauuuuuucucucuuagaaaagggcagggagguuguacaagccugcaaucccaccaacaauggaggaguguuccucuuucuccacauccacgccagcaucugcugucaccugaguuuuugaucuuagccauucugacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuuccggggauccaucccauaaucagcuuccaaaugcugacaccauugcauacacuagcaagauuaugcugaaaggacccugauauagcugucucuugucagaguaugccugggccuagcaaacauaaaaguggaugcucacagucggcuauuggauggaucacauggcccccaaugaaggagcuagagaaaguacccaagaagcuaaagggaucugcaacccuauagguggaacaacauuaugaacuaaccaguaccccggagcucuugacucuagcugcauauguaucaaaagauggccuaggcggccaucacuggaaagagaggcccauuggacacgcaaacuuuauaugccccaguacaggggaacgccagggccaaaaaaggggaguggguggguaggggaguggggguggguggcuaugggggacuuuugguauagcauuggaaauguaaaugagcuaaauaccuaauaaaaaauggaaaaaaaaaaaaaaaagaaaagaaaagggcagggagccgggcagguggcgcaugccuuuagucccagcacucgggaggcagaggcagaggcagaugaauuuccgaguucgaggucagccuggucuacagagugaguuccgggacagccagggcuacacagagaaacccugucucgaacccucccccacccuaaccccaaaaaagaaaagaaaagaaacgaaaaggacagggaacucuugaguauauuuaagacugaaacguccagcaguaaaauagagucacaaucuugauugacaacauaauacaccuggaaacagcuccuuuguaucuuauuuacuuuuaugaaauacauuagagaccauaucccacuccaacccugugucuuuuccccaccucccuguuaauuauacucccuaauuaaauguugcacuuuuacaaaaaaacauugugcaggauuucuauauaccucuacacccaguuuccuuugcuauugaaucucacauucaugugcugcguuuguaauaacuaauaaacaaguguuggcucauuuuugcuaauuaaaauccacaccuuaagccaguuuauggcaacucaugcacuugggaggccaagauuggaggauugcuaaaguuuggaggccagcccuaguuuaccuaccaaguuccaggauagccagggauacauaguuaggucucaaaaagaccaaagaaauaaguaaauaagaauaaaaaauaaaauuaaaaucuccaaccuccauucaaauuucauucauuagcuuuuagcugcugucuuuuucuguuccacaccucauauagcauccagacagcaccuucaccuguccugucucgaguugcuuggcugggauuacuucuuagguucuccuuguuuugcaucacuuugguaguuuugaggaguauugcucuuauguuguauauaauuccccuuuauuagaauuggacuucccccccuccccaaaaugugcacaugugcacacacacacacacacacacacacacacacacacacagaguuagacuugcauaaugguuuugggaaagaagaugauggagauuuuuaauuuuaaagccaaggugcaccauucucaccauguccugucaagguuauaugccauugucacaucuugucgcucuuaaugcugacccuggucaccuggcaaagucguguuuuucagauuucuguacauacacuuccuccuuuuucuuuggaacuguguauuuucucaagaacuauuuguaugucuguuucagagguuugucucuuaugccccuuauucauccaguuaguucuaucauccaguucuauguaugcauuaguauagguuccauugguauugugcucuuauugaucugaugagccacagugacucccaguguggaacucugcaugacugguagcaauugagaugcagaaagaaguaggugcagaaaugggaagucucaguuuaggaagaccucagugaaucauuuaagugggauugugccgcagagacguugaggaaaguacagcuucaaaacuguaacuccaggauguugucagcagaggaggaggagaagcggagaauuugacaggaagcauugcuagccuuggauauggccuccuccucucccacacucaagcaggacuagcagggaagaauuagaagggaauaaagccgcaucagugucucucuuaacuucuguguagcaccuggucacaggaacggggucuuucuuugcacacucugccuacaguuggcuucauuucugccuaggagggucucuauaaucaugccuaaccuuauuguuugcccguguuuucuccacuuugccuucuguggcuguagaaccaaaagcuguuuguaaaugagggaagcaggacuagaacccagaagaacaagccacuagaugucucugaggccggacagacauuuguuaaacauccugaguacuguguccggcagccucugaguugcagcucccucuguccugguuccucagcucuuggacuggggaaguugccagagcacuuucuccuugaguugucccuccgcugucgguuuccuggugcugcaaagggcagcgguucaaaagcagaggcuuuucccaccuugauaggacugaacuugggaacauucuucacuuugagcucauuuuacucuuaagguuuuguagaaauggccaagaguauuaugcuagagaggguaagagaaugucacugugcaaugucccugggaagcauuggacagaggaucauguccgucuucaguaaccccuacccacaaugcuucaccaaggauguucauuguuacugcaucacaagucagaugcucuggaguuuguuuuucgugcuguucuauuucauauuauaaaaagccuaauuucuuuucuuuuuaaagccaauuuuccaauaaccggagaaaaccaauucuucuccuucccccacagaagaugagaaagauaauuuuacucucuuggaagcaggaaaaacagacggcucaacuugagcgugauucuauuuugugucaguagaggaauuauguguuuggauuauuucuuucuuuggaggauaguaaaggucuugaacccauacggucuuuagucuuucugagcaguucaugaugguuuggccucacgcugcacucuuuuaaaaagugucaccauuguuuccucucgaaaauguucuggaaugucaucccaaggaauauuuuguccacugcagucagauguuugacuguuuuccuggugaucuucucugugcaguagccaucuucucuuacccugacccccaaagacauucaacuagcagugauggucaugagcuccagucuagcggcaucucaggagccuuuagaaauuaaucaguggcaaggaacagaguugaauaguggaugccugaauuaagccaagacacuuggcuucuaggcuauuucuuuugggucuuuuuuuuccuaauuucugcauugcaaucugagcaauugcaacagcagacucuuagcucugauggucuuaccuucucagccuuauuuguuguguuugaaauaauucuagugucauuuuaauucaugcgaccccggaaaauacugaguuugacauuugcagagccauaguuucuguguuuugaacuuuugggggaaaaaaaagauuuauuuuuauuucaugugugggaauauuuuggcugcauguauguuuaugcacugcaugcaugccuggugucugaggaggccaggagagggcacuggguuccugggaacugacguuaaggaggguugucagcugcuacacaugugcugggaaaccuccuucugcaagaacaacaaucgcucuuaacugcuuagucaucucuccagccccugcuauuucaguuuuuaauuuaaaaaauuggcucguguuuuacauaaguaguaugugcauguuggcagaacuuaaaugaugcagagugugaagagagucuuccaucuuuaacaccuacccggccuccuccacagaggcaccacuguuacaaguuucuggcugauucuagaacaagugguguauaugcauaguccacccccaccccuuuuccauuaguagucccauggucugauacaugguuuguccccugugguuuuguuccugugacccgugagauuaucuuauucccuuauucucugaaauuauuauuguuguuguuguuguuauuuagaaugccccugaaaggauggacugauagacaguaagaucauguuuagagaacuagagagaugacugcuuuuccagaggacccaguuuugauuccugggaaccacauggcaggucacaacucucucagcuccacuuccagaggaucugacauccacacacagacauccaugcaggcaaacuaccaaugcacauugaaugaaugaaugaaugaaugaaugaaugaauaaauaaauagauccuguuuagucuuuuacuauuguaauauuauuauaaauauccucacaugguauggugaaugugcuguguuugacuauguuuuauuuugaaaagaaagccauugucuaaggcucgguccuuuccagacucuguaguuaauaaccagggauguuuagucuaaauggucaaaucuaaauuugguggaaggaaaaaagaaaagagcucuacugucccuucccaccaucgucucccaggagagugaacaccugcaagagcagauguucugaagaucagcaagggugugguuuugggaagaaccugccucugcugagucuuaaauacccagauuucaaaaaucagacauuaauaaaaucuacagagagugucugguugugguaugaaguugagugguggaagacuguacuguuugugagcagacccugggcagcaaggauguucugcaaggaugcucuacguagguuguugaaggcaaggccacaccaaccuuguuauguugguaacuucucagaccucagucagauucuuuaaaacuugagauuuuggccuggagagguggcucaguacacuagagagcauguuguuauuccagaggaccaucucagaucucaaaaccuaugucuggugguuuguuuggcuuuucuaggcacccaaagauacacaaacacauaaauaaaaaguacuagcuaguuuacgguuagaaaaaagucaauaguauuaacagccuuuuaaccccgcccacccucaaucuggacauuucugauguuuguuuggaacauucugugucaccccuugccuauagcaguuacaucaguaaaguagaaaugcucuuuucuagagagcacagaaaugucuguccuuugaguuaauuguuuaauacuuccuuccuuugacuugaaacagauuuuaugaauuaacucuuccggaugucagauuuuugucuuaggugaaaguguauaugagguaacauuuucccugugacacuauauguccaaaaucuuucuucccccagccuucaacaaagacugacuauaccaaguucuggaaggaaaauauacauuucaaauauucugccaucaauaaggacugugggguuuuuuuguuuguuuuucugaaacuaagggugggagaaaugcccauaagguuccauaggguccuuacaucacagguuagcaauugaguugggacgacugcccaucuguuacacaugcuuuagacacacgaugucuuuuuaucuaaggaauuucagguauaugacaugcuuccacaugauauccacaccaaacugaagauuaaaguauucucaaaauuugugugugugugugugugugugugugugugugugugugugugugugugugguacuuacuagcauauaugccugugcauauauucauucauagcauacauucaugccuggugccugcggaggucagaggaggguguugugucuccuggaacuggaaaugguaauaaacuuccaugaguacuggaaaccuggaccucuagaagagcugccauggggcucuucaccauggaguccucuuuccagcucuuccuuauuuuauuuuauuuuauuucauuucauuucucuguguagcucuggcugucauggaacuugcucuguggaccaggcuggccuccaacucagagccuucccugccucugccucuccaaugcugggauuaacuguggaugccacaacugccuggccuccucaccuaccccuuuguacauuuuaagacaggguuucauauagcccaaacagggcugagauuugcuguauugcugaagaguccucugcauuuugauucucuguuuccacacuugagugcuaggauuauaggaaugcaccaccacuccagguuuauccgacacuagggaugaaccaagggcuucuugcauguuaggcaaguacucuauuaacugagcuaugcuucccaucccaggaguuauucuuucuuaagaaaguaugaaaugggccucuuuuaugauugaugucuuuguuuguuuguuuguuguuuguuuuuucccuguuacucucaguucacccauucaugcugaguauucuuauauagccauuggauauugagaauugauuacaugccuucugugaugcugcuacagcuauuccggguguuugaaaaguucaugcacuccuggguauccuggugaaacauuuuuucuaacguguaacaaaaagcgacauauuuugacgauuauuuuuuauguuaugucuaaaauguauuugaggcucaggcuugugagauggcucaguggguaaagguacuugguauaagccuagcuuucugaguccaacugugggccccacauguggaaguagagaagcaacuguggcuuacacguguauguggcucacacaugcacaagcaugagcacaaaaaccuacauacuuguguauacacacacacacacacacacacauacacaaaauaaguguaauauaaauguguuccaggugugggaaacauaugacauaagauguuuaacaguacagaaaacuaauacuggauaugguagagcuggaaccuguaccuucaugaauugaauuaagggaauaauuguuaaauaguaauuaauaauuaaugguaaaaugcuugaaaggaauucaggacucuauacuccaaagcacaaagcauucugauggucucuuuaugauauggugucauagaccuuggucauugaucuguucguuauucccuucuguagcaaugaaucaccaacaccagcaagucguggccacuagccugaguccacagaaccacccgacucagaaccaacccacagggcucaugagugugcccaaugcacugaccacucagcagcagcagcagcagaaacugcggcuucagaggauccagauggagagagagaggauuaggaugcgucaagaggagcucaugaggcagguauggucuuccaugguaccugcuggagauucuguggccuuggguggcuguuugcuuucaagauaaguccaaagacucauauucacagaccaguuucuucucccaacucucucugccugaacuaucuucagggccaaccuuaggagcuaaagagcuaaacuagcucaugggcaugguuauauuggcauggcugccuugccuuccauugauaguguuuaaaaagagagaaaggaaaaauugagaaagaacaucuuccaauuagcuguuacuuugucaacagguuauccccccaaacucggagacuugaaauagucauuuacuuuaaucacaguuuuguagguuaaaaauuuagaaagggcuaagguaggugguucuucuguugccauugacuugagguuacuuagcgguagucaacuggugggugguuugcaagguccaggaggauguagcuaguggugaguauugcuggcagguugggcuuaguugggauuacaggaagcauaacaaucucaagaguaccaggacauuauacagcgaucuuccagaagagaggauagaaagagaugggagagagaagcugccggugucuuagggucugguucuagaaauggagucagcuuuguccccuuucccucauuaaaggagacaguaggcaggcauuccauaaaacaagccccguguagccagccaucuuguucgaugauagaguaugaaaaaggauagaaucaaagcagaaugagaaggaaaacugguuuggauguggauuugaucagaauacucuacaaaacugcacgggcaucaauuagacuuuucuucuuuuacgucuaucuuguuauagcugggcauaguagcacaugccuuuaaucccagcccuugggagacagggguagguggaucuuggugaguucaaggccagccuggucuacagagugaguuccaggacagccagggcuacaugaugauacauuguaaaagaaaagaaaaggagagaaaagaaaaguccuguugucaaagauccucuugccucagcuucuaaauccugggacuaagaugugccauccugcccauaauauuuauucuuuauucaccuauuuggucaagagaaaacugcuguauaucuucugaggguucagcauuguaugucauaaacaaaauaaaaaagccaggcauggcuucaauccauaacucagaagacccacucagggaugagaguuugaggccccagaguuggcuaggggcauagcucaauaggagaguacuugcuuagaguguucaagguucuuguucccagaacagagggagaaagaaagacagagaagcaaagaagaaggggauaugggagggaggaaaaaaagacaccuggcugaguuugagccuuuuugccauuguuaaaaauauaguuuuaacugcucagagaguauccuuggaagggaauauagggguauuguaaagacuuucucaaguuacagcuguuauuuuaaaaucuauacaucuuuuaucaauaguaaugucuugcucaucaaauacagcucagaugcaguguuugaaaauaggggaaaugaauaucaaguuaaugaagaagacuauuaaguagcuauaguuacuacguuuacucauagaaucuacauuuucgcuuucuuggcugcaucaugguaacaauuuuuauuaagguuuuuagauauagccuaucauguuucuuggcaggagauaaucauaugauuuguuguuuuccauuuuuggauauuucuauguggaaucagucaauuucuuauuuggaaauagaaugugaauuagcauuuauaaauugucuuuauacauuuagcauuuauaaaucauuuuguauuuaaaugauuguguguguguguguguguguguguguuucuucaagucacucuuuuguuaggagugauuuguguccgucucuucugccuuucuuuugcccugucuccuccuuucccacagaaagaauuuucgaaaagggguguggaaaagggccuggcauuguuuccuuuauucuagcuggaggugccuuugagccaaggauaguuuugaugguucauauuacagaaaugccaacauaguuccuucagaacugagcuguggcagcuggggaacuuggugcauuuuagggaaucccaguuuccaguccuucccacagugcagcaaaagaaaggcuggcaaugacugcuuagcuuugacuccuguguguguguguguguguguguaguguaugugcaugugaguaccagugaguauguguguauguguguauggaugguuuugaucucuuuaauuuuguuacuggauuauaggaggaaaaacccucugaaguagacuuauuaaucauggaagauuguuuuccucaccccaaacccauccagaaacagcaugguccccguuacaagucauagguaauaaauaaggccauauaauaaugguaugaaaguguuuucugaggauauuuccagaauaucuuggauaucaucuugcucagcuucaauuuuuuaaaaaggaugcaucuucuuuuauauguguaaauguuguugcaugcauauaugugcaccauaggcaugccuggauccuuuggaggaucauuggcucccccggaacgagaguuaaggguggacgugaaccaucuugugggugcugagaacugaccuguauccucugcaagaucagcaguuguucuuacuugcuaagucauuaccccagcccuuuggcaggccuuuugcuauuaguguguaugcgcauacucguggaggucagaguccaguccucaggagucagcucucuccuuccagucugggauuugagggguuggccgcagauggugaagcuugcuccgaauagcacuuuuacccaccgacccauacugcccaccccuggaaggcuucuugacuucuuucuucuggugauuuuucauuuugcuauuugugccuugacaccaggguagagauaggaaaagacucaaaguaaaaaauggccuuugguucaccuguucagcugcuuucuagcaccaaaugggaauuuauagugaggaggacugguuuuuccuggugggaccucugggguaucuagaaaaucaccuugguuuguuuugccucagccaccagcagcccucugaccaucucuugcucacugagagaucuguaaccagccuggcuccccugccugcaggagaucuugaacagccugucuucucagcccuuguucguuucucuuccuccuccuccucuucauuuauuacucuacgccuaugguuugauguugcuccaugaagaaagcaguuccucaguccguagcauagcuuucuggccuguacucugccaccaggcccaguagaguccuguguuagcucacuggugcugaagucacugagggcguuaacaaaauagaaucggagacggcuuugauugcaguuuuaaaacgaguuuucauugguuuaggaugaaacucuuucccccucucuuucuuccuuuuucucccuauugauucccuuagccaguauccaugggauugaaaguaauacaaggauaagugggacgugacugcuuugaaauggcuuuuaugguagcagaugagacagaauaauuaguucuaaucuaaguuguuggucaaaggguaaauuaacgucaucaccuccuugggucccacugguuaccccuuugacuuuuguuauugucacugagcccagacagcuccacuuccuguggaaacaguagaagauacuucugaaucucuuuucauugaccacuccuccugcccaguaagcucuucaaccacugcugaauuggggucaaaguagcaggcucuccauagagguagcgucuuaccuagacuaggccuggugguagcaggccucucguuccaaguccuuggaaggcuaaggcaggagaauugagaguuuaggccacccugggcugccaagugaguuuaaggcaauuagugacagacccuguuucgaaauaggaaaauaaaaagaggggccugaggcuggagagauggcucagagguuaagagaaccgacuacucuuccagagggccugaguucaauucccagcaaccacaugguggcucauaaccaucugucaugggauccgauguccucuucuggugugucugaagacagcgauaguacacucacauauauauauagaaagaggggccuguaaaaugacucaaagaguaaaggcacuuaccaccaagcauggcacuugacuuugaccccugaaaaucauaaggcagaaagagggcaacuaccacaaguuauccucugauuuccaugcgugugguauggugucuauacaugcauaggugggaugcauguauaccaaacacauauaugcaugaauauauucauacauguuguggaguucuuauaaggauguagcacauguagaugauuugccuggcaugcaugaggccuuaggucucauccccauauuucaucauucagaauuucugucugucugucucucaacuuggcauacuuccuuaaguuuaguuucuaaauuuagcauuauguuuuugaagcaacagcaucgagcuuuugagggccugcgcuguuaacuauuuucaaggcaauuccauacuguuuccccucuguccucucuuuaauuggcacuuggggguggggaugggggcaggagagcaaagcuuguaaacaaaacugcugacuaagguuggccuuucguuuccagggcaacagggacacagauggagggaggcaggcacaggauucuuucagcagguuuuacagauuucugucaagcuugacagccacucuggggguggggguagggucagcugcccagccucacacagccauuucagauccaugcugccaaggagagccgugcuccucucagggaagauuuaaagggcuguuuucugucuugaguuuuuaagagauuuuucagaacuuaaaaacauaccuagcaaagcguauagggcaaucaguggcugcuacauagcccuuggaacaugagguauaguuauuaggaaagcacacuguagaguuagguuucaggguugacuaaggcauuugacugguccuguuguccuacguucaccauauaucccuaagucaucuguaguaagauggcuguuuuaaguucauccauucauauauuuacucaacacauguucuuaucacacauguugggauggaaaguggugaauuugucuaggaguugagggcgucuauuguguucccccacaaaggaagguaguguaugucuaucucguagguuagcgcucuggaagcaaaggaccacugccugcuacaggucagccuggucuacauagcaaauucuggcuaaccagagcuacaugaugagucuuugguccggguaaggguggaaaugggaagaaaagaaaaagggugccaguucaaaucuuuuuagaaaagacuccccggcuccaucacuccaaaccaaccucuuccgugauacguacuugucccuuuaaauaaauauguucauaauaaaaaguccuuucgaaaacaaauuggucauuguuuuaaacuggaggcuuauuuuguacuaaggaaaaugagaucacagaggcaugaggaaguauuccauuucaaaaaaucuacuuuacauuuuuguuuaagucagaaguauaucuacauuuuuccuuccuucaagugauucuuaggcgauaacaggcuuuggauaauaauuacagacucaacaaauguuuccuccaaaguaucagaguuucgaaucugcacuuuucuagagccagucuggcagcugagugugugcgagguguuucaaagagacacuccaggaaauguggcagugaauuucuagaaucgauugguacaggcuuucaacaaaagagauugacaccagauccccccccacccccccucuucccaggcagucugccucugcagucuccguggcuuugagaaagaaagagugagcugcaccucugcacugaaauagccgcuuuaacggugggauuuuaaaauaccgcuuucauuucauuuguuucuacucgccccacccuucauaauuaaaacaauucggucuuccauuuuuguagaaucccggcuacacacuuaaaucaagcugagcacccucagaagagguuauuaucauucaguuagcucccuuugaaguacauuccagccgaggcaggagcuggcuggugggaggugcccugcgagccaaaaacacucacucggagccaggccccgcucuccauugccuuuuacuuucuagcuucuucuguugauuuauuccacagagcugcaggccagugggggaacuagaggggaggaagcuuccagaacuucuuaacucacaaauugucucugccuuucauuauccucugcguccaccgcacagcuucucagcccuaggagggugccuuuugaauccauaaaugacguuugguuuuguuguuuaagggagcuaacagauuaccaguaacucacuccaaagacucuguuuuacaaaggguuuccauucccagcuuguaugugaagaaauguugggggcaggaggagggagggcugcagcuuuucagaacuuucugagacuggccuuuaaaaccgaaccuuaaaacuuugcuaaauguggugugaauucccgggauacuagcuccacccauauacaucgaaaaggaucauaaaacauuuccaaucccaucuuccucccggcucggggaggaaaaacugugcucagugcuguugaauaggcugguucguuaaguucucuucuaaacaagcugaaugaggucaugggguugguauuuccauuuuauagcugggaaaacaggaucagagaaaugaaguaacuugcccaaguuucaucuccaguaguaggugaaaggguuugaauuugaggccugccaacuucaguccucacugccuucucccugguacugucuguggaaauuaccggaauagccucagaggucaaacugccuggauuuagacacuggcuccaccugcuguuagcuacagggcucugggaaaaccacuuaacucucucuggcccuguuuccucaucaguaaacuaaguuaauggaguccuguguucaggcuucacauguuuuuuuugcaaagucuagucaagucucuuugccucgcaaaucuuucugugccguccaugacaccuucuauuguuugucucacuguguucuuugaucuauguccaacaagaugcuucauaaagcaucuuaaaugaacugucaaggauuuaguccaaggggcugcagagauguuuaagagcacugacugcuuguccaaagacccagaguucagaccucaguacucacaugguaguuuaaaaccagcucuuaugcuaguuccaagggggucccccaucuucuuuuuugaauagcuuaggcacugcacacauuuggugaacaaacauaccugcaggcaaacaaacaacccccccaacccauacauguaaaaauaaauaaauagcauuuuuuaaauuaaaauuuuuaaagauuuauuuauuuauuauauguaaguacacuauagcuguguucagacaccccagaagagggcgucagaucucauuacagaugauugugagccaccaugugguugcugggauuugaacucaggaccuucggaagagcagucagugcucuuaacugcugagccaucucuccagcuuuaaauuaaaaaaauaauuuaaaaaaagaauuuaguuuaaaauuucacagcucuauuguaacugaccugggauuugaacucuugugauuuuaaaguccucuucucugcauugcaucacugcuuucuguuaugccaagcucaggacagguucaacagcauccuuaacuacuucuugagaauuccacuggcaaauagcccacagaacugagaaguagccaguaccuuaccugauuacaacuagaaauuucuucauucugucugccacaaaucugugacuggagggaucuuguaguucacuaguagcuuaagagccauugcgaggccuuugaguuuugugauauccugacuccucgaagacccgauauucuccaguggucaugcucaugcauuguguggcuuggugaaagcacugauagaccugcccaacgccugacacacggcuugauggcauggcagggaagucagcuggaguaauugcagaaguaaugauguuccuggagauggauguaagaccagagaacagcaauauagggguuagaugaacauccuaaugccuguccauugucuauucuuugugauugucugucuagaaucuuguaauugguguuuuucuauucuagcuagucuguguaaaagacacacaauccugguauuuuauuuacaagcuauaggccuagauugggcagguuuggugcuauuuuaacuuacaucacuguggcuguauaaccuaaauacuaaagcuggguaagauguguuuggaggaagagagaccugaaguacugagauguggagaaaucagaggccuguuuuagacagggcuuguggugcccugugaauagaccacaauaguuagccuuucuguugccgugauaaaauaccugaagcagcuugaaggagaaaagagugucuuaccagcuacaguccauccuuuaaggaagaagccaaggcuggaggagcccaaagcaagaaccgaggcaagaaccauggaggaauguucuccacuaggccgcucagcuugcacucccacaucugucaucaaucaagaaagugccccacaggucugcccacaggccagucuuacagaugcaagcuucucuucccaggugacucuaguuuguguaggaugacguaaacuaaccagcacaccugccaagacgagagaggaugauaauuaguuuugagcacucuucaugguugagguaaagguggaugauugcccuuuugcuuauagaagggcuucagcuaucaggugacagucaaaagcauucugaucuagacuuuaauuacccaguuuugauaaggacauacuggggagguugguccuuuauuuuuagccuuugguauugucccccaccccccaaauuugugggcagauauggggauuuuuuuuuuaaccuuucaaaacaggacugucuuacuuggguuucuguugcuaugauaaaacaccaugacaaaagagcaaccugggaaggaugggcuuuauuccaucuuauauuuaucccaucaccugcgggagggcagggcagggcagggcaggaaccuacaggcaggagccuggccuguaagaauguguugucuggcuuacucagucagccugcuuucuuguauaaccuaagaccuccuaccuaggguaguccugcccugcccucagugagcuaggcuguccucccaccaagaaaaugcuccaaagacucuccugucagcuaucugauggaggcacuuucucaacugagauuccucuuuccagaugacuuuaacgugugucaacuugacaaaauaaaaacaaaacacaacagugggaaaccaggcagguagaauuuuaaaaguucuaaauguagaacuauuauauuauaaaauacaacucucaccacucuauaguuaaaccuaauuuuaggcaguguaaguuuucuuagccuugugaugaauuuucacauucugauuuaaucuuucaaaggugaaaggugacuaggaggaaacucuuagguaucaaaguggaucuauuccacacaacacugagggauacuuuuaaaguuaucugcuuacacacuuauuuuuguaguucuggggauggaacccaugguuuuccuuguaccucuuaggcaaguccuuuacugccagugucuuuauuuugucuuuaaccuguguuuuugagauugguauguagaacacaaggugaggugacauuagauaucgaugcagugacuucuggagcaagcucuguucugagcaucuuugucauaacagcagcauuuugcacaugugguguuauuauucccccgcugugaggugguaggggacaaaauugugaaauaccucaaugggacacagcaaggccagaauucacauccaaguauuuggugcugcuguuucuguuacuggccacuuagcaccgugcaucuuauguuagggacaguggaggaggauucaggugaacuguuaacuaggcagcguguguacuaauuugugguugaaggugugauuuuuuuccuuuuauuucucauuuuguuaucaccagcauauuuuuuaaauguuucuauuugaauaaauacuauuucuuauuuacuuacucagaauguauuuuauggguaucuacuacuacauacuuaacaugguuacagguaguggguguguaggcaugaacauggugaauaagaucccuuccuucaugggucauucauuggggaggacagauaaaacccaaguugcugugaagaaaauaggugcagguuaaaagacagacagucauggguggugggaggugaccuuuuagauaggggcagggaggagugucuugauaccuggcauuuguagguuaguaacuaagggaaaugggcuucggugggacguguguuccagacagagggaauaauuguauggauucaggagcuggaagcaauguuaaagccagacacuaagauugggagacuguaucagagccaggcugggaugguuuuuuggccacugggcuacaggcaagaugugacuccacuauccauccugguaggguaggaagcagaggucuuccuuauauuuagcuguucuuuggaauggucugugacccaagaauaaucguacaauaaucuuaaacaagucauuccauugcauuguuaauaauaaaugguccgauuuauuuacuuuuuuaaugcuguuaggguuaaaagagcccucugcagucucuugcauuuuguuaguuacuugaagaagguagaaacaugauccagugagaccccuacagacaggauauagcauuuccucuuuuggugacuuggagacugguguaacuaguuaggacccaaugaugaagaaugggauagcacuucucuuggauuuaaaauguggaaaagcagugagcaucucccauccgcauucuacagguucuuacccuuuguuauauagucuuuauuuauuuuuucuugguuagcauacaaagaaauggauuucauccugacauuuucauacauauauauuaugcuuauuuaccccucacuacacucugacaucuuucuacucacccucucgauuguaaccuccuuccuuccaagaaguucccuuuccugcuuuuaagaaaguuuuuacuuuaucuuuuauuuagugcaugugugagcacacuugugccauaguacacauguggcgaucagagggcaacuuucaggagcugauuucucuccacuugguuaauaggaaaugcagcuauucuuggagggagggagggagggagggaggggaggagggagggagagagagagagagagagagagagagagagagagagagaauaugagaaugaauaugugugugcacuauuagauagugaggcuauuagccaaaggauucuuguauuugcuagaauauaaaucacugaccaguuguuuucaugccaagagguucagcauaugugagugcuuguaagaguuugugguagucucaaguuuacucaccccagguucaagcuuugccuucugcaggagacuuucaggaaagccuuauuggauaguuuccaaucuccauuuguuuuccccuucccuucucccucuugcucuggccucgcuugcucuggcccauagguuuuuuuuuauuuguuucucauuacagaugguugugagccaccacaugauugcugggauuugaccucaugaucaacaaaagaguagucagugcucuuaaccacugagccaucucacuagcccucaaaucuccauuuuuaacuugcuuuuuuguguauuauugaaugaaaugcauucucauuacuugcgucaagauaaacagaaggaccaggggcccuuucuugccaguuauuuuauuccuccucauaucaacaguguaguuucuuaacagaccuuucaugguuuguaacuuauaccaccauaguaaguacuaguaaugguacagugaacacaagaacuuuuaccagcuagaacaagaguuuucuagcugguaacuucauugucuaaacagcaauacuuuaaccuucauguugcauguagcuuuugcuacuccgccuaugcucugggaaugcgcugagcuaccagccccugcccaguuucccucgaauccauggauaaaaaacauggauacacacaguuguucaagucccccuugccuuuuuggcacaauugcugggugcuacuugucuccugccuggagaagcaugucuuuaucaauacucuuagcucugcaccucuccaccugcccucaacuuuaguugcucuguuacaucuggucccagcuaaauacucccaaccaccggccuguaggagcagcccauggccacugcauccgagaucucacaaggcuggucaccuuuucucccucagaagcauagugaacacuccccccaggcccaauccuuugugucugucugcuugccuccagggacccagaaguucugccuguuccuucugcccagcaauuggcccaugacuucauuacugacagaucaagaaccaauuggggaacaggaccuuagcaucagaaccaucccuauaccaucacaugaagagaucuaaccaacauccuagaacucauauagccagaauguucucuuucaugguuuaugaauuuuaaggguaugagaucaaugacauccauuuggaaauuguagaaguguggccagggcccguccuugguuuuggauguaagcguaagcauaugagaauauucuucccuggagauagcuaucaacuugaaaggggucugacaccuggucaucucuagcuggaguguaccgcugcagucaaguucauaacauuuuggacugauucuucaugguuuuaaugcuagcuuaaaaauuuuaaaucuauaauccaccaaacaucuaauugucuaugggaucuccaguuuucuccaauuuucagccauucuaaucaacucaacauuaucauuauucuguguguaugucaguaaguauguuguguguauguaaguaugggcauacuugugccaagccuuguauguagaggcuaggggacaauuuuguggagucaguucuccccuucuacccuuaugugugccuggagauuuaauucaaguugcuaggcuuauacaguaagcaccuuuaaccauggagccaucucaacacauacauucaugauguaacaugcguauguaggucagagagcaacuauuuucuuaaagcaaacuuuaaaacugguuguauuguucauguggugauuaacaccaacugcuaaguguaaauucauguagaaccuggauucuaaaccuuccauuuacacuagcauguaaaugggagagaccagauucgcaugcuaguccagaggaguccaguuacuuugacuguuuuuagauuuagucugagacucuagagcaaaacugacuugucagugagaaaguaucuugaguggcuaugguauggcuuguguaucuuaacaacuccaugggcaggugcauguuuuucagaguaaguucccagagguccaguguccccuuagguucaguuagcugggaguagaagagaaggacaugccuugaagacuguggaagaaggacacuaaucuagugacuuugaucuacugaaauauauauaaaguguuuuguguuuggugagcaguuuucccaugaaguauauuaugaugcaacccuuuguggcaauugaguaacucucuuuccccucugacucuuguauaggaagcugcccucugccgacagcuccccauggaaaccgagaccauggccccugucaacacgccugccaugagcacagauaugagaucugucaccaacaguagcucagauccuuuccucaauggguaaguuuacacuggggaccacugacuuuugcuuucuuccccaugguuuagacuguaaugggguguuuguuuacacuguggaaaggcagggagcuuuggggauggggagagaguugggggcggaugacagaauaaaggaaaacguagucacaugucauggaauauauccuucagugauuuguacgugagacugaacuucacauuuaaacaggacagugcuauuugguaaucacuugcaagaaucuugaaauucuuucgaguaagagugcaguuaaaagcaugucaugguacacaauacaagaaaauucacggguauuuuuggugaaaggaaaacuuccuucuuuccucagaagcagccacucugcagaaagugguguguuucugucacagugaacuuugcuauuuuucuggauccccuuugcccagccucuugaguguugagauuauagacauggaccaccacgagugguuauauacagaguucuuuuaccaugacuguucguaucuaugagcauaauucagcacuauuuucugguuuuuaaaauauuuacauagauauuaucuauauguagaauagaguccaagugguuauuuugagucaguaaggaaaccccugcccuuguauggugaguggccaguuuuagugcauagaauugauugguuuugguaagaucagguuauguuucaaaaugaaaagggccacguaauuuucucccuuucacugauugaguucugugacuguguuuuaauuuugaacuuuauugaguagacucacauugaggucuccuuuauuuauuuuuauuuucugcagagggcccuaucauucacgggagcagagcacagacaguggccugggguuagggugcuacaguguccccacaacuccagaagacuuccucagcaacauggacgagauggauacaggugggcacgcagccuuccacugucuguaguguuuucauuuucacauuguccccuugauuuuggcaauccuaaaauccaaugggaaacacaagccuucaacauaaacuaaaauuccacucagucugcuauuacuaaauauagaccuuucagaguuugugcaaauaugauuucacauagaugugagauuuuaagacccacccccauccuuuuuaguauuucccuuuccucagaauuauacauaacugcagugaggugacugugcuguacccucuuuuugguuguaaugaacaguccacucuuuuuacugggaaauaauacucuuuuugguucuccaggcaugcugauauuuucauguuacucacuaguuuuagaagggauugacaguggucauuuagaaaaucaauaacucagaggauccuguucuaacauaauaucccacuucagccauuuacaagaagacaacaagcuugacuuuucuaguccccagccugugcauccuauagaguagaccauguccaaacaacaaaauagucucuuaaggaaguuugcacuuugguguugggacacagauuuucuucuuccuuccuuccucccuccuucucucccuccuucucucccucccccuuccuuccuuuuaauuuugauacagggucucucuauguaccucuggcugugcugaaacuugguauauagaccagguugaccuugaacuucaaggauccaccugccucugccucccgaaaagagcacuaauagcaauuaaaggcauggaccaccacgcuuggcuuucauguaguaguagccaagccaaaacuaaaugacagcuugaguauaugcucucuguaaauacuuuugcaaguuucccuucuauuauuauucaugacagaaaagcgguuguuguauuguguucagcauuugaugcucuucuaaaagacccagguucaguaagcagcaucuacaugugacuuacaacucucugcaacaccaguuccaggguauacaacacccucuucuaaccuuuguaggcaccaaacauucaggaguuacacugacauuuaugcaugcaaaacacucauacacguguaguaguucugacaaaaaauaagagauugucucccgaaucauugguuugcaguagcucaagcuuagcauacucugugcauguccaacugcucugugcugcuaagagucuaaaauguugagucugaaugucagacccaucgccagguuuacaguugagccuugugaaaguacaggcuggaugcuggaacggcaucucucugggucuuauaggcugacaggaguagguagagagcauaggagggguugugaagagucacauaggggugguuugcacugggccguguuugauuuauuacuguuuuucuuuucugcaccccuuucaucugcacaccccuacccccauguuuugcuuccuuaugagguggcaucuuccuauguuguuuacuuucaucuuuaaacacugggaaucuagugaggguaaaaagagaaauaaggggagaggguggggaccugaaaaagauagauucucuccuauagguuucuaaaauaauguuaaguagguaaauggggauugguuuugaagauguacuacacaauccaauggugucaugaaaagaacacaagcagcauccauccugaguugagucuuugucuccccacugucugguaacuguguucucuaugaaucucugugcgcuucagcucucaccagugaaaugaguguucucaugccugcccauccauugaagaagucuguucaugaaauagauuugacaaacacuaugguuccuauuaaucgaguuaagugagugugaacucauugaguucagggcuaccucugugauguguuuguaggaaauggacauaaacuguuaaagagagacauggaauauuaaguaauuagccgagggcaggcagagcucaauagugacuagaagauuguugaaucugccagucaccuugaccccucucccuuugcaacaagcacacacagcuggacuuugaugacgauggaacaaagguguauuagcauaagcaaaguuugggcagucauucauccuuccagaguguuccaugaaaaucacaccucuggaagaauugcguacuuuuuaaauuuauuauuauacguaaguacaugguagcugacuucagaugcaccagaagagggagucagaucucauuacuggugguugugagcuaccaugugguugcugggauuugaacucaggaccuucggaagaacugucagugcucuuacccgcugagccaucucacaaacauuuuuuuuucuuaaguagcuuaaguaaccaacucaaguaguuaaaucuacaaagauuuaagaaagaccacagugacacuguagagucacugcaaaaagaauacuuuaagauuguuaagcuugaugagacgcuucucuuggcugcucuuguguucauuccuggugaggaagaauaggaagaauucuuuuuaaaaaaaaaaaagacuuuggguaaaguaagcauucucaggaauuagaagauugcaccuuuugaaguuuuaaaacguuguauuuaucuuaauuugugugccugugugaguuucugugugccucccacauguaugcaagugucuggaggccagagggcaucagauucucugaagcuggaguuacagggguuugugcgccaauauguaggugcugguaacagaacccagguccuuuggaagaguacuaagugcucuuaacugccaagcccucucuccagccccugugauguggauacggcagacacugauccuagggccuuacuuucuagcauuuuuuucucacuuuguauucugcagaacucuagucuuauugggcuaaacacuuccaaaauaggacuaggucaguaacguggugucugucugcauaaaugaaauaugagauauguuaacacuugagcuaucugugcccuacucaagaacuuaaaagaaaaggcuggcaagauggcucagugguuaagagcaucagcugcucuuccagaggacuccaucucaaguuccacugccugcaugauagcacacaacugucuguuacuccaauucuguggguacuuaacacucucuggucugugaguaccaggcacacauauguugcacagauauaaaauuuuaugggcaaaauacucauaaaaaauaaaauuuaguugaguguaaugauacauaccuuuaaucccagcacucaggagacagaggcagguggaucucugugaguuuaaggccaauggucuacauagugacuucugggacagucagaaguacauagugagaccccgucuugaacaacaacaaaaauuuaaauuaaaaaaaaaaaaaagaacuuacaaggaggaaauaaccuggucacccuucauucuauuacaggugaaaauuccggucagacacccaugaccgucaauccccagcagacccgcuucccugauuuccuggacugccuuccaggaacaaauguugaccucgggacuuuggagucugaagaucugaucccucucuucaaugauguagagucugcucugaacaaaagcgagcccuuucuaaccuggcuguaaucacuacuguuguaacgugaugcagcugugagcugacgcgagucuugggccuugcggaccaagugaugaggcagagcgggccugcagcugcaccacguucugccuuuguacucacacuccuuguccguguggccacuuaaucauugccugguguugauucgcaggaacuugcguuacacagaaauaaauacucucuuuucauuuucugcaagccugcauuucuguggcagauaaagcaggauggguugugcagaaugacuuuagagaaugucugcagcccuauggcuggguuuuauuacaguuagcuuaaauucauauaucaacugauucuaagccauacaaagcugaccucaggcagugaauucugauaggcagcuugguccaggaagugauuuacaguuucaaaagcuguauugauaacaguaguaacaaaugcuuuaaaacuuauuuaacuugagcuucaaaaaaaaaaaaucauuguauagauaguaauuuucuccuguagggaauacaguguaguuuggaauccaugcuggcucugauggcuucucucauucuguguuuacaagggcacagaguaccaauguugccaccguucaucauuuuccugcuuagcagcuccauucugugagcaggagaguaacuucaacaucugucacaauucuugcaugacagaucgugugaaagagaccaguuuggucacaauaugaaugauuacagaacaaaauuguuuuguuuuuuuuuaauugcagcuugguuuuuuuuucaaaaugcagcuuagaauuugauguuuguuauauauauauauauauauauauauauauauauauauauauauauaaacucuguaauuuuguagcuauuacagaggguagccaaauguuuuugauaaaucaguggcaacuauauuuuuaucuuuuggaccugauucugaaaacaucaggccaacuaggucgcagccugaugaaccaugaauuuugugugcuguuuuguauucugaggcauuauuaauucugcuuucaagauuucaaguguuuaaaauaauccugucuaugaaacuguuugaagaaugaagccgaucucugauuaacacauacagaaaggcccucgucaggacaugagcuguagauuuguacgucugaauucaguaaaauuguuuccuaaguauacuauccuaauccuuuugcuaaauugguaagaaaaaaaguccaagguauguacucaaugccucuuauguaaccaacauauuauuuguuucguuagcuuuuaaggaccgagagcuucauguuccucuggcaggcaggccgccugcacuuggcaaugacguccuuagcuguuuaguauuuugaacugacauuauuuauaaucuaugaauuuaaucucuuuuuuuaauuuuuauuuugaaagacaucaagaagcuggaaggaagcuuuuaguugccgugagggugaaggcuucucgguugaggaucuucaguaagaucccuuuugauccauugaaauagaaacgcacagaguacauuugaucuuggugggaagaggcaaguugaaaggucagaggcaaaguagcagagccagggaagguggcggaaaggccaggugaugugaaauuaaguagacaugucagaaccccucaaagacaaggcaagcaagacgugugagaagugccccaaagugcuccgcugccuuuaugccaaaagacaccgcuguuagagagaagagggucagggugcacuuuacugggaagggcagaggaggaaggaguggggcugugacauuguccauguauuggcagacgagaacauggacugcuguugcuuucagcacucuuaaagugaucucucuuuuucugaaggaaccccaauuuauguccacguuaauuccuugcucucucucugagcacuucaagagagacaaguaggaauuuuuuguugauacuagguugaaagggagcacucuuucguuuccucuuuuguuagcaaaaguugcaaaaaagaguuguacauucuuucugaggaaaaccaaaaacaagccaaaaacacaagggaccuaacaaaacuugacaguguuacuauauuuaaaaauauuuuuauagaugcauugcagguuauuaaguguaaaaaacaaaagauacuccuuuuuuuaaaaaaaaauuaguuaagucaucuaugauuuauguuaccaaguuuuagaagcaauuuucuaauaagcuuguggcauuaugaaauacuagaauaauuuucuuaguaaauuaguuuaaaacuuuuuaauuaauauaguauuuuucuagagugaaauauggcccuugacuguuuacuaauagauaaagccagauauuauaauuguuguuguuguuuuuaagaacauaaaauaugguuuguuacagaacacuaaagcuagaagccagaccuuuuucccccuaguucugagugaacucaagaguucaugugugcaaguggagcgccaucuccagcccucagagcagucucucagugguucuuugcuguuauaaguauuaauauuuucuaagaauucauaauaaggugcuauucauauacaucauacuauaagccaacugucagacuaucuagucuucuuaguccuaaaucaacaaauuuuaccaugucaucuccaaauuuugucauaggauagacacauuuuuuuaaaaaguuggauucaaaacacguuuuucuugauaagauacacuucacugaagcauuuaaauagcuacacacccugucauuuguuaacagcaggugguauuuaggccuuguuuuacuguaguauguaggauauaaaguguauuucuuucagugauuucucagugcauaagaagugcauaagucucagccgccugggcauugcucagcagaaaggaaucugcagauggugacgugacuuguccgugauggacaugucacggaguacugcguucuuacgaugucauuagaagcaccuugugaaaguguaacuuucguggaacaaaacaagccauuugaaaaggaaaacgguuauuuuaaaauggugauugacagagaccccuuccccugacccuguauuauacagugugcuaauacuuuaacuuaauuuuuuuuuuacacuucuacguuuuaccaaauaaacguuuaccuguguuguugauuauaauccaguauguuguacauacaggaacugugccgccaaauccaucagaugaaaccauuuuaucuagagucugguacaggguuuacuucucaauucuauauauaaaaaaaauaauaaauacgauugagcuuccacuuggg

SEQ ID NO: 1430 - RNA, 1299 nt, Mus musculus
agcuugaggaaaauuuuauuagaauuuaagagaaaaacccagaggcaggagauuugucagucuuggcagcugccuaggggagggagacagaaucagacagaaagacaugccuuuuugaguuaggcauggaagguuagcaaguagccauagcagauaagucacuaccuaguaaaaggggcagagagggcuuuagagaaggagugaggggaaaugugugggaaacagaaagaagaaaaggagaagugagcuguuucugaguaauucagaaaagcaggccaguguaggaagcugccuggcuccgguucuguaagcaacugcuugaggcgggggcucuggcagagagaaguacguuguccagggugaagguguaacuauuucucccacucuucauuggucuuaggugaauucacccuccugaggguuggucccuuagccaggcaauugaccuuuccgccuggaucaguuccuaagggaggagaccacggcaagccucuacccagaggcagagccguucuucugggugugaagugcuugcuagcuuuuucuuaauggucucccagagcuacuggaacacacugaaauccccuucucagguucugcuuccagaggauucugguuaaguuagagauccucaggaaacuuacaugcuucacacgaagccaaaaccgagcgaucuguaccuuccugaacugcgcguuuauuucaccagaaagcguuugucacacuguuguugaguggccuuuuggaagcaugagcaagucacauaaaguuaagguaguugcucccuagcccacacagccugcuuguacugugaacuucauuucaaaaucauuugguugaacuauaacuaaucagugagaauccuugcuuucugcaccgaagguaaauaccaguuagugguugaaacuguagcauucagaugaggaacuaugauagaacuaucaucuugcuccaauauauagccacguucaagggaaguuagcuguuguggcaaauacgauuuuuuucuuuaaaccuauuuagaccauauagcucccaaauaaaagacacaaaaaccuuuauacuuauaaugauuguaaaaacacuagagcugggcagauuucaacccucugucccauuuugucuacuucccugucaauaacucugagauaucacuuccuauguucagccugggcugcuccuacuccacaugcgaguccucaugaccaugaguucaggauccaccuaucucacaguaacuuccuccuucuucuuccuuccuucuuucccucauggucccuaccugaaagcccaauccca

SEQ ID NO: 1431 - RNA, 613 nt, Mus musculus
cuauaucccauuuauuucuucuucuucuucuuuuuuuuuuuuuuuuuuuuuuuuguacguuggaaaauaacuuuauuuguucuagggcauuggccagaguccccuuagaacuucugaaacugcuucuuggugccagcagccuuagugaccuugagcacauugaaucacacagucuugcucaggggccugcacucuccaacugugacaaugucuccgaucuauacaucccugaaacagggggacaggugcacugacauguucuugugacgcuucucaaagcgauuguacuuucggauguaauggagauaguccccgcggaugacaaagguccucugcaucuucaucuucgucacgacaccagacaggaucggaccucggauggagacauuaccauugaaggggcauuucuugucucuguagguacccucgauggccucuuugggcgucuugaagccuagaccgauguucuuguaguaccgagggaguuuuuccuugccgguuucucccagcagaacccgcuuauuguuuugaaagaucauaggcugcuuuugguaagcacgcucagucugaauguccgccaucuucccggccgccggagaaagggagagcuaau

SEQ ID NO: 1432 - RNA, 99366 nt, Mus musculus
cgggacuuccgcuugcccgcuguuguggucccuucuccgacuugcuuggguaggggcucagugcggauacucagucaugaaguccggguagcgacuucucuuggguggccgugagccuagguuccgggggcggacuucagguaagaaccagcguggcuccgcagcgguaggcggggguugucgggccuggccgggagaacacacccacuccggccugggugcgguagcccgagguggggacggucgggcuccucugcuacgugcagugacagcacaggcccgugcgggagaggaguccuuagcaucccauccugcgggcugguagaucugaaguugucgggcuauggauuuugcuucccacggccccuuccagagguccccguggccuggaaagauacuuggaagacuucucuaguccaggacuugccucuuaaguccucggcgaaaauacucucgggcuguuuugucuuuaaaaagaagaagaagaaaaucucaucgcuugcuuccuuccuuuucucacccacuccccuuuccuuccguaaaagcucagcucacaggcuuggacgugaccuugcuagggccacauacugccuuuuuuuuuuuuuuuccuacccaauguuggaaguccgaacuuuuuugcaaggacgcuuauugaauugaucugccccugagagggaaacaacuuugcugcauguucucugcuugcuuauggucaauugcccuauuuucuucuaaucuggcaguaguuaauuuccauaacucccauuuuaaucuucaauuucagcaccgugggcagcugcuauaggcugaugucugccccaaaccugccuggauuauacuguuuucuaccagugaugcagcaguuccaguggaaacugcguuccuuucagcagugcccagaagacagcugcacuuucugauacaauacaguaaaguggccgugccucccaagagccaguagagacaggcuauuuaaagauuuagggaagaacuuuugagaguuuaauuggccacagggucauuguuuauuuauuugagacaugguccuuacauguagcccagucugaucucagacuuccauucuuuugccucagcuuacucaguacuggaauuacuagccaucaagccuuguuuaaagacaguuuuuaaugggucaaaaagaauucauuucagaggacuguggucuuuaaauaggaguugaguguggagggccacagggauucauuaauagacuuuuuucuucuuuuuauaaucuauggccauagaguuaauuucagguauaguuuuuuuuuuguuuuuguuuuuguuuuuaugcgggucaagaggaagauauaaaguguaauauuguagaaucaggcaaaaagcaaagcaaagcaaaacaaaaaacuguuuccaaagaguuucaaauuugggaaucagacuagacuuacccuccaguguugggugacaucaguaaauauggaaagggcuagugagauguuuggugaguaguagagcuggcccugcaguucuaauggucuggauuagauuuccagaacccacauagaggaagaaggggagaacugacuccacaaagcuguccucggcucuccacaugaaccuugugguauaugucuuaccucccaagucauacacacacaauaagugagaaaguuaaaaaaaaugaaaaaagggugaaguugugaagauuaaaugaaauaaaauaugucuguaucauaguuaugcuuccuugaauugauuauauagacuauagucuuuguauagggaaaguuaguugucuuagucauauguguauguuuuccucugccuuaccugaagucaaaauggugucucgaugugcaguggaaguaaugugaauaaaguccgugcuuagggaaauggaauaugggaagguuuggggcuaacuacucauuuauccuuguuauuucuguaaggauuuuagaggagccuagcuucuugcuagcuugcagcuuacuuccuuugauguuucugcaucugaggcuaacagaguuuauaucagcuuuugggcacuaaguucagcaaagugaggguagaguagguguuugccucuugggguagguuuauagaguugagcaagauacuuuauguuuuguaguuuuuauuaagacuguguauuaacuggcuugauaaaaucauaugacauacuuaugucauguuaguauuaacuaaaaguaguuggcuuuuaaaauaaaacauggcuuuuaaaauaaaacaugacuuuggacauuuugaaguuaggaacuaauaauguauagcugaaagcaaaaugaguaagccaaaguagugauuuccacuguuugacuuguggaugcucacagucagcuauuggauggaucacagggcucccaaaggaggagcuagagaaaguacccaaggagcuaaagggaucugcaacccuauagguggaacaacauuaugaacuaaccaguaccccggagcucuuaacucuagcugcauauguaucaaaagauggccuagucggccaucacuggaaagagaggcccauuggacacgcaaacuguauaugccccaguacaggggaacgccagggccaaaaaaaugggaauggguggguagggaaguugggggaggguauaggggacuuuugggauagcauuggaaauguaauugaggaaaauauguaauaaaaaauauuuaaaaaaaugaguaagccaaaguagugauuuccauuguuugacuuguuauuaguguaucuucgugcugcauacugugguuuccuguggcaucaaaaagggaaggcaguuagaaaccacugcuagguuucucagaagaaacaggguuaauagacauaugaauucacuuuaauaaaacacguuggugaauaaugguucuaaaaucauauauucuguagauaauuauugaacaaauaaaacagagaacuaagguuuuuaugaagauguugcacugcacaaaaauugauuagagaagaaugaaaguaugugauugcuuuugucaaaauuuauaugucauaguauacaaauaacaaaacauaauggcuaauuuuauuaucuaugggucaaauagguuucugauuacuuuguaugaucacauucaauucucaaauucauuaauauggcagguaauaguacaguuaugacuuaaaauuuauuuuuuuuuuuuugaagguucacuuuuuuuuuuauuuuuuuuuuuuuauuuuuuuuuuuauuuuuauuuuuuuaaagauuuauuuauuuauuacauguaaguacacuguagcugucuucagacacaccagaagagggcgucagaucucguuacagaugguugugagccaccaugugguugcugggauuugaacuuuggaccuucggaagagcagucgggugcucuuacccacugagccaucucaccagcccaaaauuuauuuuuuuguauguguauacacauauacucacagugcauauguugaggacagcuugugggaguugcuucucuccuaugaugugggauauagggaucaaacucaagucuucauguuugguagugaaugucuuuacccucugagccaucuuacuggccagauagauuuuuaacagaaaauuauuuuuauuauuauuauuauuaggugggggaacucucauuauguagacguggcuugccaucugacuagcaacaaaccagaguaagagacucugucucaaggaaauaaagugucgacuuguagacuaauaaaggguacccuaugucucucuuuggccuuuucaaguauaugcacgugugaguauacaugcauauauuacacauaucauaaggccucccucucccccauaagauacuaucagguauuuugaauuuuuauuggcuguugacuuugggaaguuugcuuauuucuuuacauugaggauguggcuauuugcaugauuguuaguaaauggcggagguugggagacaacagucccuaccaggauguggucagagcaaaagucuagaggaagggaagucagagaacauuugccaagguuguauauuuaaggaacaggcugaugaagauaaaugguacugacuguggaguuccuuaaaugccagguuaagaauuuugcaugugauuuuuaguugagacaaaucccucauuuaugaacauuaguuugggaucagagguccaguagagaaguagaagccuggaggugcgaguuccauagaauggagacaaaugucaacauuuuaaugaagacuaggcuugaaacagcuaaaauagcauugguaauucacauggcuggggacaagucaguucugauaauguaaauaagggauauugcuaugaacaaauguuaguguacugauauuuaggaagaaacugaaugguggaacuugagaagguauucaguguguguaaagcuaaaauggauacccuuagcuuuaucuucugugaacagaggagugacacgcugcucacaccauuggucauugguuagaacugccacucccauuugggucacugcacugacucaacuccugauuuccucaggacugagcauuccccguggagugagaaugcacugauuguuuucccuguauccuauuuuguguuuggggauggggaguggggcaacaggagggaaaagagugggaaggaaaaguuguguaaacauacaaggcuccucccauuucuuaagaacaguaaauuggagacuagagauucucacaucaagaaugcugaaagauguauugacuuuuguuuucugaaaggcgguuaaacacguagguguucagcgacauuucuacauuaaauauuauaucuuuguuaacuugaauugauuauggcaaaaccuuuguucagagaugggaugagacuuugggggaugucaaagagggugcacagcuggaaagagugugcuguuuguaccuaagauugcacggaaagaacuucaaaggguaagaaggcuaccugggauagugggcagaaugaagaucugauggcauccuauugcuuuccauuuucggcuucaguuuucccuuucugugaaaugaugauggcaacaguauugauuuggaguuguuuugaaaauuaguuaauguaugaaaacugguagucaguuagagagauguuugugcugucauuauaaccuuagcuaaugggacuugugggaagacagaaggaucaaucucuaaaggccucuuuaccaucaaaaagaucucaggacuaaguuauagguggaccuauagauuucuuucuuuagcagauuuucuagggcuuaugugcaauugcuugauuuucaguucugcagugaaguuugccacugaauuauauuuaguuuucuacugucauguuaggccugaguaacuggccagucaaacaaaaaugugcuuauuggugagcauggugagagagcagaagguuuccauguguguuaucucaauagaagacaguacugaauucugcugcuugcauuucuuuucuucuuuauuuccccccagaauuuuucacuuaacaaauauuuacuuaguaccugcuuuguccuguaaugcucuaggcacuaagugaucaucacuuaacugaagggacagaaacccugguccuuccaaagcugucuuuuugugggagaaauggguaccuuuuuaauaaugguaauuagauaguuuuguacugcauguucaaauuauacugcauagauaauaacaaugccaggccccaguugguagaguagaagacuuugaaggagggauccuuauguuucucuuuucucccccucccuguacaguggcuuacccuuugaacagugccaaauguaaugcauauguugaaugcuaagucguccugucuccaaauuuacuuuuuuaaaaaucuccucuuagacaaaacacuuaaagucagaaagcucuuaauguacagcaaauguaggugugcauuaaaagcuuauaguaggcaggaagaggcugugccaaggcggggaccauguuuggaaggaaauuuguacugcaguaagaguuaaggaccauguguucauuagaugaacagagagagggguaugugugaauaguauuucuugcugauguaggagaccaguggaaauaagguuauuggagacaaaaacaucaacuuuaagggaauuugggucuuauuguucacuaacaauaacaauuucuuaucucaaguuaauuuucucauuggugaugcaauuggaauuuuucaguguaaagaucagcuuuugagaugucuuacaaaaauguugcauuaauauuuugcuuuaguagcauagauaaaauagagcugauuauaaacuuuuauuaaauacaaaacaagcuagauaacugcuuuugguuaacaaaauaguuugaagacuagauuucuacaaaauuaauaucaugcuuugaugcuauuuacuaauguaccuuuuaaaaacacaguaaaauguaguuacuauguaauugccagcucuuucauacagaggaagaugagcuguaguacuuuaguacucagucauaguaauuauucacccuuuuauguuuuauguuuauucaauggucacuugcaucauuuccucauaugagaugcuagacauguagaaucagaacaugucaguccguaauuugaagaaguguaaagaaaagggguccuuagcgugaugagguucgucuggcuagcucguggugggacacaccaagggcagcaugaaaggcuggggaggacagaguuccuggauggagaggagaggcaagcauggggacagcaaaggacuguucuccuuaacgggaggacaaguggauguggcgccccugugcugaaucccaagcuaguuaauugggauugacugucuuuugacgcccgugugaucugcuaaggaauuuuacacagaaaguaauaugaucaggcacuuugcuuuuccccccaggauauauuaauuauauauaauaguaguuucacuauuauauuucauuccgguuuauuaaguguuucgcgcauauucauuuacuauuauucucuugcuccccucccacucuuacuuguugagauaguuuuauauguaauuuugccaccuucuuacaaugugagacuagaagaagacauuaaugcuguuucaaugaugaucauagaacuuuaagaaaucagucuuuuaacugcaaagucuaagaaacaugguuaaugucauguauauuuuauuuauuuauuugggugcugauaaucaugaaacauuacauauuaaaauauguaaauauauagcuauauuuguguuaucaaaaaaaaggaaauuuugggauaauuuuguucacuaauauaaugaggacuuuugacuggguaaaagaauuugaucuagaaaaauuucuagggaaguuagaaauguguugauguuuuguuacuuaaauguuguuuaaguucaguguauauuuacuuaaaguuuguagaaggagugaauuccaccgggaaagaauuuuauugagguaaugagagaugaauauuucuuaaugaagcacuaagagaaagcaaauauugaaccucagcuuuucuuacauaacacaccucauuaauguuaaagauuaucugguuacuguucuuguaauuuccauguuugaccuuuagaaagaaagcacuauauacuaauaaauuauaaaugcuaauugauuuuuuugaaaaaugauauucaccuagcaaaauuaaccuuuuaggaauugggaagguggcuuagugaauaagagcauuugcccuggaacauuuggaccugaguccaaauuuguagcauccauguagagagcugagcaaggcugugaauaccuaguggagacugcgagcuugcuggcuggccauucuaguugaagaggcaaacucuuaguucagugagagagucauagggugauagaugaacacauuccauauccucggcuggcauccacaaaugugugcccauguuacauaccagcacuaaaaugcauguaccacacagguacaaccugcccccccccccccaagccauauaccaaaaagaucuaaccauuuaaagcauagccacccaggggcauuguguauauuuuuaauguugcucaucaacacauuuguuuagcuuugaaacauuuuuaccacuucaaaauaaaaaucauaaaccauuagcaguccugucuccugauuuccuaauguccuuagccauaccgaccucgaauuguuuucuuucuauguauuuacuuauuuuggguaauuuauauggaaucaaauguuauaugauuaauuaugccuggcuuccuuuacuuagugacucuguaaucacauguaccagcaucuuuuacugcuguauaauuuuccuuuacagacaaaaccaauuuauuuagucauuggugaauauuuggauuguuucaacucuuuaccugcuguguuuaguguuucuguuaaaugaggguuuguuugaguccuaguuuuccuuucuuuagguuuaucucaagagugaaauugcuuaugguaagcccgugucuagguuuuugagcacuuacuuugcucuuuuccauauugucuaaaacauucuuauauuuacuuuggcaauguguguugcuaauuucuucauauucuuguagcauuucauauuucuuuuuuguuuguucacuuuucuguuucuuuuaaaccuucuuugauacguguaugucugugguuuaugccugcuuugauauguguaugucugguuuaugccugcacauguguguguguauacauguaagaaugagugugugugaugccgggucccuuccuuaguuucuuucuacaucagcuuuugagacagucucucacuaacauguagcuugcugguucagccagcaaaguuggacagagaguaagcuccacgucucagcacugggugauagauguguagcaccaugaucaaccuuccaaguguuggcucucugaacuuagagccucauauuuguguggcaagcgcuuuaucuacugaucuuucuucaguguccuguuuucuaucaaucaaucaaucaaucaaucaaucagucaggcagacugucuguuugucugucuaucuauaguuaccuuuaugaguaugcaguaguaacuacuugcauuuuguuuuguuuuuugaaacaaggacucauuaggccuagaacuaguuguguagaccagguuggccuugaacuaguagagaucugucagcuacccaaggguuggaauuaaagguaugugccacugugcccacccuucuccuguuuuguguugaucugacaugaaugaacuagaacauccuuucauauacuugcuugccaugugcauauuuucuugaaguauuauguuaguucuuugucuuuuacaauuuguccuuuugauauugaguuuucuaaaaagugguuuauagggcugaacagugguggcauacaucugucauccuaguacccuggaggcagaggcagguggaucucugagaucaagaccagcuuggucuacaaagugaguuccaggacauccagggcuauacagaaacccugucucaaaaaaccaaaccaaaccaaaccaaaccaagccaaaccaagcuaaaccaacccaacccauaagcucaaacaaacaaacaaacaaacagaaaauccaaaaugauuuauuuuguuuuuauuuuuguguaucuguauguacauguugcuugugugggugcccuuggaggcuagacgaggguguuagauccuuuugaacuggaguuacagguuguguugagcagucugagcuggaugcucuaaaccuggaacugaacuuagagccucauauuuguguggcaagcgcuuuaucuacugaucuuucuucaguguccuguugcuccugaaagagcaacaaauagucuuaaugauugagcuaucugcccagcuccuuucuguacuuuggauaugagaucuuuaucacauauaugauguacaaauuuucuuuuguccauuuguguggggccucuaucuuaauaauguucuucgacacauaaaaguuuucaauuuugaggaaauccgaucuauaucuuuuuacucuugcuuuuggugcuguuucuaagaagucguugcuaacauggaagcuucuuacgucucucuaucuuucucugucucugucucucuguaucucucccuuccucucuccuucccuucuaccgucccucccccacccccuggccccccagagucucagcauauaguccuaguuggcuuggagcuugcuguguagaccagacuggccuagaacucaagagaguucaccugccucugccuccuaacuucugagacuauaguugucccaugguaccuggccuuuuuuuuuuuuuuuuuccuuuugaaaucaaauuuaaauaugcagcauaagcuauaugaauuugggauguuuucuacauccuccugagugcugaaauuuacaggugugcacugcccuaucugcucugaaccugcacuucccgaguuuucucuuauguucuguuguuguuuugguguggugucaguuuaggucagagguucagugucuuguauguggagauccuuuugugccaguccuccuagcugaagaugguauucucugggcucugcaucuuuuaaacaggcuguuugccucucuguagguccaugggcauagaugcagaugcgaggcucugcugcuuuacucuguguacccgcuugcagaagcaccauucaguugugauuauuguagcucggugcaaaggaaaucuugacauccagaaaacagaggggcuagaaaaaaagauacuaucccaaggcacacuuuacuaaccugcuucucaccaagcuccuccuccuccaauuuccaucaccaucaauauggcagcgccagcugugaccaaccuuugacaaggcagaguacccaucaugccaucacagggagcggccaagcuggcugccacagcaccacaccuuccacacaugagccugcaagggacauuucuuacucaaauucacauuuugucccuggcucccccacauccacauguccaucucauaguacaaacuacauuuagucagcaccaggagucucuauacuguucuauagucugacucauacucugagccucaagccaggcuuuuaguugugaaccccacgauaguacaacagaaaucucucccuuaagcaaggcuuucagacgaaucccuuuuacuugaugauccugugauagauggcaguauugccaaaccugaguugccuucaugugauguuauuguucugcuaucuauguucagcuucuugaugcuugggaucauacuuuguugaccucacuguuacaggucaacaauacuucauuacaccaucaucuuuaucuugaucuuuuuuuuuuuuaagacaaagucuauuuauuacauagcccuggcuaucuuggaacucccuauguagaccaggguggccuugaacucacagagaucaaccugccucugucuucugaguucugggauuaaaggcagcaccaucauguugggccauaaaucuuuauuauuuaauugcacaauuuacuucacaagaaauaauuuuauccccuccaaauacugacuagacuagugaacuacaagcuuuguugcuugcucauuuaaaauguuuucuauauuguaugaagauacuauacaaauagaacccuuaaauaggugguuggggcaggcuuauuagaguuuguauguaguuuagucucuagaauaugccauauaaauuaauaugcuuuagacauuuuuuacuuugagcuauggaaauagguaugaagaauaaaccaaaaaugauaaaaggacccaccaccuagaguuaagauguauuugcagauuauuuuauuguuucauaauauuuaagaauuauuuuauauguaugugugugugacagaguguacauauguaccacauugugcaggugccuucagaggacagaagagggaagcugaagaggguugugagccaccugacaaggaugcuggaguccaaaccuggguccucugcacaaucaacaacugcuuuuaacugcugagccaucucuucagcccccauaguauccaauguaugcauacuuauguauauuuuuaauauaugcacagacauuuuucacuuaaaaauauuuuugagacaguaccucacuguugccuauguuggucuugaauuccauugaguagcugggacuacuguucaaaacaccacaccugccuccaauggaaacauauaaaagcaggauuuguuuuugguggugcgggggauucagugcuucuuugaggcagguaggcaggugcuuuccuacuaagccuggaauaagacaguuuuaauguaaacgucuuaaaacuuuacaaaaagcaguuagcagguaguagcauauagagguuucauuaaaugagcguaaagagaagugggaugugcauuuguuuuuguaacuguuaagcaccuaauuuuuguuaggcacuguuuacauauuuguaaaauaaauauguccuuaagaaguacauauucuuucagcaaauaaguacacuaaacaauaaaaauaagaauuaaaaauuaugauuggaagcaaugaguauuuaagaagcaggagauuaaaggggugcaucacggucgauauguaaagugacuguaaacacuugccagggcaaggcuggcauccaaaaacaaggucaagagcauagcugggggaacacuguaaagcagcagguuuuagggcuagggcagggguccgcuacuuagaacacucuuagaguuugguucucagcacccacauccugaggcugguaccuuccuguaacuccagcugcaugggaaucugaugccuuuggccucuggacaccugcacucaugugcaccucuccccacauacauguaauuaaaguucauuuuaaggaagaaacagguugaaacaaugacaaugauauaacuugaucaggagugugacagucugccaccauuaacacaguaugaaagaguucguguaauauuauuguuucccaucuaaggacugcacaaacaguaaagaaugagggaugaaggugggguuacaagugagcuaauuaguccauuuuucagucaguugauauuagugcuuauagggaagugcccuaaaauagggaagcugagugagaguacaaucuacuuucuccuaugugcuaauuuaaagguugcauagagggaaaaccuucaugucagauccuuaauacagaacuuagcauaaaaucaaguuuucuuucaaugucauagugguagcauugacauuugggugaaaagucauaaaaauaaaacauucugaauuaggagauggauacuuugaaguacacuguguauauuuugauaacccagaaaaccagaauuuucuacuauguuucccuagugcucaagauuucaguguccaugaaaacauuucauugucaauuguuccuuucaaguuuucuguguggcucauugcugggguugacaaccugcgauacagcugacaauaguggcauugagagaacuaugaagucuguuuuuguuagcaucucugccccuacauuuuugucuugucgacuuugaccuauacauugucuuuugauuuguaagaagguuaugaacaaucacauggaauacacuuuuaaaucuggaucaaaaaaguguuuuccaaauauguguuggacucauaacuuauauuguuauuuaauauaaaaaaauuaaaaaaguguucaaggacuaaacauagaaguaauauaagaaagaaaucagggaaaagguuugcauuacuggauuucuuacauaggacacugaaagcgcagauaagaaaauaaaacguaggugcguuggaguccaugaaaauuaaaaguccuuguacauuaaaugacuuuucuacuucuuuuuuuuuugguuuuauuuuuuucuuaauuuuuuuauuauuuaaaugcauuuuauaaucaaacauuaauaguacugaguauuuuaaagaaucaaauaauacauaaaaauuguucaacuuuuauauucauauccuuucauacccuaaaaauaucauuagggaauaauugaggauccuauaucuaauguuguauauuaaauuguuucaaaacauacaaaauauucuuugggaguuaagcauaguaaaacagcaucaaauauuaaaaaugaaucauuaauauauucaaaaucucuuauaugauaccaccugacauagugagagaguauuuaaaacacauuauauaucuguguaccuugucuaacaaucaguuuacuuaaaaaagauuaucaguguuucuaggagagaaauuauuuuaucaguaaguauauuuuauaaauuucaaaauagcaaaaacucucugaaguuaaacauuaagaaaaugcucauuucaagcacagugagaaaaaucaguaauauuuucaugauguuuguagaacaugauuuuaauauuuucaacuguuaauauucaacaaacagaauaauuauuuuguuauauuuuguuguucugucacccuuuucauuucugauuuuauuaauuaggauacugucucuggguccucugguugguguggcuaaagguuuaucuaucuuguugauuuuucucaaagaaccagcuccugguguugcugauucuuuguauuuccugcuuuuuguucuagagcuuucaggugugcugucaaacugcuaguguaagcucucuucaguuuccuuuuggaggcgcuuagagcuaugaguuuuccucuuaccacugcuuucaucguguccuauaaguuuugguaugaugugucuucauuuucauuaaauucuaaaaagccuuuaauuucuuucuuuauuucuuccuugaucauauuaucauugagcagaacauuguucaguuuccaugugugugugcauuuucuguuguuuuuguugguauuuaagaccagccuuagucuguggugguuugauaaggugcauggaauuauuucaaacuucuuguaucuguuaaggccugauuuguggccaauuauauggucaguuuuggagaagauaccgugaggugcugagaagaaaguauauucuuuugcuuuaggaugaaauguucuauaaauaucuguuagauccacuugguucauaacuucuguuagguucacuguuuaguuucucuguuucauuucuguuuccaugaucuguccauugcugugaguaggguguugaagucucccacuacuauuguguggggugcgaugugugcuuugagcuauaguaaaguuucuuuuauaaaugugggugcccuugaauuuggagcacagauguucagaauugggaguucaucuugguagauuuuccuuuugaccaguaugaaguguccucccuuaucuuuuugauaacuuuuuguugaaaauugauucuauucaauauuagaauggcuacuccagcuuguuucuugggacuauuugcuuggaaaauuguuuuccaaccuuuuauucugagguagugucuaccuuugucacugagguguguuuccuguauacagcaaaaugcuggguccuguuuauguaaccagucuguuagucugugucuuuugggggggggggggauugaguccauugauguuaagggaaauuaaggaagagugacucuugcuucuuguuauuuuuguuguuagaggugaaaucauguuuguguggcuaucuucuuuagguuuguugaaagauuacuuucuugcuucuucuaggguguaguuucccuccauguauugguguuuuccauuuguuauccuuccuaggacuagauuuauggaaagauacuguguaaauuugguuuugucauggaauaucuugguuucuccaucuauggucauugagaauuuugcuggguauaguagucugggcuggcauuuguguucucuuagggucuguaugagauuugccuaguaucuucuagcuuucauagucucuggugagaaaucugguguaauucugauaggucugccuuuauauguuacuugaccuuuuucccuugcugcuuuuaauauucuuucuuuuuguuuaaugcauuugguguuuugaguauuaugugacaggagaauuucuuuucugguccagccuauuuguauguuucuuguauguucaugggcaucucuuucuuuagguuagggaaguuuuuuucuauaguuuuguugaagauauuuacucccccuuuaaguugggaaucuucccucucuucuaucuauuaucguuagguuuggucuucucauugugugcuggauuuccuggauguuuuggguuaggugcuuuugucuuuuuuuuuuuuucuuuuuuucuuuuuuuuuaagauaucuucuucauuuacauuucaaaugcuaucccaaauguccccuauacccuccccugcccugcaccccuacccacccacucccacuucuuggcccuggcauuccccuguacuggggcauauaaaguuugcuagaccaaggggccugucuucccaaugauggccgaccaggccaucuucuacuacauaugcagcuagagacaugagcucuggggguacugauuaguucauauuguuguuccaccuauaggguugcagaccccuucagcucuuggguacuuucucuagcuccuacauuggggggcucuguguuccauccuauagaugacugugagcauccacuucuguauuugccaggcacuggcaaagccucacaggagacagcuauaucaggguccuuucagcaaaaucuugcuggcguaugcaauagugucuguguuugguggcugauuaugggauggacucucggguggggcagucucuggaugguccauccuuuuaucuuaucuccaaacuuugucucugcaacuccuuccauugauauuuuauuuccuauucuagggaacuuuuugcauuuucuuugacugcugugucaauguuuccuaugguaucuucugcaccugagauucuugcuuauaucuccuguauucuguucaugacacuugcaucuaugacuccugaucucuuuccuagguuuucuaacuccacaguugucuccuuuugugauuucuuuauuguuucuauuuccaauuuuagaucuuggaugauuuuguucauuuccuucaccucuuugauugcguuuuucugaaauucuuuaagggauuuuuguguuuccucuuuaagggcuucuaguuguuuaccuguguucuccuguauuucuuuaagguaguuauuuaugaucuucuuaaaguccucuaucaccaucaugagaagugauuuuagauccaaaucuugcuuuuccagugugauggucuaucuaggacuugcuauggugggagaauuggguucugaugaugccacguaaccuugguuucguugcuuauguucuugugcuugccuccugccaucugauuaucucuagugcuaccuacccuugauaucucuuacuggggccuguccuuccugugauucugguugugucagaacuccucagaguucagcugccucuaugauccugugauacugagauccugggagugucaaagcuucucagagucaagcugcuucugggacccagagauccuggugugaccaagcccuugggauccuggggaccucugauccuguggguccugggcauguuagagcaucugggaguggaucuuccucuggguguugugggacuggcugcagaguuugcacccaaggucugcucagggcaccggcucagaccagaaggaaccugugccacugguugugcgaaguuccuggguaccugggucccauugaucccaguuacuccugguguuggagcagauguguccucuucaccucugaucccaugauccugggaguguuagagcgcuugggaguggagcuuccucugguguugugggacuggcucugaucaacuuuucuacuuuuuccaugugaaaacauaauguaccacaugggaggaaacauauuuuucagucauauccaaggcaagguuuaauauucaaagugugucugaacccuuauagcucaacaacaacaaaacaguuugauuaaaagugagaugaguggauauuuuuccagagaagaugaucagauagauacaaaguacaagaaguggugucacuauuucuaauuaguagagaaugcaaauuagaacccacguucuguccucuuuguguuggcuguguuaaaaguagcaaguaauagguauugauaauaauggggagacauaggaacccuuguucauuacuggugggacucauguauuccagugugugagaaaaaaugguucaauacucaaaaaaaucagagguaacuugugauccugaaguucuacugcuggcauauccccaguagauuuuagagcaccgagucgagagacugaacagagaaagagaacagugugaccucagcacaugauugcauugcauuaguagcaugcacagcaaagggcagccucccucccaggggaguggaggggucugcagagggaaacagcuggcugggacccuuugcggggucggggagggacuuugaaaugaggggccugaugcagcugugggagcucugugcuacucuguggucuguccuuucuggaauugcuugcuucaggaaggacaggcgauggugggagacaugcugucucagcaaacauucugucugggcuaaccaguaacuggugaacaaagccagcuguaaucuucauaggaauucuguuuuuauaaccaagggagucuaucauaccccauccccaaaaaaacuggaagaaggaacacaaaugaauguuuuuugacaagucaagaaguggaagcaauuuaauauuuauugauggaugaguacguaaauauauguagcauguauaagccacaggauaccauucagccagacaaggaagcagauuugaggcuucuacagcacagagcaacguuuaggacaggcuagugaacugagcacucacaaaagacaugcugaacaauuccucuuauauguuacccuaaacuaagacaagaaguagaauaaaguguagcuaaggacuacagguuucauuuuguuaggauaaaaagauucuagaaagcauaguggugauuacugcuugacaguaaaaauauaguuaguuacuaaagucuguuuaaaaugauaaguuuuauauauugcauaccacaucaaaaugagacuugauggccugcugggagaccuguaucacccacuagugaguucacuauagauguucuuucacugagacucuucacuuuuuuguuuugucaaauagacaguuaaagcuaaccaucauagcuacacuauccuugaugccucugaacugucuuuuuauuguugguuugaugaaacuguguuguagucacuauuucucauuauuuuuaaauauuuuauucucuuuauuuaaaauuaaaaaguuuuuugagauaacaucuugauauauauauagauagauauauguguauaucuaucuauauauauaucauccuugagauauaucuuguagcaaucuuccugccuuugacuccuuagugcuggauuauagccaugagcauuaugcucggaugauuucuuuauuuuuaacaaccuugugcugcuuccucauucugucaccuuguacugcauuuguuuaauuuucuacuaaauuuuauagaaauuaugacuuuuaaagaagacaugcaccuugucauaucuucuaacacaucuaucuaucuaucuaucuaucuaucuaucuaucuaucuaucuaucuaucuaucacauuucaucuaauucccauaagguuuugaagccuggcaaauacagaaguggaugcucacagucagcuauuggauggaacacagggcccccaauggaggagcuagagaaaguacccaaggagcuaaagggaacugcacccuuauagguggaacaacaauaugaacuaaccaguacccccagggcuugugucucuagcugcauauguagcagaagauggccuagucgaccaucauuaggaagagaggcccauuggacuugcaaacuuuauaugccccaguacaggggaaugccagggccaagaaaugggaguugguggguaggggaguggggguuggggaggguauaggggacauuugggauagcauuugaaauguaaaugaaguaaauaccuaauaaaaaaauuggaggaaaaaagaaagaaagaagauuguagauuagaaucaagauuuuuauuuuuuuuuaauuagguauuuuccucguuuacauuuccaaugcuaucccaaaagucccccauacccucccccccaauccccuacccacccacucccccuuuuuggcccuggcguuccccuguacuggggcauauaaaguuugcaaguccaaagggccucucuuuccagugauggcugacuaggccaucuuuugauacauaugcagcuagagacaagagcuucaggguacugguuaguucauauuguuguuccacauauaggguugcaguucccuucagcuccuuggguacuuucucuagcuccuccauugggggcugugugacccauccaauagcuuucugugagcauccacuuuuguguuugcuaggcccuggcauagucucacaagagacagcuauaucuggguccuuacagcaaaaucuugcuaguguaugcaauggugucagcguuuggaagcugauuaugggauggauuccuggauauggcaaucacuagaugguccauccuuucaucaaagcuccaaauuuugucucuguaaguccuuucauggguguuuuguucccauuucuaggaaggggcaaaguguucacacuuuggucuucguucuucucgaguuucaugcguuuagcaaauuguaucuuauaucuuguguauccuaaguuucugggcuaauauccacuuaucagugaguacauauugugcgaguuccuuugugauuggguuaccucacucaggauaugcccuccagguccauccauuugccuaggaauuucauaaauucauucuuuuuaauagcugaguaguacuucauuguguaaauguaccacauuuucuguauccauuccucuguugaggggcaucuggguucuuuccagcuucugguuauuauaaauaaggcugcuaugaacauaguggagcauguguccuucuuaccgguuggaacaucuucuggauauauacccaggggagguauugcggauccuccaguaguacuauguccaauuuucugaggaacugccagacugauuuccagagugguuguacaagccugcaaucccaccaacaauggaggaguguuccucuuucuccacauccacgccagcaucugcuaucaccugaauuuuugaucuuagccauucugacuggugugagauggaaucucaggguuguuuugauuugcauuucccugaugauuaaggauguugaacauuuuuucaggugcuucucugccauucgguauuccucaggugagaauucuuuguucagcucugagccccauuuuuuaaugggguuauuugauuuucuggagcccaccuucuugaguucuuuauauguauuggauauuacuccccuauccaauuugggauagguaaagauccuuuccuaaucuguugguggucuuuuugucuuauugaccgugucuuuugucuugcagaagcuuuucaauuuuaugagguuccauuuaaugauucucgaucuuacaacacaagccauugcuguucuauucaggaauuuuuccccuguacccauaucuucgaggcuuuucccuacuugcuccucuauaaguuuccgugucucugauuuuauguggaguuccuuaauccacuuagauuugaccuuaguacaaggagauaggaauggaacaauucucauucuucuacaugauaaccuccaguugugccagcaccauuuguugaaaaugcugucuuucuuccacuggaugguuuuagcucccuugucaaagaucaagugaccauagguguguggguucaucucugggucuucaauucuauuccauuggucuacuugucuguuucuauaccaguaccaugccguuuuuaucacaauugcucuguaguaaagcuuuaggucaggcauggugauuccaccagagguucuuuuaucuuugagaagaguuuuugcuauccuagguuuuuuguuauuccagaugaauuugcaaauugcuccuucuaauucguugaagaauugaguuggaauuuugauggggauugcauugaaucuguagauugcuuuuggcaagauagccauuuuuacaauguuaauccugccaauccaugagcauagcaugggagaucuuuccaucuucugagaucuucuuuaauuucuuucuucagagacuugaaguuuuuauuauacagaucuuucacuuccuuaguuagagucacgccaauauauuuuauauuauuugugacuauugagaaggguguuguuucccuaauuucuuucucagccuguuuauucuuuguguagagaaaggccauugacuuguuugaguuuauuuuauauccagcuacuucaccgaagcuguuuaucagguuuaggaguucucugguggaauuucuagggucacuuauauauacuaucauaucaucugcaaaaagugauauuuugacuuccucuuuuccaauuuguauccccuugaucuccuuuuguugucgaauugcucuggcuaggacuuaaaguacaauguugaauagguagggagagaguggacagccuugucuagucccugauuuuagugggauugcuuccagcuucucaccauuuacuuugauguuggcuacugguuugcuguagauugcuuuuaucaugguuagguaugggccuugaauuccugaucuuuccaagacuuuuaucaugaauggguguuggauuuugucaaaugcuuucucugcaucuaaggacaugaucaugugguuuuuguuuuugaguuuguuuauauacuggauuacguugauggauuuccguauauugaaccaucccugcaucccugggaugaaaccugcuuagucaggauggaugauuguuuugauguguucuuggauucgguuagcgagaacuuuauucaggauuuuugcaucgauauucauaagggaaauuggucugaaguucucucucuuuguugggucuuuuugugguuuagguaucagaguaaucuauguggcuucauagaaugaguuggguagaguaccuucuguuucuauuuuguggaauaguuugugaagaacugggauuagaucuucuuugaaggucugauagaacucugcacuaaacccaucugguccugggcuuuuuuugguugggagacuauuaaugacugcuucuauuucuuuaggggauauaggacuguuuagauuauuaaccugaucuugauuuaacuuugguaccugguaucugucuagaaacucguccauuucauccauguucuccaguuuuuuuaaguauagccuuuuguagaaggaucugaugguguuuuggauuucuucaggaucuguuguuaugucucccuuuucauuucugauuuuguuaauuaggaugcuuucccuguguccucuagugagucuggcuaaggguuuaucuaucuuguugauuuuucucaaagaaccagcuccuugauugguugauucuuugaauaguucuucuuguuuccacuugguugauuucaccccugaguuugauuauauacugccuucuacuccucuugggugaauuugcuuccuuuuguucuagagcuuuuagguguguugucaggcugcuaaugugugcucucucuaguuucuuuugggaggcacucagagcuaugaguuuuccucuugaaaugcuuucauugugucccaauaguuuggguauguuguggcuucauuuucauuaaacuccaaaaaguccuuaauuucuuucuuuauagaaucaagauuuuuuuuggaaggauauuuccuagguaagauauaguauaaacuagacagaaaauauaaugagaauuggaaaacuguauuguaccaggaagccgauuucagauaaaaucacuauuaauauuuauuagaauucuuucaaagaagggugaagguuaguuugugauuacaaaugauacugcggacucaaaagcuggcucagugucucagagucugcaugugcuuccaaagggguuuuugucccuaugccuguuuaugugcuuaauuauaguuacggaugugcacauguugaaaaaaccuuuauggcauauaucauuuuaaugugcccuugaauuugauuuguuagauuuuuccauguauggguauauguguuguguguauggguuguuauguguauggguuguuauauguauggguguguuugugaguuuccguguauggguguauguguuauguguauggguguauguguuaaguguauggguuguuaugugcauggguguaguguugcuugugaguuuuccuguggagucuagagguugacauuuaugucuucuucuauuggcugccuuacuuauuugcuuuugugcggcagguguucauugacuggguagucagguugacaagugaggccuagagucugccugucuccccuuuccucacuguuggaauuucagauauguacuaccacaugggcauuauguagcuggcauuauacuccacucuacaggaguguacauacuggaagcacaggauagcaaugacaccauauaugguuauggagaacuuuucuaugauccagauggcgaagcuuucauccucagcacagacuagacuugaauuagacccagccggauccgauguggaaaaucuugguguuugaaaggaacagguucccuuaacaguccccgauuagucuccagguuuccuugaagaucaugaucaguuuuaagaaauauauagcacaggcgagcaaacacuuuuuuuuaaaugucaaguuaguuuuuuucuuccuagacugggguagggacuguggguguaagguggguauugagggguggggccucauuguguugugguucaggcuggucuccaauucuucgcuuaaaccauccuuucacaugagcuuucuaagaagcuggggcuacagacuuguaucauuguaccuugcuuauaaaagguuuuuauagcaaacguagagucauuucacauaaacgcuuuucuccagugaagaauuguauuuaccuggauguugcuuaguaacaugauuggcaauuugcauuuaucuuuacacaguagguuaagugcuaggaggagccaucaaagaauuuaagccuguuaaugguuccuuuuagaaggcuuccugguuaagcaaagcuaauuuaaacuaaaauguaaaaacuuuugugcuuucucaagaauguguuaaucaugaaagucuugguguuaccaugaugaaacaccaugacccaaaacaacuugggaaggagagguguuuuuguuuuuguuuuuguuuuuguuuuuuggcuuauacuuacacaucaccauucaucauuagaaaaagucauggcaggaacucaaacagggcaggauccuggagucaggagcugcugcagaggccacggagggagcugcauccuggccugcuuucuuauagaucccaggaccacagcccgggaauggcaucacccauaaugcgcugagcccucucacauuaaucacuaauuuaaaaaauugucuagaggcuugcccacugcccaaucucauggucuuagggaggcauuaucucaguugagguucccucuucuuagacauuaccuugugccaaagugcuaaaaccaggaaggacaaugaaccuucuuuauguacuuacacauacacaaaguuaaaauuugcaucagauucauagauuuuucuccaaauucuuucuuuucaaugaaacaaccucacagcacuuauugucaccugauaacauacgagucaucaaaauaaggugaaggcgauuauuguuucagaacuacccucucaguauugacuucuuagcucauuggucauuucuacuuugaaaugcugucccuguucagcuugguucaagccaguugucuucuugacuuuguuuuaggagugccuucugcaucaucuaacuugagguucaugugcucaucaguggcagcagucugccggcauacucccuuguucacacagccacacucagcugugucugagaugugguuugcaaacgucucaagaugaggcugauaggcuguacccucgccuucuagacccuuggcccuggacauugcacaccaugguggaacucaggccauaggaaugugcaugccaccucagaaagcaacuuguggagauccaaguuccuuuuuagaagguagaauauuucuuaaugucugaguaacacaccagauauuuaaaaccuaauuucagauauuaaaaccuaauuucagccaaguuauacauuuacauuuuuauuguagcaaaaucagucuaaagcuuacuuaaaacauacaguaaagugauuuuaauauauuuauaaaauuaugcaacuaacaucaaaauguaguuuagaacauuucucuuaucuuuccuuuuccugugagcagucacucuguccucaccugucccucuuuuguucacugacccuucaugucagcuaccagucaacuuuaacacguugucauugcugauacuaacagcuuuguaaaaugguguuccaaaaacuauuuacagguguuuugcuuucagugugugaguuagauugagacuuucagucuguaucauuccccaccaagaacacucaguaccauaccccaccaagagcacucucucaauaucauuaaaggcgauucuuuauaacuuggugguauuuagucaaacaguucauuauaaaaucucuugucuuuguaaacuuuguucucauuuauucauaaaauguauacuauacaauugauugagucuugccaacaaaaaucuuacuguguguaaugauagauuggauaguaacuuagagaucugagugauuugggaggaucagauacuagcuguguuuuuuucuuauuuuuacagugaaggagauggcuuaugaagggaaagauaacagaggacugggaguuugcuuugacuucacuuggguccaagagugcaagggacagaagggauuauuuuuagauagagguagggaaaauaaaguuauagguaauuuuaauauaaaauuauaggagauaaaggcaaaaauugagugucccuuaccaaaagaacuugggauaggaaguguuucaaugcuuuuaaaguguuucuguacacgguugcguguucguaauccaaaaaaaaaaaucacaaaucugaaaugcuacaaaaccugaauucuuuuuugauuucuagaucagagacagucaacaaguuuuuuuuuuuuuuuuuaauuucuuuaauuaaguauaacauacaaaagugucuuccaucauuaaccccaguacuugggaggcagagguacaaggaucacugugcauucaaggccagccugauuuacaaauuaaguuguauaguucaguuauuguugugagacccugccucaaaaaaggguggaaaaaagggaagaaaaacacauaugugggccugguggcacacaccuuuagagauggguagucuucaugaguucaaaggcagccuggcugccuggucuacauagggaaucuaggcuagccagggcacacaaugaggccucccucaaauuacauaauuuauauuuaacaaacauauguguacuuuuauauggaacuaaagaugagauuucuagaagugugagaaaaaaaucaauuuuaaagcaaaguugucuguuuucuuagaauuuaccauauuuugauuguaaucuuguuucuucaaaaauugaauugauaaacaaguugugauguaaccaugcacugugaggaaacacuuguucugugcuuaaaacgaggaacauaggaccacugugaaugugcuaaaaacuaaccguuauccccugcacugucagagugaacauacuugugugcuugcuugccaggcagaggcucuaccacugaacugcaucucuaguccuguguggacucaguguccuagacucugaaagguccggugauuugaaauaccuuuuuuguuuuguuuugcgauuuuuuuuuuuuugagacaaggucucucuuucuguauaacucuugucuuauagcucauuauguagaccuuagcuuguuuugaagucacagggauuagcucugucucugucuccugagugcugggauuaaaggcaugcacuacaaugccuggcuuccaaauauguuuuaauuuuaauauuagcacacuguaauuuuaaaagguuauuuuuauauguuaggaaucaaugugagaaaugacguguucuuuacaauucuucuuuccucgucuccuaggugauucacaagaugcugcucuccauugggaugcucaugcuguccgccacacaggucuacaccaucuugacugugcagcucuuugcauuccuaaaccugcugccuguagaagcagacauuuuagcagugaguacaguguaauguauucaggucugaaaacguccccuaaugcuguaaagaaaaaaaagccacgaaugugcguucuuauuauuuuaauaauuaauuacuuuauuuauuugcaucccaaauguuucccucccuacuggaccuccugugcagaguucuuccucucaucccucuuucucuucagcucugagauggugccuccccccuccccgcaagcucccguaaccucucauccuggggcaucaagucucuacaugaugucaucuuauaauguauuuauaaccaugccaaacaacacaguuuuacuugaaaauuggguaugucuuauucucuuuugguugcuuaauaucaguguauacuucauguacauuaaauaucugauaauggcggauuuuugagacucugugcucauaccuauauccuuguguuuuuauauagaauuuuauugguuucuuuaguacuuauaucauaucuuuuauuuccuuuuucuuugagauaguucuuacuauaauaaucaugacuauccugaaacccacucuguagaccaagcuggccuagaaacccccuuaccucuaccuccugggugcuugagauuauaggaguguaccaccacacuugcuucuccuuuucuuucuuucccucucucccucccucccucccucccucccucccucccucccucccucccucccucccucccucccuucccucccucccucccuccccccuuccccuuccccuuccccuucuuccccuuccuuccccuuccccuucuucuuccccuucuuccccuuccccuucuuccccuuccucuuccccuucuuccccuucuuccccuuccccuuuuuccccuuccccuuccccuuuuuccccuuccccuuccccuuuuccccuuccccuuccccuuccuuucuuccucucucucucucucuuucucucucucuuucuuugucugucuuguauagcaagcaucauguccugaauacagcaacauuaaacauagauguuugauguaguguuacuuuguuaauuucaguggaaugauaccauuuuagauguucccagccugccuuacuuccauuguuuguauuugucagaguguugguuacuugguggucagcaaggugacaucagagaaccacaucccaggaaguggcauggaugcauagucuauguaaugguagucaagagcuuugguaauagaggugcaagcugauuuaaauucuuguucaugugauaagaugaccuuggucaaauuacugaacaucuuaguucacaguuaauugacaauaaaaguggaaguauagguguaucuaggucagugguuuaaaaaccagggcucugcugacagacugccuugguuagacucuugguucuucuaagguaacagaacaagguuuuuuuuuuuuuuuuguuuuuuuguuuuuuuguuuuuuuuuaauuuuguaauuauauuuauauacagaaaacuuaguguacauuuaacccaauuuaguggcaaguucuuuagccuuugcuuuuuccagcuuggaaaugcgagccacagacuuaggacccagggaguugccuccccaguggcgacagaucucgucauaucugucauuauaauugguccuaauagcuuccacccgcuuagccagagcacccuugucuuaaccugugugaaggcaacaguggugcaugucuuccuguggaccaggcgccccagccuggccuuucccuugaugaugcaguaggguacccccaucuuucgacacagggcagguaggaaaaccaccagcucaguggggucuacaccaugggcaaucaccaccaacugagccuucuuguucuccaccaagguggugacuguauugacuccugcucagaggacagguggccucuuaguugggacgucgccuuugccagcagcuuucuucucagcacgagccaguagccucugcuucuucucuuucuuugucucuggccuguacuugugggcaagcuuaagcagcugaguagcugucugccuguccagcgccugggugaacugguuaauggcaggagggacuuugagccgcuuguagaggauggcucuuugccgcugcagccugauguaguggggccauuugacgaagcgcguuaaaucucuuuugggcuggauguccuguccaaugccgaaguucuugggccucucucgaacagaggguugaccaccuucuuggccuccugcuucuugacgacggcgggggccggggccaccuucuuccccuggccuucuucccuuugggcaucuugcucggcuacuggagagagaaagaagagggaauugugggggaauaaguaagcgguugcagauaucgaacaaguucuuuuuaguguucuauguucuguauguaaaaugagggugauaguaauaguguuuacauuacagggcaguacguuaaugaguaccucuauucuugcucugaaggguuuuacagguacuguuuaagcuagagguuuuuauuuccaaaaauucacccuuaaaagcaaaucuaguaauaagugauugaagaacacuuauuuguagauuguuccauuuucuaauuuucaaaguacagauuuuaaagugccacuuucacgcacuugcacuuucuaugcugaucuaaaucaauuuauucauuuuacauggguguuuugggaaggguuaaugaccucagguuuaauacagaacugaucaugguugaauaauuaaaguaacaauacuuuaggagauuaaguguaaauugcguuaguguuuggaagccucaugacuaaagaacuuuauaaaucacucuggaaauaugaauugcuguugcaauagaaagucaguguagagcaguucccauguguaucugguggccccagguaugauuuugggccggguacccaagucaacagaaugaaugauuauagaugcuucgugaaaagcaaagggaaaagcuggguguauuaaaacaugcagagcugcaucaccuaguccugugcugucgacuguguuagccugagcucuguuuacugagucagcucucacuguugacagugacaugagcugaggaugaacccaagagacugggcagcuggcagguguccugguugaagggugcuuauucuguaggagagagaaagauguuugugccucaguauagcuaugaagauuauguugcuaaacuccaguacuacuuaugccucuggcagaugacgcaagaacaggguugaccagcaggugauugauuuagcauaguauaccugucuacauggauauacgauuucuauauuuuaugacucuaaggcuuauuugaucuuuacaucuuuuaaaaaacagauuucuuuauuuuuuauuuuauguguauuugugagugucuggauauauguaugugcacuacauagugcccauggaggccagaagagaguguuggauccuuuugagcuggaguuauaaggugguuuuaagccaccaugaggguguugcuaggaauggagccuggguccucuacaaguacuccuaaccucugagccaccucuucaggcccuguaacuuuuucucuguugugauuagugucaugaaacucccuuuguaaguaugcuccguguuugauacuucugacuuauguaaauguguucgguguuuucuauuucuauaggcuaugaacaacugucuuaacuuuuacuauaaaaguuacuugguuacuaucuaugcuuacuuucuucuauugcucuuguuucucugcuuuucucuuaauguagcacacuuacaguuaugaaguagcaacagaaauuacuuuaugacuuggagucccuacagcauggggagcuguauuaacagggucacagcauuaggaagacugaaagccacuguguucagugcuccacuuauauaaaaauggacagugcauaaagaguauguguugauguugcuucuuuccuggggagaaaaaucaucuuucauagcuaucacggaaauccugcaaaucucauuuuuuaaaucagacccuuaaaacuuggagaaaauaaaauggaacucuuuuuuuuuuuuuuuaaauaaugcaucggaguuuuuuuuaaauuagguauucuauuuauuuacauuucaaauguuuccccccuucuaggcuuccccucugcaaaccccuuaagccauccucuucccccugcuucuaugaaggugcucccccagccacccacgcacucccgcccuagcaucccccuaugcugggacauugagccucuacaggaccaaaggccucccaucccacuggugccagauaaggcagcccucugauacauacucauuuggagccaugggacccuccauguguacucuuugguuggugguuuaguaauggaacccuuuugcuggaaauuauacaucuggaaaguuccuugcuagggaguuaucuguaccuggagaacagcagauguguaauguuuucgaauuauuuuuguguuugauaauacaugaaguuagaauuaaauuuaaaugguuuauauaaauuguauuuauucuuacuauuuuaacugacacuccuuuucuauuuugugauaagcugcaguagcaaauaugaauuauagaaaugauaauuuauaugauguaguaaacucuuaaauguaauauauaaguugauuuuaacuggauucuuuuaaauuuuauguuuaguauaauuuugaaaaugcaucucagacauuugaggaccuuccagcaagauuugguuauagacuaccagcugaaggcuuaaaggugaggagguuuaauaaggugggauauaauaaggugcuuuuaauggucauguaguaaaugaaaacauuucuuaguacuuauucucauaaaaccugaaguguaggcauuugaaaaggugaaguuauucacugugggcauggugaugcaugccuguaaucuuagcacucaggaggauggcagcaagacugugcauuuguggcaggcuugagauuagacugggcuuggggugagacccuagcuuuaaaaaguagaaagaaaggugggcaugauggcacacgccuuuaaucccagcacucgggaggcagaggcagguggauuucugaguucgaggccagccuggucuacaaagugaguuccgggacaaccagggcuauacagagaaacccugucucgaaaaaccaaaaccaaaccaaacaagaggaaaggauggaccauucagagucuaccccacccagggaucuaucccaugaucagccaccaaacccagacacuauugcauaucccagcaagauuuugcugaagggacccugauauagcugucuccugugaggcuaugccagugccuggcaaauacagaaguggaugcucacagucggcuauuggauggaacacagggcccccgauggaggagcuagagaaaguacccaaggagcugaaggggucuacaacccuauagguggaacaacaauaugaacuaaccaguaccccggagcucuugacucuagcugcauauguuagcagaagauggccuagucggccaucauggggaacaccagggccaagaagugggaguggcuggguaggggagcaggguggggggaggguauagggaacuuuugggauagcauuugaaauguaaauaaagaaaauaucuaauaaaauaaaauuaaaaaauuaaaaacaguuuugaagaguuaugagugaagugccgguuugguauacguguguauauacuuguuacacaaauaugaagaagggcaugaaauugccugggauugccuucccuaacacuagauauguucaaaucuggcacaugauagaaguuguuaugcaugcagucuuagauauguguguaugcguccuuauguaaauucuuauguauaaagcuuuaugcuguauuuacauucauagaaacuugcuguuugguuccugcccucauaauugcaucucucuaucaaguuuucuugcuaguaggaaaagaccuuuauuauuauuuuugaggauuacuugguuuugcaauaucaugaaauauuguggauuuugaacauuuuaauuucuugaaguguauauauagacuuucuaguuuauuguuaucguugcuccaaugauucucuuuuuuuuuucuuuuugagacaaggucuuauuauguagccuuggcugaccuagagcucacuauguaggcgaggcuggucuugaacucacagugguccuccugaguguuggauuaaagauaugcacgacaaauccuuagucaauguuuucauccugucguauuuacuucuauaggguauggcuucaagcauaaaaaugcuuucuuuguggcauacagguuuuaaauuuugguauagauuucagauugcccuguagaaaguuaaaggcaguuuaaaauucuaucaguaauaucugagaccauccuuuuuucuguauuaucuuuaauauugcauauaaaaacauucacuaauuugccagacguaucuaauaagguuaaacaccuuaguuuucugcuuguaucucucugugucucugucucugucugucucucugucucugucugucucucugucucugucucucugccccucucucucucucucucucacauacacacacacauacacacacauacauccucaugcuuugagaguugguugacuauaaugcuuuuuacuucuuuaaaaguuaacacauuuauauuuugacagaguucuuuuuuuuuuucuuguaaagauuuauuuauuacauguaaguacucuguagcugucuucagacacaccagaagagggcaucagaucucauuacgaugguugugagccaccaugugguugcugggauuugaacucaagaccuucggaagaacagucagugcucuuacccacugagccaucucuccagccccacagaguucuuaacauauuggaaguaucaauuguuuuccacaucugcuucagaauauuaugugguuaaaaguuaguguguuuuccuucuuccucugacacaauagagaguccuugcucuuuccaagacagugugagaccuuugauguauaagcuagaauaugcaugcaugauguuuucaguuuguucucagcaugcugugcaacucugcaaugggcauagccacucuuaguuuucuuuauaaauuuuaauuauuaaaaauacugccaauaucaagugaucauauuucauuggaauaauauuuaaacagaacagggaauauauuagaaaaggaaaaucuucccuuugucucucccuuaguuauuauacccacccagccuacucucuuuucuccccuuugucucucccuuaguuauuauaccuacccggccuacucuuuuuucagaguuaagaaucucaagugacuacuggccuuuguauucuuuucugaauauguagcauuuuuuagugcuuuaaaaagcuaauuacauuuacucucuguguguguggcgcgugugcucacaugggcauaugaguauguguguguucaugugaguaugugugugugcauguaugugucuauguguaccaugguaugcacagggaggccugaggacaacuuucaauaguuacuucuuuccuuccaccauguuggucccaggaauugaacuugaguugucagacuuggcagcaagcaccuguauccucugagcuauagcaacuugcccccuuuuaauuuuuuucuguuaauaaauuuaucaaguuauguuucaaaaaugcaucauuggcauauaugaaauauuuuuucuuguguuuuuacuuggaaagggauuuaugaaaagaugaugacacugcuuuaaggauaaaacucagaaacaacguucaggcuuuaaagaggaguuguauucuaguuccccuucugcugcgagaaauaccaaaacuaaaaaccacuuagggaugagaugguauauuucaguuuacugguuucagucuaucacugagggaagucagagaggaaucugagcagaaauuugagguaggaguuuuguuggaagacuccugcuguuggcucauggcuauagccuaggagcacuuaucccagguguggugcugccgucgaggugggcuggacacacacacacacacacacacacaccacccagcaaucacgagaacuucccacagacccucucuagagacucucucaggugacuguaggcuaugccaaguugacaguuaaagcuaaguaggaaaugcagauaucggguccccaaaccacaucagaauauucuugaaguuuuagcucagaauauucuuuuuuuuaaauuagauauuguauuuauuuacauuucaaauguuauuccuuccucauuuccccucugcaaaccuccuaucccauccucucucuccagcucagaauauucugcugcugcagcuacuuaaggguauuauucauuaaacugcacauguggucauuuccaaguauaguaccugguuucuguuaacugacagccuguaggccauauaaauauuuuuuauuggauauuuucuuuauuuacauuucaaauguuauccccuuuccugguuucucucccucccggaaacacccugucacauccucccugcuucuaugaggguguuccuucacccacccacccacuuccaccuccccaccauauaaauauuaaccacauauuuuggugaaauucuuaccagauaggaaagguagagaauauuguauaauauuuuuguugcuacuuuucaucuguguugagaugauacuuaucauggagggagaagguuucagaauauuuguggugccgggaauggcagacaccuaccucacuaacuacugugcaguuugauuuuccuacuuccccagugucuuucagaaauuuccacagcagcaccuauaaaacuaguuugucucuugagugcuacauaauauuuuauguuauaagugaucauagcuauuucuuauuauaagguauucugguuucucuuccucuuuuucuuuaguuauuacagugacaugucuauauaaaugccuagauauauaaauauaaccuguugaaucuguucagugucaccuguauauguaggauuucagggcugacaugugguauugcauaaccaauuccugggacaacucuuucuccuguucuauuagccuguaguucuuugccuagugugaggccuguugagacagacaugcccacuucuaugcuagcaugccuaugguguuguacuucagguuuugauuaggcagccauauuguugagguaucacgguugaagcgucucucucauuucuaguagguacaaucucacagcagauuucuuggcccucaguacuacaauccuuccgccuggguuucuauuguuugaagcagaacggugaaccagauccugcuacacugucauuguugggaaguagauguuaacuuagcaauaauauaugcuacuuaucaaauccuuuaacgauaaauuaccccaaauuucacacuugaaggaauuacaaugagugucuuuggaacuaacguguuaacauuguauaaacuguucuuuccuuuuucuuuucauaucacagugaacuuaaaguauauugguuuagaaacuuuuauuaauaagcuuuuauguucuuaaaauauuauaaaacaaauucauuucuaauucuuuuaaauuuuuucauaaauguuuuuuauuauuuuuugcuuauuuuauguguauaggaauuuugccugcauguaugucugugccacucugugugccuugguguccaaggagaccagaagagggaaugagauucauuguaacuggaauuagaguugugagcugccaucuaagugcugggaacuaaacauagguccuuuggaagagcagucagugcucuugaccucccaucuauguccccagccccagaaauagcauuuuaauaauauaagguuggcuaacuuacagugauuaguuuuggcaucucaauguauucuuugaaaaauuuuagaucauugauagacuuuaaaaauaucuuaccaguuuuuauuaaaauauaaugaguuugggggggaggguaugggggacuuuugggauagcauuggaaauguaaaugaggaaaauaccuaauuaaaaaauauaaugaguuaguaagcucuauaaucaaaauaaguugcuggggagaauugugguagaguguacuaggggagauauaaauuugagacacuacaacuaugggagauuuuuuuuuuuuuagauuuuuuuuaauuagguauuuuccucguuuacauuuccaaugcuaucccaaaagucccccauacccacccccacaauccccuacccacccacucccccuuuuuggcccuggcauuccccgggagauucuuuuaaucuuuugauccaguaagauuuaaucuuuaauuacuauauaccuucugauguuuagaaaguaugagugucaggcuuauagguaggcauaugguuuggaauauuuaguauauuuuacccuuuguuuuaagagaagagaacauugcuuaguagcaaauuugucugaaauguauugaaacaauugugauggguuugcuggagacuuaauucacuuuucuaaugauggguuaauguuuagaacaguauaaaaggugguaguuuuugucuguucuauuuugucauagcauucagaucaguuggcccuagucugguuuuugucuacuagcagugaccaugucauacaguauuuguuuucuguaacuaccuucacuguuagaauuacugcauucuacugguugcgccauuguuuggacuucauuguauuugcguuuguuuauuauuuuaaaauauuuacuuuuguuuuauguucaugaguguuguuuuugcauggauguauauauacucaugaccugagcuuggucucucagauccacagaguggaaggacagaaccaacucucagaaguuguccuuugaccuccaaacaugugccacguuauguauguucaugugacauugacuucuucauccuuccaccuacaccucucaaaugcugggauugcagauguuuacucagcugcaugcucagcuuaugcucagcuucccugcugccuccuuccuuccuccuccccuuucucuucgucucucucuguguuauucugucucugugucucugucucugucugucugucugucugacugucugucugucugacugucucugugucugucugucugucucugugucugucugucugucugucugucugucugggcaagggucuccuuguauagccugggcuggccuccaguguuguauguacuccaggcuugccucagacucauauugauccucuugccucagccucucaagugugggaauugauuacagacuuguaauaccaugcauagguuaauaugauuuuuauguucagguuauuugacucuuucaguuaaaaauugguagcuuaagcuauguuggaaaugucugguuaguuuuuaguaauguauacuacccugugaccuaacuuuugagagucugugacucuacuucuauaaauauauuuuuuauauauacauacaugugaucauugaaaaacuugacuauaauguuuaucuuauuuuauuuuuugccuuuuggauuuuaagcucuucuuuuauuaaauuuacuuuucacuuacauaauacaucuugacugcagucucucccccaccccaauuuacuccuccuaggcacugcccucaagcuccucucucucccacauccacuccuucucaguuuuccuucagaaaagacuaggccucccagggauaccaagaaaacauggcauaacaaguuacaauagaacuagacacaaaccauaucaaggcugggcaaagugacucaguaggagaaaaaagguccuaagagcagagacaagaaagagucagggacaaccccacucccacuguuaggaaucccacaaaaauaucaagcuaacaaccauaacucugcauaauauaugcagaggaccuaguacagaucugugcaagcacagugguucccaggucagucugugagccccgaugagcccugcuuaguugauucuguaggcuauguucucaugauauccaagaccacucuggccccuacaguucuuccucccccucuuucgugggguucucugagcuuagcugaaaguacugaaauauucaccaauaguggaauaaguugugauauaugucacauuugaauacuaacuagaaauaacaauauauauguuuagcaguagggugaaucucaaaaguauuguucagaaaauagucuacaaaagcauucuauucuguaugcuuuuguuugugucaaacauaaaauuagguaaaaacaaauauaagcuguuggaaguccauagggugucauucccucaugggaacacugacuaguagggagcaucugaagugcuguuaauguuuaauuuucugauacaguauggguaauucaacacgcugaaagacauuuauacauuuuguuuuaugaauaucauaguccuaaaagcuuuuaucaccugugaauguaccauaacuguguuguauuaugcauuuaauuguguguuugauggucuugagacuucaguuaucacgcacucuuguuuuccgcacccucauuuacucaucagaagauuaaaauacaaagaagagaaaaugggcaucgagucccucaguuuuguaguuccuugggcuuccuucauguuaaguagcuuuguaaagcacuccuguuagaagccaggugugagaagauccucagagcagaggaaguguuauuuuagugaggagagauuggacuggagagugauaccaagcauggguucuggcugaagguaacaucugggccacucuuauuucaggcgccagagaguucugccaaguuggaagaugacucugcuuucugauaggcuuuguucuugaaacagacuuagugugcacuuaauuuuaagugacucauauuugagacuaguaauagaaagcuauuuuagcaaguuaugcucuuuaguauauuccauaggaaugauaauaauuuaggacacgucaaucaacuuaagcaaaaagauuauuuuagggacuuuuaguguacaugcuuuuaagauuuauauauuucuuguguuaaaaauagugcaugauucauauguaaaaaagguguauaagcaaaaauucuccucuauuuccacuccccuauuuugcugguacguuuaaccuccugcguagcugggauccaagcgugugcuagagcuccugguuccaucgucuucucuugaguucuacgccuucuucguaugugcugaguuuaacuguuauuauaaaugaguuaaaaaugauuuacagcaccaugauuuggcauuacaguguuugcagagaggcaugcaaaagauuuggggauucagaucgaggguauaagcauauaugaagcauauagccacuuugaaaauggccacaguuuuguuucugggacauucagauccaauguucuuuggagucaagagagaaauucuguggguaaaugaagaacuaguacuuauacuuuucauuccugaagcaggugcaagcacuguuuuuuaccauaagccaagcaaagcuuuuuuuuuuuuuuuuaaagaaauccuuaaauccuaugaguugcuucaaggggcuaguucugacaccaugcagaacuuugaagauauuaugccauagcuuucuuugcuuauuucuuucuaaaaaguuugauaauuuuagguguuuauugguucacuaugucaagaucacuugguuuuuuguauuuuagccuguuaauaugacuuuuuaaauuaauacauuuucugauauuagaccauuguacauuuuugggaaagcaauuugcugcuuuaagauuuuuuuuaauuuauuaugcuaaaaccuuugcaauuuuauauguaaguacacuguagcugucuucagacaccagaagaggguuucggaucccauuacagaugguugugagccuccaugugguugcugggauuugaacucaggaccucuagaagaacagucagugcucuuaaccucugagccaacucuccagcuccugcaauuuuaauuuaaaauuuuuuaauuuaagaaauuuuaaauuuuuuauuuaaguuaauauguaaguugauggauuucauguugacauuuucauacaucuguguuauuauagucuguucuucuuggucuccaucucuacugcuuucuucuugccugucaucuuccuaucucccaaguaguccuuccuucuacuagggcugugucguacauauugcauuacccucucuucccccuucuccccaucccauuaaauguuuucucuacuccucaugguucccuuaaacauauguguguguguaucugucucucucucuuucucucucuuucuuucucucucuuucccuucuuccccucccuccuagaucgcaaauaugagaaaaagcauagacuauuucugagucuggcuuauuuugccuaauauaauauaauauaaccuggaaaugucaggacuuuacuuuccuuuauagcugaggaaauuccauuguuaucacuucauuuuuaacuaaugcauuccuuuacuuucucucauguguauaguaugauuuuaaaaauauucaccucauuuaugagcuugauuucuguuuuuuaacuauuaaagccaauguaaaaauuaauauauuuguacaugucuauauacucagaagaguacuaacauagaaaaauauacagcauauuucauuuauaauguaaugugugcccuuucguguuugacaauguaaaaaguaaaagcuaacuuaaaauuuuuucuugguuuagaaauguuguuguuaggaaacagcaccaacauacuaggaguggcuaucuuugguguaauugacuuauguguaauccuaaaaauguucugaaaggcugaacuuuuuuaaaacaaaacccaugaagugguuaugaacccaaauucuacuuuaaagguucugggguuguaagcaacugugccuagcagaaaguacaccuagaauaguguaaagcauugaagcuaaugcaagccgucugaagagggaaguuaacucacuuaucgcgugaaacagaaauaacuuguuacuaauuccuuuucaggguuuucugauuaacucaaaaccagagaaugcgugugaacccauagugccuccaccacugaaagacaauucuuccggcacguucaucgugcugauuagaagacuugauugcaauuuugauauaaagguaacuuuuuugauauuauuaauguuuuuaguaauuuacauucuccaucaagaaagauaugucagugcauuaaauuauucagauuaaaauaagaaugaggccagcucaaggaaauagaagagaagggugggaaaaauuuuuacuugaauuucauuuguuucaaaaugaacuuuaaguauuuaguggcuagucggaaaugagaaaaggaaguuauccuaaguuuugggaggcuuaguuuuagcaagacugaauacagauugcuacuauuggugcuaagaauuuagguugguugguuuugguuuguuuuuucuuucuuucuuucuuucuuucuuucuuucuuccuuccuuucuuucuuucuuucuuucuuucuuucuuuguuucuuucuuucuuucuuucuuucuuuucuauuuuuccaucuagagcugugauuuaauagugaaauauugcuugauucaauauaagaauggcgacuuaacuucauccuucaauuguacaccuaagcuuuuauguuauggauaaagugauuaacuuucuguuaucaacuuggacaugaagauuucuucuguaaaacacuuauucugucccuguacugggcuuugucucccuacaacugggggaggucgacauuucagguaguaaagauagaacucaccuugcuucuguauuuauucccauuuaacaacaacaacaacagcaaccacaacauagacucuuucuguagcuuugacuguccugaaacucucuguagaccaggucggcuuaagagggauccaucugccucugccucuccaaugcuggucuuaaagucauggaccaguaaggcuggcugucacuauuauuaaaaggaaguuuuuuuuuuuaggccaguuaugucagcuaaaguuaauuugaacaaagcaagacacaaaugauuugugagucaaagacuuucuagaaucacaaccgauugugagaauucuacucagcaccacaaucagucagcagugauaaagaaauagaaguaaugcauggaauggggcuuaacuggcuacaguuggucaaucaacuggucauuugaggauagcuuaguuagccucuguggauucugccauccucaaagcucaguacugugauagaauucugcaugguucugucuacuggauccaguugggagcuuagagcaaacacugaccauuaauuucauguaaggcccuguuaccagugaggcucugagguguggucucuguugugggguaacuggcagaagaaccgugugagucuaugugacaugaaaucucaguguuauuuacuagauauauucaaaguucccuaaauaagaauaaguuagugugcaagucaguugggguugcuauucucagggucaucuaugaagcuuuaacuuaagccacuucaauauuugacccagaacuaaacuugguacaaauugucccagcuaaaauaaaauacaacagaauaauuuuuucuauaaaaaaguaaaacuaaaccaaugauauugacucaaguuuauuaauuuguaacuguaauuucugacuuagcacagucuucaguaaaaaagaagcuaggauguuuuguuguuuuauguaacuuuucuuauuagauggagauuggcuacaguuaacuuagaaauugaggggacuacugucauugccuauucauuucuaaggaugguuggggcaggcaggcauauuagcuuacuauuuauuuucuauacuguaucauguccucaccaugagucugagugugucuaacagauacccugccuuccaccucccaucuuuaacucugugcuacagccaugcuccauguggggcauguugacagcauucuugugucuuccgucauuuccccaguccagccugagcacuaucauccauuuauauguuacuaaacaugcuacuuccucuggaagcuucacuuuucuuuauccucccgagcuugcuaguagaggcucauuaaaucaagccaugcagcaauuagcuuucugcuuuugugcauaauacauccgugaagaauauauauaugaugcaagagugauggcuuuguagucagagaguguauggcucuuguagagaaucugaguuuaauucacagcacccacauuaggaaacuucuaaaugcuguaacuccugcuucuaggaaucucaugccuguagccucugaggggaccagcacuuauguacacauaugccaacacagacacaaacauauuuguuaaauuuaaaucuaaaaguauauauguggaaaacuuguagaaauguuuaaauuaagccauuuucauuuuaggagggaagauguuaacauuuuuccccguuagauuuuaccauauaaacggauaaaauuuuuaguugguuguacauguuuuuuaacuauuauuuuuucuucaaagauaugcucagugacuccgguggguucguugacuuuuaccuucuucauacuucuguuagauacggaggcaucagcuuaggggaaugugguucuaaucaaggacugaaaauacauuucauacauuugaaccccaaaugccuagccagaccuugaauguaggauccagucaucaggugucagcuguugguauuacauauuuuuucccauuuuagauauaacaauagaaagauagcaaaaauggucguuuuaaagaaauuuaguuauugguaaaugacauuuauuuagugacucaguaucaguuguaaaauucuacuauggauugaaaaggucaguuuaguuacauuaguaggugauguagaaaacgcaggcuauuccuaauaguaauacuuauugaccaccuaucaagguaauuuaaggaagggcauauaccucaaagagaauuucugauaaauaaguaucagcguuugauuagaaaucacuguuuuccaucuuccagauggauuauuauauacagcuuuauguuacauauagaaucugauuauuuauaauguagauauagaaucuucuuuucaauuuuacauaauaucuuucuaguagucaguagugguccauuuaugucuauuuguaauuuuguaugaaugcccuggcuuaagcaaaugguagaaaacuaacuuacuuguaugcuguccaaacacaggacacucagaugcucugcucugccauaaugaauaauguuuaggcaagagagagacaacuuaugccaccaaauuaucaauaucuuguaaaagcaacuuauaggaauggguccaagauuccuugggggacaacuuguaggagucaguucucaucugccaccaccaaguuccgggguuaccucaccgucaggcguggcagcaggcaccugcuugcugaaucuuuuguuuuaaagauaaggucuuaauauguagccaugcuggcaugacauuugccauguaguucagguuggucuugaacuugcagugauccucccgccuucaucuuuuaucuugagcuugaaaaaaucuugugaaaggaaacauuguuacuucaggccagggaaaaccacagaaaagcauuuucuacuucuuuuuugagauagagucucauuaugucugccugccucugccuuuugagugcuggugguguguaccaccauggcuggcgcauuuguccuucuuuuugugaagaaagaauauucuucuuguccaguaacaacauuuuccuuccuugcuugaugcuaguuuaugguuuguuuuuguuuuuaaaauuuggcucuuuagcauuauagcuaauguuuuauguaguuuuggguauuaaauuuuaaauauagggccugggacagcagaacagugaguggccauugauggacacuuguacuggcgauggaucacugggaucaacauucugacuguaacugcucugucacuguuguuugucaaggacaaugugaaucccggucacucccgacagccuuagugggcagauagcaaacacagauuucuuuuggucauguuaacgaacuucucgagcccuguguucagcgaugagcuugcugcaacgccaccucugcugucucagccugagaaauauugagauugguuggacuaggaauccugucagcacacaaaaaguacuauaaguauaaauuuacauagauaguuaauuuuaguauucauuuaauaugcauaagaaccuaagaaugccauuuguagacuuggaauccuagcauugaaugcuuaggcagccuuuucaauagucauuaauuugagcugcuaagaaauuacugaauucuaaaugucagguugugaaagggcuguucuuagguuuaguucuuccuuucucuacuacagaaaagaauaugagggcagaaagacaguacugagcaguuugccagugugaggacugaggcaagggggcgcuaacauuugacacuuacugaagagagaaggccugcugguucgucauacucaugacuaacuggagaaguucaagucauguccagugcccuuuacuugacaacacuuggaaacgucaauauuacaugagggacaguuuugucuacaaugacugaagaaaacuucucuggcucuggaagaauaaagccacagauaaaaguaaaguuuauuuuccugauaugugucuuguaggguaagaguugaauaaauagauaucuuuguuacaauuuaagcagcucuguuauagauauucuccuacaauugaaauauauauaaucaggauuauucauuuuucaugaaauguaaagucucacauucauaauauuccaagccaggggaacaauucaaagcuuuuaggcuaggcauuuauucauauacaauucagucucaaacuaguuauuucugguaacuugggcaugggugguaagcaaaaccugagguuacagcagaccagguucaaacuuagagaugugccugccucugccuccugagugcugggauuaaaggugugugacaguguaccugaccuuugucuggacauuuuagaguuaauguuuacuuugaucacgcuauccauuucuucuacuuaucuuuaagaccugaaauucacuuuuacauguauuuuaauuucaguuagugagguuuaucucugagccuuuugcuuggugaguuacaaaugaauggagauagaguaggaggaaugguugaagagggugaggacgaacuagggggacccugggucugcucugugacccugaguccuaagggaaucuguuuuuaaauauuugcuugcuaauuauauccaugucacuugaguuuguuuccacuggcuaacuuuucuccaggcucuauuuucuacuucuuugugucaagugauuuuguuauguuuuauguaaagguuuugcugccuuaaaaaacaaucuguaauuuguuuugguugguuauuuguaggugagcuugauccuuuuagaauuuaaauguauuaaucagugguaaccuuuauccuuaauuaccuuuaauuacuguuuucuguugauaaagguauguucuucuuaguguguccuuugaguguuauuuucaaagaagguuuuccuuucuggucagaacuugaacuuuuccuaacuaccucgaguucuggaaauuggucaguuuauacuuuuucccuggguacaucugggauggauuaucuauaugggcucauggaguuuuguuuuaagcauguauauuuuauguucagcuaaagauauaagggaaugccaugcagauuucuggagugguuucuuugcauucugcuguguacuauguaaaguauauacucuaguuaauaaauucaaauuuaagccaacacagccucuauuaauucacaucuuuguauucauaacucaaaaucuacuaugcucuauauugcuuugauccaacagacugauccaacagaaagguagggcauauaaaaguaauauugcccuauaauuaacuauguugaaauagcagugaucuaaacuuaaggcuuaaaucuaugugaccuuggauaggccuucuuuccauucccuggacauuuccuuagaguuucaaacuguuaacuuuguuuacaauaaaggccuuuuaccuuucugcauuccuguggucuaaaaucuuacuuaucaauuguaauguuuucaggugcugcucaggaaccaaucugaucucauuuagaguccuuagccauucuuugaagauagagacuucaaagccacuaaaauuaauaauaauaauaauaauaauaauaauaauaauaauaauacucaaaccccccaaaccccacaauguuaaaacaaaucacuaaagcccccaguggaacugcagcuauuccuaggagccccugcaguuggguuuuugguuugucuuacuucugauuuucuguuuuccuuaauuccaacuuuccuuuauacugguuggcccuauaauuuuuuuuuugcauggaggcucccaauccugauuugacuugagucagggacccuaugaggaaauccucacacugcugaggguggcagugugggccuuugcuccaccugccugucccugcucuuuacagugcuaguuguuaagccugucugccugucugugguagucuccuguuuuugaucuuuuucgcccaucauuuguuaaaauauaagaaauuauucuuuauguagcacaugucagugucuuaguuuguguuuuacugcugugaacacaaaccauuaccaaggcaacucuuauaagggugacauuuaauuggagcuggcuuacagcucagagguucaguucauuaucaucaaggcaggagcauggcaguguccaggcagauaaugggccuggaggagcugagaguucuacaucuuguuccaaaggcagcuaggagaagacuggcuuggcuucuaggcagcuaggaugagaguauuaaacccaugcucacacugacacaccuacuccaacaaggccuuaccuccuaauagugccacucccuggaccaagaauauacaaacuaucauagagaacaguuuuuaauuugaaguguugguugcauucaaauaaaaaauuuacaaauuuguucaguuuaauacaguaauuguucucuaaaaaaauauuuuucuaccucuguuauguuuucuaccucuguuaauuauuuuugcagguuuaugauguagauguguauacauauuugcuuauuuaucucuugucagaguaaccacaaacuauauuuaacuauuccauaggcaucagaggauguuggaaacgauaggaaauauaaaaauguguucuuugaaguuuguuuugaaaaauauauccaauuuuauucaaaauacugaguuaauaaaugaauuuauuuacuguaaguguuuaaauguuugccucuaguuuuuuucuccuuuaauuuuuugaaaauuuuuauuauuuucuuuauuuacauuucaaauguuauccccuuuccuaguuuucccucugaaaauccccuauucccccccccccccacuucccaacccacccacucccauuccugguccuagcauuccccuauacugggcauagaaccuucacaggaccaagggccucuccucccauugaugaccgacuaggccaucauccucugcuacauuuauagcuagagcuacaaguuccaccauguguuuucuuugauuggugguauaguuucaaggagcucuggggguacuggugaguucauauugaucuuuccccuauggggcuucaguccccuucagcucccuggguauuucucuagcuccuucauuggggaccuugugcucuguccaaugaaugacugugagcauccacuucuguauuugccgggcacuggcagacucucgcaggagacagcuauauuaggcuccugucagcaggcucuuguuggcaucugccuagugacuggguuuggugguuguuuaugcgguggauccccagguggggcagucucuggaugguccuuccauccgucucagcuccaaacuuugucucuguaacucccuccauggguauuuuguucccuauucuaagaaggaacgauccacacuuuuggucuuccuucuucuugaguuucaugugucuugcaaauuguaucuuggguauucuaaguuucugggcuacuauccacuuaucagugaguacauaucaugugaguucuuuugugauuggguuaccucacucaggaugauauccuccagaugcauccauuugccuaagaauuucauaaauuuauuauuuuuaauagcugaguaguacuccauuguguaaauguaccacauuuucuguauccauuccucuauugagggacaucuggguucuuuccagcuucuggcuauuaugaauaaggcugcuaugaacauaguggagcauguguccuuauuacaaguuggaacaucuucugaguaucugcccaggagaggaauugcuggauccuucaguaguacuauguccaguuuucugaggaaccgccaaacugauuuccagagugguuguaccagcuuguuugccucuaguuugauuggugugaucucuuuacccaguaaaccuugcuaccucucaaucuugauguucugaguggucuucaagcaggucuucaaccugcuucuccuuuuuuucucuccuuacccccugacuaucagcaguaauaaaaacuaauugccauaagaacauauuuccuaugugccagagcuguguagguacuguuuuaagaguuuuugcauauauuaacuuguuaauucuucagaacaacauucucagaugggcauuaauuuuauggaaguuacuuaccuaaauagcucuaucuugucuaagagcagcacucaaggccgagucaucuaguuuugagauucugcugcuccaguuuccugccuuccagggacacccuucucuucaagucaaguaacucuuucuguuuauaauuugcuuuggauuaugucuuuuaguaugcuguuggcuuguuauugcucucuuuucuacaagaaaaaaaaaucucuucuaugucuuucuaugacuaaaucaaauuuucucuauuguagacauuuaauucaaguuccauaaaaugugcugcaugaauauuucaugcuguaacauuuucuucuuuuaaguuucuacuuuacugcaguauuuuaacacauuucuucuaggcacauguuguuuauuuaauaaaguuucguuuuuccuauagauuccuaauauuaauguacccaagucaguuucaguuugcuucccagccuugguaagaugccaagugcugguagugauccuggcuuaguccugauccaucagcacaucccacugugcugcuuagcuuuccuauagugcuaccuuaaggaaccccucugacauaagcagucugugaagagaaaaugcacguuucagucauaguuuccaaggauucuaucuaugauucuucggcucuguugcuucugguugggagcauguggcagaaaaugugcuugcuaaacgggauggaaaagagcccaagggauagacuaguauuggacaguccucccaaaggcaagcccccacuaaccuaaaagauccuguuaaggucuuccucuuaaaguuuccaccaccuuuuaauagugccaagcuuaggacugagaauuuaagaauaugagucuuuaggauauucuagauccaaaccacagccuuaaacuucucucuaaccuaguaagaugcuguuccuugucagcucugcccauaugugacagccuguagggccgaucuugccucgccucuaaaauguagaaaagaauguccgauuguagggccuuuggagauaauaacacaaaugucuagcaaggagagcuuccuuuguucuuaccacuuuuguucuggaacguagcuaucuaugucauauuaauagcuucccaaguccuacagcccaugaguccuucauucauggucauuuuuagaacacaaucacuucuuuguucuuauaagguguuuauauuauuuuaguguugcuauuaccaauuuauucaaacugaaaaagauaaacuguuguauuguuuccaggauuucuuuugcaacuugucucaucgaugacuuuaucauuagagugugcuaucuucugauacacugccuauuuauaauaauaguuccuuauuuccuugaaacucuuuguuugaugccaccuggucuacauaauacaguugcauugaauuuguugacuagauuuaaaauauucaguauauucacugcaauuugaacuaauagcucugaccaguccuuuaaaagguagcuuaguaauauaguucauuagguuuugcaugcauuuguuauuugugagggcuguuuuggauuucgguuuuuauucagugugauuuuuauucaugaaucuuuucauucucugcuuccaucugacaccauauguuugaggcugcauuuuaugaauguaaaaccaugcacauaauuacuaaaugauuuagguuuuauuucgguuucauguguucuuaaaaauaccagcugcugcuuagucaagaauguaauuuaauuugacugacacuugagauuuauaguuucuaaaugugaauauauuuuccuuguuuguuuucaaaagcacuuugguacauauguuaauguguugcuugauuucucuucacuucuucaauuuaaaaaucaauaaaaauuuuuuugggaggggagauuguucaacuuaaaaaacauuuuuuuaaaucuaucuaucuaucuauauuuuuuauuuuagcuuuuauuuuguuagcugaaacagcuuuugauaguaauauaauuuugcauuuuauuugugaaaacaguugcaugcuagauaugugaaauaaauauuuaucuucaguuguuuaauaaggucuuaaaaacuuaguggcugcuuuauuuacguauauaccuaacaugcugcuguuaacccauccauacauguugauguguuaauaacccgagagugagaguuuggagagauguacugaaaaauaaguuaaaaguuuucguuuuccagccccggcucccagaaugaugucucugagacuaauuauuauuaaaugccugggcauuggcucauucccuggcuagcuuguaacuuauuuaacacauucaaacuauuguaugccuaccacuugguuaguuaccucuccuucaguccuggcccgcuucuuccuuugcaucuccucagcaucuagcucuauucuugcucuaaucucucucugccccuccuuuuagucugucauuauuucccagaauccucuuucuuccugccaguaucccaccuccuauuuccugccucagcucauuggccaucagcuuuuuuauugacagaugaugcuuauaagauguucucucugcagcgauagcucagcagguaauguuacugcuguaagccuggcaaccugaguucaauccccuaagccaugcaaagguggaagagaucuacuccugaaaguuguccucugacccugacacuuacacgguggcgcacugugcacucauguucccauacacagcccuagcaccaccaggaacaagaacaagaacaacgaguacaguccaaaauaauuuuggagugaaaaagcaucuuaaaaacaaacaauacuuugacucuucucaccagaaaauguuauagguagagaucuaaacauguaacgagccuuggauaaacugcuuuguaauugggaugguacauguaugcaaaaguuuaacauguggcaugguuuaaaauuaguauaauauuaguacuuauguaaauagagugaugaaaguacuggaagcagggaauggcuggugugggaagagauguuguauagaaaacaugagugcacuucacaguuaguguggacauuuaaggcuuucagaagauagagccggcuggagaucuuggagaagcaagauagcaccuagccucuuugucuguuuaggaagacugaggcgccgguaaggacaacagugcuucugacccaucuuugaucucuauugugcauggcauacagugguuuccauggugacuuugucagcccuaacaugcuaugucuuugcucucagagaaguaaaguuagcuuuaaaaaaacucuuuauaucagcaggaauugccuuuugauauugauucaaaguuuauuucucugaaauugugucuaugguaaaaggugcuuuuuugacugaaaagcagugcuucuugguuacuuggcuagcuuuuggaagaagaauuaaauuggcuauugaagugucagaaaagcuaacaauaacaccaacaaagcuauuggauaaaaguuuuuaaguaguaacuagugaugucugaagaaagucuccuguagugguaacagagugagugaaugacuacucaaugcacgugagggcuggaagcuugcagcauucuucucuagguguccaugcuugcacacaguggccucucugaggaagaggcucucgugcuuucucagauucagcuaguaauaaacuuagauguuaauaaaauccaccuuaaaauaauaaauguaagguuuuaauuauugacaucuucuuugcaugaguacagaauaugcuagguuuguuacccaguagguuucuugucauuguuccuaacguuaaaguuguuaagaguucuucaugcuaaggguucugugucagugaacuguuucuuuuaacuaguucuucaggaaaucuuucuuguccaauuuugccaagcaugugacccuguaaucuaaacaaauacuuuauuugcuuaauucauucagugacauuugauuagugauguucuacucugucaggcuauuuuauagacgaugggggcaugaaugcggacaaaauauuccugucuuaagacacucauaucucauagacucaauuuuuaaaaaauaagaucauuaaaauuauuggauuuauuuugauuuccuuuggugguaguuuuagagaaaucacagguuauguaaagagaauuugcugugcgaagcugauuugccaugaauccauagccucauucuuuuuagcucuuuuguuagauuuagagaauggauaauuagacauugcuuuuauucuugaggacgcaacccuaggcuuuccuugacucuuuggagcuugguguagguauuauuucuuacauuucggcaaguuucacuucaguacugcuaaccaaaauaaaaccaauauuagaucuaggaauucuuuuugaaaaauuaauuagccugcuuauaaaaaguauuauuauaaaguaauauaucucaugaguuucuugacauuaaauauuuaguauauaauaauguuuguaguuuuuagauauaauuuguuuuaaaacauucaaaauuuagaaaauauauguuaagacauuuauguuuuauuuauuuacuuaauagcaugguuggucacuuuucaacuccuuuguguuggaaacuugcaacacaacuagcuacuaccucaugguccucaguuaauauuuuagaaucuuuuuguugaaauccagcuuugauccauaguggucugauaggaugaggugguuauuucaauguccuuguaucuguugagauuugcuuugugacccguuauauggccaauuuggggaauguucuauaagguacugagaagaaaguauauuuguuuguguuugggugaaaugaucuguggguaugucauagcuccacuauuucucuguuuagucuuuguguggaugaccuguccauuggugagagugggcuacugaaguccacuauugaugugugagggucacuguuaggacuuaaacuuugguaguguucccuuuauaaacaugggggcccuugcauuuggggcacagguguuaagaauugaaagaucaucuugguggaguuuuccuugaguaugaaguguccuucucugucucuugauuaauuuugguuuguuagaugguagagugaccacaccagcuugcuucuucauuugcuuugcuuggaaaaucuuuuccaacccuuuacucugcaguaaugucuaucuuugaaccugagguuuguuucuuauaugcaguagaaggaugguuacugguuuugcauccauuuuguuagcccguuucuuuucuuugaagaauugaguccauauagacaucacgacaaugcuuguuaauuccuauuauuuuguuggugguggugauggugguuugguguguguguguguguguguguguguguguguguguguguguauguguguguguuuuggaguggggauuuaagggauuuauuaauuucacccauuuuuuugguuuauccuuaacuagauuucuuaaagguauuuguucauuuccucuuuaagaacgaaccccugugaucuuccuaaaguugguuuaauguccuuuucugguuucaccuguguuaauauauugcacuggcuguugucgauuauguucuuaugcuggugucuaggcaucuggguuuggggcaauuauaggucuaggugcugggugcugauuuuugaguuugucuuuguugaauggcugauuuguuuguuuuguuuuguuuccccugccuuggcuucuguuuccucucuggucuucuggcuggaguagucugugcuuuaguagagggucuccauccaaguuggggcuggacuucugguguggccuuugguggagcaggauauuccagcuugaguuggggacuggaguccugguguccaugagcuggggguuuuccagaguaguugcaagucaggauaaggaguggagaugcagagugugggcuggaggugggcuagguaggcacugaggagguggaggcugucugugagcaagcagccugcugggguucaguauagacuggagggccagggggcuucugcuggagcuguuggccuggguucugguugcuggcuuggccucugguagagcagcaggcuuccucugggauugugggcugggguauggugaugagagggggggcagcauuugggguaagcuggguggguacugaaacgguguugguggucuguggguggggcuuuucuggaguucuggcuauaaccucugguggaacagggacuuccacagaguugugggcuggaauccuaaguugcuuuuauaugccacauuucaacgugugaaauaugguuuuaagcauuuagaaauauuauuucuaugccgcagacccccugggucccugugucugcguggaacgggucucucgaucaggugggcaaagcguaggauuaaauugacaaacagacacacacaggagagguuguguagaaucugaauguaaugucagguugagccuuggacuuuuuauaauacagaauuccagggucaauaugucacaccagacaagguacacugaaauuuaccagauacaagagaauggaauuugcaggaacuagauaaauguuuacaauagagauuaucagcccugccuaggaucagccuagugccaggcaagaguuucacacuuuaguguuaaaagcaccaggggguaauuacucuuggcaggccucaagaauaauguagugucacggaccccuaaauuccuaggccuuguaaaaucuuaucuagucuggagaauccccauuugucaggagaguauaucagcuugcuauagguauggaauguagccuguacuaaagauuuuuaucucagugagauucccaggcucuuucugcaaaccaacugagcuaaaggccguuuuauuguaaugcuuaauuaguuacugaauagguuaaacuccucgcuguaaucugggaucuuggaacacugggagaggcuuuagcuaugucagaauucaaucuuaaaaggcacuuauaauaggguaaugcuuaauagaggacauguggauccauacacuagacuaacgcgggaguggaaaauuaauguauggguuaaagagauuaaagagagugccagacuccaggagggaguuuccuugaaacucuuuuccucagggccagcuuccaagccuccacuugucaaacugacucaacuggagagcguggcuuucgccagacuccaggagggagcuuucgugaaacucuuuuccucaugagauagcuuccaagcuuuugccugucaagcugacucgaccagagugcauggcauuucuauguaugaggacauuuaggauacugaggauugaaaaagaaaguagagcugcuuagacagaaggcuuggaaaauuagucccugcccccaacugugaagccggaucucaagcacccguguaaauuaaguauuggguaguguagcagccuuccuauaaucucuucauucaggcaaggacuugggagaggggacaguacagaaaauccccagggcaagguggcuacccauguuagucagaucugugagcucuggguuuaagaagagaccuugcuccaguacaaaaaauagagagugaucaaggaagacaacuaacugcugcucuccagauguacugacacacagauacacuucucccucucucccucccccccccccccguguguguguguguguguguguguguguguguguguguguaagugaaacaugcauauacagguauuuacagaggaagcaauucaccggagucuauaccgcucguaaguauuaagaaggauuugaaagccugaugaccugugauuccucagccugaucauggcaaguuucuguuuuggcaauagauuucuuuauucuuuugaauccucuuaacacuugugccacaucccuggccuuuauuuucuugaacucucucaaagcucagaaugaaaugagaaagcaucuaaagaccuccuagguguucuccuauaggcaucuacaucuuucaagaacaucuacgcuuuauucucacagaugcacauggugugcuucuaggcaacuaguguaggcuuguugugaccaucuuccucauaauaugacuguuuucuuuucugcagguuuuaaaugcacagagagcaggauacaaagcagccauaguucacaauguagacucugaugaccugauuagcaugggauccaacgacaguaaguacagguaucacuucucuugucuccugauugacagaucauuugaaaugaaaguuaacaaaauuucuuuacuccuuuucugcuuauauagugaugucucuucaguaucagauaguucuuaggucuugggguacucuuaauuccuaaccaagguugaauugacuugucuuuuaucugaacaguuaaggguuuuuguuguuuuguuuuuuguuuauuuaucuguggauauuuucuuucaaaagaaaauaaauaguaauguaguuacuuguuaagaaugccauggaaggccuguaagaugguuuagugagcaaaggcauugcaaaagccuuaaaguuuagucuccuuuaaccacacagugauaggauaagaauccauucuugaaaguuguccucugcccaccacaugcaugcagaggacagacagauaaacacacacacaguaacacacacacacacacacacacacacacacaguaacacacauguacaaugaauaaaaguguaguuaaggaaugcuguagauucauuuuuguaauuuauuuagauacacauauuaaaguuuaagauguauaagugcucuugacuacagagucaucucuccagccccuucaccuuuuuugggagaucagggaguucccacugaaccuggaaugaacugauuagggagauugcugccaagcaaguccuugggauccuccugacugucuuccacugcaggaauuacagggcuuuuaauaaaagcuuuagauacccaaacucagauccuuauaaacagagcaaacauuuuauccauuuacccauuucucuggccccugaguggauggauagauggauguuguuuugcuugcuuuuccuuccuuccuuccuuccuuccuuccuuccuuccuuccuuccuuccuuccuuccuuccuuccuuccuuccuucucuccuucucuccuucucuccuucccuccccuuuuccuuuccccauccuucuuuuccuccuccuuuuuauuuuuauuuuuuuuaauuuuuguuuuugagauaggguuucucuguauguuucuagcuguccuggaacucacuguguagacuagguuagccuagaacucacagagaucugccugccccuguccuccaaguauugcaauuaaaaguguauguaugccacagugcccagccucgcauaugcuuucuuaucauagguggccuuuuacaucccauggauacacucauaguuuuuauuugaaauaagaauauuuucuaauuccaaauauuacuuccaguggggauacugagccagccuuuuucagugauuuuauuuguuuuugauuuuagauaggguacgaugcagcacagggaacuugcagagaucuguaccagccuguccuugucuucagugccaugauucaguggaguuuuuaaagcuguaucuuucagucaauuuaguuuccacaacucaggauuuuuuuuguauugauauaauuuauuuuuauuuuuauuuuauuuuaauuagguauuuucuucauuuacguuuccaaugcuaccccaaaagucccccauacccaauuuuuuugagaaaauuauguauguguucuguauuuacaucauuucugucccccucucuugucucucuaacaucucuuguguuccccucguucagauucaugauuuuucuccuuuaauugcuauuguuuuacacacuauugaguuuguuuacuguuguuuguauguucacgugguuagggcuuacugcuugggauuagauaaccuaucagggacuuaucuuggagacagcuuauucuuucucucuuagaugccguugacugccuguagcuuuucauguagagguggagcuugugaaauguuucucagcaauguuuucgaguuaacugguuguuauugugcuggucuuguuugggcaaccauauuguugagauuucacggguacaguuuugcugucuuauauagaagauacuaucuugcagcaggcauccugguccuguauuuuagaaucuuucugcuccuccuuacuugauuucugggaacuaaguaaaggcguuguguuguagauguaucaguugagguugggcauuccauugacacuuuugcucuguaauuugaccaguuguggaugucuauaguggcuuccaucuguugcagacaaaagcuucuuugaugaggggugaaagcugcacuuaccugugaguuuaaggacaagcauuuagaaugcaguuagaaaugaugguaacuuaggaaaguggcaguuauagguucuccacuagaguccaugacuuacccagaaaugggccauuggcuaggucuacaguaccaugcauaaauuccaugcuacugagcagccuuuaaguucauuuagacagcuguugguuaucccugguugaaugugucauuguuguggcauugaagaugccuuuguggucaagaguuauuggggcuccuagacuuuauaggugaagaagguuguuuauugcucuucuccuucccucuuggcagcuugcauaguaucuuuugaugcuauauuuaagcucugggaggcaacuaagggcaauggaaaucaccuguauuguuugggggagucucuuagaccacccuaagcaauaccuugaggugggauuuugacaucuggcacugggguuuuuguuagacuguggcuuggggagaccauugucguuaugugugauauaauuccauugaaaauuacguguguguguguguguguguguguguguguguguguguauuucuauguguauguguauugugcauauauuuuugaauaagcauguguuucauuaugguauuuugaaaccuccauaguguuauuugacucucuuuccuuuuucuuucucuguaguaccuucccuuucccuccccaguuaaaaucuaccgccauuuuucucauuccccuuuuauggugccuaaacuuuaauaaaaucucuguaauugcaauuguuuacugaucacauucaugguuguaagaucuuuuauuuacuuuuaguuauacaccaguaugucuuuuacuagcgaauuuucaaugauuuacauauacaaagguagaacaaagaauuuucuuggaacaaaaggugacauaaaguuaugcacugagaugguauacuggaauguauuuaggacucuaaacaaccccaucuucaauaaauagcagauauuuuauuuauuaacagaucaaucuuauacccuaaggaaaguguuuugcuauugucuuuucuuaccucuaauaugaugaggcaaaauuauauuuaaaaucuacugugcuccuuuauuuauagugaaugauuucacagucaggacugugaugauuauggagucugcaaaacagucucuaauuaauaaguucuagcaucucagagcauccugacaaccagucaugggcaccaccagacuucagagagaagugggguuauacaucaaauaagaugaugcuguucucaugaaacauauaacauguauaaauuacuuaagcaucaucuugaucauguauuaguucucuguggcaaagcauuuuaaacauuuucuuuuguuuuuggaauacauagugcacccuggcuagcucaccagaacugcucuugagaaaugucuacuuaggucucuugcccauuucaaaaucaggauauuuagacuccuuugcuagugagauuuuggauuucuuuauauugucagaccuuuagcuugcaaguauuuucugccauucuauagacugucucuuuaagucugauuaugcccuuuguugugcaaaagguacuguagauuuaauuguauucuuucacccuuuuaaaauacuuuauuuuaauguuuuaaaaaucucaguugauacacucuaacucagucacauugguggucuguauauauuacuggcaaaauaaaagaaggcauccuuuggcuagaauucuaauucaaacucaagcaucuuauuaaaaugaggacuagucuguaucauucuugauaucaugguuaagaaaauauuaucucuaauaauuauaagucaauagccucaagucaagucuuuccacuuuaucauaguaucuucauggaagaauaaaauuucuuacgaagggaauauaauagcaugccucucccaaaccaagaaaacaaaaugcccucccccauaccaucaaacugaaaccaaauaaagcagacacaaaaucuguagaguuuaguuauauguugaucugaauaugaggcucucguggagugguagaaauacccacugauaacugauuuucccucuuccugcaggcagagggcauucaauuguuaacccuuccucuaguagcuagguuuccauccauccauccauccauuaaaaaacgacaagauaaaauaaaacaaaaacuaucacaucaaaguuggauaagacaaaucgacagaaggaaaagagcccaagagaaggcgcaagaaucagagacucauucagacacccaggaaucccauagaaaacacuaaacuagaagcuauaauuguggaguauauucaccagacaugacugcucagacauggguuuaaagugauagaaagucuuuauuauuuaguauuauuauuuauuguucagcaucucaguauagucccgagccuuucuccaggugagcuguuaacccacgcccaggguugacauacuucagcuaacaagaacaaguagccagaagcagaauuauaaaagccaaagagcaaggguaguccauguagagacuuuccccuaacuauggacuuugauagauuaggucuuugguuugguuuuggcagguggugcugucuacgugcugaguuuuacagccuaaaggguacuuugcucauggagucaguucugcuaaggucuugggguugacuaaggucccucaaguccuuccagauccucaccccuucccuucccaccuaacuuuaacauacacacacacacauacacacaagaaagaaagagagagcgagagacagagacagagagacaggucagagagagagagagagacagagacagacacuugguacagacccaugcaggcccuaugcaugcugcuucagucucugugaguucguaugagcuaaagcaacauggguucauaaggcaaaacccauguugcuuuagagggccuuguuugucuuccauauccccucugacucuuuuacucuucccaccuccucauacgauauccuaccugcaagauacucuaaggcaaugguaccacaaagcuugugaaaauagacaaccaaucacugauuugacuuaagcuuuacuccagagauggaacucauacuagacacuguuuaggugaccaaaaccugagauuagauaguccagggaccuaaaauaaaaccaaaaaaaaaaaccaaaaaacaaaaacaaaaaaaacuggucucaaaauaaaagaaaaaauaguaaugaaaugacucuuagugacauucugcuauguuuauagaucagcgccuugcucagccaucaucagaggagcuuccuccugcagcagaugggaacagauacagagacccacagcuacuaugcagacguugaaagacuuuggaacacauccuuaaauaagcuguccccaucaaauucuucccaccaaaagauuguuuuuauuuggguuucugguuacuuuauuuccauaccugaauaguggguaauuuuuuaaaauucuuuuuugguggcauuuuauuuuuguuuuaaauacguaugucagggucagguuucuugggaccucuaggaggaacaugaacucccuagcuccuugucuuaugccgggcaaucugccaccauuucccuugagaggcagaaguaugguguugcccguuaaacuucccugaguggagacaucuuacucugguggcuuguuucuguccuugaaauguguauauaaaauacauuuuccucuguacuuaggaaucaaguuaugugugggaaggaaggcuaaaauuuugcccuuuucuuuguucuugaauaguuaaauuguuuuuuuuucuguagaagaguaagucaaaggaaaauauuagagauuaaaaacugucucuaccuuguaagacuguugagagaacuaaaugaacaugugcauggaaauuugaguguaauugugucuaguugcauuugcugcucuuagagagacccuuaaguauugccuuguuacaaauaaguuugcuguucuuuuacgcaguugauacacuaaagaaaauugacauuccgucugucuuuauuggugaaucaucagcuaauucccugaaagaugaauucacauaugaaaaaggguaaguauuggauaucaaaaacacuauguaacuucagacugucccuuauuguagaauagaauuauauaauuguaguuauguugacauuugcuuauuuauuuagagacaaggucucacuauguugcccugacugcccuggaaaagauuguuuuauaauaugcuaauagauugugcuaaauuaucucuucuuaauacaagcuauuguaaaaacuuguuuuuacuugauuuguauuuuguauuaaaggcaaauucgauuauguauuaaaauuguuuucaugcuccagaguguugcuaauguuggcaucagugcugcuaagaagauagacguuccauuuugcaguuucuuuuuaagauucugaugagagauuuuacuguuugcaaucacuggcagacucuccuauuuuuuuugcauuugcuguuaagaacuuauuugcaaaaaugaaagcuuauuuuauauggugauauuaaucugugauugccaaaacuaugguugacaaucuuucuauuacacauaugaacagcuucaccuuuucuuucuaauuuuucuccuucaaguugcuuucugucuuccaaaugcauuguaaauaccuuuaaugccacacuaacuaguagggagaguggguauuugccuuauucguuaaugagauaauuuguuucaaaauagguuucuagguuguaaucauuuuaagaaaguaucaguccuacuuuaauuuuugaugcuacugucuaguuauuuagacacuguuaagaauaauagcauauuggggggacuggagaaauggcucagagauuaagaggguauacuaaucuugucaaagacaugaguucaauucccagcaugcacaucaguauccaauaguugaguugaucacagguuguucccuuaaguguauggauagaagacacuguugugugguacuaaaggcucuguaauuggcugauguggguugucaggagauauaagucaagguucugugugucaacagggguuggggaauuaaaacguuguuguuuauguagacuuugauguuggguuugaaauuagcugaaaacacacaaagggaggauaaagcuuauuuucuccauuccauauuucacuaccucaaagagcaaauauuggcugcaaagccuuuggaguuuacaguauuuagacauggucauagaaagcaaugugguaagaaauugcuaaaaacuaaaaaaaauauuuaaauaccucuucccacuccucaaaaauugagauuaaccuagggugaaucuguagguucagcuguggcgauagaaaaauaggaaggaagcaguucucaaccaugaguaauugcuguuacauguuaccaccucuaccacuagcaguuugguuaagaaagaacuguaucuugaauaucuauugacauuguaacuuaauuaaguuuguauugcugugauaaaacaccaugaccaaaagcaauuuggggaggaagugguucauuuugcuuacacuuccaaauaacaguccuccacugagaaaagucaaggcaggaaccuggaagcagagguccugaaggaucacuguucacuggcuugcuccuaauggcuuacucagccaggacaaucagcuuagggguggccccacccacaaugggcugagcccucucauaucaaucauuuguuaauuaaaugccccacaggcuugccugugggccaaucuuauaaagacauuuucucaauugugguucucucuucucagauaacucuaacuuguaugaaguuaacaauaaaccagccaggacagucuguaauucaagaugcuuaaaauacuuaauuaauuuuagacuauuuacaagccucauaauacaucuugacaauagcuaaaaugauuuggaacaugguaggcaagcauacauaggacuuguagaacuuuaaauucaaacuccagaccauuaaaucaguguggcugggaaugucuguaaugaauuccagucuuguucuuauaaauagcauuuuuauucuaaaguguuaauuuuuauuuuauuggaacuuccugauuugcauuuucggcuuguuucuucuugccuggcaagguauuucugagcaaucgaacacguuaaaucacaggagauuguuuguuuugucauauggggaaaaauguauccacgucauaggcaugaaaaaaagaaaaaccagaauagaugaaguauaagcuucuacugaaagauauuaaaccgcucuauugguuaaagugaguuauggagcagucuggccuauacacccagcacuguuagauaguaugucugugggggugugguugugacauaccagcagaucagugucucauguaagugguaccauuauuguagcgcagaggguuuguggcccaaacuggaaaauuauuuucgagauggucuuuugcuaaaagagaugaucaaauagguuggucaaagccugaugcugcugcuuuuuuuuuuuaaaccaaugcuauuaucauuuaaauauuuuauucaaagcuacaaaaaugcauuuaaaauaauugaucaucuucuauucugcugaaaagugauacuuguauucuagcaauccuaguaaguuuuggaggguauuuacaauauuugggaggaaucccugauacugcuuauaucuguugcaguuuaguugaauuacuuagaugcaaauuugacaaaugauagcaguaaaaacagcuugggaguaaaaauauucauuuuuucauuaguacugugaaacccuaaagacuuuuaagcaauuuuuuauuacaaaaaaauuauuacuuuacuuuaacugacuauguggcauuaucaccuuaggaaacaaaucaccuagccgugagcagcaggagaccauggcuaacccugacuggucuaguacuccaguccuccccguggagagagcacugcucagucuugcauaccucugcuuagacuaaggaguuguaaagcaaucuuugcauaccauguaaaguguggccauucaugaaauacagugaacuuaacugagcaucguuuucaucuauaggauauaaccaacaguaugguuauaucucagaggagaagaaaugugucccaucuccacaacauacauauuucuguaacucuuucagccaaacaguggagaacaugaaaauguagaaaaaauuacucuuuggaauuccuugaugagauuuuuuuucauucugcaucucauagacaaauguagggauccaggggcugugucuauuguaccagguacaaugggugaaguacauggggggggggcaguauaauuugugucacuauuuacucuagagcagggcuugucaaccuuuggguugcacauaccagauauuuuggauaucagcuauuuacauuaugauuuauagcaaaauuacaguuacaaaguaacaaugaaauaguuucaugguuggggucuuuacagugcgaggagcuauauuaaagggccacagaauuaagaaggcugagaaccauugcucuagaauagcuguaaaaaaagauguacuuauuuuuauuuuauauucauaaguguuugccuacauacauguaugugcaccaugcacaugucuggugcccauggagguucucuguaguuggaguuagaggugacugugagucacccaguauagaugcuagagauugaacccuguuccucugcaagaccagcaaguggucuuaagcauugggcuguccucucuccagccucagacuggaagaguuuuauguugaugggaauaaugaaugaggucgagguuuuauuacaugcuacuagaggggcuacuguuuuuguuguuuguuugcuuuuacgguuuauuauuuuuauuuucucuguguucuucaugugugugucuggugccuguagaagucguaagaauguauuggauccuuguaacuggcguuaugggugguugugaaccaucauuuccggacugggaauuaaaaucagguccucugcaacagcagcaagaacucuuaaccacggaaccaucucugaaccaucccuaugauuguuuuugaugcugauguuacauguaaaauacaacuuuugcauaguucauuacauucaguauauaauacuccuccauggguuguucugaacaauaugcaaaauagacuuaaaaauguaaaaagcauucccuaaauuggguguucucaacuuuccuaaugcugccacccuuuuaacuacaguuuaucauguggugacucccaacuauaaaguuauuuucauugcuacuucauaacuguaauuuugcuacucuuaugaaucauauguaaauguauguauuuucagguggucuugggugacccuugugaaaaggccagucaaccccuaaaggggucacaacccauagguugugagccacugccuuaaauuauguaaaucaugucuuagaaaaugagugugcagaguauauuugaguuuaauggccaugucauuaauuuuuuguuuuaauguaacuugauaauuauuauuaacucucaauuauuaauuuuucuucccucuaggggccacauuaucuuaguuccagaacugagucuuccuuuggaguacuaucugauccccuuccucaucauagugggcaucugccucaucuuaauagucauuuucaugguaaguccguugacgucuaauaaugauaaaaguacuguggguagagcuaaaaaaguaaguaagaauauguugaauauguguuuuuauauaaaguucuagaaaaggcaaauauaauguggaagaaaaauacacugaaagaacauuuauugugcaugggaacuggagauggguaaagaauugcugaaaagguaggaggggccuuucccagcugagaacccuuuucucuguaucgagcaagcuguaacacacucgugaauauggcagccaugucaugucacucaucuucuuucauccaacuccucuguuguuuccauccuugauaacacucccuaaaccucagaggacauaucuagaugucccuuuuagggcuagacacucaacaagccacguguuguuagaauuuugaacaucccugcaaaauugccucccacuaaaaaagaagcuucuuuggccaaagcugacaggagcacuaaccaguggcauccgcacuaagauuuagaaagugauuugauaggcauagcaugucuccuuagcaaaacaaaagcucagcuuccccacuaaggucuaugauauccacagccacaagaguuuucuuucuuuguaugcauguguguguguguauguauguauguauguauguaugguguauaugugugguacauguaugugaguauguggaugcuugcucucauauaugcaaauguagagcccagaggaagauauuaaguaucuuuaucuacucucuaccuugccuugacacagggucuugcacuaaacuaaaggcucacuguuucagauagucuagauggccagugagcuuucagaagcugcuuuugucuguguacuaaugcugggguuacaggcacaugcagccguguuugcagcugacagguucucaugcuuguacagcaaacgcucugaccagcugagcuaucuacucaguccuuagauaccagcuuuacaggucuacaguccuagacaugauuuuucuccuguggaauaggccccaaauccagugaguaaguauuagguucccccauaguaguaucagucacagcagugagcacauguugcuugccugcucuguaucauaugcaagguguacuaaguguagcuuuacgaguaaacaguugaugacaacucuccccaggagccugaauaacaccucuauaaagcagguaggaagccuucaccucaguuuuagcuuaauuuccuauguaauaucuaugaccaaaguguauggccacgucagcaaugaggucauauuaacaauguauccaugauaggcaaccaacagcaguggaaauagccuggauuacuuuggagaccucaaggauacccagcuaaugacucagaggacaguagcucauacuggcucugggauuuguacauaauccaucauauggcuucugagaguggcuuguuuucacuguggagaguaccuccauucaaacuuuaaaagcauuuuaauguuuuuaugcauguauauauuguuuguugaauuuacuugccuuuguaacgccuucacuccuuucucaugccucucccccugcauugcuccuuagaccccuuuauuucaagucuuauguauauguguauauucaugauuuuguauaucuauauaagaucuaggaaccagaagugacauguauuugucugugauuagcuuacuuuauuugauauaauuauguguagcuacauaauuuucugaaaaugcuguaacuuuuauuggcuaaaaaaggugguguguguguauguuacauuuuucuuauccauuucucaguuguuagcuaccuacauugguuuuauacuucagcuacuauaaauauugcugcauuuaacauugacguauguguuucucuaugacauguaugacaugucaacuuaaagucuugaguaaguucucaggacgacuauagauggaucguguggaagauaaguguuaggcucuccuggaaaccuccauauuaauuuccauaauggcuagauaguuuacauucccacuagcaguguguaagaccugccaguguuugugauuauugguuuuuuuaaugacugacauuaugauugugguaagauggagucccaauauaguuuugacuugaauuucucugaugguuugugaaguugaacauuuuaaaaugguauuagccauuuguauuuacugccuugagaacugucuuuucauuuuuuuaaccuauuuauugauuggguuguuugauuucuuguauaguuuuugaacuuuuaauaaucuagguauaaauucucugucauauguacagcuagggaagauguuucaaucauuguguaggcuaggcuauuuuuuuuccccacagaaguagcuguuuacuguauacagccuuuugauuucaugggauucugucaauuguuggcuuuauuucuugaguggcuuaaguaccauugagaaauucuuugccuuagcuggaaucuugaaguguuuugccuccuuccccccauguguguauuguguauguguguaacugugugcaugcauguggaggcuagaggacagucuuggaugucuauuuuuucuuuucuuuuuuuuucuucuuuuuuuuuuuuuugacugaacaugauuugguaguuuauaagagagcaccguggaagcccugaggaaugcagggcucuccacuuguucaggggaccaugguuggggauauauuugaccccacagucaucaggaaugagccacugguauuaaaccuguggaagccuuacuucuuugagauguggaucuucugauaaccagggaacuugagccucaaucacauguuccuuauucugcagcuugguccaagugaugguagccacugugauccuggucacugugaccuguggcuuccugaaggugccacacauaccugucuggacccugucagauccagcacuggacaacauccuguugguuuggaugacauggcaaggaugagccucacuuggauaugaaagccauccuugccacauucuuucccauguauuuguugcuacugaugccagcgacaucuggugcuucagaagagagcuguucauauucauuugacaugauguggccacaaagugggaagucaucaacuuuugccuuccuccaucccaagucaaagaugugcaucagggccaccccuguggcccaugaugacccugggaucaucagaagaaaagcuuuuagguuuuuguuguuuuguuuuguuuuuugagguuuuuuuuucuuuuugcuuauuuuucuuuuguuguuguuguuuuggggggugaacuugggggaggauuuuacuagcuuagaauucaccugguaggccaugugagccccacgacucuauugacccuggcuccccagaacugagauuaugagugugugccaucacaaccagguuaguuuaugugggcuuuggggcucacacucagggguuugugcuuguacuuuauugacuaagccagcagcucucaacccguggauuacaacucuuuuggggguugcauaucagauauguauauaaugauucauaacaguagcaaugaaauaauucuaugguugcaggucacuaaaacaugagaaacuguguuaauaaguugcagcacuaggaagguugagaauuaagcuaucuaccuagcccaaccuuuucuucagaguuucaaguuuuacauuugguccacuuaaagcugauuuuuaugcagaaugaaauaggagauccgacuucagucuccuguauguggauagccuauauauguugcaccauuuguuaaagaggcaucuuuucucuaguguuguuuuaaaaacauuugucaaaacucaugugguagaguuguguggguguauauuuggguccucugcuccacucagcuauuugucugguuuuccacugguaucauguuguguuuacugcaguagcuuuguaguauagcuucaaaucagguaugauggaaguaaaaugucuccagcaucauuuauuuugcucaggauuucuuuggcuuucauuuuguguuuccauauguaaaucuaagucuauguuuucuuuuucugugaauaagaauggucuuagaauuuugguaagauugcauugagucuauagaguacuuuaagugcugcauguuaauauuuuuguguggugugcacacacaugcauccccugagccuuuaguuuuuacuuccgcuccuauccugugcacucaggcugguuguugaguguaucccagcagucugggauauggccaugcccagcuaucuauccuuacaauauuucaguguaccauuugcucaucugugucuuuguggcuuacauucucucuucuggcugcucaaguauacuauuggugcuuuccacuguguguucuuuuucuuucuugaaaauuucaaauauuucuauuuagcuucuuaaauguagauuucugacccuguuuauagcauuaugauuuuuuauccauauuuuuaacuuucugauuuuucuucucuugcugauuuuccccuccaguuucugaaaugauuaaucugcauguuuauauuguauuuaagguuacuaaacaauuauacuacuaaacuuuuagaauuuucuuuaagcauuuaauucaggggcugaaaaauuaggauauuuuaauggacucaugaugccucaauauucuuuaugcauauuuuauaauuuguauguuuagauaucuaguuuuauuuagcuauauuuuacuugaaugcaacauccccauuacuagucagcauagaaaacaaacagcaucaaaccuuauaggaucuagaaauauacuaaaauagauuagaccucagcccacuuaaucaccuaugaucauaaaauaguaaugggaagacuaauucugaauauguugugaagaauuguuuuagauaauuauaaaaauaauaaguaaaugaaaugaagaaaacagagaaaaggaaaaaugaaggagaaacaagauuaaaaaaauuuuuuuucugaggaacugccaaacugauuucuagagugguuguaccagcuugcaaucccaccagcaacggaggaguguuccacuuucuccacauccuugccagcaucugcugucaccugaauuuuugaucuuagccauucugacuggugugagguggaaucuaaggguuguuuugauuugcauuucccugaugauuaaggauguugaacauuuuuucagguacuucucauucgguauuccucaguugagaauucuuuguuuagcucuguacuccauuuuucaauaggguuauuugguuuucuggaguccagcuucuugaguucuuuguauauauuggaaauuaguccccugucagauuuaggauugguaaagauccuuucccaaucuguugguggccuuuuugucuuauugacagugucuuuugccuuacggaagcuuugcaauuuuaugaugucccauuuguugauucucgaucuuacagcacaagccauugguguucuguucaggaauuuuuccccucugcccauaucuucaaggcuuuuccccacuuucuccucuauaaguuucagugucucugguuuuauguggaguuccuugauccacuuagacuugagcuuuguacaaggagauaagaauggaucaauuugcauucuucuacaugauaacugccaguugaggcagcagcauuuguugaaagugcugucucuuuagaugguuuuagcucaauugccaaagaucaagugaccauagguguguggguucauuucugggucuucaauucuauuccauugaucuaccugucuugucgaacuucguuccuccuuagaauggugaacaaaauacccaugaaaggaguuacagagacaaaguucagagcugagauggaaggaaggaccauccagacacuuuccuacccagggguccaucccauaaacaaccaccaaauccagacacuauugcauaugccagcaagauuuuugcugacaggacccugauauagcuaucucuuaugaggcuaugccagugccccucaucuauuggcugaaacacagggcccccaaugaaggagcuagagaaaguacccaaggaccugaaggggucugcaacccuauaggaggaacaauaugaacuaaccaguauccccagagcucauguuucuagcugcauauguagcagaggauggccuagucagccaucaaugggaggagaggcccuuggucuugcaaagauuauaugccucaguagaggggaaugccagggccaggaagcaggaguggguagguuggggagcagggcaggaggaagguauaggggacuuucggagaggaaacuaggaaaggggauagcauuugaaauguaaaugaauuaucuaauuuuuuaaaaaaggaaaaaacaauuggaaaauaacauaauacaagggaguugaaaaaagcaugacaucacauacaacucaagaucguagauuacacaaucaagacagaguuggaaaccaaaguuagauaaaagaaaucgaauauaaacgcuugggugggcaugacggugcagggaguaaggguuguuacaaccccuggcaaucugagcuugaucccuggaacccacauggugagaggagaaccaacucuugcauguguggcuuccacgugagcacuguagcaugaguguggaaaaaaaaaagcacacacuaaacaaaacauaacagauacaugugaguuaaaaaaaaagguaaaaugguauuaaaauuauagcacggggggggggggguagagggggaaucauggugggaaaggcaagacagaaaagaaaaacaucuaacagugaaaaggcaugcaacuaggagaauguaugaaugggaauauuauuuuaaaaaaucaaaauuugcugcuaaaacugauguggaaagggaaaaaaguaaaaauaaaagcaggcuagagcaauggcguggucggcauagugcauacggacaagcacaaugaccaggcuucgucuccagcauaggcagccgaagcucccugcacugggguagaugaagaugacgucaucucugugacccaucuggccgugugcaugagcuccaguuucacugugagacucuggacucaaacaaacaaacaaacaaacaaacaaacaaaaaacccaaaccaaacuaagaaccaaacgaccacaagaaacaaaggccccaaacaauaagguugauauuguuuucuccggcuuccacauacauucauacacauguaccucgacucacauguguauacacacacacacacacacacacacacacacacacacacacacacacagagagagagagagagagagagagagagagagagagagagagugagagagagagagagagagagagagagcaaauaaaaauagggagcauagcgggccaguggggaauggaauacuggacuccuuccuaguuauauaugcauguuguguuuguuguuaggugccauuuguagcauguacuucuacuauccaacuuuaauguuccugggugggccgugcuaucagccaccugcccagguucucuaggauucguggaugaaacacacacacacacacacacacacguucuuucuuucuuucuuucuuucuuuuuuuaaugguuuuuuaagacaggguuucucuguauagcccuggcuguccuagaacccacucuguagaccaggcuggccucgaauuuagaaauucaccugccucugccucccaagugcugggauuaaaggcgugugccaccacucccagcacacuaguucauuuuuuuuuuaaguuugaaacuuguugagauuuacuuuugguacaaugaaugauauguuuuuuuaaauuuuuauuuuuauuuuuuuauuagguauuuuccucauuuacauuuucaaugcuaucccaaaggucccccauacccaccccccccauccccuacccacccacucccccuuuuuggcccugggguuccccuguacuggggcaucuaaaguuggcaaguccaauaggccucucuuugcagugauggccaacuaggccaucuuuugaugcauaugcagcuagagacaagagcuccaggguacugguuaguucauauuguuguuccaccuauaggguugcaguucccuuuagcuccuuggguaauaucuuuagcuccugcauugggggccaugugauccauccaauagcugacugugaucauccacuucuguguuugcuaggccccggcauagucucacacuguccgccuggcccgagaggcacuaguucauuuuuaaccugccuuacuggcucaauagcuaggcucuucuaauccucccauggcuaacaugcccauacuuuuaauccuaacucagcacuucuaaaucuuccucagcuuaguugcugguuaccguaugugaagcccauuggucuugcugggaagacgcuuucgggcugcccuuccgugggccacuuuccccuuccaccuacauucuggaagacuucucugccgcucugagucuguuccaucucuuucccugcaguaucuugauucuucuccucucuccuagucugugggcaaaaguaucuccaguaacuuucuuuguguaccauagaccucugcuggucauaguuagcuuagcagucugugagcuuggcaaguuuucucacucuuugagacuccuaagguuauauucaaggggguggcuaaugcucuagcagggggcaucucaaaugugucagaugcauaagcagcagccauagcuuugagaugugugcagaggaagaaccugcauucguauguucacgauguauguacuacuccccaugcugggggcucuacuuccgaguucuuggguucuguggcauuggcuaccagauaggugagugcagagcuggagcccacacucaagagcuaucagacugugugccuauuuccauugagaaaccugcuccagccaccaaaggugggcucauucacugaacccccugagccaacccuccuguagccuacagugucagcuugucagcaacugucccuccugcuuuuuaagugucccagggcugaaccuugugaaaugacagcugccuggcuuguugucuguucucaagccucccagucuagcucaguuuuaaauacagauucauugucaagaacucacccccuacucauagggugauaaaaugggguuccucucgauuaccucacugguugccagagguaucauuuuuaccuaaggcagagauugcauuggagguggcgagggccguagcccuggggauuuaggacaagucuccucuccccagagucacucagcuuaguuauuagcccuguccucucucucucucucucucucucucucucucucucucucucucucucucucucucucucucucacacacacacacacacacacacacacacacacacacacacacacacacacacacaccgaaggccacagcuacaguuguuuggugcagcuuaccuuuucucagucucacccaucucuuccuuccauugucuugcugguucccucacugccauuccaaguuucugaggcugacuucugcuuucugccucuguagucaguuuacucugucuucuccugaugucuccuugaccagucaugugcaggcagauuaccauccuccauuuuuccuuggaagccucaacuucuuacuaauuauguuuuuuaagaaauuauuuucagcauaguaauacagugguuucugugguucauauacugaaugaguauuuuaagagaauuucugucauauguggagugaguucucuuuauccuuggccaucugugccuugcauuguuguuagauguuuaugugauuuguccuuccaagaaguggacuuaaguucugcauccauaauaaaccagacucacacugcuuugggaucuauauauucccagugaaaaaauacauacaaauucucuuuuucuuuccuuguuugauuguuuguuggagacaagguuucucuguguaacagcuccaguuguucuggaacucacuuuguagaccaggcugucuuugaauccauagacaucuaucugccuucuuuugccuucucaaaugcugggauuaaaggcauguacuaccauaccugccuacaaaaacaaaacaaaacaaaacaaaaaaaaaacaaaacaaaaaaacaaaaaaaaauccuuucuucuuuguucuuaaauuaacuuguauuacccuuauuuacauuguugucccuuaggggauuuaggucaagccuauuguuuuuuuuuaagauuuguauuuauuuuguauuuuuuauuuuugagauuauaauuugguuauauuucuuccuuaccuuuccucccuucaaacucuccuauauacccuuccuacuuuccuucaaauucauguccucuuucuuuaaacuaauuguuauucaugcauaugaguaugcauauauacaauacauacgugcauacacacacacacacacacacacacacacacacacacacacacauauauauauauauauauauauauacauacacacacacauauauuccuaaauauaaccuguucauauaguucauauaguucauauagugcuucuuauauguauguuuucaggcugaccauuugguauuagacaaccugucagugugcucuucucaucucccccauuuccagcuuuccucgggugcuuguaauucuuuguguagccucacgggcuuuuugccauucaguuugguguauuuguuguagccaucuuuguucagcucacauuugggcaggugucuuggugacauuuuacgggugcaccuucugguauuacuaggagauacaaccucacaacaaacuuccuaaaucuuuuugaccccucuucugcaguguucccuaagacauaggugaagggaguguuuguagauaaauccauugaaacuaggcuguacaacuuauuugaagugucauccuuauuguaagacauuucuuuuguuuuuuucuuucuaggugaaggggacucaguuguagcuuuuuucuguuuucuuucuuucuuucuuucuuucuuucuuucuuucuuucuuucuuucuuucuuucuuucuuucuuucuuucuuucuuuuuuuugccacuucuguauuaagagagaauaauaauacauuugcaggaguaaauaggcauacuugccuaugucaguuguggcugguauucagcccacaguaucucaaagcugcuuucagauauuugaguacuuaagguugucuaauacugugguccagugaaaagcuugcucguucuccagugaguuagaguuucaacuucauucauaauuuaugguguuuucuggguugcagagauucuaggugguaaagaggcuucacuagaaaccuguuacccacuggguguuguuuugugguucauggauuacuuuauugaaguuuuacauuucugacauauuuuuucuguaacuuucauauauauuucuaauuuaguuguacuguggucagaaaaccuguuaugaauauuuaggugauccuuaaacaacuguucugugacauccuuuuguaaucauguuuuauaaaugcuguucauacaugugcaccaugcagguacauguccuuccauuuaaguuuguggauuugucuaacuuuaaaaauauaauucacauaacauaaaacugacauguuuaaaacacacaauuuagugauuucaguauauucacagaauuguacagcuuugauuagaguugucuguuguuuugcauucuuagguuuucuaaaacaaugcuaagcaguagaacacuauuauuuuuaauuuucugguagccaaauucagcaaaguuagaagagguuaauuuaaauacuguguuuuuuaaguuuaaaauuuuuugaaccuucaaagcacauauauagugugguuuuaucuuucaguaguucaucuugcaggcugcugucugucugucuauucugagagcaacccucacuuggaggcugugcuucaagugcuugucuguggcacgcagugagagcccaugcagccccacugcuucaauggauguaaacugcuguuuacuuagaagucccgaaggcuuugaauucauguauugcucccauaguuuuuagcauauucuugcugaauauucucuuugcuauuguuuuacuggguacauagcuuuuacuuuaauauguucacaugcucccuacccccuuuaaagaaaccuuaagguagcuucaguuuuaacuguaucuuguaaauagcauggaauuggauuguuuuaauuauacacuuccuuaaaaacugauggacuuacuccauugacagugguuauagcuggauuuggauucauagcugcauauuuuccagcuuucuuuuauguaaauuuggauuccauaauuuuugcuuuugguuuaaaagcuuauauuucuggauuuuuuucuuuucuuuuuagagucaaggacugaugaaagaaucuuguauaaauaagucaaccauucuacuacugaauuauauuccuagccucaauaaaaccugcuuaauuuuugaugucuuaguugguuuuuucuuaaacauuuaaaaauauuaagguaugguugacauaaaauaaaccacacauuuaaguuguacaucauaauaaauguuagcacuuauauaauauauauauuuaaacacugcuauacuaauuucaauauuauaaucaagaugagauguccaucacccaccacaaaauguuuucuguuccuuaguagccccuacgacucgcaugccuagauaaccacaaacuugauuuuuacucacagugguuuguuauacuaauggaauucagagcucugcucuuugugucaucucccaguauauguuuggagauuuauguaaacuauuaaguauauugauuguuuauucuuuuuuuuuuuucugaguuguauuuuauacauggacaccagaagagggcauuggauccucuuuugaacuggagucacagguggcuguaagccuugaugugggugcuggaaacuggaccuggguccucugcaagaguugcaagugcucucucuuaaugacugggcuggcaaaguguuuuauagaguaaggcuugcugccuggugaccugaguuuggcuucugggacucagaugguagacagggagaacacauuucucuaagauauccucugacuuccacaugcgcacuguggcacauguguguaugcacauauacauacagaacagauacauaaauaaguaaauguaguaauuuuaagaaguuaaaauguauuuaauaauaaauucaaauuauaauagauaaauuaacaaaucacugugagcuuaaugguuuaaucaauaguguugucauuaggauugaaauaaauuaaagugguuuuacagcaucuauccagaaauuuaaaagagauuauuuuuaucucaaugucaauuuuuauuaguauauuuaauaucugaccagucuuuuuucuuucuuuccaucuuuagaucacaaaauuuguucaggacagacauagaaacagaagaaauagacuucguaaagaucaacuuaaaaaacuucccguacauaaauuuaaaaaggguaagugaauauuguuguguccuaaauauuaacauauaguguuucagaacacacgauggccauauuuacuuaauaccacuuucugagucucuacuauauaccauucuuaacacucacuaacauuaauaaugaauauuugggaaagauuuuuuauguacugguagccugguaaaggcaggaagaagguaugggauugguauaaaucuuaauaaugaaacggggagaaauauacauugccaccaccaugugccaguagcucuguauacuaucauaggaaaaaaauacuuucuugcacuaagguagucugcccucauugacauuccuccuguguucucaaaugcugugauauaugcugcuguauugcucuuaaaaccauagguagcuauuacguguuugcauuuugcaugucauguaauuuucauacuaauaugaaauggguaccauugguaucuuuccauuaaaugcaaggaaauagagguuuacagagguuugcacuguauugacagagcugggaaggagucuggaauuuauacuauagccaaugcucugugcuaagugaguuucagauguagguguauacuuguucaucaugauggcuaguacaucucagacuacauuaaaaacauaaaaauaaaauauucugcuuaaagacuguuuaaagaagguaaaauagagaaggcauuaaaacagaguucuagggguuggagagauggcuuggugguuaagagcacuggccacucugccaagagaacuuggauuuaauuccucagacccacauccaucugugaaugguauaucccaggaaaaucuaguacccguuuguggcuuaccugggcaucaggcaugcaaaugauguugcccauauaaauaaaauaaauaagacagugaaugaauaaugaaaaagcaaagcuuuauuuuccauauagcuaaauguuuuauuaccauuuauaauuuuaucuuguuauaaauauaacaguaaaaacugggaaaacauugaauuucauuuuuuaaaaggacauagaugcuauaaaacugcagaacaugugaggugaguuauuuaaauuuguuuacagaucauacccaguaugacagucuaccucuagagaucacuuuuaaaagcuccaugguuuugaauaugaccccaucuuuuaguugaaaaaguuuucucauacaauauauucugaucaugcuuucccuccuccagugucugccagcuccccccaccgccucagugaaccaacuccauguccuuucuuucuuuaagcaaaaccaaaaaaaaaagcccugaagaaauacacauacaugugcacacacaugcacauacacacacucaaaacuccacaaaacacacacacacacacacacacacacaaaaugcucaaacaaagcaauaugugucaaaaaauauacaaaaaaauagcauugagcuugcuuuguguugcaaacuacuccugagcaugaggccuguccuuaaauacgguuaauauaccuagugacacuccauuggagaaaacucauuuuuccuuuacaaguggguauuaauuguagauagcuucuugguccagugccaggaccuagcuuaaaaacaucuuuuuuuccuaaaacaaaauauuaauuuagaaguugauguugagggcugacaagauagcucagcagguaaagguaaaggugcuugcugcuaaguccgaugaaccgaguuuaauccccaguaucuauguaguggaaggagagaauuaacucuaugugugugcacacuuacacacauacacacacaaagcaugcacacauaugcacacacaauguaauaaaaagaaggaaaaaaaaaagauguugaaacuacccugaauuaaaauggcuuaagcaaaauuggcuuuuccucuaagaugaguagccauuauaggauuuuuuuaagagaaauagcaccuaaacaguaaaaaauuuaccccucaccauuuuucuuucucugagcauucuuuaauguuagcucuugggggacagagaccaguggaucuauaugaguuugaggcccaucuggucuauacaaugauuuccaggcuaaugguauacagcaagauccugucucaaaacaaaacacccuauaaaacaaaaaucuaauuuuaaaaagcaguugguuguacccguaauagucaugccacaguuguaccaguauguucagcuugccugguguguuguuaguacagcacacagcauccauauuugagcaggacugucagcaacaauucuuccccagaaguuuguauacucugauacuauagugaaaaugagugaacuuucagcuuggucuuagccucauuucucuguaugcuacagccaaagugugugucaucuuuagaaauaggaucuuauuguccaacucagaugugcagccagcaguagcgggaauaaccuuaugguuuguagguuaucaggggauugauuccucugccaacaaguaauaggaaggcaaccuacuccugggacuuaagauuuuuacuuagcaaccuuauggcucuugggaguauccuuuucuacccauguacagugacuucagucaaacacuuaaagugauaguuuuaccauccuuucagauaccuuuccaaaucuguacaacaccaaaggguuagcauuuacagaaggugggcaaaaucucuguaggccagcugcuguauuggauugcuauuuuaaaaaagcacucacaagguccaaugaaaagauccuauaacuuguuucaauuguguuuuauacagaugcauagaugggggcacugauccauccaauucuguauggcucagucauuuuccaugagccauuuggucuccuuaucuuggugcuuugcuucaucugcuauaaagccucugugcaagccccuaaauacccagcagucuuggugaggcaggcuugugcugcuuagccuggaucaggccccaggggaagcaagagcaaaucuccugugccucacacuggaguuggcuccccugguuugauaagcccaggguaaccuguggcccuuucauuuucauuggcacaauuaguugcugaaagccccagucuggguaaacaagcuccaaccacaauguuuuuuuguuuuguuuguuuuuggggagaauacagggagaaauagauauagaauauuauaguguauguguguggggguguguguaaauaacuguaucucccuaggacaagcuuaauauuuuucauuugcacuauuuuuuaucacuuuauauuuucucugaacuguucuccuccagaaacucacacagaauuuguuuuucuguuaaucuuuugcucaggcacuccagagacagguuuugcuacccugaucuuccaaauguaccagauaggcccuuuuguuucgccuuucucagcucuucugcauugcuuuauaacuuuauaaauuucauuugcaugcuggccugccaguaagaucugccagagccccuccuacuuuauaaagaucacauucugccaugaagcccagcaaauccacuaaagcccuauucuagucccaaggucauugcuaaaaggacacauguaaaggucagaggacaacuuacaagagccaauucuguccuucuaccaugugagcuuucagaucacacuuaggucaaggggcuuggugacaagugccuauaucugcugagcuaugacacuggcucccaacaacuuuuuucuucuuccuuuuaaacagguaauacauuuuauguguuuuuccccaguguauguauguguacucuaugaaugcuugguguucacugaggucagaagaaaccaucagauuuucuggaacuggaguucuauagacuguuguaaauuucgaugugggcgcugggagucaaaccagggccuuuaaacagcagccaauacuuucaaccccaggcuggcaacuucugucaugugaaagagcccuaacaugcaccaccccaucaguuguugcugcccaguuugcucagcaacagcuguccuuucccaggugccuucccgucccugggauucacggagcccucagccaucaauagcaugugcuccuaaugacucauaugggccaguacgucagagacugauuuccucuguauuaucucagauuauccaaucuuugucucaagggugguuauaauacugucuccacuuccauggcacucauauugaucucuugugcgcccaugccacacagcaucauaaaccgauugucagggggcacugguauucaaucuuccccaguuuaagcaggucagauguauuuggugauuaacuucaacaagagcuccuuggcagagaucuaauuuguguucuuuuccuugcauccugccaacucugggaaacagaaggccaacaccuugaucucguuuucuccuuuuuuccaccuuuccugccaaaucagaggauaauacuuacugacuuuuucccguuguagaucaucuuguacucugacauuuuccuucuuggcagauagcugaaucuuaguuacaugucuuuuuuuuuuuuuucuuauggcccacagcaacccaugcaucaacugugauaaacugcauaugaucucaucucaucugggcuuuuauggacugcaacauaguccuuaguucaucagcugucuggggauggaggugggccuguguucaucaaggaggcauggccucucauacuacacagaagauggccacucuaaguggcccacucucagguggcuuggccuugguuuucuaucuuaucucuccuugguaacauguaauugucacaguagcaaggagucgcagagucauaucacauagaggaaauggcuauaucaagauuacccccacauauguuccacccacagacugaucaccugaaguuacauuuuaucauucaucccauaggccacacuucuccccaacucaucuaucagccccuauucacaugccaauuagguugugcagcuuuuccugggaagacaugaauaaacauuuaugcauggaugacagaucaaauaaauaacuaccuuacucuaguguagugaaccagugaacucauuaggguuacuuacaggaguacggguggcucaaagauagucacguuacuauauagugcaugccagcaugggugacgacgacucagaaaagcugcaucucugaagugcuacacauagcuagcagauagcuccacuaacagggucucaucuccuguacuugcuugcuguuucauagauaaucuuugagaagggccaugugaauucaugugaauuuggaggucuugugagcuucuggaauauucugaaucgcaguccucccgcaugaauuuuauaguucagaggaaacagcuacagagcacuguuucuaaaaacccagaugaauaauucaagaaugaacuggcauagaucuauaggugucuuaguuagguuuuuguuacugugagacaauaccaugacaaaagcaacuuacaguucuagagggagggucugugggggagggggcagcaugcuaggaagaccuggcauagcggcugcagcaggcagcugagagcgugggccugcuuaggacaaaucaucugugaaaaaguauuuuuagaauaguuuggugaaauuugaauuugcuuugagugauauuaauaaauuuagaugcuaagaaauugucauucauuuuuguuaagcaugauaauagugugauuauguuuuuaaagcucuuacuugcuauguauauauuuaauaaaaugauaugucucaguauuggcuuuuaauuuuuuucaagaaaauauuggaaguagaucuaaccaagauuuuuaaaaauacugaaauuguuaagccugauaauugaagauuaaguuguauaguggcauauuuuauauauguauauuuuaaauuuccucuaauuugcaaauauguuaaggaaaacaaugggauacucacacgugucuacaucuaaguagauccagaagucagugaggaauguuguuguacuuucuucccuccaucaaucucuuuacuuuaggaauuacagagcacuagaacuacauggcaucacaaaucauuuuauuuuguuucugguuccucaauucucucgucucuagaguucagcauuacucaugcuuuguauuaagacaacauucauaggaauggaggcauaagcagcagucaguauuuuuuuuuuaagauuuauuuauuuuauguauaugaguacauugcagcuaucuucagacacaccagaagggcaucuaauaccauuacagaugguugugagccaucaugugguugaugggaauugaacucaguaccuguggaagcgcagucagugcccuuaauuucugagccaucucuccaacccugcugagcagucaguauucuuuaguuggccaguauuucccccagcaugcuguacuagaaagaaugaaccacaggaccucauucuaccacuuggaugugacugugagaacccacuuaacuucccugauaauauccgugcugugcauuuugcucaguuaugaggaaaagcaaagcaaaacugucuuuucaaauaugggauuucugugaccugaaaguaaacaagucuaguacuguacugccaugauagguauagagucuuugaaauccuguaggucaggugagcuucaggauaucuuaacuucugcagaaaaagaaacccaaacuugcgaucuaacggucucuauuguguccugcaggguguuauuccuuucaguugccaagauuaauuuuuuucccaauuacauuuguaaaugaaugugugucuaucacuauuauagacacauuagaaaaugaggagaaguaugacccaaucaagcaauuuccaggacaaguauaaguuuauauauagcuucaugaaagugacucccugccauaguaccuuauucuguagaguggggagugguccacugagaggaccugucuaacacacgugcuuagaguauaccuaggcuuugaauaaaguaguuaaacaacuccugaaaguguggaccagcucaucguauuuagguaucuuacuaacuuuggacuaaaacaaaagucuguguugcuuauauggcuaauuuucuccuagucucucuguucuuauuucugguuaccuccuaguaaugucaaauaaaacacuuuuaaauguccaucaaaaacuuuaacuuuuuauuuuauacauuaccuuuuauuucaccccaggcuguuagcaguguuuccucauaaaauuucagaugacggggaucgcauccuuucucuucguucuuguuacugcaagccaaccuugugguugguccuacagucucugugcuuaccuguacaucucaggcccauuucccuucaguucuuugaugauagguuuguaacaacaugcuucaguccagugcuuccucuacuuugaaagguuucuguuacccucuuccguucaccauuuuaucguagagcagucaucuugguacuuagagcuuuucaugaucuaguucaauuauagucauuuaacuuuaucuuccacuucuauuuauuacauaacucugcaugacuuugaugugcuuauuugaaaaugcuuucuuucuuucuuucuuucuuucuuucuuucuuucuuucuuucuuucuuucuuucuuucuguucuaauaaugucuuuuccuuuuuaaaauucaguuuacacuuaaggccuuauuugaauuccucuuuaagaacucuuuaaaacccaucauaauaaagucuucacacuugggugucuggauugucaguagacacaauaucuaguauugcuacuggaaaguauuuuguuaugucuuacugucuuaagaguuggaugacacauucaaugugaaaaaugugaggccagucucuuucugucgggucugucuaccacuucccaauagugccaugcuggugaacaaaucuuuaaaagaaaggcuuuuggggaaacauucaagauccagaugauaacacauccuuagcuauaauguuucuacgggguuguuaguguauucuuaucaauuucuuaccacuggacucuuuagaaggaaauuuguuugauuuuuuuuuuauaguuacuuuacuuaaaaugagauuuaacuaaacucuaggauaaucuagcuaacaagcauaaaucauuuagaagcaucauuuauccaagagccuuaagauguauugaaguugaagagguuuuuaacuuucuuuauauugcaaagaaaggaaaggaaauauuugaguagaacaccaauauuucaggaugugugcaauuaaauaggcuuuauuuuuauguguacauguguuuugccugcaugcaacuauguguaccucauguauguagaaaccaggagaggguaucagaucaccugguguuggaguuauaaaccguugugaccaccauauugugcugcaauuugaacccugguaaccucucuaguccggcauauauacaaauuuagauggcuugaaaucagcucuggaaaguauuuugcauccuaaacuccuaauuaggaaaauuucuaaauuccuaauuuccagauggcuguuuaaaauacuucuggacuagggagguagcucaguggguaaaacacuuaacaaggaaggguuaggaccuguguuugaauacgcaccacccccaccuccuaccccccaaagccauuaaugaguaguuucaauccugguacuccccuggcaagauaagaaguggagacuggagaauucccagaggcucacaggucagcuagccugguguaugcagcagagaacaagugauccugucucaaauaagguagauaauaaguaccaacacucaagguuuuucacauacauacgcacauacauacuaacaaaaauauacagacuaaaagaauucuagguacuaugagucaaaagguaaggagacaauaaaacaauggcuaagacaacagagaccuugaaguauagaacauucuggaagucuggguuccccuguaggguuagauuuuuuuuaauaccuacuuuaauaaggguuuuuaaugcuauaaccucccuucuagcccaccacccaccagagguaguggaaaacaaagguuaauggggcaaaagggggauguggaccuacuuagaaacaguucuuuuuuuugggcgauuccaaucuuccuugucaggauaucagcagaucaguucacacaaaucagcaguaguaguuggauccacuagcaaacacuauucaugaaucagcaauaguuugauccagaagaaaccccgaggcucucaaucggccugugucaguggacauggcaaaaggcagcuggaauaucaugagaauugcuuagguauauuucucucuacgaagucaugacaaauacuguucagcaaagaaggcacggcaaaccaaugccacagcacugcuagcaaagcccaaugaagaccagcaaagaguagcaaggggagccaauggcauauagcuuugucccuuuccaaucaucacaugcucucucaagcacccacucuaacaaaacuaugcaccuuuuccaggcagcuuccagagaaacaccaugugucuguucucagcaaaacauccucucaugagacaguuucuaaaaagcaucacaugacacaacugagucuccaaagacaccagaaacuuccacuucauucucucauguguugugugugugagaucuuauacaguuucuuaaccuucccauuauacauuauauuuaauguguaaaugugaccaagaguaccuauguugcagggggguggggggagaaggguauaaauaaauguaugaaaaugcuaagugggcuuggugucuucuaucuguagucugagcacuuuggagguggaaauaggaggaugaggaguugaaggauugcugugagucuggcuaaaugagacccauucucaaguacacgugcacauauccacaacagggggaaaaaaacaaaaaagaaaaaugcuuaacagagccacguaacaagacuaaaaaaaugguagacaguaaaaauuacuaacacaaaacaacuccguaaguaagucuuaaauacaauaaaacuuucucuuauuuaaguuaccaugcuccuaaccacuauagcugaaaaguuauuuuccaagauaacauacguagaagacuuuuuuuuuuaaucacagagauuagaaaagaacaacauaucauuuuauaauuuuuacuacuuuaaccuaguuacuaauuaauguuuuaguuuucacaauuacuuucgccaucauuugcuuuuuacugacaaaaugucuguccauccuucucauugucucccccauccucaguuuuuaaccacauuuugacaaggaaugaggcaugagucaaaguauagccagauuuucuguuucuaaugcauucaacccauucaauuaaaaaucuuauauucagucagcagaugcuaaauauuuaaguuguguaacuuccccaaguaguuucagugaacacugccaugagcucaguguaaaauagcuuaugugauggcuauggccuuugguguucccuauugauuaagccaggauaucuucuagucuaguuuuaccaggaugagaucuagaugugugccuucaaacacugugcacucugcuuccgcauuaccucuguggagcacaggaaacacccucaacacaugugcaucuugagaauuuuugguuuugacucugaaaaacugaagcauaauuuaugucuuauaaaaggcuauauaucaaauaaauaaacguauaagaugggacaagacaguguguuucauuauuucagaacuaguccaggacuacaaggacuuucuacagaacauacaggguuuauucugguccacaaucacaaacuauaucuuugagucuuauguaaaguaaauguuguaacaaaaaguauaagaucaauaugaagucauuacuuggaacuauucucaggacacaaaaacucaaugacucuaaaauaacaaauauacacacuuaaagaugacccagaucacaaccaccuuuauuaguuucuuggguuauaaauuaugacaaaugcaauagcuuaaagcacugcaaauuuaugucuuauaguuuuauauaaggacucuuguaguuacccugaauucaugugaaaaccccaagccauucucucuaccuacuuugaucccuguuaaccacauggcuucuaauaggcaggcauaguaccagguaaugagauuaaauguuugacauguuauaacaucaguugcgauuuaauugcuuaauguauucaaacucuacucucaaaauccagguuagugauuaaucuguauaauuauagguuaucauaaauuuguuaaaucucuuuaauauaagaccugucuaaccauucugaccaaacuccauaugagauucuaccaucuguacacaugaauuuguuagaguguauuugacaauacaguaagcaaaaucaagguacuaguaaaauaaaaacacuaauuuucuuuucagcuuuccauuuuggauuccucuuacaccguuuaagugacuagaggauagugaaugacuugccuggaaaaagccauuccucccuucuccauccagacuaucuucccugauagcggcuuuaucucuaauacuuuccaaaguuguucucccuguguaggucaggcaauaaaacucucuuuuauuuccuaaaaguuguuuuuuuuaaaguaaguuuuuggacugaacuaaaacaguuauugauguaacaaaguauuuuuaaaucuaacccccaaaagcaguuguaucuaaaagaauacuggcuugcuuccuuuaaaaauguauccuuggaauccuagaagaguuaugaauuaaggaaaccagauaguguaaggcaauauacaagaguaagacacaggagugaugccuuuacuguaagcaggcauuugguaaauacccauuuccccggucaucuguuuacauagcaaccuuauaacaccgcagaauugguacauauugguuauuggaagccacgugucuucauuuucgauccauuuuuauuuaacaugaguauuugaauguuuuaaugugcuuuugcauauguguuuguggugggguagggguauagucagugguuuaagcuccuacuuagcaaaccugugucagucccaccaccagccgcaaaaaugacucagacuuugaguuuagugaaauauugauuuuaguauaaaauauuucaaaacuaacauuugaaugcuuaagugaagcacuaauguaacugugauucuuaugaaaaucuuugacaaacauaaucaguguaaacaacucugacaucuauuuuuaauugccugaguugaguaaaagguuaauuacuuaaaacuucaggucccugaacuugaaguagcucuuugagucauauagaaaaacgaagguaucauuuaaagacaaucgaaaagcauuuacaauaaaagucuguaaagcuucaaugaaucuguggcauauuuuuauuugcaguuuucuguugcaggagaugaguacgaugugugugcuaucugucuggaggaguaugaagacggagauaagcuaaggauccuccccugcucccaugguaugaguacucacacagugcuuugagcuguauauaauuccauucugaguucuguauaaagggagaagaaagagcaaugcagaaaucaaggauagaugugauuuauaaaaaugcacuaacuucucacaugcauauacaaugugaacagaucacuauacuaaauaaacacagcaaguaauuaacuguaauagucucuucauacaauaguguuaugcaugcuugacucaagagaaauaucuauggaucuuaguuuucauguaucauugucauucuuuuguguugugauaaaaagaaaauacugcauaaaauaccaaauuucagcaccuguuaauacugagaucauauacuucuucaugaagagcaucuuaugcccugcuguauuugaaaguaagugcuuugaacagaauuguuguacugaagauguauauuuugcuucaacagcuuaucauugcaaguguguagaucccuggcuaacuaaaaccaaaaagaccuguccagucugcaaacaaaagguuguuccuucccaaggugacucggacucugacacagacagcagucaggaagaaaaccaagugucagagcacaccccuuuacuuccacccucagcuucugccaggacccagucauuugggucucugucagaaucccacucacaucacaacaugacagagucuucagacuacgaggacgacgacaaugaagagaccgacagcagugacgcagacaacgaaauuaccgaccacaguguugugguccagcugcagccgaacggugagcaggauuacaacauagcaaauacugugugacuuuccggugguugguugacuucccuuauaauguuuauuugcgcauaugauuugauuuuuugcuccuuuuagaaguuucuguagaaauaacuuauuuuuuaguuuucuaguguaaucaaguuccugaaacaggcuauuugaucucugauacuuaucuccaauaguauacagccacuucacuaacaaaguaacagauuggugcuguaacucaggcaucaaauuagcucucuggggaugacaaaauguagccaggacacuuuaaaaauccucaguauagcuugaaaugaagaccuagaucacagucugcaaaugucuuacacaugaagucugcuauggucaucuagcaugagcuaaaacaacucucacuuucauaaaaguugccuagugugguuggguugguacaagucucuucugauagucccucuauguuaugauuaaugaguggcaacaggcaguuuaggauuuuucuucauaauaccacagagaaacuuaugucuucuuccuuucuauucccaaguaguuuuuccucauaggaaaggucuaguguagacuucaaauacuuuaagguuuucaaaaccacuauaguguuaugaguuugauuccacgggaaugucucuggaccuuacuuuccauauuucaguauccuuuuguguugugauuuuaaaaaauguugcauaaaaauaccaaauuucagcaacuguuaauauugagaucacauaccucuucauaaagagcaucuuaugcuaauuagcccugcugaaccaugugcagaggaaauuguucaaguauuggauuugaaaauaagugcuuuuguuuaauagaccuaauguauugaggcaauguauuaugaaaagcaaaauuauauaacucuguaacuauguagaaaauauacuuaaauauaaucagaaugcuaagacuuuuuauauggccuuguaugaugagagcuucaauguuaauaaauguuuuccacuuuaaaagccaccaaguauuguucuggugaacucuuacauuaaccuuauaugcagggugcuauaaaggagaaugauggagucauacaccaccuuaagaugugauacaagguuacuuacuaauuacuuacaagcagucagguuuauccaccaaaguuagcacuguagccaaaaucaucuccuaaauagugugaauuagggaauuugguuguaaauugugacacauucuuuacaguagaugcauuuagugacuuagugacguggaaaauugaauaaaaucauguaguagaauaaguauaucacuuauaugagcauuucauuaucuuuuuaaaaugcuguauuuuaagagaaauauaacacuaggaaaagaaauuuuaauuuugaauuguuucuuuuaaaaauuuauacucagauuguuucuuuguugaguuuuuuguuuguuugcuuguuugguuugucaguugguuugguucgguuuauugagccaagguuucucuauguagcccuggcuguccuggaagucauucugaagaccaggcuggccucaaacucaagaaauccuccugugucugccuccugagugcugggauuaaagaccugcacuacca

SEQ ID NO: 1433 - RNA, 6188 nt, Mus musculus
auggaguauuugguuggaauaaauuuauuucaucugucuguaaacaagguguuuaauaguuauggcauuuuuuuaaaugcauauuaagucagaugaguuagacuguaucccagauguaacaaagugcagggaaagaaauggacaaaucagcaacaagauuuguuuuuaaaucuguacauuauccacaaugcccaaacaauagaagcaauacuagaaugucccuaagguagugccauucgaaaggaaauccaucucacaauagcaacaguucauuuuaacaauaguauggcacaggauacauaugaaaaaaauacaucacaagacagccaaguccacaauaaugcaacuucauauaaaaaccuaagcugcaaauaaaaauugguccuaugaaaaauaaacuggacacacuccagaugguuauguugggauaccuaauauccauaauggcagccuuuacauuuucucaagagcacagcuggugugcaagaaaagacaggucugagcuacugcaaugacagaaugucccugggaauuugaucgguaugguuacugcaguaaggucgugggaggaagugccuuugcucuccaagcugcacgcuucauguccuauagacacuacaaauagucugucccaagugcagucacuguauuaaaaaguaaaacacugcaacucucaauagcucaucaacagaggagguauuaauuaguuaaauaaaccaggcacuacacagaagagaauggaagcagaccaaacaccucguguugguagggaggggugagaaaggugugacguacagaggcaugcacuuuuuccucccaaccaugcgcuacaaaaggaagacuagaugagccaaggaaaugcuccaaagugcugaaaagacacugaucgaguuagagacuguacaccggcaccuugcuuacuauuaaccuauuuuaguaaucaguaauccacuaacugcuaagacgaagugaugcccaacuuggcaugcccccuucccccaguuucaagauaucaugcaaaucauuauugugcugcaauuaugaugccagauaaagguugguuacagaccucuucagguauaaagcgaguucauauguuuucuuguuaauugugccugcguggacaccuuccuuucccaugacuauaaccaaugcuggaguacacaaggaaacaaaacaaaaaugaacacaauuauuuaaggggaaggggcagaaagaaagacaccuuuccccaccaacagagggauacaaaggagacuuaagcuuacagcuaggaaaauuuaagagcaauuuuccccuaauacuuaacagucugccuagcagcuagaacccagagucucucaaguauuuugccauugaguaugccuucuuauucaauccgccuccauggaccccuucuuuucccauuacaaagaccaagacugaaagaaaaaggagaaaaguguuucaaaaggaguguuaaucaagaaaucacguaaguuuaagcagauagauuaauaaauuaacauuaaguuaguuuccaugaacuguuaaacacugaaauccauuaugucuccagaauggagagccuucaggcuaguaaauaaacuaaaaacagcacacuacuggaugcauguaggaaaccccacuguacagcagcuaauuuccauaaagggaucuuuaugagagcuaggaggaaagugacaguuuaccuugcauccuaggagaaacagucuggcugauaucaugcuauucaucuccuacaacauacuuuaaaaacuuucauauuuuucauuuacaaacucuccccaaauguaacaugcaugauaaauacaagcuauuguccuauacgugugacuauaaaugagagacaugucuauuacuuccagaggaaaaugaaaaccaaauuuaagcagaaauguuacugccagucacaaaacucuacacuagugauaucugucuuauacagauacuucccuuugcuaauucuuuccagucuaaaaaaaauaaaaaaaaccacaaaaccuguuuacuacuucuagcaccuaauuugugaacugaacuauauguacagguguguuucaaauauacuuauugccacuaggugucagcaguguucuaugguuaaaaaaaaaguuucaauucauuuggcuucaaauguugauuuuuuuuuaaaagaugcauauuuguguuuuugucaugcauauauacauacugcaugugugacugguguccuuggaguccagaagagggcauuggagcccccaggacuguagcuacacagcuguaagcugcugcagggugggugcugggaacagaaccucagucauggcuauuaugcacuaagacauuuuuccagcccuucagcagaugcauguuuuuuucaacccuagcaucuuacguaucuagaagcagcaaaaacuuaagauuugucuguuuuaaaguuaucuuguuuugugugauuuguuucugaaacaaaccacaccucagacacccacagcauuaaaugauagcucacuguaggcucuugugauuucacacuauagaacuguucuaggugcuaacuuugccaaaugaggcaguuauacagguuaguacauguauguauuugugugucggugagaugucagaguaaacaucaaugucaaagguucucuauggaauaugacaguuccuuaugccauauugaaaccagaacuuuuauuaucaagucuggaaacugguaccagaguuugugggccaaguucuuaaacugcgaguaguuuccuacuuuucaaacugauaucucguucuuuggaaguauuucagcaaauggaacauguacucuaaaacuuuggccuaucccucuucuucagaaauguuccuggcaaaaaauaaaacaaugugaucuuuuuuuccuuccuuucuuuucuuuucuaaugaugagcagagaauugauuucaaaucucagcaaacaucaaaggaaagaucuccaaguaaagacuaauuagacacaaagauaacuaagugacuggcacagacuaacaaccaucuaucccacagcaucguaacgcguuggacugaggcaccuuuucauuuuuagguuuaccaaagcugucauaauuuagaguagucagaugaggcugcauaugcaccacucuaaaguagacaggcugaaagcagugccaccuuucagugcugagcaguucacaaaaaccaccuuaauagccauuaugaaccaauuuucaauuuaaaccauuaaagaaacccuaguuguaauaugacaugcaacuuuuaaggagaaaaaaaaaagccuacucaccucucccggcccugccaacagcaacguuguauguuggcuccccaccuugacucuuuguccggauguccauugugcagucaccaucaacguauaggcuaucucugaucacagaacacuucuuugcuccaagagucaaaccguugguaaagaaaccuucccggucuuuuccuacaaucauaucuauuucuacuggcuggccacccaaaacaaagaagaaaaaaauuacaguuaaucagaaucugauacaacaaacugugugcuaccguagaaucaagauagcuguuuuuauuauuaccuauuccuucgugguuacaugauuuacacauuaguuugcuuuugcagcgaacagugaggccugcuaacuaaaagccaguguguaucaaccauacagagaguuucccuaaauaguuggcaguugacacuaggugcaaacugaaaacgaguuauuuauaaacuaucucaagucaggugcuacuugaggugcuuauguaauuguaaagauucagguauaagcucuuguauacaacagcuugacuaucauauuuugccacauuagucauguugcaucaaauuuaaaguuggguaaagucgauccagaugggccugcuuacaucucuguuucaagcagcuugaaaugucccugguaguaugaaccucaguuaccacagacugugggacaucuccaaauucauauuucccuccuacuuuucuagccaccacucuuuucucuccaacuugccuugcccuuccauucaauaaccugcuuuccuucuggacaaaugcagagugauucugucuacagcacugcgguagcaacagcaaaaucagagagaaaauggaggggcauugguaaagaaagugagguagccaccagaaccggaaaagagaaucuguucauucuaacguuccaugaauaagaaggaaggcgucgcccccaucagaacugcagagucauagcaggccccagccauuuccaagcauacucccgcaauauucuuaagccagacagcgggaacucacacacaaagacaagacugcagaaaaaaaaguuaaucaccaaaugucaauucgcuauaggaacuguggccucccacauggggacaggagaucuuaaagcacuccugucacagacugaauccacacuaauuuguuaaaccacauuaaguaguaaaaugcugagcaccugugauaugggacuugaauucuguuaugugguaggggagggagugggaguggggagcaaagaaauuaagagaaugguccuguacuugauacuggugucaaaaucuuaaagagcauugcauagaaacaagcauaacaauaagcaguguuggagacugguugacgaauauucuccaaauguguggcaacccagucaaaagccaucaagucacaugaaaaggaggcaccgugaagcauaaaucgguauuaguucuuuuacuaccaucacuaaagagggagugacuuggagaaguguuaucccccuccagcgacuccccagauuuuuuuaaaucacccuuaaaccauccccuuuuuagagcuauguugcguaacuggggauaacaguauaucgaugaaucucuauagguggagaagagaaaucaauggcaguucgccaucuuggaggaaaaaaaaaaaaaacuauagaaccacaagcugaaguagauucaccauuccaccuacgugguccgcguaccuuucucuccagccuaggcggccuggacacccgcaagccuacgcaaagucacuccauuaauucccgggauccggccacugccgccucccacauuccgcgcucacaaccgaaccagauccagggccagccugccgcccagauuccccccgcccacacccggggacccgcacugcagcccgcagggcuccccgaacgccgagggccucccggggaggcguccccuccuccacccuggcagccgcaagccggggcgccgccggggcgaagaguccggccgccccgcccccgcgcggccucgggcagcauccccaggcucagcugcccgcaaccgggcuccggcugcauccccuuccucgcgggcgggcgaggaagccggcgguacccuucccuucagcccuagccgcaucccuuccucgcgggcgggcguccccuucucagaggcccgccgcacaccugccggcuuggcgcccccgggccucaccgugaugcucuggaagacgcccccggccguggcugcccagacguauuuggcgucgcaguagccgacaauggcggccuccuggcagcagccaucgcacaucagguuauccacguagcucugccaaccggccaucuucgagcccuucgcacugcagcggggacggcaggagcagaggcgcagcagcggcagcggcggcggcggcggcggcggcgguggaggcggggcgggggcggggaggaggcggcucugcgcaggcaccgaccgccccucuccggggaacugcggcgggcggugacaggacccgcagcggggagcgccgggcggccgcggccgcggggcucaggagccggcggcggagcgacgcuggcagcggggcuggugacggccgucucacaccgccgcagcucccucggcucuccgcggccggcgggaugugcgcgcgcgugcgugcgauccuuccgcagcgcagccggcgaggguccccgggagggcgggggagccgaggcgggggcgcggagggauaccgccggggacaaucacggcccacacgugcgggaggcgagugggcgugcggcuggggcgcggcggcggaggccucaccaccggcuaggaggcgaagcagcuugagugggcgccguggggugccggagcucugggcgcccagcggccacgcucaccucucaagcgcccgcucggggacgcgguauugacagcaucggugucggguggca

SEQ ID NO: 1434 - RNA, 6188 nt, Mus musculus
ugccacccgacaccgaugcugucaauaccgcguccccgagcgggcgcuugagaggugagcguggccgcugggcgcccagagcuccggcaccccacggcgcccacucaagcugcuucgccuccuagccgguggugaggccuccgccgccgcgccccagccgcacgcccacucgccucccgcacgugugggccgugauuguccccggcgguaucccuccgcgcccccgccucggcucccccgcccucccggggacccucgccggcugcgcugcggaaggaucgcacgcacgcgcgcgcacaucccgccggccgcggagagccgagggagcugcggcggugugagacggccgucaccagccccgcugccagcgucgcuccgccgccggcuccugagccccgcggccgcggccgcccggcgcuccccgcugcggguccugucaccgcccgccgcaguuccccggagaggggcggucggugccugcgcagagccgccuccuccccgcccccgccccgccuccaccgccgccgccgccgccgccgccgcugccgcugcugcgccucugcuccugccguccccgcugcagugcgaagggcucgaagauggccgguuggcagagcuacguggauaaccugaugugcgauggcugcugccaggaggccgccauugucggcuacugcgacgccaaauacgucugggcagccacggccgggggcgucuuccagagcaucacggugaggcccgggggcgccaagccggcaggugugcggcgggccucugagaaggggacgcccgcccgcgaggaagggaugcggcuagggcugaagggaaggguaccgccggcuuccucgcccgcccgcgaggaaggggaugcagccggagcccgguugcgggcagcugagccuggggaugcugcccgaggccgcgcgggggcggggcggccggacucuucgccccggcggcgccccggcuugcggcugccaggguggaggaggggacgccuccccgggaggcccucggcguucggggagcccugcgggcugcagugcggguccccgggugugggcggggggaaucugggcggcaggcuggcccuggaucugguucgguugugagcgcggaaugugggaggcggcaguggccggaucccgggaauuaauggagugacuuugcguaggcuugcggguguccaggccgccuaggcuggagagaaagguacgcggaccacguagguggaauggugaaucuacuucagcuugugguucuauaguuuuuuuuuuuuuuccuccaagauggcgaacugccauugauuucucuucuccaccuauagagauucaucgauauacuguuauccccaguuacgcaacauagcucuaaaaaggggaugguuuaagggugauuuaaaaaaaucuggggagucgcuggagggggauaacacuucuccaagucacucccucuuuagugaugguaguaaaagaacuaauaccgauuuaugcuucacggugccuccuuuucaugugacuugauggcuuuugacuggguugccacacauuuggagaauauucgucaaccagucuccaacacugcuuauuguuaugcuuguuucuaugcaaugcucuuuaagauuuugacaccaguaucaaguacaggaccauucucuuaauuucuuugcuccccacucccacucccuccccuaccacauaacagaauucaagucccauaucacaggugcucagcauuuuacuacuuaaugugguuuaacaaauuaguguggauucagucugugacaggagugcuuuaagaucuccuguccccaugugggaggccacaguuccuauagcgaauugacauuuggugauuaacuuuuuuuucugcagucuugucuuugugugugaguucccgcugucuggcuuaagaauauugcgggaguaugcuuggaaauggcuggggccugcuaugacucugcaguucugaugggggcgacgccuuccuucuuauucauggaacguuagaaugaacagauucucuuuuccgguucugguggcuaccucacuuucuuuaccaaugccccuccauuuucucucugauuuugcuguugcuaccgcagugcuguagacagaaucacucugcauuuguccagaaggaaagcagguuauugaauggaagggcaaggcaaguuggagagaaaagagugguggcuagaaaaguaggagggaaauaugaauuuggagaugucccacagucugugguaacugagguucauacuaccagggacauuucaagcugcuugaaacagagauguaagcaggcccaucuggaucgacuuuacccaacuuuaaauuugaugcaacaugacuaauguggcaaaauaugauagucaagcuguuguauacaagagcuuauaccugaaucuuuacaauuacauaagcaccucaaguagcaccugacuugagauaguuuauaaauaacucguuuucaguuugcaccuagugucaacugccaacuauuuagggaaacucucuguaugguugauacacacuggcuuuuaguuagcaggccucacuguucgcugcaaaagcaaacuaauguguaaaucauguaaccacgaaggaauagguaauaauaaaaacagcuaucuugauucuacgguagcacacaguuuguuguaucagauucugauuaacuguaauuuuuuucuucuuuguuuuggguggccagccaguagaaauagauaugauuguaggaaaagaccgggaagguuucuuuaccaacgguuugacucuuggagcaaagaaguguucugugaucagagauagccuauacguugauggugacugcacaauggacauccggacaaagagucaagguggggagccaacauacaacguugcuguuggcagggccgggagaggugaguaggcuuuuuuuuuucuccuuaaaaguugcaugucauauuacaacuaggguuucuuuaaugguuuaaauugaaaauugguucauaauggcuauuaaggugguuuuugugaacugcucagcacugaaagguggcacugcuuucagccugucuacuuuagaguggugcauaugcagccucaucugacuacucuaaauuaugacagcuuugguaaaccuaaaaaugaaaaggugccucaguccaacgcguuacgaugcugugggauagaugguuguuagucugugccagucacuuaguuaucuuugugucuaauuagucuuuacuuggagaucuuuccuuugauguuugcugagauuugaaaucaauucucugcucaucauuagaaaagaaaagaaaggaaggaaaaaaagaucacauuguuuuauuuuuugccaggaacauuucugaagaagagggauaggccaaaguuuuagaguacauguuccauuugcugaaauacuuccaaagaacgagauaucaguuugaaaaguaggaaacuacucgcaguuuaagaacuuggcccacaaacucugguaccaguuuccagacuugauaauaaaaguucugguuucaauauggcauaaggaacugucauauuccauagagaaccuuugacauugauguuuacucugacaucucaccgacacacaaauacauacauguacuaaccuguauaacugccucauuuggcaaaguuagcaccuagaacaguucuauagugugaaaucacaagagccuacagugagcuaucauuuaaugcugugggugucugaggugugguuuguuucagaaacaaaucacacaaaacaagauaacuuuaaaacagacaaaucuuaaguuuuugcugcuucuagauacguaagaugcuaggguugaaaaaaacaugcaucugcugaagggcuggaaaaaugucuuagugcauaauagccaugacugagguucuguucccagcacccacccugcagcagcuuacagcuguguagcuacaguccugggggcuccaaugcccucuucuggacuccaaggacaccagucacacaugcaguauguauauaugcaugacaaaaacacaaauaugcaucuuuuaaaaaaaaaucaacauuugaagccaaaugaauugaaacuuuuuuuuuaaccauagaacacugcugacaccuaguggcaauaaguauauuugaaacacaccuguacauauaguucaguucacaaauuaggugcuagaaguaguaaacagguuuugugguuuuuuuuauuuuuuuuagacuggaaagaauuagcaaagggaaguaucuguauaagacagauaucacuaguguagaguuuugugacuggcaguaacauuucugcuuaaauuugguuuucauuuuccucuggaaguaauagacaugucucucauuuauagucacacguauaggacaauagcuuguauuuaucaugcauguuacauuuggggagaguuuguaaaugaaaaauaugaaaguuuuuaaaguauguuguaggagaugaauagcaugauaucagccagacuguuucuccuaggaugcaagguaaacugucacuuuccuccuagcucucauaaagaucccuuuauggaaauuagcugcuguacagugggguuuccuacaugcauccaguagugugcuguuuuuaguuuauuuacuagccugaaggcucuccauucuggagacauaauggauuucaguguuuaacaguucauggaaacuaacuuaauguuaauuuauuaaucuaucugcuuaaacuuacgugauuucuugauuaacacuccuuuugaaacacuuuucuccuuuuucuuucagucuuggucuuuguaaugggaaaagaagggguccauggaggcggauugaauaagaaggcauacucaauggcaaaauacuugagagacucuggguucuagcugcuaggcagacuguuaaguauuaggggaaaauugcucuuaaauuuuccuagcuguaagcuuaagucuccuuuguaucccucuguugguggggaaaggugucuuucuuucugccccuuccccuuaaauaauuguguucauuuuuguuuuguuuccuuguguacuccagcauugguuauagucaugggaaaggaagguguccacgcaggcacaauuaacaagaaaacauaugaacucgcuuuauaccugaagaggucuguaaccaaccuuuaucuggcaucauaauugcagcacaauaaugauuugcaugauaucuugaaacugggggaagggggcaugccaaguugggcaucacuucgucuuagcaguuaguggauuacugauuacuaaaauagguuaauaguaagcaaggugccgguguacagucucuaacucgaucagugucuuuucagcacuuuggagcauuuccuuggcucaucuagucuuccuuuuguagcgcaugguugggaggaaaaagugcaugccucuguacgucacaccuuucucaccccucccuaccaacacgagguguuuggucugcuuccauucucuucuguguagugccugguuuauuuaacuaauuaauaccuccucuguugaugagcuauugagaguugcaguguuuuacuuuuuaauacagugacugcacuugggacagacuauuuguagugucuauaggacaugaagcgugcagcuuggagagcaaaggcacuuccucccacgaccuuacugcaguaaccauaccgaucaaauucccagggacauucugucauugcaguagcucagaccugucuuuucuugcacaccagcugugcucuugagaaaauguaaaggcugccauuauggauauuagguaucccaacauaaccaucuggaguguguccaguuuauuuuucauaggaccaauuuuuauuugcagcuuagguuuuuauaugaaguugcauuauuguggacuuggcugucuugugauguauuuuuuucauauguauccugugccauacuauuguuaaaaugaacuguugcuauugugagauggauuuccuuucgaauggcacuaccuuagggacauucuaguauugcuucuauuguuugggcauuguggauaauguacagauuuaaaaacaaaucuuguugcugauuuguccauuucuuucccugcacuuuguuacaucugggauacagucuaacucaucugacuuaauaugcauuuaaaaaaaugccauaacuauuaaacaccuuguuuacagacagaugaaauaaauuuauuccaaccaaauacuccau

SEQ ID NO: 1435 - RNA, 1744 nt, Mus musculus
auucuuuuuuuuuuuuuccauuuuaguggacaucuuuauuguuuaauagaucaucaauuucugcagacuuacagcugggauuucaucagauugccaugcugagucaagaacagugagugacgaagcuaaccagaggcuacauacgucagagagagagcucagccuuuacagcucacuuccuuucucaggcagaauauaaauagacgcccucuacaaugcacaaugguuuuagucacuaaggaauuuaaaugggaucuugaagaacacagacaaauccugaugcaguaaagacgagcugagaugcugugcaacuguuuaaggguuccuggugccacaucucagccacuagcugaaucuugcgcuaacaccaaauggagauguggaaaacacuagguugacuuaggagcugugcacaggaaccaaaggcaggaaagaaaauacuaaacauugcugagagcauccaccccaggaaggacuuuaccuuccaggagcucuagacuggcaccgcccccagugcucacauggcugacuuuauccucuguguuccauuuggcacagcaaguggcagugucuccaccaccuaugauagugaugcaaccccuagaaguggcuuucaccaccucauccaugagugacuugguuccccuggcaaaggcuucccauucaaauaccccaacaggaccauuccaaacaaucugcuuagcucgacccacagccucggcauauuucuugcugcucucaguaccacaguccaagcccauccagccagcagguauaccagaggccacaguagcuuggccagucuuggcauucucaucaaauuugucagcagugacaaagucaacaggcaagguaaucuucacaccauuuuucucagcuuuggacaugagaucuuugacaaucuuggcuccuucuucaucauacagagaugugccaaucuccauguuguugagcaccuuaaggaagguaaaggccauuccaccaccaaugaucaucucauugacuuugucuagcauauuauugaucagcuggaucuugucugcaacuuuagcgccucccaagauagccaggaagggucgcucuggacucuccaaagccuuggcaaaguaguucagcuccuucuucaucaaaaauccaccagccuucuguggcagauucacacccaccauggagcuaugggcucggugugcagucccaaaagcaucauugacauagacaucuccuaguuuggacagugaggcucggaaagcaucaauuuuggccggcucagcuuuaaccuuguuuccagaagcaucuuuucccuucccuucuuccucuacaugaaagcggagguuuuccagcaggaugacagucccagccgcuggguuggcacaggcauucucgacuucugggcccacacaauccuucaagaacagaacauccuugcccagcagagauuugaguucagcagcaacuggcucuaaggaguacuugucaggcaugggaacaccaucaggccggcccagguggcucauaaggacaacggacuuggcuccauuguccaagcagaauuugaugcuuggaacagcagccuugauccuuugguuguuuguuaucugguuguucuucauaggaacguugaaguccacccucaucacgacccgcuuccccuucacguccagcuuguccaaagucagcuuguuggaaagcgacauuuuggcaacaccgugaggucgaaaggcccggagaugaggaagaggagaau

SEQ ID NO: 1436 - RNA, 1744 nt, Mus musculus
auucuccucuuccucaucuccgggccuuucgaccucacgguguugccaaaaugucgcuuuccaacaagcugacuuuggacaagcuggacgugaaggggaagcgggucgugaugaggguggacuucaacguuccuaugaagaacaaccagauaacaaacaaccaaaggaucaaggcugcuguuccaagcaucaaauucugcuuggacaauggagccaaguccguuguccuuaugagccaccugggccggccugaugguguucccaugccugacaaguacuccuuagagccaguugcugcugaacucaaaucucugcugggcaaggauguucuguucuugaaggauugugugggcccagaagucgagaaugccugugccaacccagcggcugggacugucauccugcuggaaaaccuccgcuuucauguagaggaagaagggaagggaaaagaugcuucuggaaacaagguuaaagcugagccggccaaaauugaugcuuuccgagccucacuguccaaacuaggagaugucuaugucaaugaugcuuuugggacugcacaccgagcccauagcuccauggugggugugaaucugccacagaaggcugguggauuuuugaugaagaaggagcugaacuacuuugccaaggcuuuggagaguccagagcgacccuuccuggcuaucuugggaggcgcuaaaguugcagacaagauccagcugaucaauaauaugcuagacaaagucaaugagaugaucauuggugguggaauggccuuuaccuuccuuaaggugcucaacaacauggagauuggcacaucucuguaugaugaagaaggagccaagauugucaaagaucucauguccaaagcugagaaaaauggugugaagauuaccuugccuguugacuuugucacugcugacaaauuugaugagaaugccaagacuggccaagcuacuguggccucugguauaccugcuggcuggaugggcuuggacugugguacugagagcagcaagaaauaugccgaggcugugggucgagcuaagcagauuguuuggaaugguccuguugggguauuugaaugggaagccuuugccaggggaaccaagucacucauggaugagguggugaaagccacuucuagggguugcaucacuaucauaggugguggagacacugccacuugcugugccaaauggaacacagaggauaaagucagccaugugagcacugggggcggugccagucuagagcuccuggaagguaaaguccuuccugggguggaugcucucagcaauguuuaguauuuucuuuccugccuuugguuccugugcacagcuccuaagucaaccuaguguuuuccacaucuccauuugguguuagcgcaagauucagcuaguggcugagauguggcaccaggaacccuuaaacaguugcacagcaucucagcucgucuuuacugcaucaggauuugucuguguucuucaagaucccauuuaaauuccuuagugacuaaaaccauugugcauuguagagggcgucuauuuauauucugccugagaaaggaagugagcuguaaaggcugagcucucucucugacguauguagccucugguuagcuucgucacucacuguucuugacucagcauggcaaucugaugaaaucccagcuguaagucugcagaaauugaugaucuauuaaacaauaaagauguccacuaaaauggaaaaaaaaaaaaagaau

SEQ ID NO: 1437 - RNA, 52070 nt, Mus musculus
cggcugcggcgcuggcgguggcugcggcagcggcggcauuuuagucugcggcggcagcggcugcggggcugcugcuccucccagcaucccuggcgcggccauuucagccccaucuuggccgaguggagggagcugcagccgcugcuucagcaguuugaauuucuguuuuguuuuguuuuguuuuuucccuccggagucuccgagccggccgcgccgcggagaagcggaaggcgccgccaccgguuccccucacgccgccgagcaccuccgcucgcuugccguuccuucagccgccgccgccgccccucacgcgccucagagccgcgaggaggccgggcccgccgccgccgcggguggcucccugagggaggccagacugccggccuuccccgcccccgagcgggcuuccgccgccaccgccggcauggcccccggacugcgcucgggcuagagcccgggacggagggcugccucccgccgcggaccuccagccccguccgucaggaagcgccggucccggccucgccgcuccgccuucuuccuccgcgucgccgcgcgggagcagccgcgggacccggccaggagagcccgagcggggcagaaccgccccucacgccgccgccgccgccuccugcgcccugcgcuccacccccagccgggccugcugaccgcgccgagcgccgggcuggacugaccgcggaggcugagcuguuggagcagccggcccgccccuggaccacgcucgggccgucgcugaggaguugaauugaggcaccccugccgcgggaggugaggagggaggaggaggaugucgcgccgagacgccggcgcccagagcagcccgugacuuggcggcgugggccguagacccaggcgcgaacucggacuuugucuuugggggcccgugcucggcccuucucgguuuccgguggggucccagaggagccucugcccuccagccucuuccaccauguccaagaugccggccaagaagaagagcugcuuccagaucaccagugucaccacggcucagguggccaccagcaucaccgaggacaccgagagccuggacgacccggacgagucgcgcacggaggacguguccuccgagaucuucgacguuucccgggccacggauuacggcccggaggaggugugcgagcguagcuccucggaagagacgcucaacaaugucggggaugcggaaacucccgggaccguguccccgaaccucauccuggaugggcagcuggcagccgcuucagcugcgcccgccaacggaggcggcgguggcgugucggcccggagcguggcgggggcacucgcccagacccuggcggcggccgccgcuucgguguccacuccugggccgaguagugcaacuccaucucagcccccugccacuuguaguucgcguuuccgcgugaucaaacuagaccacgggagcggggagccguaccggcgcggccgauggacguguauggaauacuacgagcgggauucggauagcagcguccucaccagguccggggauugcauuagacacagcaauacuuuggagcagacugcggagcgggacagcggccugggagccaccggagggucgguggugguggugguggccuccaugcagggggcgcacgggcuggacucgggaacugacagcuccuugacugcugugucacagcuacccccgucggagaaaaugagccagcccacucucgcccagccgcagaguuucagcgucgggcagccgcagccuccaccgcccguagguggggcuguggcuccaaguucggcgucgcugccgccguucccgggagcggcgaccgggccgcagccaaugacagcagccguucagccaacccagcuccagggagccguggccggaggcgcccuccccgggccugucggucaggggcugccgccgccgccgaaugucaaccuggcgcagccuguggcccuggcagcucagcccggcccggccggcggcuccucguugucacagcaguucgccuauccccagccucagauaccacccgggcauuuguugccgaugcagccauccggccagagugaguaccugccgccgcacguggcccugcagccgccaagcccugcgcagcccuugucuaccagcgcuagcgccaccucugcuuccgcggccagcuuuccucuggggucuggccagagcgucuccuccuugggugcccagaugaugggcgccuccgcccagcccagugaagcuguggccccggguccgguuccuguaggccaggccgcuccuugucagccggccggaguggccccagcugcucuaggaggcguggugcagccaggcuccgggcuuacugggguugggcagccccagcccgugcagccuccgcagcagauggguggcaguggucagcugccagccgugccuggugguccucacaccguggugcccggaguuccaaacgugccugcagcgguacccguuccaagcgugccuagugugcccaccacuucuguuacuaugccaaauguacccgcgccucugggccagucucagcagcugagcagccauacgccagucagccggagcagcagcgucauccagcaaguugguucacccuuagcucaaggcacacacagugcaccaacaagucuaccacagucugaccuaagccaguuucagacucagacccagccuuuagucgggcaaguugacgauacuagaagaaaaucagaaccccuaccucaagcaccacuuucucucauugcugaaaguaagccuguugugaagccuccaguugcagaugcccugacaaacccucuucaguuaacaccuaugaacagucuggccaccucuguauucagcauagcuauuccuguugauggugaugaagacagguauguacauuuuuuuaaauuuugaauaucugauagaguugcuugccccaaauaucuuaagaugcaguuuggggaguuuguuuccacuuagggucuuuauuuuuaaaacuuaaauuugguaaaaaucaauucaaaguuuugaaguaaggagacaaaagucacgggauuuuuguuguuguuguuuuguuuuuguuuucuuuuuaagcaauuaaauggauagugauucaacaugauugauguauuucagcuuaauaguuugaagaugagagcugguauugcccccccccccuucaguaagaaagagggucccuuucuaagguaguaaauuacuuuuuaauguuuaugguagaguuuugccugaguugguaagacugaaaaccagaaagccuuuuccugggggcagggaagugauggaauagaagcagucuccaucagugaauuuggaagacuggagagaaugauaaaaugugaagucuagcuuugacuaucccuaagugagucuauagaagggggucgugagaauucccaguaacuuuucaaagauaauauuuuuguuuaagcaaaagaggaaaaaaagcaaagaaaaaguacugggaaaauggauguucuccuaucagucuuuaguguaggaaagggagguguggaaugcuuaaacaguaguaaaaacuagaguuuugaaaugucuguaaccaacucccucuaccuagaguguaaggauugcuuuuuuaauaguuuagguaaaaauuaguguauuacuacacuauucaauaguggugguguuugguuguggccuacuuaggaauuguaggggguuuuuugguuuguucuuuaggagcugucacauagaccuuugacauuacauaauuccaaccuuguuaaaaacuuaauugcaguuuaacacuacauuaaaaauuacagggaaagaguuggguaucuucuuacauuguauguuuuugagagagguuaauuuuaggagcuaaaagggucagaauuugguaugaucuagaaucguuaguuauguagaagacuaccaugaaauaauaaagcuucucuucagcauuuuagacucacacagccuuaacuuuugacuuccaguuauccuuguuuuauuuuauauauauauuucugcuaguuuaaaaaugcugacuggaauucauucaucacuguuuuuugugauucagaauucaugauuuuuguagucaaguugugggaaaucuguugcacuugagaacucaguguucuuaagugugcuagucggccagccggucacugaaacauuuagugggauuaaaaaaaaaaagaaagaaagaaaacugacuucaugagcaacucaaaacaacaacaacaaaacccccucuguucucuaguugcuccuauuuucaaggguagggccacauauaacaggaagguggaguuuaccuuucaccuuugaugguggucaauagcaccuuaucuuuucuagcuagcagcaaccucuauuuucuaaguaaguuaucuuucacuuacccucuuugaucuauacacuguccugucucucuucaauuaugacuuuuccccaaucucuucuuuuacacauaaaaccuaugacugugaauggaaaguacaucuuuccucuucacacacuuuacaguuuacaacgucuacaguuacagucuucagaacuuaaaaguauaauuauauauuauugaaacagaaaucuguuggcaaauggaaacucugaaacauauuccuguugaauauuucuacagaugcauacauuuuuccuuacuguagagaaaguuaguaaucucagaaaucuuacuuccaaauaugaauguuuucacuccagauagugcuaugucauuguucuugcaucaguugguccuuuucaaggguuugauugugguagccccauuuuaaaugugccacuuuaccccagucuuaaauucugcauugcauauuuaucgguuuuuccguuuuuuaauaugcuaguuuccaagauguaaucuuaacacacuugauguuuugucacuagaccaacacaccuggugaaggaaugauccauuaauuagaaauaggguuugguuuuguuuacuuguuuguuuuaaaggaaagucuguguaaagaggucauucugaaguuuacacaugggaauaauaguuuuccaggcacauguuuaaauuacccagaugaauaacuuaauagaaacaauacuaacuagaaacauuacuuuuaauauaauuugagguuaacuuucuuaaaaucugcaguaucauuuauaauacuucaaauaaaauauaaauuggagaguucuugaggaauuaaugucuuaaacuuucugaauagguuaacacauuuagauccuaaggaaauacuuguaaauacucauuuuuuguuaaaauuccaaauuuaguaaacaggucuuaguucuuuuguuuuuaaacaaaaugaaagaaggugggaaguuaacaaaagguggguuuuagguuccuacauuggaagucuuaucacgguuugauuccauauaaaggcuaaugcggaguccuuaucauugucuguugacccuauauuauuaaguaaucaaagagugagauuuuuccagccauuuugauuggaaaaauuuauggcuacacauuaagacuucucacauugaauuuguauaaacuggugauuauaaugaugauugauaaggaauuauguagccacuuuuauagugaacauuacaaacuuugcuuaaacugccuguauguuuaacagucugcuuuacuguaaaugagaggacauauaaacuaucacuggcccuaaauggagcacaguacagauuguuuuccauaaauaacugaccaguguuaacucagaagguagcauuccuggaacucaugaauggcuauaauugugaacugucaacugugugacaguugaaaaccugauuauuguaaggaucccuuagugacacguuacuuaguauuguuaguuuaauuugaauaguuugcuaaugucuaguaauguugacuggcauguguugguaugugcuguaacaaauuuguccauauauauuuaguuaauggauuucacauacauuuaauggaucucucucuaaaauuugaaguuuaagugaggauuuauuuaaauauauaccaggaacaacacuguccucuugguguaaaauguauugacccccuuuuaagagcuauguuacagaaaggucuccuugaucuuccuguguauaaauuuaaaaauaugaacccuucuuauuugaaucuguuucuuuggaccuuaacucuuuuuuuuuuuuuuuaaucgauugcaucauggagguaauuuugcuuuuccagcuuuacaauuaaagaguaaaucaccagcaagauacugucuuaugccaagcuaagacuuugggaauguauuccuacucaggaguugguugguagucaaaguauaaaauuagaugugaauauaacauuauauuuuguauaaaaacugauagugguacagucauuagaaauaccuaguugcuaaaauauacauuaguugcaaacauagauguaaauaaaauauaucugaauuuacagauuuuccaaaggagcugaaauuccuacagcuuuaucaggaucuugaccuuucauauucaugggaacauaccuuuuuuaaauugagaaauaguuacuauggaccaaauguuuguuacuuuaaagaaaauauaugcuuauguguauauggaugaaacacauuccaaguaacauuuuuguacagguuuuuuucagguaggugaaagaaggguauggaaucauaaauauacuaaaucaccuuugugagaaguaauuuuacauaguauuagaaauagaugauauguaucucugagaauaaauacaccauccgucuauucuuuaaagcucugacagcauucauuuguaauugguaugacacugggauuaaggauuugguuguaauacuuuggaguggaauuuaucuuuuuugcacaaggagagguuagaugcagauauuaaacaaauguucucacacucaguuuucuugauagaggaacuggaugugaggaaaguaaaaaagaaguuuuaauuuuucauuucccaugacggccugaacuuagguguaggaaaguauugagugauggcaaauaaccaagaugaaagaaaauauaauagaguaucauccaguuuggucuuagaagaaguggacuuuucaauaaugaggauggacuaauagucugauuuuuuuuuuauacccuuuuacuuuuggauaauaguuuuagaccauuuaagauacuauuuacuaauuacucuuugcuauaaggagaaggggcuuuauaaaagccagucugucuaaaugucgucuaaauguugaccccucgauucuuaugcaaaagaauacaagauuuuuuuaaaaauuagaaauuuuaauucuuaguauucuauuggaaaaaccuuaaagguuguaguuuuuuuuaauauucaacuaguuuaaaauuauuuuagauagcacaauccugaugagguacaucuacaaaaaaauguacauacauaaaucauuuaucuuuucccauagcaaaucaaagacacacuaauuauucaauauuuguauguucuuucuuagucuuguauugcuuuaaaaaaaaaaguugccuucuugguaggcagaggcagaaucuguaauuucaaggccagccugguuuaacauaguaaggcuugccagggcuacguaaugagacaccaucucaaaaaucaaaguuauaugccucccaugaagauuuacuagcuugccuuaucauguuaugguauuaauaaaauacacuuuaauguguauaguucaaauuugaaugaugauauugaagauacauaaauuggcuucauguauguugcucugaaucuuucaaauuaaaauuagcuucauuuaauuuuauuuguaugaauguuuugacugcauguauguauguguaucacauguguuugcugauaccaguggagaccagaagauaccaaguccuuuggaacuagauuaacagaugguaugggcugccgugugggugcuuggagucaaacccacuccucuguaagaggaacauuugcucuaaacuacugagacauuucuccaguccccuccccucucaaauucaauuucaaauuucaaguucaaaacuccaaaucaaacaaacugugcgucugugugugugcgcgcgcaaaaucaguaugcaaguuacugauuuuauugcuauauaccuaguauuuacuguuuguuagacuaggcaaggcaagcaagugaaaucugauuguuaguuuaaauuauggacagucuccuuguccauaaguauucacuaagauaugguuggaguuuuacacuauagaagauaagcuuuuucuggcaaauauaucaauuauaaagaacguuggaauauuuuaaaucuauuuugaguguuuuaggcaguuacuuuuuauuaacaaguaaaagguuuaauauguaauaaaggauuuuaaaagcaaauuuuaaggcccauuaguuuuuaaagagaguuauaguuuuaccauuuuggagguuauguauauuaaaccaaacaaauccuuuuuauaguuuaccucugccauggaaacaagcgaaaaugaaaaaggguuuucuuuugguuaaaugcaaucaauaauauguuuguguauuaacauaugaauggccaugacuccagacuauugaauuaaaaucuguugcuguauauuuggaauauuggacuuuaagccagucacuuagcccuguguaauuucugcuucuuuaugugaaaaaugaggauaccugccuuggagaucucagucuuaauucugggacucuuuauuacaguuccucguguuaugcugaccuccaaccaugaaauuauuuucuuugcuauuuuauagcuguaauuuugcuacuguuaugaaugguaauauaaauaucugauaugcaggauaucugauaugugacccagugaaagagucauuugucaccccacaaguugagaauugcuggccuaauauuaaauuuuaugugaauagccuuuaacauaagaaauuugaguaaguauucccaucaccacuauagauuaucccuugaaauaguauacauuuuucaaagucuucaguuuugauauacaaguauaagacugauauggaaagauguuuuaccugcaugugugugugugccugcugaugcccauggaaaaggagaauacuccuuuagucaugauguaauaagaguuauagcaaauuguguucuaaucuugauucuucaacugcuuugcugauuuaauugauagucauuuaauuccccucagcuuucccccccccuuccauuuguaaaguuagaauuugggucuuacucauauuuuaaaguucugucuaguucuauugagcccauuaaagaagaaauugggaagaaccuuuugucaaaauccucuaccacuuuuuuuuugcuauuaccauuguaugauugguugguuggaagaaaauggagcuucuuuauccaaauacuccagaaguaaauugaaugcaaaauaaguagcuaaaggaacaauuuacuaaucauucaguuuuuguugauucuccaaguuguaaacauuaagguacagaaaugagauucuauuucuucuaagguggcauccuauaugauuagguuaucuaugauacauguguuagguguugauggaguaaauaguauaugcuaguggggaaugguuuaagaaaugugauuucuuaauacaggcugacuucuguuuagacauugucuucaaguauguauauauguauguauguacauauguauguauauuuguaguucagaacuuaaaauaccaaaaccaggauaaaucaaaaacuucuuaccucuguucuccagccagccaguuuucugucuucagaaucaacccaauauuuguacauucucugagacuaacucuugaacugaguuuuaauuuaaaaggccauccacauuugaucacugauaagagugauuugcuaagcucagagaaguagcagcuugugaaaugaaauugaagagugaaaccgucauacuugauuaauugacaagaacagugaagggcuuaauaccauaguaaauuuagauuuuuacuuuccaguugcuauuuaacaguauuuuuugaaacuuuuauugcuaaauuaguguuucucuuacagcuuacuucaguauuuauuucagugauuauuguauuauacguuaaaauguaauaaacuuaugggggcuugcguuggaggcguugcacugaagcccaaaagucagagcuguuacuuggcaaauauacuaaauaguuuucauguaccuaacucuaaauuuuaaauuauucuuuuugcuucaacauuaccuugaugaugaugaugaugaugaugauaugaugaugaaacacuugaugcaugucaagauucuguaccaaaaguugcauuuuguauagcauaaaauuaagcuuaauugugucaaacccuauauaaacauaaucuuauuuggucucuucaaugaccuguaaacacauguuuuauucucuuuuguggacuaagaaaagaugaauacuuaggaaugacacucagaaaccaguauuccuuugcuuuaguacuuagcaaacaaugaaugggaagaaagcaaaguuacaguaaccacaauaauugguuauguuuugaccugaaggauauuuacaagugcuuaguucacuuguaagauuggaauggcccuuaaugauuuuuuuaaauuuuguuugguuucuauguaaucuugaagguugaguuuugacauauuuuaagcuucaccaacuuuauggcuuuuagaugugggauaugcauauguguguuucuuuucccuacuacaguuaacuuacaaauagaguaucuugcuaaagcaaguggauauuuguuauauggguuuuguuacuuucugacauacuauuuuucaugaacugggaaauuaaagugacagacuaguguaugaagccagggacuagagaaaaaaaagccauuguaaauaccaauaggcacaauuaaacaauuacuuugaaaugacauaaaaauugaggggacuaagggccuaaggaaagcucuauuaauaagauuauuuaaaugcuaaaugaaaauuaauagcacaaagauguaacugaaauguuauuaaacguuugugcauuuuugauuguauauuuucuucugcaagaaauuacauucgaaaccaguuuucuaacaacuuucuugaagugaauauaaacuacuacuauugaggggugauaaagcaauucuuagaagaaugagauguaguuuauauugaauuuauugcaguuuuuaaaugaaacauuuuuuaaaaccacugauaaaaaucuauccuucccuccccuuauuguacuuuauuucauaggaccuuuucauacccuaauguuuacuguuaacuuuagauaauuuuuuaauuuuauaagaaauacauugaaaaaaugguagcauuaugugacuuugacaccaauuugcuuaggggguaaauuugcuucaaauuaaauguagguauuuccaaagucaacauaccugaggguuuuuuuuuuuuuaaugucaucucucugaguagauuuaauuucaaauacucuuuauaaagaagcuuuaauuccaaauugggcacuagcuucaaaguuauuuuccucucccucucugccuucuucuuagaguuaguuauuucauuaaaguugaaguuucuaaacaaaauauaaggaauagcaaaccaguuuuuauaugguccugggcaggccugauuuaguuggugguaggaggagccaaauuagguuuuucagaucuuuugcuuucuaucuuagugacuuaauuuugaagcacagugaggaaaaagaaguagcuuaacaaaaguuggaaaagguuggaauccucuucaauuuucuuguuggaagaucuaaucugugcuucugaugaaaggauucaaagaauagaaaggaaauaagagaguagggaaagcaguaaggacuacauugagaguccuaauuaauccaacaacuacuuggcuauucucuguuauccagugucagugugucuuuucugguuuaucaaaagggguaccuguugguuaagaucuaaacaguuuucuaaaacgugauuguguauacauacagcauacaguuugacacaguucugguuuugaagucacgauuuuguuuuuaguuugaugaucauuuuauauuuaauugcuaaugcagacaacuuuguaaauaguucuaagguuuuuuuguuuuguuuuaaauuuucauuuauguguauaugaaugugugugugaauguauacuaugugccugccagugcccauguaggccgcaagaggguguuggaucuccuagcacuggaguuaacagugaauuguugugauccagcugacaucugugauaggaacugagaaccagauugauugcuaucuccucugauauuuuggaaguuacagucgugugauccauuucugaucagugagauagaaucaguaaaucugagcccuguuagaauuguuguggaaauugagucagucaguguaaaguagugugaauagcaucugguauauaacaagcuuguuguuagcugcuagucuuauacuaaagcauggaucaaaguuguuuuuuuuguuuucuuacggacccagaagaaugauugagugaguuggugggugauugauucgacauaagauuccagggaguugggaguuccaugcaguuaugagaggauccugguaguuaaaccugggcccuuagcaacagcacuuaaugugcucucaacuagguggcccucuuuagcuccaagucagggauuuuaaagugauguaacagguacuuguuaacucccaucaaguacggguagauggugaagaagacauuagaauuaugcuuaaugacagaaaacuguuaggaaaaauauguuucuuaaaaguuuagcuccuugagaaacuguuccuaucauagucaguuguacauauuggaguuugccugcaucagcucaucaguuacuuacaguucuguuauguuggcccuaaggauagaaauaagugauauaguugauagguuuuuacccuuaaagggacaauaaacuaaugcuagaaauuaaaacacugucccacaauugccccccauacacauacuaacccaaagaaacugcacacaaacuuacaguggaacuguaucaugagcaaaccaggaaggaauuuacauuauuuacauuaacugucuuuuaacaaauacuagaaagcugaagcuuaguguuguaucuguauacacuacuagagaacaacuuaacagcuaaaaucauagacuauuguuaaggcaucugauacaacuugguguugauaggcucugaacggucacaucgaucgauauauauaugcacacaauugacuauuaguaguuaacuuuaucugcuauucuuccuuuuagaacuuugauccugaauuacuguggguucuggagugugugucugucugucuccaaaguauuguuuauaaacaauaaucuuuuucuuuuuccuuuuucaaguuuaagugguuacacuguguaggaaucuaaagucuuccauuuuuuuguaaguucugauuauacuguacguucucaacuucauuuccauuugauucuugggucucacaggaauccuucaacugcuuucuaccaagcguuccauuugaacacgugucaggaaucaaagagccucugggauagguaugauuacuugauauggaaugcauacaugcaaaaguguaugcaugaauugcuuugcauaaaacugaucuuugcuauuuugaaggggauugaauuacaugguaucuaucaugggacaaagcagcaaaauaaaccaaaagacuauuuucuauaaaaguguaaaugugcuuuuuauuuuacugcauccuguccauauuauaucuaucuuuuuuaaggauuugcaucuuugucuugaaauagucacauaauauaucuuaauacaaaacauuuuuuucuguuaaauuggucuuaauuuuuguguuuuauaggauuuauaaacacacacacacaauauuacugcaaacuaaaaaacuggaggagggacaagaccuggauaacaaaaugccauuaauuuugacaagaaauugucaugaaguuugcuuauuagaauuucauagauguguauaauuuguaagcccucaaaacaaguuuuuguuuuguuuuuaaccagagauacuguuuaggucuuaucuuucacuuaaaagaaaacuugauuucacuuuuggcaaaagauacuuugguuuaucuuucugcuuaacacacauuuuuaaauaguuuaugcuuuauuuaguuauuuggcugaauauuuauuagcaaucuaucauucaguguuuaauuaauaggaguugagcacagugguuuuuguuuuguuuuguuuuaaauucccacaaagcuuguuagauucuuuuaacucugccuggcaacgcauuugugucuucuggcauauuuuuggauaacacucauagacucaacucucucucucuuucauuagaaaagagaguugcuaagugcauguacauguccuauuaagacauggucugcauuggcuuaaugggaaaugguaaaccuuuuaaucucuaggcuugauuuauuuauguguauaacucuaaagcuauuuucuaaacaaaguaucuuguagaugauuuguuccuuacuuaaccaaaaaucauuuuaaauaauuuuuaagagaaaguuuuaaaauuuuguaguacuguguuuauguauaaucgggcuuuaauugguuuugcucuaauaguauaaaguauuauaaauaaauauauaaguagauuauaguaugaaauacuauacuauaccaugaaguuuuagucauucaaauaguacuugaggcgaaccuuauacuuuuccugaauacaaaagaaauauaguacacuguucaaauauaauaaaaguagcuuuaaaugcaguuuaauuauuuguaauaucugucucauaagcugucaugucaguaugaaugcuguauuuuugagagagguuugauuuuuauuuucaauaauauggaucuaauaucaaaaugaucuuuauaaguuucauuauaagacagccauagaaguuacuugcucauaauuuguuaacaaugaaauacuaacuuguucucuuuaauagauaccaaauccuuuuaacauaucagaagugaggcaaguugcugcaucuguaucguuucuuauugguuaaaaauuauuucugagcuggggaaaaggcagauguagcaagccagacacuagaauuauggaaacagaacacucccaggaucuuacuggcuugcuggucuucccaauauagccaguuaguaugaugaagauuuagugagaggccuugucuugaaauagaugggauagaguaagacaccugauguugaccucuggucuacacacacauauacucuaauaccccaauauguauuuucucuuuuuggauccuguuaucuagaacuaaagaaguuuaguggauauuuguacuguugccaauauaaucagagcuuaauauuguagauagucuuuucuguaagcuggacugauugguaccaagguaaaacacaauggaaacuugagaauaguuuucuuuuaacuucuuauaugaaaagaaaauuaaaugugggcuggagauacgacuuaguaauagaguaauuauacacauauguucacacauagacacacaagacacaguggaaaaugaccagcuuuauuaguucuaaacaaaaauagagaacaguuuauacaauuuuauuuggcacaucccuauaggcuuguuaagggacacugagaaagcaucgugguucuauuuauucauaacagauggguuaaaauuuuuuguaauauuaggcuuaaaauaguaauuacaacuuuuggcuuuguuuuggaucucaccaaaaagccuaauuuuggacuauuguaaauugggaaguuugucuugucuugucuucucuuguuuuccuuuucuucuuuccucuucucuucucuucucuucucuucucuucucuucucuucucuucucuucuuacuuuuuuacaauuuuccagguaaauguuuuacaaagguaauuaauucaguguuaaguagaaccauucaaagguuuauuaagacagugguucucaaccuuccuaaugcuaugacccuuuaauauacaauucuuccuauuauagaaaccccaaccauaaaacuauuuuguuacuaacucauaacuaauuuuacuacuguaaugaaucauaacaguaaauaccugauaugcaggauaucugauauaugacacacacacacaaagagaucacaucuacagauugagaaacacugauuuaggaggccauacguccuuuauaugaucuaucuauguuauuuacauauuuugaagcauaaauuuucauauccuuguugccugauaccauauuucaggcuucuguuucugaaaucuuggaaugauauugaguagagguaaccuuuuuaagauuuauuuggauuaggcagagguaugcuacuuguguguagguaccuauggaggccagaaaaggacaucaaauuuggaucuggaguaaagaugguugugagcuaucauggaugcuaguaaccaaacuuggguccucuggaauaacuggaagagcucuuaaccauugagccaucucucuaguccuggggauacuuuaaaagccaacuuucaagcuagcuuuaaauaauugucccagaauaucugaagguccaugcuugcagaagguccaugcuuacacccaauuuuaaggacugaaaccuuuuucuuccugacaggauacuaucaauuugucaagucuuuacaaucaaaauaggaauaacuaauaugcuauuacauauuaacuugccaguucuccuuugucacuuccuguauuuaaguuagaauuaacaauuugagagacuuuuaaaauagucagaugccuuugucuauauucagaucuuuucugaggugucuaguguuuuucuugcuuauguacuuaaauugaacccuuccuuuucaucauuucguagguaccauuauaguuuguguuccuuauuugucaguuuugcagagaccucagggccaguugguuaaaauaucuacaaauaugaaaagagugauacuauagccccaaaauaauccaacccuuuccuaagcucuguucauaauaguguagcuuauauaauuaguuuucuagguaggagguaauauacuugugaagucaauuuucugugauauccucacauacuagcauuuuagugauacuaaauuuugauuaccuuuuaaaaauugugcucauucuuagauuucuuuggucuaccugguuuuuuguuuuguuuuguuuucagaauuaguuuagaagccuguuucaauaaucauugagaaucaaacaucauuaagagguuuuaucuaugaaaguuuaguguaggaauuauaguagacaguuuuaccaucucuuaauggcauaucaggaagauaaaggagugcuagagaaaagaacauuuagacuaaagggagaaaaacagacggcuuauaaaaauuugccuuagggauaagcacuuggaguguuuugucuucaugaagaaaucaguuaaaacucuggggaaagaugaccagauacaugacccacauaauuaaaaaugauggcuccuuuauaauaugcaagcaguuucaacuucauaaggagaguuggagccauuggucaaaacuacuuuagaagguagcuuucuuauuugaaaaguagauagaguuuguuauuacagaguuagagaacugaggaaaaggagcauuucaguuagagaaacaguacuguggauuagugugcagauagauauuauaucuuauguauuuguguggguuaguauaauaagaauaauuagauuugacuuaguauauaaaagcaacagaaaagaagagcuugauugaacagagaaaaaauaugauugucugaaaguaggaaucaauuaguaaaauuuuacagugcauagauuuuaagcacccaaagaacuccaaagugucaaaaacccaguugacugaggaaaugcuuauauuauagguugcauuaacaaaagaauuaguuuagaaaagcguacauauauugaugagguuuaugguuuuagcuguuuauggauuaguugacagaccauuagaaaugauccagguaugcaauugcauagagaaauaagauuagaagguuuuuucuucuucuucuucuucuguaaaguccaaacuucaaaagaggccaggaucccaaggaacagacuaggauaagaguaacaaguaacauaaguaggauaugggucaaaccagaaccuuaagcagcaccaccuaacauuuagagacuagaaucgagauaguaugaaaaagguguuuuagaaaugggaacacucugggaauauugcuuccuaacaaaaaagaaaagaauguuugcaucugcucuuaggcagauugucugcuugcuggaguuugaaccauagucuuaagcuuacucuuugcauugguuccuagguaaugauuuuuuuaguuuuucuauaguucauucagaacacuugauauacugauaccuguuuucugcccaucgauagacuucagaauugacaaucagaaauaguuuagcaacuuacucccgggcuaaaacgguuuuguuucuuccuuuaccaccugucuuuguuguuuaaauuacuccaccuaaaucauccauccuacuuagagagugugguaauuauguucagugugaaauuuuagaugaauuaagaaguuauuauauauauuucucacuaaauucucugguucucagagaaccagagcuuuaaauagcagaaaauuauaaauuaauucaauaaccuagucuacaaaaucuagaacuuuauaggaaauauuuguuaagagaagccauuuauuagccuggcucagaauaagagaaaauuuaaaugcacccuaaaauuacuaaaguaaaacaaacagggugucuuuuguuauuuuguuuuuccauuauauucaucagcugcuuaaaguuuagguucauacuucaauauauuuaaacucauguauaguuuguaagccuuuugagaagaaauaucagaugaaauuguaauuauuuuuaagauuuggagcagugagagagauuuaaacuauagcuaguguucuuuaugugccugaacacacaugcucaugcuaaauaaaauaaauaaaucauugaauauuuugguuuuggugaucaauaaagagaacuuuuaaauaaaugcuauggauuaccaaaaaucagcuucuauguuuggacuuuuaguuggcuacuuguaaaauauuuguuuuauuuagaagaaauacauuuuaauagaagaaaugaauuacaguguuuacuaaauauccuuaaaaauaguauuuuuguuaugacaguuuuaucucuucaaaauuugaagauucauuauaaguaugaaaagauuuggaggugcuacuuuuuuguuuugguuuuuuuggggggcgcuuuuuaauucuauaguauuugagucagaaauagugguauccucaauauauuaaaguaugugugcgggcaguaugacugucacugucuauaguuaguuauuuauacuuauauaaguauauaauauacuugucaguguauauuguaucagacaugguggcauggacuuuuaauaacagcauucaggagacaaaggcugaugguucucugaguuuauggucagcaacuuccaggaccaccagagcuaugcagagcaacccugucucaaagaaaaucaacaauucagaguugaauauguaguuucccauuaagaaaguaugaggauuucuuuacauauucaugaguaguauauauaacuggccuccauuuacuuuguuauuccauuuuauccaauuuuaauuuuuuuauuguuauuacacccuuuguaaauuuauaaauguauauagggcugagugaugugacucaguguuaaugaugaguuugcaucuuauauaugugaggcucuggucacaagccuuaucacugaaagagaaauagaaggaggaugggcaagggaaaugacucagugguuaaucuuugccacgcaagcuugaagaucuuagguugauucucagcauguauguuuugaaggggguggagaaaaaccagcaagagcaacacacaccuguucaauuccagcacuggagaggauccgugggccuuuaauaaaggucagccaaugagaagauccuaguucagaaucugagguggagaacugauggaggaagacacuugauguuaguuuucggucuccguaucuauuccuugacacauauaacacauacauacauguugacccaagaauaaaaaauauaugucagcauguagaggcuuuuuacugugucauaauauauuagaucuaacauuuguuguaguuucuaugucaauuucugggaacauguggucuucucgugcuuuuauucuaucaggacuauuaauugcuuaucuuagauguuuaaguucaucuuucuaauacauaaucuauggaaaaacuauauguaaaaguguagggaacuuugaauagccaugaaauuauaucuacauauuuauggauaguuguauagaauuuuuagaauacuuuaaaagaaauaugguuuauacuuaaacauggaauuguguuugacucuaaagauacucauucaagugacaaaaagguuagggauuugccugucagugguagagcauucacuuauuggcaccucguuugucaagcgauuuuuuucacaaaaaguuauuugggaaaucuuaacaagcuuauuauugaguaucuaucacuuucaaauuaauaucuggaaauuuuaagccauucaucugugcccuccuauucauuguuuuguucuguuuuauuuuuuauaaagaaaacugagcuaaguuaugguaauauaaacuuaguucuuaacuugaaacuuucaaaagcacuuugucaguuaagugggauuucucuuccuaacaauagaaauauuguuagaucaugguugauaauguuaaaugauuaaucuuuauucaucuauaaauacuucagcuaauuuauuuuagaauuagacuuuucuaccauuuggaacuuaaguuugaaguaauuugaaguaacucuucaaauacuacccuguucuauauaauaacuaauucuuuaaaaugugugcuaaaggaaagaaaugaaauggaaguuuuguauuucuuaaacauaguuuuuaaacucugagauuauauuugcauaacauauauguauuuauuuuauccuauaagcuuaucauuaaaauaacuugccuuauauauggcuaguuuaauucuaucuuccaaagccuuccuaggcacuuacuguaauacuguguuaguuagcagacuuuaacaaaaagucagauugcucauuaaaugaccaauucauucaggccuucuagacaagcaaguuaccaaugcuaucaauacacauuucaagaagcauuuagcuuauuaaauaggacuauauauuuuaucuucuugugagauuuuucccauaacagaguaaaucaucaaaauuagacacuuuuaaaauagugaguguuuugauugcuaggauuauaacuaaacauuuucaaagacauuuggugauaguugauaaagcagucacagcuuuggauaaauauggauuuuugccuucaccaggugauuucauuauaaacuuauguguucaggggaaaaauuccaauucgcaugauuuuuaaugaagucaagugcguugugagauuacauuuggaaagauuguauuuguaaauagccacauaugauagaaaaguuccauucaaagguaaaaucugugguagcauagugcaccucauacacuuaggucagauaccuuagauagcugcagaguuuccuuuccaagacugucuggaguuuugaacauacugaucuuccucaauaaugggucucuuucuuucucccuccucuuugcuccuaccaucuacccauuaaauaauuuuauuuagaguauuauuuagguaaaauuguauccacaacuuuugccuuugcuguggaucucugacaacuaaaaauaaaaauaugaauuauaugacaggacauguuuuuaaugaugucauucuuuagggauugaaauagaugcucauuaagaaacuuucuagcaaaaaaauuaauaauuuaagaagauacucuuuacaaguaguuuuggccauuuuuaaauauuuccccaguuuccaggaccacuguugaauaauucaggauauacuauuuuuguaagcaugugaugaaguuuguucuuaccaacaugucuacuuuagaaauugggagcauaggcagacgcagaugucggaauaaacauggagugcugucuuacuugcugacgugauccaugcagguuuuuaugaucuugccaacuguacuggauuagagacuuccauggauuugggcuagagaguagugcuccagugcauucuguagugucuauccgguuguaugguguuaaaucagaauuucuggaucaugaucuuaaacuuuaaugguuccauuucuauuugacucuucacugagaaguauucugguggccuggaacuccauguuggaauuuuaaguuuuaaucaaaucaaguauuucaaauuauuuuacaucuaaaaauaucaguugugugaccaugguaaaacaugaaccuuugcuauaaacgauuuuaaaggcuauuugauuacagcacuuauuuacuuaaacucuuugcuagaauuuuuuuuagaauucagcaucggaggaggaaugugacauaauaaugaucgaaagccgaaaguuuaaaaguugugaugcccucacaugguuggaggguuauucuagcuucuaaggacugaauguuguccacaagagugucucaucaggucauaaauugguaagacuuaauggauuagauuuuauguauuauaccugauguuguuguauugagaugacuauaugaacaaaaugagcacguuguguaauuaauaguauaaaauauaaguuaaacuuagaauuuuaacuacuugauuauguaauuauuucaaagucucacaaagcccaagccccugucucuguaguauuaaacaaagcaguuuaaaaaagaaagugaaauccuauaugauaguaacaguaaauauuuuuguugcaucuguuauagaugcuuacaguucagugaaagcccaaaauaauuugcagcuauuuuuccaggaaauauuugagaaauauuuuuaaaaauauauccauuuucuucauaacauacugcauauauuaauuuuauuucuuuggaggguuuuacuuucuucauaaaggccaucuuuguuucuaaacacagccauuuuuuuccaauuuuaauguugagaauacuuaucauggcagugucaugugaaaacaguauauuagaugucaguauacuuguuuuuauaucuugaaaauuaauuucucucagaaucucuccguagaagacaacuuguuuuauguaccuuccuuggcuuguuuucugaagcuguguuuuaauaaauuggacucuuacuaggauuuaggucaggauaaauaagaucuuuauuuuucauauuuugaaaaugaagaaaaaaggaugggcuaaguuguauauaguuauagaacuaauguucuuauuaagguauuguauaaaaacacuacaaagcuaucaagaacuauuuggaguuacuuucuaagaaagcuaaaagguguggguugauacuaagcaagccacuguagccguugcaacuuuauacucaagcagacauaggucuuuuguccaguguccccuuagccacauucaugccuacacugucuucucaauaaaauccucaguuguuucuagugugguuuuuauaacuacucuguaagcuuaaauuccuucaaguaguaauugugaguguggaaauaaaauaaaccaucaaauucuuuauuauucuauauacuuuuuguuucuucauuuuucuauaacaaaucuucauaacccaaccaagagaauaucuaguuugucuaguguauguuuaauaguuaaaggcuucagaaaauuguaaauuuaggaauuuaagguagaauagugcagucuuacauaaaaaguuaagagcauugaucagaucuuuaagaguaguuaauaucaauacugaauauuuggcucugcuugguggcaugugccuuuaauccuagcacuccagaguaagagguaggggaucucuggaguucauccuggucuacacagcaagcucuaggacagcugcgacuacauagugagaccuucucugaaaaauaacaagcaaacaaagugaguaggcuuuguuuuaaaaggcaagccuuguuagucacccagguauaugauuugcaaaaggaauuuuuaacaaguccauugauccuacugauuuucacuaauaauugaucuuaacagagagggauagaacaaaucagagccuagcugcucuaguuuuaaauuuucaugcuguucggugugguggcacaugccuuuaaucgcaggacuugggaggaagaguuaggcagauaucugaguucaaggccagccugcuccaagaaccaagcuccaggaaagccagaaugacagagaaauccuaucuuuuuguguaguggugggcuuaggggaggguuaggauuuccucccucccucccuuccuuccuuccuuuucuuucagaauuauuuauuuuauguguaagaaaacacuguaccugucuucagccagacacaccagaagagggcaucagaucccauuacagaugguugagaaccaccaugugguugcugggaauugaacucaggaccucuggaagagcagucaucugcugagccgucucuccaggcucccaggaauucuuacacugucaauccuuguuuaaguuuugauucaguuuuuccuacaagcuaguuguauuucuacugcuguuagacauaucucacuuaguuuuucuaaaucauaauuauauaaaucaucuaucaguaucccugaugguuuauuuuguuuuguuuuggguuuuuuuggaguuugguuuguggcagggugcauggaacuuguguaaacgggguagccuuggauucaaaaaggcuccuucuuucugccuccaaaaugcuauuauuaaaaguauguaccaccauuccuaucaaauuuucuuguuuugcagagaaggaaauugaagcauggagagauuaaauaauguauuauauagccauuaaaugguggcacuaggagucacauuuaguuuucauuggauauauauauauaugcucucaguaugcuggcauggagaguaaaccuagauaacaugguggauaaguuuauauuauacaaaaacacagaauacauaauuuuaauucucauugaacuagaguuuaaugugucauucucuauuagaaaaucauccuuuaauuccaaaauacaugccaugaauuguauaguguccaaaauuaauuuuugcauuagaaaacauuuuguucaaguuuaaugcuuaugauuauaagcaaauaaauaucuauuguaauacuuuuuuuuucuucaaaaaagucuuuagcccacaagauagagagguugaagguguuugacaccaaauccaaugacccgaguucaaucuccaugauucauguaaggguggaaaggagaaaacccucccacaaguuguccucugaccuucaugugcacgucauggcaugugcaugugugugcauguacacaaacaaacacuaaauuaaauaaauaaugcaaaauacuaaagucuuaguuccaauuagaauaguauuacaugaaaugauugugaaauuuacucuuuaauaaucaaguuuuauaaauagcaaacaauaaggaggcuguuuuaaaagcucuaauugcauauauuuucuaggauagugggaaauauaugucaaacucucuacuaaauucauuguaagaauuucuuugugaauuuuuacuuuguuauaaauccauggagaaaucgcauuuauuuuuacuuuugaaacauuaagcaaaguuucuucuagguacaugagccuuuaaccauuuuaugugauuugcauauaucuuuuugguuuuaauuuuacaucucauugaguuccaagccuuauaacauuuuguuuaaauuuuaaauauagagaacaauuaaacauugaaaguuuugugugcugaauaugacuuaaaguugagcauggugauacacaccucuuaauucuagcacuuaggaaguggaggcaggagaauugaaggguuugaagauagucaaauuugaugagacccugucucuaaacaguagagcuguugauauaguuucaugauacauugauugccuuaaauguacaaaguuuuggguucagucuacaucaccacauaauaaaugggaagagagagggaugguaaaguuuaauccaaaaugguacuguuuaaaacaaguucaagucaaaaauacuaauaguuugcagauacauucacauuguuugcaggaaaagaaacuauucaaugccacaauuaaaaguauauaaacaacuugauaugaaaucagaauaugaaaaucuuuaaaguauuauuuuugggaauacauuuauaccucaucuucuuuaguaguaauacuuuuauguuuucaaaaauaaaacuguggaaaguuuagacaaaaaagaagaagaaaaaguuaccuaaucuaacuuucuaccacaauuacugucccaguuuuuauauauuucccuugagacuuuugaguuacauacauaaauacacacauacaugcauacaugcacacacacauaugaacacauaaugaguauguguacuaauaguacuaauaacuaaaauuuuucaguacuuuuaagcuaauauaaaguaaaacucguaugugauaguaaacuucguuuugcuauugugacaaaacacuugagagaguaauuuaagggaaggguuuauuuuggcucacagcuucauagaccucaauccaaguuuugcuuuuggauguagagagagguagagcaucauaguggaaagugcauagugaaugaaaguagcuuaucuuaugucaucaaggaaauaguaagaaaaguaugaaaggaagggucuugcacacauaacauacucaucaaaagcauauccuaugaucuacuucuuccaacuagaguucuaaguccuaagagcgagcccauuagcacccucaugauauagucaccaccucagcagggaccaagccuuugggagaaacuucauauccaaacugcauuacucugccucagccuccaaaaauuuacaguugucuuuaaugcaaaauucauucaguaaacaucaaaguuccaacauuguuccacagggacagucccucuaagacuccaacaaauucauaccuauuagccugcacuaaaaacaaaaacaaguuauauacuuccaguuugcccacaggauaaacauugccauuccaguggugaaggagacauagacaugaagaauugaaccaaaacaaaaccaagccccaggggaauagacauuaaauccucuagcuccuuguguggcaucugcuacauacagugguaugaugugcacucuuacacacuuagccagcccucacuccucuggccuugcugguugcagcauacaugaccucucuacugggcuggcucuguucauugccuauggcuuuccuuggcaaauauccuauguuuuugucaucucugacuuucuggaaucuucaugucagcuuaaggauaacuuuuacaacuucacauaauugacuuuuccagggcuucccacagagauucuaaucuugccacacauugcauggcuuucaagacuuccuuuagauaucaguggaaguuucuauggcuucucuagaaagccagcaucacuuagaugauaccaaaaagaugauuacuaccauauaacacaugaaauacugaagaauguauauggucuaguuagcuguucuuauagcuguccuaauuauaaguauaggcuuccauuucuggucauauaaguuaaauaguacuaauauaaccauaguuccaaaaugguaaggagguauugcuuaaaagaaaucacaguuuuaauuuuagaaaucacaaagaugucuucucuuuguaguuguuauuuaccucuuagauaauaguugucuuaguuguuaauaaccucuuaggguuauuuguacucagaucuacuaauacuaaaaagaguaaagugucuuggaauuucuucgugcuccaaaaucucauuuacuaagaacucccacuaauuauuaggcauuuuaaaagcauuaugaaucuuuaucucaucuaaguaaaucuucaaauccuuguccuguccugcucaucuucagaauaacuuggcuucuuuuacuuccuuuuagacucauuucugaucaaugucaaagggauuggucaguugaaaggaauucauagauagguacuucugaaauaugauuaugaaauucauauuuucacuagauuugaucucugaaccuaauaauuguaacgugaaaaaucuucauuaucugaaagauuaggaguuuagaaagucccaaguuuuuuugugaaaucuuuuauuccuuuaucaucaugcucaggauagaacugcuguguuucaucaugcaauagccagcaaccaauagaaauuguuguaaucuuuucucgauaaauaagaccaaauguaaaggacauuuuagaaggaguacgcauuaaaggcuagcuucacaaccaaaaaaggaauaggaagagcuguacuuauugacuugacuuucucuaaccuuacuugggagagcugcuccuacugacugucccuaugagacuuuucuagucacuuuuaaucauuuaaauaccugauacguuucuuacaucuuuguccuggcaagcucuacauagcgccaauuucaaacugaucuuuucaaguguaacuagauaauauauuaaacauuacaagcuguguuucaucauuuucuuuguaaauauguuagauauuagucauauucagaauauauaagaagacccccugagauggauaguuccugcugucaagguuuacacuaaggcuacaauucuguuugauaaagagaacaaacagaauugaauggugaagaaucagaagacuauugacaagacagagauggcuaaugaaggccugaaaggaacagaugucuuucuaaauuaauauaacaaauauaucagaucaugauagaaauuuugaauuccucauaaagacuuuauauaaaacugaggcccauagggugguucagugaauaaagguaccugccaccauacuugacaauuccuagaaagaaaacaaaucaacuccaaucucacaaguugucaucugacuuccguaccgacacaucccacacaauacauuaauuaaacguaauuuuuagaaaaaaauuuuuuaaauaacaaacauuuauuggucucacgguagaaaguggcuggagagauggcucagcgcuuaagggcacugacugcuuuuccagugguccugaguucaauucccagcaaccacaugauggcuuacaaccaucuguaaugggaucugaugccuucuucuggugugucugaagacaacuacaguguacucauauacauaaaauaaauaaaucuugaaaaagcuuuuaaagauuuuacauaagcugagguaaacaauuauuaugacauucuuccauuuaaauuucacuguuaccuacaauauaacucaauaucaauucagaaauaugauucagcuuuaaacuagaaaguuguuaaaagcugaccaugugccacucuuuuuaccauucuuuaauggaaaaacaaaauuugaaagaaacccuuguauauuuuccuagugcugcuuuccuagugccuuuauucugcaccagacucuuaacucugaaagucuaaagcaguaggacuaggauaauaaaugguuuaagcaaaacagcacuguauccaguguuucuggguaguuuuguuauuguuaucauuuuuuaauauuuauuguuagaguuuugcauaacacuaaaaaaggcccggaauauuuugaguuauacuuuuuuauaaauuuuauguuaaauugauucuguuacauuccaauaacaguuguugauuuuuuccacaguaacuauuauauuuuauuauuauauauuuauauuaucauauuauauuuuguaauuauauuuaauuauauuuuacacuguuaagcucugacaaucuaaggauuuagauagauuuauuacuguguagucuacauaaaugcuguuucuuaagccuuaauaccaauuucagucucaaguuaauuucagucuuaagccuuaauaccaauuucagccucaaguuaauuguaccuauuuuagaauuguaugaagucuuaaaauuugacuaacagaacaaaaaaaaaaaucaaaguuaaucuaguaggauauaauuagaauuguuuaaaauucuuuggaauagcaauaaacauguuuuuuuuuucuuuuuuucuuuuucuuuuuuuaaauauuuauuuuauuauauguaaguacauuguagcugucuucagacucuccaaagagggcaucagauuucacgauggaugguugugagccaccaugugguugcugggauuugaacucaggaccuuuggaagagcagucggcgcucuuaacugcugagccaucucaccagcccaacauguuuuuaauaacuaagcguaauuaauuucuuacuauuucauggccucaggaccuuaauuauuaauucguaguuuaagauaguuuuaaaaggcugaccuuacagggucagaagacaagguaacuguuucaaacaguagaaugaacuaauugaaucuuguauuuucauaagaccuuuugacagucuuccauuagcaugcaauaacugugaccccccacuuuacagaugaggcuggucauagucuguuaacucuauaggauauaccuucuaguaaauggauagaaguuagaugcaaaaacaacuggaagcugaaacaggaaaauuacauguuugaagcuaaucuggguuauguagcgagguccuaucuugaacagcaacaaccacaacaaauuucuaauccaaaaguuuaugcucuuaaaaauguaauauucuuugagaauuuaauuuuugacuuagacaagagaugacagguagguaagauguuuuaccucccagaauggcuacaucaccaugaaacaaagagcaaaggggacuuuaauaguagugaaaugauggccuagacaguauugugcuuaaucugugcugucuuuuauuuguuaaagguguucguuuauucagaguuaagauuguaauuuuuacacaucucaacuguaaaacauugauugguuuauuaaaaaccaaauugauuuauuaaaacacaguguauugauacacaccagaaaucacagcacuccagaggaagaaggggguaggguugcaaguuuuagaccagccugugcuacaugaagaaauccuaaacaaaauaaagcaagcagauauuuuccucaauaaagaacacuuuccucucuuucccuaaggaacaaugacuguuugguguuauuacuuuaauccacacaagaagcaagcaauuaccuagucauaaaccucaagauauucucuuagagcuucuggguuuaauccaguuuugaaacaaucccuugacaaccuucauuuuuaauuauugcuacccuggacauuuuuauuuauuacuaccauggaugaggguagguuaugagugaaggaacauaacauagcaaagaaaaaauuaguaaccuuugaaugugguuuagcuguggggucuuaguggcuaaucuuaaaacuuauuuuuucauuuguauuguccauagaguuuuucuagaaugcagguuuaaauaucuuuucuaugaagaagugagcauaacugaaaauagcuauaaaauggguaagaacuauguacucauugcuauauuugaauuucacuuuaguuuacagaggaauaguuugauuuucauuuugaucaagucucauguagaaaugggauugagaggaucuguucacaaaugucaagguguaagaagcaguauguuagguucuugagagaggagauaguuugaggcuauugauuaaauaguauuucuaaaaaacuauacaugcuuucuuaagcccgucuuacucuguaaccuuucgcagugcgcuucccauuuuaucuuuaauuuuaagcaugcucauuuucuuccacaggcugagcuagcuaccacauucuaacaacucuuagaucuagagcucuuggccccagacuccuggaguucuagguaccuacuuccugugucuucuuucuguauuucucugcaggguucauauuucaggugaaaccuaaacucauuuaaccccuuuccuacuuuaccuaaaaaucuagcugccuccauuaucauuaucauuaucauuauccaauuccagauuguccuagucccuguccccugccuccuugcauuuuacaguagagucccuuucccucuucaucuguuugcucucucauggucucuaugcuucaguugcaaaaccccuuuuuaaccuuaaguacauaguacuguuuuauaccuaugaaucuaucugcuucugcuucucucuucuuuaacuuuuuuccuaccaucuuauuaccaauuccuucacagagagagaaagaaacaauauuuuacuugguaauacuauuucauaaaacucuaaaaccaauugauaaaggaauguauaucuaauaagaguaauuugccaaaggacaaaugacuugagguaaagccaggcuacacuguaucuacuaauuccauaucuagugauccgaccaccccuagaugcugcuaaauuuucuuauaaccaaugaucuuuggcuggcauccuugguauagaaaaggcagaguauguauuaucucauaaaguugucuuuucaccuugaccauaaaccauuguauucuccucacaggcagaaaauaaaucaauguaauuaaagauuuaaaaauauuuucacuuguuauguuuauggauauuuuugcauucagggcuguauguguaccauaugaaugccugauuaccauggaggucaaaagauaucaaaucccugggacuggaguuacugacagacgugagcugccaugugaaugcugggaaucaaaccuggguccucugcaagagcaggaaguguucuuaacaacugaaccaucucuccuguccccccuuuuaagauuuacuuauuuuuauuuuguguguaugaauguuuguaugcaugcauaugaaaucaauguaaaauuuuaaaauggcaaguauuuauuuagcuucaaacuaaaaaaugaggaaugagauucagagcuauuuucaacuugauuuauuuugaguguaaaauugucaguguccacuaucuaggaagaaucaccauaaagaaacacaguaaauguaggaaacaguuugggaagugauauaaaauuguauaaaaagagaaagaggccucacaauuaacacagcaagugacacgggauuuaaguauacagauuuuuuuaaaccuuuaaauaagagaaaacuugagcugagagggggaaaaaauuaucccagaaguacuugggaagaaagagauaagcaaagaugcuggaaaaaaaggauaauagagccuuugccaggcaugcagaagacacugagccccagccucagcaucauuuaaaaaaaaaaaaaaggaguaaaggaaccuuggagaggguguaaugaaaugauauuugaaauggguuuaggaaaaaacaaaguaguucauuucugugaucuagcacucuagauguagaagcaggaggaucaagagaacucacagcuaggggcugggcagugagcacacugguacagagagguagcugcucauccagaagacuagacuucaguugccaaccccuucucugacucuggcacccucuucugaccuucuugagcauugcaugcauguggugcauaaacaugcauguaggcaaaacaccccuacauauaaaauauaaaaaguucaaaguuggugagacaguuuaccagauaaaggccaagccagaugaccugaguucuauauccugcaauuacuuaguaggagagaauccgcaaccgcaaguuguccuuugaccucagcgugaacuuaaaagaggccaaagcuagccucgacuaauaagcugcuaccucuagguagguagguagguagguagguagguagguagguagguagguagguagguagguagguagauagauagauagauagauagauagauagauagauagauagauagauagauagauagauagauagaguucucuuuugaaauaaaucaaagggguuucuauuaauagccuaguuccuuuugcagggagaggaggcauugcugagaauucccaagcuaauguuaaauggauauggcuauuugcagaagauuauuuuuaugucccacuacuguuugaaauuuuugcuguucaugguuucuaaaauggaacaggaauugggaugaacuuuuauauuuguauguuuuuauuucuacacucuuuucugacauaguucuucucggguucuauucaacgaaccugaaauaccaugguauaccaugaaaacugccaugaacacuagguaaugaaagaauacuaucauuuccucuuacuuaaggugggaaaaagcuaugaaaggaggauugaucucuacuauaaaaugccugacuuuuauuguuuauucauuucccagcugaaaucuuuuaacuccuuagguguuuuugauauauaagauuuuuuacuauugggcuuaugccauuuauauaauuaguaccuuugagaaaauggaaaaccuuuuaaaauaaguauugaacuauguagguuuugcuugguuuuugcuuuuaagguuuaccaauauucuuagaucaguaccaacuauccuaauuaaauuaaaggaugauguuauuaaaauauagaccuacucaucacuacagcgcuaauuuuuuuuuugaguuuaagccccuuggugugcagcauucacuucuuaguaguauaucaucagauuaccuaauugcugcugugcgaaaaguauaaugaaaucaggaaagccuuuuuaaauguaagcaccccagcguuagugaaacugccacucuccuccuaccccuuucucacauccuuccuuguuucagucugauugagaaggaugaaguaaucuuuaagucuucuuggaucuugcaugauguuagugggguaagaagcaaguagaggguucaguugguaggguacuugccagaguucugagcuuaucuccuggugcaacauaaaauuggcaucauggugcaugccauguaguccuagcucugggagguggaagcaggaggauugggaaucccuaacuacauguggaaagaaaggaaggggcuuggggaguaugguagugaauaacaucauucaucuugaguagauaucccauguucuuauaacagcaaauuauuuaacuucgaguaauaagauacuaaccccuuucacuuauuugaaauauuuggauauaguuacuuaaguaucacuuuauaucauuuucaguuuuuccagguauaauucacacauacucuauuuuuaauuuuaaaaaaauuacuaguuuguuuacauuuauuuauuuuguguguggauacacaugugccauggacaugaccuguggagaucagagaacuuguaguugguucugcccgucuauccacugggacaaagcacgccacagaagagcuauaucagaauuuuacugacagauucaaggaugacuccaccacccccaaauauggaauuggagagagaaaccaaacagauagauacuauuaauccugguuuugucuuuacaauucagauauuuuuguuguauaaauagacuggguagacagaacuaacaguaauaagcuauguucuuaaauauguucagcucuccuaaacuuagggaucuaaguuuugccaaucauagaugucacaguaacuucuguuucauauauuuaauaaggugccuuaaucuggacuagugaaauagauggcucaguggguacaaguguuugccuuguaaaccuaaaauuuuaguucuauucucaguugucuugccuccacaugugcuccugccuucacucauauaacaacaauaauacauaaaaauuuaaaugccugaugguuguggcucaagggauaugggugcugcuaccaaacuuaagaaccugaauuugaucucugggaaacacauacagaaggaggggacauacucucucaaguuguccucugacuggcauauaggcacagugguauaugcacauauacacacauuuauuaaguggaaaaggaaaaaggaaagcucuauuuugcaugaugaaguaaucccuagggacaauggaaucuagcuccuccuuuacuucuaucauuuccccuuuuccuguuaguuuuuucugcagccauaaacacaugucuuaaguuuaugcugcacaggguaacuuaaaucauuuuugaguguuuuuuuuuucuucaacauauagugaaacuagucaccuauguucucuuugcccaccuuuccaaacaggcaccuucuuagguuuuguguauauguuuauuugguuucuuuguacauuugcacagcauauacagauauauuacuccuuuuguguaugauuauauauugugcagacaauaauuuuaaagauguucuguacauuguccccuccucaguaaauaaagcauucccugacccagagauauguucaguuaaauauauugcuaugcugugagacaaacugucuuuguguuugcuuuuuuagagauguauaccauucagcuguuauuuaaccacuuuuccauugauagaacucuugcuguuaaaacaauacaauuguggcuggagaaguggcaggccauuaagagcacuggcuacuauuccagaggaccuuaguuuaauucccagaaccuacaugguaguucacaacaucuguaccuccagucccagggaucugacacccucuuugagccuccaggagcacuguccauacacagugcacagacauacauucaggcaaaauacucauacacauaaaauaaacauaaaaucucaaauaaauaaacaaacaaacagugcuguaaugaguggccauguaaauaauaagauaugcuguauguguaccuaagagauaaauucuuagauauaggauuauugauucgaagagugaauaaauaaagaguaaauaaagggaagggaaaguuggguugaauaucugaauugaaaaauguuauguuacaguuuuaauuuauauauuaugauuuauuaugauuuucaugucuucuguguguguguauguguguuuuguuuggggaaacagaaucauguagaucagucuagccuuuucaaauauuuuuguaagcugugugaauucuuucuguuaggcucagagucuuuuagauagcucugugugugugugugugugugugugugugugugugugugugugugugugugugugugaaaauuauaaaagacuuuuuuuuugcuuuguuucagacauaaguagacuucuuaauuuuuuuuugaaccccuuaauauaaauuacauaguugacuuuagacaaaacagggccaaauuaggaaaggagcauggaauugauugcauacuuucaaucucauauauauacauacauauauacacauauauauguauguauauacguguauauguauauauauauguauaugauuuauuuucuuaccaugugcaugucuuuaauuuuuuuaauauaagaaaucucacaaacacacauaaauagaagacuuguuaacucaccaaugucuuccauggauaaucuucuaugacuguauuuaauaauaucuaaacuaggaaccugacauagguacauacaauccacauguuuccuuuucuccuuuuaaacauuugcuuuucuggccaggaauuugacuuaaaauuaccugaugaauuuucaaaaaaaaaagauauugaaggauuagugaacaaaauuuuuauagaaagugcuaacggugaguaucagucuuugcauaaguacuuaccucagcuuuucaaagcuuccuugugaaaaccuuuuacaucuuuguuaacucugguuacuuuagaaaauaauaacaccuaaaucuuacaauagccuucaugccugcuuucuccagauaaauaauagccauaaaaaaaaaaucacugugauccaggcaugagcgcgcauauuuguaaucccaguauuuauaagaccuagggaagagaaucauaaguuugaagucaguuugggaugcauagugagaccauauuaaaacuccugucccauuucuuacuuuagguuacuacuaacggaaaucucaauugaacauuuuucugggaauuuuuaaucauuaaagcacauuaguuuuauauuaguagaauuuaugaucacuugucaguacaaaauacauaaaaauuugaaugcguaacuaauuugccucagagagagagagagagugugugugugugugugugugugugugugugugugugugugugugugagagagagagagagagagagagagagagagagagagagagagagagagagaagagcgccugcgcacuuggacacacauguacacgcaugugcaugcucucccuguuuuguuuuccuagggauaaaccaaggacuucacauagguuaaacaagcacuguaaucacuuagccauuauauuuucuucuuaagacaggagaugaagauuugcauuugccuagagauuaguucugugugaauuuuauuucuuugguccuuucaggggaggggaggauuaauuauucuuaaaguauuuuaggccucugugaguuuggagaagacagucuucuccagagaagaucacacgacuaauuacccacuaccaaauagccuugaaaacaugcauccaggcaaaacuauauggacuacaaagguuguacuuagaauuauguuugugugucuacaucuuuguguguaacaacauuuuuuuaaggccaggauuaagcugggcguggaggcucaugccuuuaaucccagcacucaagaggcaagagucagguagaggacagccagggcuaaauagagaaaacccugucuugaaaaacaacaguagcagggcgugguggcacacgccuuuaaucccaacacucuggaggcagaggcagguggauuucugaguuugaggccagccuggucuacaaagugaguuccaggacagccuauacagagaaacccugucucgaaaaaaacaaacaaacuaaaaaaacaaaagaaagaaggaaaggaagaaagaaagaaaaacaacagcaacaacaacaaaaauaaaauaaaaaagaggccaugaauuugaaagacagcaaagagagagggaaagggagacuucaaagggaagaaaaggaaggaggaaaugguguaauuauaaucuuaaauaauuuuuaaguauuuaaauauauuuaaccuucaguuuuguaaaacuuuauguugauuagauuuagucuucaaucagcaacuuacagucucguaaauaacugcauuucuuaaaagacaggcaaaaugcuuccuggguuuuaauuaauguuuuaguaauaaugcuauuauuauaucucuuuuauugagaaaugguaggaauaaaguugauaaauaaccuacuguaagcaagcagcguaugauuucugagggguauaggacuuagcuccugucaugauugaugaagagucacuuuuaccuggcuugcagaagcuuacggauaaagaaucaggauugccuacucaaaguaacugacucuuauuacagaagauuuaauucuguaauuuaagaaaugucuuuacuguauuugugucacuaugaaugugacuagacagaaaauuuaaaggaucuuugaguaaaaacaagguaacuuuucuauauuuuuuuauuuauagacacauagaauuuuaauauauuaacucugacagacaagaacguuuuuuaguuccuagcaaauaagcagacuaugcuggcuguccaaagaucauugagcacauaaauaaaugccuuuucuaagaaguugccucccuaauucugcgaguggaacuacuuccgggaaugugcuagauaagauaaauaacauguuaugaacacuguuuaaucuuuggauccaugcucaguuucacagcuaacauuuagugcuuauuuuaagcauucuuuaauauacacagcucaagauuuauuuaagucacuauagauaggugcuuucuuucauagucuuucucaggaaaaaaagucguagauuuuauuuaacauuagguccauguuaguuuccuuacuuagacaauguggauauugcccaggcuuauugauaauuauaggccugccauaaaaugaauugucauaaacuuccucugcuuuaucauuuuguucauuagcauuuagauagagaaaagacaggagacuggagagguuauuaaaauacauuaacuguccucauuccaggaguguuuuaacucaguagcucuagggcagauccagauauauccacugcuagcaaguucucagguaauguugcugcaucuaguugaaaggacccucacuuugaaaacuaguuuaucugaacucaagagaauuuucauggcuucucaguauaagucauuagugcuugaaaucaaauuacugucagaaugcauuugagcucuuauaugucaaagcacuauguccacuuggagaaauauguuugcauuuuucuuuuauuguuucuguacuuacuucagacaggaaacuauuccaggccagucuacuuuauuauagauuaugcaaagguuaccucucaugucauuuaaaaaaugaaaucaacuuggaugacuuugucuucacuuguaaaguccaaguuucuuucugccuucuuaucuucuugguaaagcuacacauacuugaucaugaccaggugcuaaagaguaaggaaaaccuaggaagaaaagcagcucgugggagccagcugugaugauacagaugagaaggcacacuaccuaauggagcaugguuacuuugacuucuuucuuugacgagauuugugauuagcuuuauugaaacauuaaauucagcgcuaggcauguagcucaaauaguucuuaucuuucaauauccuauauuuuuguucauugacucuguuagcacuuuuaacuuguuaauaaaugcuaaucaggauuuuuuuuuccccuaaaagauguugcccauauuugaaaauuaacuuugggcuuuauuuuacacuucuaguuuacaauaauagcuuaaaagcaaggagauucugagcuugucauuuuucccuguauuucugguaguaauaauagcacuugauuuauaaaauggauuuaacuucaguuugagugugugugugcacgcacgcgcguugugugcgcacacaccaccucauaaucuaaaacacaugguuuauucuuacacugcauuuauuccaacacuacauuuagggguaccuaguauaauggguagauaaaccaaaaauauuaccuugagguguuuagaacuugaaacuguucaaaauaugguggauguaguaauaaaaaaauaaucaagguauaaaucaacauuagaugaagaaaaauugaagggaaaaauauuuuguuucauucaucagucucauuuuaaaggaagcagaaucucucgccucagcaccacagagaacauucaccucauuugaaacuacuuaaaacuuaacaguguuaauaccuucauuauaaauuuggccauuuaaaauggugguucccaaaaccuaaguuucuaucagaaucacucacagggguuauuaaauucauuaacuguccucauuccaggagugucagucugacucaguaguucuagggcagauccaaauguauccacuucuagcaaguucccagauaguguugaugcaguauuaaccaguuaauacugguuaagauuaacuuuacuuugaaaaugaauuugaauccaaagaauuuucauggcuuccuaauacaagccauuaguguuugaaaucaaauuauuguaaucucuaauuacugucagaaugcauuugagcucuuaugugucaaggcacuguucuucucuaaagcuaauugaacuucccucaagaacuucaaucuaauaaagucaacuguaguuccauuaauauaguaaaaucaguuacuuuucauugaucauucuuugugccaggaacuaugcaaaauaauacuuaaacucauuuaaucuucagagaauuaggacauaaaaugccuauuugagguagagaaaaaaaaaucuauaaacuaauuuuccagaauucagugaguauauuaaggagcaagaauuugguaugaugcugugguaucuuccugcacuguuuaaaauuuaaagcauacauauugcuggacuagaagaggaauagaauaauggauuauacuauaggacaguaaaagauaucacaaaaagagauggcccugcacuccuuaaagaacaaguuaaagccacauacauuagaacuacagguaucuccauccagagaaguuucugcaaagugaaggaaacacaagaaaaccuauguaucagauuauaaauauuauauaagaccagaacacauaaaagggauaagagaccaucuacagcaaaggucaaagucaugaagaauuucauauauuaaauuguuuuaaaaguaggauugguugcugcgcgugaugguguaugcauuugauaaaaacacugggaagccagcgacagauaacucucuugaguuugagaccagccuggucccauaguuucaggucagccaggguuacauaguaagacccuguuaacugccaccccccuacccccaauaggauugggguuuuuguuuguuuuuguuuacucuuucuccuauaacuuuuauucacuguaagccagugguucuuaaaacagucaggcaacaggaucagcauuuucugggaacuuguuaaaagugcgguuuagagcucagcagucuguuuauacuagacuucuagagaccgguguauacuaguuugagaaacuuuaauuaguauaaauuguugaauaucauuaaaauaguaauuguauuugugauugauuagaacacagugcuuaacaaaauugaaauguugagaccuaacagaccacuuuucuuuagcaugaccuuuuuauagcuuguaaauccauuucuuccuugcugcaugagaucagagucaggacaagacucuguuaggucagcauucaaaguguugcaagcucguuaccauuccuuaguuguaguaaugacuugaaacuuuuugacuccuuuuaguuaagaagaaaaggaaauaauaaacuccuuuuuaaaauuuuuaaacugcuaauguauaaaacugguuaguaauauuuuaaaguagucuauuuaagccacauguaucaaaggaauaggaugucuucacaccaugaaaugacuuaaaguaaaagucuuucuugguaaaaguaauaauacagaaaagguaaacuaggauucucaagcaagugcuaguuuaaauaccugucaccaucuuuauuugugguguuuuguuuuguuuuguuuuuuuacaccaaagccuuauagguuauauaguuggucaguaauuuaguuacauguaaucuuauuuauauuugcacauauuucuccagugacugaaagcccagcaucuaaacacuguugguuagugaauaucccuucaaggucuuaaguauacaguaccuguucaucuuagcagcaacaaaaaguuaacuaguacacucuaagugcauuuucuauauguuggcugaaaguaccaaaguggccaaguccauugaagcuuagggacugaccccauucauuuuacagauagggaaacugagguccagagacauuaaauaaaugagugaguagcagacccuggcaugauagccaggccuccuuggauuauaaucucagagguacauggaaaagaaugguucugaaccucaaccuggcauauuucuaauaguccauaccauucaaagaaaaguagucuucagauauuuuacaucccaaauucuuuucagcuauaguauacuuuguaaguaauguuuuauuccaaaauuauauuuaaagaccucauguuaacucaaagaaguaucagauuucuuuuacaagacuauuucaaaacaaaaaguuuaaacuaauucugccuuucaaaaaucuauaaaaauacuaacaagugaguauauguauagauuauugcuauguuuacuacuuaaacaauaggaggauauaaauuauagaaaacaauuauuuaaucuucugugucauaaacgcucggguauuuuuugaauuugguaucucuaauagccagacaacugauuauucucaggaaaaacaugcuuuucuuaggugauugucugccagcaaguaaccuauagucaaaguacauaggucuaccagaauacugaauuccauuuuaaccagcuuauccaaaauccucuugaauucuuuuuagaagaccuuccuacacacuuaaaaaaaaauguuaaaauauaaacuugauagaaagaagucaucugaauuuuaauguauuaagaccaucaaagaaaaaauuccuaaugaaaauugggaguuuuaaaauggcauaugcaugucauagacaaauuguaaauacugggacuauaaauuauuuuuagaagauggccauguaccaagauccucauguaaaaaaguuaauaaauuauauuuaaaguuauuacauuugguauuggguaaacacaaauauacauuauuuuaagaguuggaugguuaaaguguuaaggauaauuuaaugaaauauucuaauuuuuuccagugcaucugggggcgguguuguagccauugacaacaaaauagaacaagcaaugguaaguaggcucccagcuguccuuucacggcacuguugguccagagagcagaaaccugaauuucuuuaagcccaaaguucccucuuaguaucaaauuuuuaaaaaugcuaggacacagaaaguuucuaacccacacaauacuaguuguccgucugucugacaaugucauacuuugugccacacgauggauccggaccauaagagggaaagacauaauucaguauagugugugcucaucugaaaagcuucagccuuuuguucauuuaaaguggaggcuguauuggcacuuaagucucuaaaauacgccugugacuaguuuauuaucauauagcuuugcauuggaauauuacuucucugcugucuuuauucugcaucuuaaaaugcucacucuaaacuuugggagcacuuucuauacuagcuggaaaagagacuuuuuuccaccccaucucccacaggcccuguuaagauaucgcagaaacauuaaaaaccaagaggagaaaacugcuuuuaaaaagcaaaauauagaaacuauuuaguguuuaugaggcacccaaauagucuagaacuaaguaguucuuaacucuucucaacucuuuuuugacauuccuaauuuuguucuucacaggaucuggugaaaagccauuugauguaugcaguaagagaagaaguggaaguucuaaaggagcaaauaaaagaauuaguggaaagaaacucuuuacuugaacgagaaaaugcacuguuaaaaucucuuucaaacaaugaucaguugucccaacucccagcccaacaggccaauccugguagcacuucucaacaacaagcaaugauagcacagccuccucagccaacgcaaccuccacagcagccgaaugucuccucagcauaaagcuuucuuaagccucguuaaggaaaaacugaaagcaaucuuuccuugugugccacugguguucuuuccacuuuauagaaagcaaguagccaugcuucggcugugugcuuggccuuuucaguauuagacaaucguucuacaggagcuucccucucagaugucaugcagcacuguggcugucgguccacuugugugucaucaguacacgaggagaauacuagaugggguuuaguaaagcaaggagagucugcauucuacaugugcccaugagugggaucuuuaaaaguuuugguggcucucccauguuucuuaccacccauggauguaccuugagccuuccugucacguuauaaauaacaguucaucuaaagagccacuuuucuuucaauaucaauaacauuugccuacauaaguuuucauuuauuuuguguuuuauuuauuacagggcugcuauuuucauauuguacaugaacaaugucacagaacuuuuuuaauuuucuugaauaauuauaaguaucaguaaaggaauugaacgacaggauuacauuuaaaaaauaaaaacguuuaggcaauaauugaacaaaagaauccuggcauauuucuaacacuaauggcaauuuaccguugguauuuauuuucaaaagauccagcuugaauguaaauuuuguauaguuguaaguaugaaaaacacagugcaccuguacagguagucaccaguuauugugauauaauaaauaauugggcuauuuuucaugaagaaaacuuuguucauuuguuucuacuuucuaauagaaauugccacgauuccucugcuuuucaacauuucguaugauuuuuuuuuuuuuuuuugggugggaauaaaaaaagcugugaaauuguucaaccuacuuuguaaccaaagaagcaaagcuguguaauggaguuuuguuuuguuuuauaaugcacauucuuuauguauuuuuauuuaguguuuucuuggucacaauuuucuuugcugucuagcaugaucugcauggccuguaaucuuugaaccacuuucguaccucauguuuuuauccagcacucuuauuguacuguguacuagucugugaacaaugucaaauaaaaaagaacgaacaggucguaugguggagcugagcuaguguacaaugcaccaguuguacagaaacaaaaaugaagugagccaucuuuuguucauuuaaaaugguguuuugaauuucauaugcagaaaacguuuuguuacauugcagauuuuaauguauuuaauaaaugcaacaugcagauuaagugcaguguauacugaguauuuaaauuaaaauguacauuucauaaauacaguuucaagagaaagcaucauuuuguguauacuaacacauuaaguguaugucagaaauugauguaaaauauauauuuuaacacauuuucugaaauuaaacuacaguuuuguucaaauauuuggcucuauauguguucagaauuugacuagauuuguauuuucacaguucaaaauauuccuuaagugaacacccaugauguuaauuacaaugauaguucuuaaauuuucaaaguaaaauaauuuaaagaacacaagaauggugagcaauauuuguacucaauauucauauuauguuaacaauauaaauaggaaauccucgucuaccaaaacuuuuacuugaauucagaaaggugccuguagaaauuaacauguccuguauggguagcccacuagcuaauuaagucuuaaugagaaacaguaguuagcuuuccauguuagaagagguuaaauguucuuuaucuauuugaaacguucuagcuucaaacagaaggcauaaaauugaaacauacaugagauuaccaaauauuuuauauucuaguuguguuacaagaaauaauguucaauaaacaaaauuuucauguuaauaguaauguuagaaauacuuaaaagaacuagguaaguauguagacuugaauauguaauaacccuaaggauucagagugagauucuaguagagccacuaugggcaagauaggaugugaaacugcuguuggaauauaaaccuaaagauuucccuucaugcccuucauugcuaauaaugugguacuucauacaaagaauguuagaaaaggguuucagaaggagacaguuaaauggcagauggcugcccaagaaugcacaagauuuuguuugaugccuggcacuuaaagugauuuuuguaaaaacaagaaaugaguuuuuauuuuagggauauaaaaacaagcaaaauauaauaguauccaccaaggaaaucguuaauauucuaagguuaaaaaugaugacagcaauugcugcuacucguaucuuuuuaaaaggagcaaaacuaguaaaugguuaauaaaaaagauuccaaaagaauugacuucugauaaacuaagaaaugcaaaccacuuuaaucaguuacaucuuuuaaauaguaggaauuaauguaguaugguggguuuuucuccagaaugaaaauuggcaguguaaagcucuuaauagcuuuaaauauuaagaagcucuuacauaagaaacaguauuaaagaacaugcaaccgugugccuauccuauauauuccuuccuuccuaggauacaaaacuuugauugcuuaccuugucccuaccuaaaguuguguaaugaaguuuccauccaaaucuguuccccauuuccacgaggcacacugaacuccagagucaggaacagaggugagccagguauugggcuuuuauguggacauauuugaacaauuucuuacagaaauuccaauagguuaaggaucuucauuuagauuaguuuuuuguugggguuaaagucuucaaauaccuagacugucaacuaguugaaauuccaauuugugagguaagucuuaugagaauguccucuaccuuuaauuuucugucucaaccuauagaccaggugcuaauacauaagcuuuauguugguuuaauuuuccaauacaguacugcauauacaguugaaaacuaacuuugcccaaaggaaauuauuuuuagguaguccuaauauaaauuuaagaucuauccaacaaaacaaaaaaaagcauagggaguuggagaauuaacauuucgcuauuuuaacuguuagaugaagcuauuaagccuugaugacauguccuuuaugauggauguguuucauuucucuucagugauucuguugaaaggugaaaggccaguccccaggauucacaauugaauugaggcuacacaaaccaaccaaugacaagaaaugcaguaaagggugucuuucucaggggguuccugaaauggugacauuuaauucuugaagguccuaagaggaaagguguguucuaaacacaaaagccuacucaaagcucugaaagcauacacaggccuaagaagcacagaauuuugugggagggaagcuagaaauaacugcuccaucaguguuuguaguuuggcauuauuaacaagaaugauucauuggaugauagugggagaaucucaauucaguucuuugguagagugguggguaaaaacuggagacaguuuagaaaaaugcaaaagaguggugagacagcauuuccaugggacaaauugaaguuuauugaauauucuacuuccagaaucaguacuuuguucucccccccccaccuuuagaaaaaaaaagcaccucagccaauauuuuuaaguuuagucagucucauaccaggagccaugcaucucuagaaaauuaaagucuuuguuuccugucgaaggaauugcaagaaucugaccgaagaguggggcaaacaggaauuuggucacucuaggccucuauccucagcccagugguaaacaauugaaucuuccuccaggugacuggccaccauaauuccaaaccuuuccagccucuugcuuccugaagagauaguauggauucugacuccaguuugcaaauacaccuuaagaguagguuuuccuuuaacuuuaccuuucauuuucuaacauaggucaggcagcucuucaauacucugcuaauacaguaacacaccucuccugcccccugcuuccagaccccuaauaauuuguguuucaauuuucuaauacuaauauccucugauguuuguaccaauuggcccaccauuugaucuuccagagaacaucccugucuccuauuuccauaauagguuacgaauuucucuuucucuuuucaugcacguuuuucuuauauaugugaagaguuacuauacaagaguucccuuaguggucuauauuggucugacauguucaaauggaagaauugcuaagugaguacuauagaaugcaaauuuaaaaguucacagaccugcacuuuuucuuuucucucuuguuugaauggaauuuaaaaaugaacagucuuugagggacuggugauaguaauggcaagauaagcucuuacuuugugauggcacagucuacuugaaaacuaaacuuguucaacaugauuagauagugaguuagcucuaauguuuccuuuucuugccagggaaacugaauaauuaggcaguuuggaguguuuccuuacugccuuucagagauccagaguccguauguuuacagacuaggaccugcccacagaagccauaauguuccucugaaagaaggaaggaaaggaaauugcuaacuuuagaaaaaaaugguuggagauuaagacaagcuaaaugacacacuucagcuuucccauauuaaaaguuaagguuacuuguagcgccaauuguuugcaugcuuucauuauuuccauaaaauaaccacaaagugcucuugcccacugcaauucaaaaugucuuccagaugauaguuucugucaucuugcaauuaguauauugauagauaaacccaaagaagacugcagacaaggaaaccucucccacacuuggcguauauaauaaauacuaggccagugucuaauucuagcucacugaaaaaauauguaaaucccuuaauaaggcaguagucuucacagauaaauauguugauguuuggggaaauauuugggcuuuauuuguauuuuuauuuccuagaaauguugaaaagcaguuugauucuaucuuaacuuaggugcuuaacccuauacugaauguuugaggagcgaaagcuguuuaggacaugaucuuugcccccucuccaaccccaggaucucagcauccaaugugaaaguagaaggugaaguaccauguugcuuauccacaauaaguacaguuuauagaccuugcucguucgguagaggaagguucucuaaguaauaauuugcuguguuaugugaaauccuuugccauugccaggaaauaacuuaaaucgucagaaagcuuuugcaucaaauaauccuucuggaaagaggagaccagacaaaagacuucacaccuguacugagccugggaggucacccccaaaagaacuaaucucagagagaaguuuauacauuuuuaauacucucaguuugcagauaauugaucuaauuuaaccuaauuugacuagaauuuccaugucaugaauuauauugucucgucucauaagcaacaugcauuuuggcuguccuaaucagcuauuuaaugaaugaaguuaauaacucagguaccugaugccaaaaaugaaucuccaguaggacugagaacucugagauaaauacaaggcuguaugcuagguaagugguaagccuuaccguucagaucaguggagaaggaauggauggcuaagucaacaggcaauauugagacuguguacccuuugaagaaaguaaaguuagcucucacaaaaauuaaaauuuccagcuacacuagaagugagucuucuacuuugugaaauucaaaacauugauaaugcaugaaagugcauaguuuuacaaauaaauugugaagagaugcucagccucagcaaagcaaagugcacaugaaacacgcuaucucagauccaguuggugaacauuagacacaaggauuaagagcugacaaauaugaaaaaacagaaaucugaugucguaaaguuugcauagccacuucuaaacgcagcugguuaauguccaguaaaauugaaauuuuaggugcccugugacccaauggacccacuuuuuaguaucucccuaaagaaacacauauucacaaggcagcuucuaauauaaaauuggaaaaauacaaaucuaacaagauaauggaauaugcuagaugcuauaaaaugguaggugucagugaaaaagaaugaagaaggacuguaugcugacaguagaccucuaggaugcaauguuaaauuuguuaaaaguuuggggggaaauacauguaauacacaugauacauguuuaaaaaaacaugccauacacaauacuguauaguguacuucugcaaauaacuauguguguacaauauaaauagagaguuuggaaggauacuaacccagcuguuuacaguagucuggcgguguguguuagcuuaaaguguaauauuugaugucugugaauuugcacucauguacuguuucuguaguaacauuaauaaauuagaaauaaaaugaaauagaa

SEQ ID NO: 1438 - RNA, 4155 nt, Mus musculus
cucuggcuccucguuuuccggagcggggaagagccuggcugcgguggcggccggcgcucgcccucccucuccggagcgggcggaguccacacuuccgcggggcggggucugcccagugcugacguuggcagccgaacccgaacuaguucgagguugccgguugcacuguccggugguuggacucuugccucucggcccugcggcccgcucuccccggcacgccgccccaaaggcugcucagaccgccgcgaucggcggcugccgguguuccagcgcuccgcgucccggcccaguggcuguagacggcguaggcaccgcgaucagagccgagccucccucccgguggcccgggaccggcgagcgagcgaguccgagagguucuuggggcagguggcgcugcgaaaauggucgccaagcagaggauccguauggccaacgagaagcacagcaagaacauaacucagcgcggcaacgucgcuaagaccucgguaagggaaagugggcaccccgcuccaugucguggccgggagccgaggcccgcgccccgcgcccggccggggccgcggcgaguucuccccagacccgccugacuccggacucccgcugcgguggaaucugggguggggggagagaucugugagucggccggccggccaccuggccuggggugcaggccuugggagcccgggauccgagagugcuuucucugcauuugaaaccggguuuuuucuuuuugcagagaaaugcccccgaagaaaaggcgucgguaggacccugguuauuggcccucuucauuuuuguugucuguggcucugguaaguguuuggggggcucucgcgguuuggaaugacguggaugaguggcgaguccuaccuacccgcgugguucucaacccaccugcuaagagaauuguuucuagugaacuggauaacuuguaccacagaggguggugccccagaaauuucucuuaccuugauuuaugcucauugaagaucaaaaagagagagagagagaaauuagaucuuccuaaugaucccuuagaagaaauuaagcaccaaauaucucugauuugcauuguaacuuuauuaucgauaguguugcaaaaaacuuagcgaacaucgugaacaucuggauacuagaacaggacugaacgauaccaguaccuaaggucucuaugucaaaaacuaaguauauaaaguaaggguaguacaaagaauugauuuucuguagaggaaacauaccugcugggauauuuaauguaugagacaaguguuuucagguaagauuaguuauuaagacagccugguuuuaagaugauagacucuugccccugcggauggauguauuacagacuguccuccugcucugccugcugcuuuaauagacaagcugcuguuauugagacagaugcuuuuauuugccgcauucuacaguuccugagauuuucauuuaacauuucacuuugccuuuuuucuaaacuuaacaaccggaagcuuucuugauauguggccaagagccaaccaguuuauguaacacaaaaagauuauugaauuucagcugugugagaaugaagaaaugugcauguguuaggaaaccaggccuuuaaggauauguuggaaauaaauuaauaguaggaaaaacguguuuguuuuggugcuuucaaguuauugcuaaaauaauuucacaucuggaauaucucuuguacaucuuauagguaaaagucaaggagcugcaauuaaggaaauaauuugaguucgaugugaagcucagcugcagcguauuuaccuaucaugcaucaggcccuccccgggucccauccccaguaccacgagauaauaaucacuucaaggcauugaauuguuuaauuaugauaaaccugcuucacuuuuuuauuagcguaaaguuagauuagcauuuguaacugacuguacgaucacgcuggagucugcagcugcuguaaauagaugacuuuuaguugagaggccuguuuucuucaacuuguuuuaauauuugcucuuucucuucacagcaauuuuccagauuauucaaaguaucaggaugggcaugugaagugacugaccuugagaucuuuccauucuccugugaauuuuaacuugaacucauuccugauguucgaugcccuaguuaaaaaccauugaguaaaucggccugccucagaaugacuuuucauauccgccuucaugugucauuccaaggugucuucaagagucauuccagguuugcuaguccaugccacagugccuugcaaaagcaccacaugaauaaagcaauaaaauuugauuauuaaguuccaguaguagaccauacuuauucaguacagaaugaguuuuauaugguuauuaaaacaugacuaauuagauuaaaucuguguagacaggguauagauuuuguuaacccuaauguguaaaugcaauuagcuuaaauuuuggaaucuuaugguuuucuauagcuaugcccuuuuuacucuugaauuggaaagcacacuccauuauagggacauguaacuguccuauaauaaggugcuuuuaaauggucaccuacacggcuuaguuuuaccacaaucauugucaccuaaaacuuuuuaaaagcuucuagggcauauuguaaguaaagaugcuuacagcugcaucuguuucuaaugauaauguuucuguuacacagccuugaauuuugcaugaguaaguauagucaccuagggucccauucgagccuggauugaacauuuucuaacuuaaucaaagugauugcaguuccacuaaaagcuaucauggugaaaugaaauuagagaugguuugcugaugucauacugaucagaauuaucaaaggguuuacuguguagauacggagaaagacaagaacuaaaugccuugucgaaacauguggagucccgugugccauaugauaucuuagcauguuaauugcacuuuuaauaccaaaaaggcacaucaacuaaaguuuugauugaaaugcccuuaggguucuaggucuaucgaucuaaaugagcauuuggaaugaaaugaauuuacugaugaggaucagucuagucuuccuuuguaugacuucguagguugugauugaucauuuucuuuuuacuaauaguaagggugagaguaaugaggcagguuugacauuuucugguacuauugaaaacuacaauuaguccuauuuaugcacuuagccagaacuuggugcagacaccaagcaauaucuguuuaugaauggagagaagccugcuuauguuugcuuuguuauuugccucaggagaucucuuuugaaauacgcuguuuucaaaggaacagaagggaaacuugccccuguucugagagcaguguaaaccucacagggcuuuggauccccucggacccccuuggacacagaggagaaggaagggaaggagugggucgggaugcacaggaaucuuuccuguaucggaccaggaaagaaagcuggcugugggucuguagggucaugacuguugucugccucuuuucacccuguaagugaaucccugaacuugguucccucugaagccagucuugguuaacuaauucuauuuuacuauaacuuuaaaagugaaagauauucucuaaauuuauagcaggugccuuauuuccuuugaaucaaaucauuccauaccagaauuucccuugguuuacuauagauaauuggcuuuaagauauucuuguuuuuaaacauacaauguuuuaauuauuuuguuaaauugcuguagccaucaaucauuucacauuuguaaaauuacauucccuuuguaucauguaauuuaccuauucagugcauuuuauauucagguuggauuaugcauauuugggucaaugaaaguugugucuguuugauuuaugguuuaaaaauaaaguucccuggauauuugaugcuguuguaaaagaaaaugauuuugcagaguuuuuauuugaauacuuuucauaguuuauagaaaauuauuuuaaaggaaugccuguacuuagccuagcagugguugcaaaugccuuuaaucccagcacuugggagauagaggcaggcagagcucugagcucuagauaaaccuggucuacagagugaauucuccgagagccaggacuaccacacagagaaacccugucuugaaaaacgguaaga

SEQ ID NO: 1439 - RNA, 1637 nt, Mus musculus
ugaaaccaagucucacuaugcaguccuagcuaaccuguaacuggcuguguagaacaggcuggacuuaaauucacagagaucucccccaucuccucagagaugggauuagauaugugauuaccauaccugguuccaaucucaguuugcuaauuugaaacuaaacauuggcauuguauggggacaaaguugaaacaugaacacaagcugugauacguugcaggagguggcucauuucuucagccuuuccuucccuugggcuaugcacuguggcauugguuaagucccugacacucauaccuaccuagauaucucugcccaugaugcccccuuccuugccuucuccccacccugaaacuugggacuuuccacuugggcuuuccuuccuuugaggaaaccagggcguuucauguucauuguauuuuauugaacuuuuacgccuucuuuugcagagauuucaugacuguaauuauuuaguugugggcccgcagccugacacggucccucagucuccugugguugccuccccaguauggcagcagcaagacacagcaugcuagacuucacgcugggugccaaagcugauggugaggccauucugaaaggccuucaguccaguuuuuucaggagcaggggaugacagagucagugcacaccuggcaggaccauggauauuuagcaacuuacacgaacaagaauggcagcuuugccaaugugcgaauuuauccacauggauugguguugcuggaccuucagaguuacgacagugaugugcaaggcaaacaagaaacugacaaccuuuugaacaagauagaagaaaaaaaugaaagaauugagucaagacaguacagggcgggugaagcgauuaccacccauaguucgaggaggggcuguugacagauacuggccuacugcugaugggcgccugguugaguaugacguagaugaaguaguguaugaugaagauucacccuaucagaacauuaaaauccuacacucagagcaguuugggaauauucucauccucagcggggauguuaauuuggcagagagugacuuggcauauacucgggccaacaugggcagugguaaagaagacuacacuggcaaagauacacggauucugggagguggggauggaggcauauugugugaaauugucaaacuggaaccaaagauggucacuaugguagagauugaccaaauggucacugauggauguaagaaauacaugcggagaacauguggagaugucuuaggcaaucuuaaaggagacugcuaucagggucuuauagaagacugcaacccaguucugaagagguaagccaaagaagggagagaguuugauuaugugacuagugauuugacagauagcugucccuaacucuauucuccagaagaagauugcacaugggaguuccucagacugauucucgaccugucaaugaagguucugaaacaggauggaaaauacuucacacagaggaacugugucaacuugacugaagcccugucgcucuaugaagaacagcuggggcaucuguauuguccuguggaauucucaaaagagauugucuguguccccucauacuuggaauuguggguauuuuacacuguuuggaagaaagcuaagccuuaaa

SEQ ID NO: 1440 - RNA, 39008 nt, Mus musculus
ugaugguuuugaagacaacuuguuuauuggcacaugcauaguacaaagcaugaaauagauacgaguguugcuuggaagaaugcuuaggaggaaggucggaaagacugggugucuucuaagaagccaguuaauagaagagaaguuugguuuugguaacucauacgccagcacccacaaagccacuucucuguuccuuugauuucuaaaaaaaugugaugugcuacagacuuccauuuugcauggaaacuuauauuuuauuuuuauuauaccuuuuuggacuucauacauauuauuagauauauugcuagcuaaguuacuuaucaucauaugccugcuuuuuauucauguaucuuaauuaucauguaacaagacugauaauacuuggaaggggaugggaauuuacaaaguaucugugcuuucaugaaucgcauuuucccuuuugguuuuggaaaccucuaggucauucuggacuuugagugacauguguaacuucuuauuuaagacuucucuaaauggcuggcauaagaagaaauaaauaaugggguccagacacacauuggcagccgagaguagcagagugaauucuuucgcauagagcagggucuccuucguccggcagcuguagugaccuuccgucugacucuuuguguaggggauucuggcaaugugguaaggcacaaagcagacgacaaaaacgagcacgaugcugaagauauugcggcuggacuuccucuugacggagguggaauucuuccuggacuugaggugagacuugaagaucuuccucgugauggccguguagaagacgauuagcagaagaaacacgacccagaagauacucacgaagauauaguuagacgccuugugccacuuccgccccagcucguuuuugagcuccaugcacuguaucuucgugaccuccuugacacccugguuugucaggaugauguuugggacagcaaggagaagcaugagcauccacacgagcacagaaagcagcuugcuauaguucaccgacugcacaauagacgucagaaggggcuucacaauuuuauaguaccugucaaagcugaugagcccaaagaacacgaugcugacguacauauuaacauagaagaugacggcagagacccugcacacaaacacauucaccugccaggggccgaggccugagucaccaaggacuuugaaagggaaagucaggcccaugagaaagucagccaccacuauguucuugagauagaugauaaaacucuuggagcugggcacauaaaagaauauccauccugauaucccauugaggaggagccccgugaugaagaccauaccguacaacacgggaaugaucugcuuugugaucaggguguuccaggagcagggcugguuuggagggucuguggugguggaguuguucaucuucucaccucuggaggcaaagaucuggauagaaaggcaggcuaguuacuuaaagcacaguuuauggccucuaagucauuugugacugguaucuaauacaguggaagaacauaaauacggcaaaacccaucaagauugugaaucauuuacuuucucucuucugggguuuuuaaucucuauuucuccguguucaggaaucucaaaggcaagcuucgucaacagaauccaggauucggaagagagaauuccagacacuaaaggacaggauagaagaaauagauaaaucagccaaggaaaauguuauuuuuucccaucuuuccucuauugccauuuuguagaauguguagcuucauucuugacuuacaccuaggaaauguggucacaccaucuacucuucacugcaagucugugacauuuguuccuagggacugccacagggcaacagagcugcccccuguuuuaacaguucauuuugggaggcugccauguggguuuugugcauuaaucuuugcuagguuaaguuuagcaaaaaaaaaaaaaaagagaaguugaauucuauuuuacuugaccuaacuucuugcuucucaagcugucaccugcaugucacuuagugauccugcuauauugagaacauagguuccauggccccagaguccuacaugacgaguggugcagggaucucugaguagcaugcuuucuuauuuguuaaaguauauauaauauuccauaaauugugaagagugugaaaacauacauauuuucuauauaaggacaaaaucaggacaauauuaccuucuaggucauguagguucuuucauaguuguuaguucuuucuuaguaucaauaguuccauuaucauuaccugacuuuauugacucuuacacugcagauacaaaagccugcuugggaacaaggcacagugcucacuagagcauuccagaaaguucuugaggcuguguuaaugaagagaauagguuuuuuggaagguuuugcaugaucuaugguagcauguagcaaugaaugauuuagagcggcaaguugagauucagcacauuguucacuuggguaggucuuauaaaauucugaaucaaauauaacacagguuaaauaucccuuuucuagaccguguguagaaccagaaauacuugaguuuugauaucucucuguguaugugcccuuguguaugcauguaagccauagaucagauuugggagcgaccaugcuccucaggagauagauacuuuuaaggauuuuuugagacagugucuauuaguaaccuggaacuugcuaagaagaauauggugaauguccacugagccccagagauccacucuccguuauucccuagcgcugggaucauuggugugcacccuuacauucuuaccuggauucugggaucgaacauaguuuuuucuuuuuuuuucuggcacagcaagcacuuuacucacugaacacucuuccuugcaauacaauuaguucacaucacauucauaucauauacucauagcccaaaggugauggguugcuuucaaaucgucccauauccauauccucgugugauaagccuuuccuuccuguucuuuguucaguccugacacagggacaaaccugauacuuccuccugccuuucuauaguccagacuugaaagauacuuugauaaauauuugucuuucaacugauuaauuugaaaagguuuaauacuauucuuauuggucaguauaaguguguguguguguguguguguguguguguguguguguauguguguguguguguguguguguguaugugugugugguguguauguguguguguauguguguguguguguguguguguguguguguguguguguguauguaugugugguucuuggcacugaagguacaugcguuugggagcugccuaacuuggaugcuuggagcugaacucugguccucugcaaaagcagcaagugcuuguaacuguggagccauggcucacguccucugacucuuacuuuaauagaaaauaauaaagaugcuggcaauaguauaggugggaacgguucuauaguuuccaaagaacauuuucuuucuucccuuuggauucccuuuaaacaauguaacccccaccuuugguaucauuauucuaugugguuuccagggaauuuuauguuuucagauacuucauaaugucgcuuuaaaauauuguguugauuauauuauauacuucccaagucugcccucaguuucuagccuuucugguucuucuggaaugcauacaaugaccucuguccuuacuuaaguugcccaacauugugauuccuaagcaguggucuuagcugcuaaggucagucagucaguggaguguggcaugugacuucagggaagagacucugcuuugucacacgcccccauuucccagaaagucuucuacuuggcuguguggggcucucccaguagcuguuuuggcugcauucuacacuccccauggccuccuugugucuccuccagcucagccagcaggaagcuugcuuucccauuugcccaggagaacgaaucccuuuauuuauuuauuuuuuccuuaaaugcugaggguauuccagguuugccagcacacaucucagaagccacugaggaucuaaauucuaaguuucuugucuuugccuccaucggcuuauuuucugaccucugugucguuugauguuauuuguuacugaaaggcuauguuuccguguucaguuguggcucucagcucuuguauauguucagaccuuacuuuguaaagaucccaacaucauucauuuuuuugcugggcacugucaggagcauucgucucagagaacucuaagggagcuucuaagcugggauggcugaacagaguggcacccuaggguauuagggacccgacuggaggaggaagauccugugcagccucaggaaagaggaugauggagcagccuuccugagcaugugacaaugaagacuggcaugugaaauggcuuagcaugaugaggaaagggauggagagcauugugacagagaguggcauagggacaggcaugaagacacgaaaaaaguguuaggauaguagggacacugguuaccuaaacauuuggggaaagcuucgccccaggagucacuauuaaccacugccuuacaggugaggaagccaguguuuguggugguugaguuaccaagguagaugguguagguuacacguguccaaauggugucaagcugaaaccuguuaagcuccaggucagagccuuacuucagagacaguauagagggccccugagugcgugcgugcgugugugugugcauguguguguaugugugugugugugugugugugucuccauguguccaugugugcucaagcucaauggguccuuuggcuuuccuggaguccuuuuaggagauggccuuucuuuugguggaaagcguuggcuguugugugcuuguguuuuaaagcccuucaguuucucuagucauccuucagguguuacuguauagaaagcauccauuuucuuugccgucuuuauacauuucuauaaccgauguccuuuuuaacuuugauuuugauuccucuccagucuuaacauuucaaugucuaagacucugcaguaggagagacucaaccugcggcauaaauuaggaguguccuagccagcagaagcccagcggcugcugcuucugaucuuuuucuuguuuucuguguugguagaugugggucccagguagccuaacuugacuuuucuaguucuuggccacugugucccuccaggcagugauccacagacaccgauacaacuuguaacuugacaaacgccugcuucucuugucacgggcaacuguguuaguuagcucucacuugagaaauucucaucugcucugaggcugaguugcagacccuuagaacucguccacuaagcuuacacuugggucugcuuugacuacguuacaguccagacuucagaauucaggaagagaaacuguauacagucauucaaccuuuacugaugugcgagacuagggauaggauguucauuaacacagacaauaaaccgauaguguccaaaccuagagcuguaauucaagccacuuccccaaaacaguuaguggaacuugcaggaacuugaaagugccacauccggccuaucugagaacuuucuguguucagcgucuugugauugugccugcagaucaugaaagauucuaguggaggagagcaggguguggcggugcaggcacuuguguccuccaaacaggagcccuugagcagcgguucucaaccugugggucgcaaccccucuggguuuguguaucagagauccugcauaucaaauaauuaucuuuugauugauaauaguagcgauauuacauuuaugaaguagaaaugaaacgagauuuuugugguugggggucaccagaacgugaggaauuguauuaaaggguuguagcugcuauaaaacggcaauauguggcuaggcucuccaccccaaauccuaucuugcuagccuugcuaacacugcgguaaaauuuaaccuacuacauuuggaccaguccaguguuacuuagcuauggacucaacauuauaugggaguacagcucuuggguuguggugucuguuuuaugccauuacauguucugcagcagcucuggcuuugguccacuagguggcaguaguaugcugugguugugagcagacauggcaguaguugcuagaauagcugcuugaugguagauggauaugauguccuucugaugcaugaagauaauuuagcugucuuuuuggugccaaaauuugugaguguguguauguauguacguauguauguauguauguauauguauauaugcacacauaucuauguauguagaauacaacaguaucaguaaagaugagcacauaauuuacugcuccguuggaacaauggacaggccauccaacauaaugauugaaagaaagcauacagugacuuuuaguuagaaguguggcucaaacuccuaauaguuuugauauugcuauuagugccaagugccucugucuaucagccucugaaucccgugacuugagaucacaguagcuaccucauaggguuccuguuucucuaagcaccagacaccuggcgcuggcugccugugagucagugggacaucauuggagcugggcgugagcaagcuaaggacagaagaagcagagcaucuggaaugcucgcucugucucucagccucucucagcuucccuuugcuucugcauauuuacuuaggcucacauucuuaagcgcugaggcacaggaacagcaggagaccauguauacaguggucugagcuuaccugggugguagcccagcauccccccucccccugugugggugugugugugccgggaggugguggcuagcccauucuuguuacuggaaguuguccugccuucagaguuuucacaucugcuuacucucucuggaacuugugggcuaagcauccugggucucugcuuuguuuuguuuucccuccucucccagaaguguuguuuuggaaucagagcccuauucucuagagcuauucaaggaaaugaaucucugacccccuuuggcaccgaggagcuaguguuugcuuucucauggaguugcgcugagaccuuccuuuguggaccucaggccguugguggauaucuuuugguuguacgcacagaaagcagauuucucuuucugacaaagcaauagcuuuacuucagcuacauagcaggcacugacugcaugcuuguuuaagagucaggauuagaucgccaaagggaaggacuguaaaucgaccccuguugugggguaggguggggaucagugaucugauuuuuuuaaauggauuguguuaugacucuagcuugcgaauucagcaguacuuagacgaaugcuugacugaggaugucaugugauuagagaacaaccacaccccucucagaauuuguagaacugaaguguggaggugugcaaagguggugcucagggugcacucagauaaucuaagacugaccuuuuccuagucccugaccugcagacugggauucacuacuggacuccagaucuuuucccggcaucccauuuagcguuauuaucauauaauccaucuuuccaguagauuuucauaggagcacuuaaguaucguaggaaacagucuuuagcuugcuaugcuccauggcagcuaucaguugcuguuucacugcugccugauaaugugugugugaaaauagagauaauaaugagcccuccuuucuguugguagcuauggcugaaauguguuucaugcuuaugauuuucuuggacccuuuuucuucugcauguguguauguauacauguauagaccuguauauguauguguguguguguguguauguauguaugaauguauguauuggguauauuuguaauaagggcugccuuuacuuauugccuucuaauuuuuccuguaauguuuuucuuucauguuuucaggaucccacuuugccuagaugcuaauuucucucaagauacgaaucuuucaaucuuucccucaagauacuucauaacucugaggagaaaaaccuauagauccaaaaaucauguauguguauguauguguguguaugugugugugggggugguaugcugacucuuguaucuuuauguucccgaggaggucagaggacaacuuguugaagucgcuguccuuuuguugccuccuggagacagaacucagauuucaggcuugguaccaaguaccauuagccaguagguucccagucugaaaacagaauucucacuuaaaaaaauuaaacauuuauguguauggguguuuuaccugcacacaucugaauaucacgugugugucuggugccuguggaggccaggagaugcugucaggauccuagcaacuggaauuggaaagcugucauguagguaagggcaguggagccucggcccuuucuggaagaacagccaguauccguacccaacaagccaccucuccagccccaaauagagaauucucauagccacuuuuuaucauagauaauuucacaaauucugaugaggacuuagugccucguuuaacuauuuaucccaagguauuauaggagaaaaacagaugaauauggugugcaccugcggucguuaugcaguugagggagucuuccuccagcagccguguuaagagcacugucuuuucuaucugcauugcuaaaaguuauuucaagucucuuaugugucacuaacuucaguccacaugugggaugaagucacccugcguuccuuugucugucugucugucugucugucucucgaugagguuuuacguguuucucauacacucuuucccuggcuaguugauucaguucugaagggucaucuuaauugggcaaccagcuucgugacaagacugauugaccucugcguugucuucaggugacucgcaccugagaaccugagguauguuucuccagaaagaggacagagcucacuggcagugucacacuuugcagugauccaaggcuacccaccuuuaggcagacuacagccaacagcaucucccaaagcuuccugugggaauucacugauccccucaguucugagacuacuuucugcugugaucugugcacuaagagcagaguugcuccaggagguacaagaccucagccucuggggucagcagagguugcagaaugcacugcggauacaccuuggcucacagcucuucucuuauacuccucacuaccugaaaugcugugacugcauuguuugcaauauuuuuaacccuaccauuuauaaagcaaaaauucuuuuuaaagauaauucaaucgauaccaauuauccggcagcacacuugguguugagaauacggcaauaggagcucagaguuguggugauccuggucugcaguggcauuugcugccccucccccacaaaccccugccuccgcuucaguuuacucuguaagucuggguuauucugucuugggaggucaggggcacuggucucacacaguuguccacugcaguggagcuagucuagccuugaugcuucuaguuacugcuaugucuuagcccguuucucauacucgcucauucucuagccguagccgcucuucuuugagaaacacuuuauuuuaugcacacucagugcuguuugcuuucaaaauggcuuuucuguucaguggaauauucaguuaacuuauauaaacuagagcaugacagagagagcccuggagcacccagcaccugagccccgccagcccccugcagcccaucccugcuccccaccgcucuuccaccauccacucagaggggagccuugccccgagucauguguuuuucaucgucucccuuuuuaaaguaagugauuccaacucguauguacaugguuacauuugugaaaacugcugaggauuuucaaagguaagguuuuaagguugaggacuauauuucucaaguuaaucaccuugggaagugaauuggaacuauuugacaagaguuugcauuuacccauccugugguggaauauuuuaucuuccaggggagacuacaacauguugcugauguguaucaggcaguauaagccaguggguuauugaaguacuguuaaugauagcaaaagcacagaacuaguuuggauaauugacaagggagugcauggaaaaauguuuuuguuuucuguagaaauuagagauuagaugaauugcagcugugaaccuuuaaguccuuuggaaguuuuggaagauggaugcaacccuuaucuuguuggaaaaaaaaaucuggaaagcgugaauagaugauucaaacugcauacuguuguguccuagagcagauuguggaauaagguuguugauguuuaaagccugaauuaguucuugugcucagcuaaaauaauccuccuaguuugcucuguaugguaacccugcaaaugacuccuagccgcaggacgagugcagaaugaucgagaacaucucgguuuuccgcaggaggcagacagauaagagaaacuuaguguguuaagcacauccccuuagcuggcauucaagagcccccguugugugucacguagcucuggucuucuccccuagagggucccugcugcaucuaaccuguauaugcucacuugguggccggugcauagagaagccuaguaggaggaacacugggagagcauagccugucacucaugugacucaucaaccugagcaauccucacuguucuccugauggucggagaagccccuccccugccaugugugaguauggucaggcugcacuggcccaagugaggcagucugaagugccacugacacagucgaccuguggcuuggugcuguauggggugggagaggguuaaaaagcaagggaguagauacucaugacuuggguaaaccaguaggguuguuguuguuuuguuuuguuuuguuuuuguggaguuuauuagcaacuuagauguuuuugguccugugaaauucagaauaaaaaugcaaaaggcuucgguccuauaaacaaaaauucaaaaugaaaugcagaaguuuaaucuucuggcucccuucucaaggcucugucauuuugugccaggcugcauggagcagaugcaugguuucagucugucucacaguccugaagguucugggucucugcgaauugacagaggccacggguggggccucgcaagaaugaccaucugacuuugucagacacuacaaaggaguagcagaaguaacugucaggcuggacacccauacugucagucuaacaagaggaaaucuaaaaagagcaaaaauucucuggggcaaagguaauuggaacccugaugucugccugggauugucccuggucuuacuguagcugcagaaugcugaucucaggccaaacgacacguucucagaagcuguuucucugugaaggcugcagcaggcacauuccuacuuguacccuccagcacuucucuuuuagugucucuuaauuaucugaaguaacaggcugaagagauagcucagugguuuauagcucuugccaacacccagacucuagucccagcauccacaugguagcucacaaccaucaauaaauuccaguuccaggguauccaccucuuucuucugaugucagagggcaccaguacacagaaggugcacauacaugcaugcaagcaaaacauuuguacguauaacauaaaauaaauacauccguaaaauuaaauaauauuuccaaccucucuccacuuguaugcaugaguacaggguuuacugcugcccucugcuuuaggaaggcucagaguuguguguugacgagcagcagaagcucagaggucacugacuuuugcaugaauuuguuuacauagcucuaggcaaguuaagcacuuaacugucaaaugacgaauguggucagaaccugcagaguuuucaaauguguucuuuuguaaauugucaaguuguaaguaagacaaauuauguagacaucuuuggccacaaggcuguaauaaucguggcucaugauuuauuauauguucagaggucaagcaugggugacuuuuuaaaaauuuacuuucuuuuuuuuuuuuuuuuuuccauuuuuuauuagguauuuagcucauuuacauuuccaaugcuauaccaaaagucccccuuacccacccaccccaaaaauuuacuuucuuauuaauuauauuuuccuucagucauagcaacacaaacagccagugcugugauugagagagugugcaugcuguaagcuuugauguuuuuuguauuaucauucugacacauacguauguguaaacagcuaaaaucuuauuuuauguguacaguuugaaucucucuugccccaaaugcuuaggaccagaaguguuucagauuucaguguguuugaagguuguuauuguuuuuuuugaauguuuacguaaauguuauuggugaggugugacuaugcugaaaaucuaaaugcucgcuaaguuacaaauuuaauagcacuuugaauuucuucugauuguugauguagagacucucauauauauuccugcacauuauuccugguguaacuauggcuauaauuuauucaucuggguugugugcucuuaaccacaguuccuuuauucaguuucuuccagagaacagaauuauagaaauuaggauuuaaugucacgagccacaacuuccccauacugagacagggcaccagugacaaugugaacccugcuuuuaacaugcuaagaugaacauuuaggccuagaauguuuuaugugaaugcauauucuccaaaaauuuagccuauuaaauaugagugaaagaccuauuuaaacaucaagacaggaggaauucaguguagcagaauguaaguuguauguggaacuuuagcagcacauugcuguccuuuaagaaaccacucuugguugucaguucagucucugugagcucgugugagcccagguuaguugaugcuguggacuuucuuguguccuugacccagcuggcuccuacaauccugcccucccaucuucugaagaaguccccaagcuccaccuaauguuuggcugugggucucuguaucuauuuccaucauuugcuggcugaagccucucucaugacaauguacuggacaccagucuaugaguauagcaaaaugucacuggggaucaguuuuuaucauagguuuuaucucuggguccuggcucucaggcagugucagggauaggcauggguuucaagcuggaccagucauugguuggcaacucgcacaaauucugugccaccuuuacccuugcccauuuugcaggcagaacaaauuauaggucgaggggauugugccugcguuggugucccagugccaccacuggaagucuugucuggcuacagagauggcugguucaggcuccguaucacuaagagucuuagcuagggucacccucauagauucucaugaguuuccauggcacuggguuucuaacuuguccuagagaugucccaauuccaguugucucuccuaguacucucucccuccaugcccaccaccuaacccuuccucuucucuucccaacucccuugcaggcacaagauugucuagccuuuguaggagaggugucuaaucuucccacagugugauaugccacggcaugcuccaauuuaucugauaauuugcaugagauuagaucuuuuagauucuuuugccaagacagcauucuguaguagcauauagugguccagggcucugagaacugccugcuuuuguggaccagguauuaaacagauggucgaaacuacagcacagugcgacuuaccuauauaagcucuuugugaacucaugcuuuuuagguuaauauuuuaagcucuuuuaaauugccuuaaaaugaacauuuuagaacuucuuacaucuuuagucuacagcacaguaguguggaugggcaugugaacagcuccuuaagagucucccaugaucuggaggagggaaaagugacccuaaagaagaaacguuugagcagucuggcuacaguguguuuaacugugcuuucuaauaaaagcauuuaaaguucuguuuaguuuguugguuuuaauacuuuagcuuccaaucuguguauauugagcaaauaccaaaggacugaugaaguaauucagcaacauggaaagugccucaguacacacgcgcacacacacacacacacacacacacacacgcacacgcgcgcgcacacacacacacacacacacacacacacacgcgcacgcgcacgcgcacgcacaagcgcguacacacacacacauacacacgcacacacacacacacauacacacgcacacacacacucacgcaugcaugcacacacacgcuuggugagcaugugaaucaacacacuuaacucuugugucuaucuuugugaauacaggccuaacuguagaacucaggcagggaaggaauagcuggauucuggagagugcaggccacgcagggcgggcugcacuugguggaucuaguagguaguuaugggcucccuguucuuugauacaauauucaguuuucuggaggaguuaacaugauuuguaaguugcuacauaagguguccuuucuccugagucucacauaugacuguaacuuucucaguuuuggauuacagguugaguaauuuugugcugauuucgcucuggcaguacugccucucauuuacugaguuacuagugcagaggaugggaaaagaaguaaauuuuuauugaacagcugcuaugggcaagauauauaagccuuagggguuuuuuuuuuuuuuaauuguugauaucuauuugcuuaaauagguacuaggacagaggugaagcggguuaaaaaguuaaaaacccaaacaaauaauguuauucaggaucucagcauaucaagauuuagcugucuaucugcaagcuugcuucgccccccccccccuuuuugggacuccaauaauauuaacuauuuucuauaacucgauuacugcccuuauuauguaaacauccagcuaaagggcuagccaguucugcacagucuugcauuucucuccuauucaugcauaaauuacauuuuuuauuagucauagucauuguaugcuagagacaaggaaauagauugggagccggaugguuucucugaguacuagucuugcccuuuaauuagacaagucaccuugacucugaaacuugcuaaacucaguuucagauugguaagacagagacauacagagauuuuuuuuuccaguguccccugccuauucggaacacccagugaccugacgaucugacagcauguguuccaagucuuaaagguggaggacaguaaccuaugagcucagugcauggaccuguuaacuagaaauccucccugucauauaaaaucaugacaugcugucacagugucucuuggcucuugugcacaugacaugagcuaaaggcagagaagggucuucuuuauuuuuaggaagaguggucauagguauuuuauaccccaacccauaacaauuucuugugauuagcuaauauuuuaaaguugucaggauauaguaaauacugaauuuacuucuuuuaaacuuccuucagcaugagggcacgcugugguugagucucaaaaccucucccuacaguugcaaguuuacaaauuuuccaucaaaugagguuuuuuuuuuuaaccuaucaaucuuuaggugguugaauaaauaaacuagagcuuaccauaaguauauuuuagguuacaaaaauguuagucaggcuucauuuaaguuacuuuacaauuuacagaaaaguagacuauagauggaacuuuguaaguaucuucuucauccucgccacucgugaauugaaacuaaaaccacucuuuacguauuuuuuuuuaagccuuagaggaagaaaucagaacuuaaggaucaaggaaaugaaaauauaaacccuaagacacaagcaccaggaggccacucugauuccucuuucucucuuuugaaauuagagugugacuuaccauugcguccccguccccauccguagcccaggcaucagugugucuggaggacagcagggacucccuuacaugaacuccuucacgucuggcuucagcucugcugggguggcggccuucaugcucuguauuuguuuucuuuccuaagcauuuuaguuauugagcugccuuugcuccgaggguugcgucauaacccagcugcacuuguccccuucacaggaucagauaacuccuuuuaaccccaucucugcuacugcacacugcuauucugcaucagccugagagcuugcuuaaaagaggaacucccaauuccuaguccgugagcccacagaagaaaaucaugcuucauuaccuugcugaacguagggaaaguccagucucaccuauaaauccaguguuccauucaucacauaggaacaauuucggagacucaaagugcagaaagccaucuuacuuugggauuaccuguagucuuugacucuacccugaacuggauggaauuuuccuacuuaccaauucuucuggccuccacagucccuguagguaagauugguucagcgacuuaguauaacaucugacugguacugagggaaauguacuuugcuuuuuagcuugggcuguucauguugacaagcgggaagugcugcauuagggcucaaaccaaaacauuuaaaguacccucugaaauguugauggcucgccaaauuccugagcauccagcaguacagauuuccaccagcuuuuggaggccggcucuaguuugugcuuauauaaguuggagcugauguagauuugcuaaggguuacagauugucaaggccugaucaaggguaaacagcaugaaggggugugugaagagggagaggaacccagccggcaggaggauggauuguucccaugucuagccaugaccuuuugugugaagcuguaguaauaauagcuacaguguucucuguuuggauucauuuuaaaguuuugauucacaugguuuuaacuagcuaagguucccccacuccccuuugcuuuauuuuuucuggaaaacugaacauuuaucugagaguaaagcacaccuguguggguguccacaggagccuugcccuguacuggcaaugcagcaacagaugagcagagagugguucaaaagaugccagcccccucuuugggacacacaugcccuguccuugugggaugcuaauugugcccagucugcaccauccuuuaguggugcguagggacuuccgaccuuucuccaguuuaucagcacaacuccggucugauuuuggauagcacuauuuccauguugguuugcuaacugaccuguuucugaguauuuaacaaauuguucccauggauuuuuuuuuuuuuuuuuuuuuuugcucuccaguuguacucuggauuaacacaauaccacaccaucucucuguaccauuaugccgagguuccuccaugugcuuaagccaacuuugaaugcuuccacccagcacuggaccuggagcauuuucucuggucuuucuuagauuucucucucuuuuuuuuuuggucucaccauuuuccccucccgcccaacucugucuuaccgaaucaaaaguaaaaguuccucaaacugucucguaucuccuaagcaacuaucaaacuguucuucuagcauccuuugcagaugcauuagaaaauaguuccugugugcugucuucacuucccuucuaccuuguaaucuauuuuccugugugacuucauggaaacugcacaaauccagccccacuacccauugcucagccuacucguuauuuuuaaaagauauauaaaggcagcauuuguuuuuuaauugugaaagugcacacaaauguucugucuugaccuguuuucuuuucugaaauaacccuguugugaguuucaggcucaccuggacuuccuguaggagcucagcagccucagagcuuguaguccuugugucuuuguacuuguggauggaguuaggugugugccccacaccuggccuuuggguuuuaaauagugucucucagagcagagucugaacaccucaccuuaccccagccucuccagugcugggauuacagguucaaaccaccacacucagucucuugaccacuucucagggaugguucagugacauauguguuaccucauugucacgaaaccaugaccaccaucauucucagaaaucuguucaucuugcaaaacugaaacucuaacaccauuacaaaagcaucucuuugucucuggaagcugccacccugcuuccuauccacguggauuugacuucaguagguacuuuagacguguggcaucacuuagcccuuggguggcuggcuuauuucacuuaguauauuaugauuuugguucauaacaugcugaagcauguagcagaaucacauugccuuuuuaggcuggauaauugugccucaugugcaggccaugaacccacccacuauggagaguuuugugcuuccaaagauccauggucauuuaucccuuucauccugaggccaugagaguauacaaauacugaagauccaguuuuaagugcuuuuacacacaguaacuuccccuuaguggugguuuaaauauuaaaugggaaauucuauaaaugaguaauucauacgugggauugguaucauucccaguguaucaccuaaaaguuaagugcuuaaucucagccuucgagcaaacacaaaaaagcaucgagacaaaguuuaucuuuucaacaacacugagcuaaugccaggacucuuaauaagcuugccuucaguuuuuucugaguaucuccucucucuguagaaguaccaccucuagacacaucuuggacccacuauggaagaaguuucccugccucuuaucucaacauacagagcaacucugucuucaccacaacagcaagaaggagcugccacuuaucugccucccccgagccaccagcggacauuuccucacuaccauccgggcacugcuacuucaggcccuugggugcuaccacagcucgggaccacagcugcugcuuguugcuuucuccuaccuaguuccugagcugugagggcaggcauggucuauuagugaggcuuugaucucuggugguuaccacauuuauuuuuauugcauggaauuggaagaauauaaauguuuaaggcauucauuuuuuuucuuccacauuacuuaguauaugcguuuuguaagugacacuccugcauguuuguuucucuuuccuguucguguaauauguauuugugaaagccacggugagacuggauaugaucacuuauuucugaagucuggugacuaccuacagcauaaaacaacuauuuuaaaaggaaauaauacuuuugugaauugaggcagcagcuuugcucacgugacacccacugacuacuagaaugugcccagacagguagaaauccuugaguaagauacauguauauuuauuaagacaaggagcuuggaguguguggcuccaacuuggguugcuuugacuggauuagcauagagacucauugcaggaugaagccagccacaugugaacgugcaccgaggaaggugggcguugaacauuccuguucaugauuguuuuauauuuuguaaacugaaaggagaacugguagggugugagagcagaauuuauuuauucgucugaacuucauuaaagcucaaagcucuauaucuaaggaauuucaccgacccgggacaggacaugagcucuguccagugagauaaugccauuaucugggauugaagauccagugucaaauaaaauuggcuggcuuacacaaggagacaugggggugucccucuuuuaacauuaccauaugaccuggcaccaacauauacugggcaugagauacaugcagccuggaggggagagguuggaccugacugcuagagaauacauuucuauauacuaacuuggggugcaacucuuauugcugugucugacuugauccaaucuguauauuauauuuagcuaucacuguacuaacucccauccugguagacucucuuuccacccccacccacacaauagaguagagcagccauaucaugaaguucgcauuuuauguggguuaggcuauaccucauuuccaaacacaccacguauccuuaccgcuucuggucuuguaccuucaccuaaaaaaggucuuuuccucgccuguugaagucuuauauauccuuaaacugcagcucagccucuuugcuuuaguauucucuuaccuuccuacuaagaaugggggaagaaaggguggguggccuacccuuauauucuaagagaucugcccuuugguucuugugucccauaugguaacgguggucucuauugguuuagagggagggaagaucuucugcugguaccuucucagucugauuuaggaagucauuuggccaaucugguuaggaggagacgcaguacccacaggcuguucagguggccggggcagguugccuuuugucuguggcugagccucugcacuugauuucuaagcauugccauuucccaguugucuucagugagcagcuaagucuuguccggugacuauugagaaggcguccccucccucuuccagguugccacuucccauuuaauuuauuuaagguauguaaauauaggacaguuuugaguguauuugagaauauuugaaauuguagguauuccaaaauaaauaacacuuuuugacaaaacacagcgaaugacuucaugggaugacagcuuccugugaugagucccaauccagacacugcuucacugaauauacuguguaaaacuacuuucauguuaaauggguaacauguaugaaacauaauuuuggauuggagauuggguuccugaguuucucauuacauacauauaaauguuaaaaauucugaaauaccuaaaauucaaaagcacuucuaguccaaagauaagagauacuuagcauguauguaaaauguuaugcuuauauuuuaauacugcauuucagcuagaaguauuuaauucaguucauuuacacacacacauacacacagaggcacagacacacacacacacacacacacacauacacacacacaaacacacacacacacacacacacacaucaucaucaucaucaucggaucggggcuuuuuaguguuacaucucaacagaaacuuguguugacaaauccuugugguuaaucaucuucucuauuuuccugcagaaaccuugucguugccuggucuuaggucguuugcuuuuagccauuuguaaucacuguggcuuuguaaagucuuccacaugcugugggagugcuuccaaacuaccuuuucucauccuucccuuccuguguggaacuugucugcugcugacagccaucccguuuggauucaaagguugacccaaguccugaguuagagaggaacaugugccuuuugugcucuuucucuaaaucucuuuccucuuguaaaacagugcugcuuccccccuuaugguugcuagaacguucacaggaagcauguugcccugucuuacuaaaaugucuagcugaaauaggugaucuguaaaagccagggcucuugauaguacuaugggccguuacaguuuuccuggcacacuacuguuuccuugcugaaauguguguggcuguaguaucuaucugcgcaguaugggagacccugccagacagcuuucucccccauggaucagugggggaagcaacacuugaauuuacuaaauaauuuugcacuuuuuuuuuccagaucagguuagguccaugugcaaagucuuuguggcuugugaggggcuuaggguaaaucacuuggucuucuguuggagacagcagaagaaaacgaagaggaugccuccucuaacaacaguauccugugagaaaagugggcacuggagaugcucacauuuuccaucuguuugcucagaaccacuuggagugguugcuaagagaugugguccaggaugugagcaucuccucuuucucuguugcuuuuaaucuucagcuucaguguaagccccuuguguuccugccaguuggcuugcugaaguuuaaacacucacaggaucuugcucuugcauacugauuuuuuuuuucagacaguugaagcauuuguugaccuguagucuuagugaucugagaggaaacauguuugugccguuaggagcacagauuccagaauaaguuuauuuuacuuagaaagcucucuuggugacauggaguggugugugcuugauggcacuacuuaacuccucugugcuucaguucuuuauagaugaccccuuauucaaaaaguauucaguucuuuauagaugaccccuuauucaaaaaguagugacgguagccacuucaggacaucauugugaggaacauugugaguguugggcauguagaagagcaaauauguguugcccuuccucaguauagauuaccaugugaagaaaugaugaagaaauguguugcggggucaccuaccaugucuaagagguaaugaaugauuccccuaagaaagcauggcuuugaaauggcaauuaaauauaauguuuauggcucaacacaacacugcuuuucaggguagugcuuagaccaccuucuguuuauggaucaguucacuaccuucuucucauuuccuuuaagcauauguauauguacacacacauucauauuggauuaaauuucaguuuuccugacaugaagcucuauuuuuuuaaaauacuaucuauuucugccacuccugucucucucuuuccuugugcguguaugugugugcgugugugugcacacgugugcauguguguacuuguguguguguguauaugucauaguguacaaguggaggucagagaacaacuuugugggauuaguuuuuuccuucuaccuuucccugaguuccagggaccgaauucaagucaucaggcuuauuuagcaaucucuuuacccucugagccaucucacugacccagaaacucuguguuugaugugccuagauagcauagguacaacuugagcauccuagcacuucacucuuuguccuuggguugcucuguugccuuuacagguuacuuuaugugacuccuucugaaucaagaggcacaaaacugcuuaaagccaccaugagaugaaucauaaagaucgccaagcaaguuaggaguaaggcuguggucuagagaagguuucuagacccucaggcugcuacuugcaggcuacuuugggagggugcuuuggggaguggauucucggaguggcuggauggauagagauggugggaugcuguggagaugcccaaaggacucugcuaugcuuucauugugaugaagaguucaggaucuuuucucuuaauuuuucauuuccucgaccgcuuccugcagcauucuaaagugugccuaagacaauguaugaguggaugcacgcgugucugcgugugagccuguagacuaggugagcaccuuuguuuugaggaaacacuccaagccuuuuuuaaaauuaaaagacccauagaugaaguaaaugaacuuacaccuuuuccugaggaugcugccugcuugcugccccaaguauuauugugauucucugaggcuaugggaaauagucugaagcuguguuuguucugaaaaugccauuguuuuagaaugagaccagcauguucgucccagugaugcauaugugcaccuuucacauuuauggagaugauuauuguauaauuuuauuaucaguauuaaauacauuuauuaaaaugguuuuaagaccauuuagcacuuggcauuuuaaauauacgaagaagaagaaggaguguuaguaaaugggcugaaauucaccuagcaugguguuauuuccacucugacugugucuguuugcccuguuguggacuucaguggcugugagcauagcaucugucuuucuguuggaagcaggaauauguuuucuuugugccuauaagauuaaagaguauuuuucuggugugauauauggauuaaaaaugaaaugaaaacauccauccauccaaggccucaccaaucaaaaaaaguagagugaguuuauaccagggacauuugggagugugaaacccuagaaguacaacugguauccugggcaaaccaggggacaugcucacgccaggaugaguagacuggagaguuggaauaggaucuaugaaaacuaaaauauuuugaaagcucagcauuucacugaugccuagaugaacuuuaaggcaguucugagcugucuccucuuauauagugagugcugguguaauccuguguugacguguacugggaaccacuuugcugaaaacguuugaaguauaaauauucuguuggauucuuucaucuacuacuugaaaaguccaugacauuuccaaaaagauaucugggucuacagugguuaccccgcauuucuuccuccacucuguuuuacugugguuucuccucugcugagcuuugcuuucucuaaaucuuaggucuuaauucuaauguuugggaaacaaaucccagcuuugcugugugauaaacacauucauuaugauauauaagugagauuuauaagcuccauaaagugagcgugcgugcauguauaugugugcauguguguguguacccagauguguugauaacacuuugcaugucaucggucaagcacagccuucggcucacuucccuguacggguuggccugggacgguuccgggcggguguaaggucccaagucuauugcuggguaugaaucguucaggcuuucuuugugaaaguggagaaaggagccugaggaaauuguuugacugaugcugugagaacacauuacaagcuuauuaucaccguucauuuccuuugaccccauguccuugcugugagaacacaucacaagcuuauuaucacuguucauuuccuuugacccuaggucuaacaucuuuuuagagccuguuuuuaaugacaucuuccaaagcacucaguguggaccaguaggaacguuagcgcuuaauccuuaaagagugauaacuuccuucuuugucuuguaaaaugacuauuuuuuuucucuaaggugucauuguugcuguaauauacuaaguuacucgcacccagcaucuauggccacuauuuguccucauccccagggcuuugugggaacagauggugggugggugggaguuggggaugggggguggaggggagaaaagcccugugugguugucagcaugaucaaugaggagcccaauauguuugcauggugggagagggugcagaguagaucagcaacaggccugggcuucuaggacagacagacagacagacagccagacagccagccagacagccagcucagugccauguagugagucaccugcaguuguguucauuccaaugggaugagccuguggagcuacccaaacaaugagaacauuggaauccuuucaacuugcccaaaaauucugggcagcugcuugaguuugaacugugugacacuacauuucuagugcuggaaauuuauaagcaucuugaaccagcaggaaauaaacaaaugugaugcucacaguucaucauccuaacaagggcugacaaaauagucacugcuuuuaaauaguauuccuuugugaaguuauucuggacuucgcucuugaguuuaauggcagcgugggucauaucaacuuugccaacucucacagccuuaaaagaucaucauuaguuggguuuccuuagaucuuuuucuuagaauauuuaagugggacuuuuaaugcuuccuuuaaugguguuagaaagaaagaauccaagagcaacuugguuuaacguacccugugagcaagagcucauuuccuagggaugaauacaguacagagguuaaggguuggaauugcgaggcuccagcacucacuccaucccugcuccucagcaaagucacuggggaagguucucuaugcaucaguaaacucucagaaaaaucucuguaucccaugggguuguggaaagaauucagagagguaauacccacacagcaguguugauguuaguguguccagcugucagaaagcagaguuuaaacagaaagucaugggcccaguggagucucuugcauucuccuaucccacccucugggugacuuuucucugugaggccuagaagcucucccguuuuauuuugaguugcugaugucaaucgaagaauucagguggagccaguccuuccugcuuucuucuuccaaggcuagacuuugauuuuuguccauacaaaacugccgugaucugcucccuuauuuagaaaauauuuguuugauguacuucaaagagucugugcucacacagugucaaguuuaagucaucauuggauguccugucccaggaacuggacucucuaccaaggagagcaauagcauccaaugcauuuugucagcuaaggaaaaggcuuugauugaagacuucucaccgucuaggaaauuuaagcagaaacuugguaguuggcuuaugauugcacaaagcauccuucucuuagccgagcccuggccagcauagaggguuuucguauagggaucggauguaacccauguguuuccaguaagacugcuccugcuuagguuguguauacuuacugaaaaccuuccuucaguuacagcgaggaaaagagucuucuaguuuuccuucuuguuuuccaucucucucuggggcuaugauugacucacggucauuggaugaaauccagguuucagagccagccuacauggcucuguaugacugcugcuccuaccccacauucuccucacacuaucugucuuagucaggguuucuauuccugcacaaacaucaugaccaagaagcacuuggggaggaaaggguuuauucagcuuacacuuccacacugcuguucaucaccaaaggaagucaggacuggaacucaagcaggucagggagcaggagcugaugcagaggccauggagggauguucuuuacuggcuugcuuccccuggcuugcucagccggcucucuuuuagaacugagacuucuagccuggagauggucccacccacaaggggccuuuuccccuugaucacuaauugagaaaaugccuuacaguuggaucucauggaggcauuuccucaacugaagcuccuuucucugugauaacuccagcuaugucaaguugacacaaaacuagccaguacacuaucuguauccuuuauccaaacugucucugccucccuuucuggugauguguccuuccccugaccucccaccaaggaugucgccaugccuuggaaauucuccuguacuuuuccugucugcuugccucaucucagagcucucuguuuuggucugcaugucguauucauagcacucuccacugacuucucauacacaugguuccuacagugucuccugcccccagcccacuugcucaguacaaaaauggcuacugggguguggagucagauuuuucuaggaggaaaugcagagucccuguaaagaggaaaggaaggagggagggagaugccugagggcagggcagcagauuuguaguuccuggaggagagaguuggaaaguuacccuaucuguaggaaaagaacucagaaguggcacuucagaacugcagagagcugcugacaucuguaaguucuuagcuuuuggggacagucauucuacuggguuccuuauauguuuacuguuaucagguuucuucccugauaagaagaauggcucaggcuggugggcuuuagauuugcagcagaguucucucuuuuaaugagaggcuuuaccguuuccauuacaagaggcccucaaccuuuccuggaucugcucucugcaccgcgucacgcuucugacccccauucuuugcacgacagcacgcuguuaucacaaaccagguucugacauagugauauuaaagugucccaaaugguccacccugggaagccgauggccguuuuaugcuuucguaaucuucucagagcuauucuuguuguuguuaguuguuuguuuauuggagggcuuucuccaggauccuaagccuggugauaauuggaccagugucauagaguaauacccaacacagugcucagaaugaaugaagaaggguggaggaggagugagauacuucuagacuacgaugcuugaugcuaugguuuugagacugaguuugaaucccuagaagagauguaaacgacagcucuaugaucccuguaccccuguggggagauuggaaguagaagugugagaauccuuggauguucaaaggucauuuaaccuggcauacacaguggaaaaacuacaaaaaaaaaaaaaaaaaaaaaaaacauuugcaagcaagauagaacacuggauauuauccucggaccuccucauguaaguuuuggcaugugccauucugcauuuacauaccuacuauauugcauacuuguacaugucuguauauacucuuucaaaaugaaaagguuagagaaacugagucugucuacuuuuuucaaaggcagauuuggaaucucuuaagauuuuuccaaggaagcagaaaucccagggacugguuccguacccuucagcacacuaccuguuuauuuaagaccacggcucaugggaaaaccuagcuggcccugaaguguaauguacagagcaggcuggcuuccuauucauagugauccucugccucugcugccuuaguccuccagugaaaggcuccggccacuaaaccuugccuagcaccuaccugcugagacuuguuuauuuuucuuacauccuaaaacgcuuuugagacuucguucuuaucuucuuaaggguacccuuguagguccuucccacccauauauccuaccuuccuucagaccagugguaauauuucuguagaauauguacauugaggaauucucuccuuugaauaggaagcauaaagcugguuagugugagacgagcuugagggcguucuaaacagugcuccagggggacaacgggauuggccucaccaggaaaacuucuaguuugguguguuuuauauacagguauaguucuccugacagaugaaaaugaguugaaauaccuccaaacuugaaguguauaugccauuuucaggggcccagggaaagccguagaacccucucuugugacucuaggaauuaaagguggcagaaaagacaaaggaggcuugacuguguuucgacuucacuucucugcagcagcuuagggucuccuggacaggaugcacaggggcucuuugauguaauuccagguucccgcccucaguuuagcacccccccccuuucacccccgugcuuuucuuugugguacuguauugcucuuggaaauauauuauaaugaugguucuauauacuguuuuauaagggcccacuggauuucuguuaaugagauuuuucuucauagccucaguuuucuaguauucaaaauagucgaaugaaauaaaaacaagagcauuggagaugcagcuccauguuagagcaugugcuuagcaugcacagagucccggcuuugguucccaguagcggcuauacccucauaacacacagagacagcaugacgcuaggugauccuaucauugaugugcccugaagucuccacaaagagaaacuuuggguuaacacauauauaggugugucuguagguguacaugcauguuuaaucuacauauguguauauauauguauguauauacaaagcacauugaaaacagagugaguaaacauacucaucaaacacaauucauauagguuagaauucuauuaguaaaaguacccauuuaauaauuugucuuuguuacauuucugauuuccacauuaguguuaccuauaugagauggggauacauuguuaccuacuuuuugcuacuuaauuguuuaauuuuuuuauguucuggaaguguuuaaguaaauggugcagugaaugagcaagcgacacagaccaauggcuggaagggaguucuggcaccaggagcaaagcuuugguacuuggcucugggaaacaaggccaaccccagccucuucuggaguguuugcaccaugauucaggaugcuacaggacacuuagauguccuugauaguuaauaguaaugaauuaguuuuauccuggggguagcucauucaaguacauuuccugcauggaagcuuauacuguuuaaaaacaaauuauuuugacugaaaugaugaaauacuucauaaaacauaugugacugaaaacaauaaccuuuucuuuucuucuuuuuuacuuuuugcccuuuggcuaugaaaaggauuucccauuguauguaaagaaaggcauaaaaauagcuacuauuaagaaaauacugauaguuggaauacuugcaaacagaaaauuaaacgccuuacuccauucuuucuuuuaaauggacaggcucaggcucacaggauacaguuccauccuaucuuccauccuuccuccugagcaguuuacuugaaguuuucuugaagaaauauuaguucagagagcuauugauagcuguuucgagugaggcuaugccagugccugacaaauacagaaguggauguucucggucaucuauaggauggaacacagggcccccaauggaggaauuagagaaaacacccaaggagcugaaagggucugcaacccuguagguggaacagcaauaggaacuagcuaguacccccagagcucauguuucuagcugcauauguagcagaagauggccuaauuggccgucauugggaagagaggccucuuggucuugcaaacuuuauaugccccaguacaggagaaugccagggccaggaagugggaguggguggguaggggagcagggccgggggaggguauagggaacuuucgggauagcauuugaaauguaaauaaagaaaauaucuaauaaaaaaagaaagaaagaaaacagcagccucguuuacgcacaaguuuaugggccuuugcucucuaguguuucccauaacagcuucccauguagugcaagaagccaaacuccaaauugggauaagacgugaacccuacuaaacaagcucaguacaaggaaacagcugucaaaauacagcucuguagagcaguguuuucucuuuguguguguguucuuguacucuacuaaauauauuaucuuuuccaaaacccagugaaguggagaugaauacuucacucuuacagggcuucuaccuucauaguuaaucuugaggaaauggcuugaaauguucuaauuuaacauguucugugaauaaugauaucuuuaucugaauagcggaaacgauucucuuuauguucuaaguuggcagggacuuugucuucccagucuucagagaagcguauccugggguggggccagcauggcucucauucuaaagagaugcuucuagguuguuaccuuguuguuuuuguuuuuauauauaucuuuuuuuuuuuuuuuuaaaugaagucucacuguaucucugucuggcuggaacuugcuguauguaggcuaggcuagacucagagaucuguuccuuucagcuucccaagugguagaauuaaagguguacaccaccaugccugacuaaaauguauguguguccuuuuuauuaguggguguguuugugugugcaugugagugaguauguuccugaagaguguguuaaauccccuggaguuggcguuauuugcaggagugauucucuuggcauggaugcugagaacuuggguccucugugagagcagcaagccgauuaacugcagugucaucucucuaagccuucauccuguguuuggcuucuguauucucuguacagguugucacugggcugaacauguacccuucuagagacuguuuuccaucagaaaauacaguuuucugaccuacagaauacuuaugaaucaguuaucucuuauaaagcuuuuuuuuuuuugcagaugguuauaagcaaacuaauucaagauacauuguauacuuaauguaaaacuggaacagcaaugcuucuaggaaaaaaaaaaacagaauaucuuuccaaauguggauaguugauuuuuuaggaugcaaaauauucuaaugacaaaagaaaaagguaucauugugccuuauaaaaaguuagacuuuugcauuccauuagacacuacugucacaccuuccugccugcugccaugcccccaccaugauggugggacuggaacuacaguugccuuggucugguguuguaucauagcaacagaaaagaaacuaauauucucuauaucucugguaaaaauaaauuaaguacuuauagaaccuuucuuaccaaguuuauugaaaacaccagaguucagaugagaaacuaaggaaacaauucacaagcuuuguuugacccaggaacauauggcgagagguacagccuucuugaagggaaauggagauuaaaaugacagcagccuaucuggaugugacacacuugccuagaaugccagcucuuuggaggcagagaaagaaggcaguauuccaggccaguuuuagcuagauuguaagucagacuugaaauccuaccuuaaaaaaauuuuuuuaaacagacauaacuacuacaaaaaaagacaugaaaaaguaguuucuaacccucagaauuuuuccccaaguuccccauaaaaaccuuagaauacuacgaauugacaagucaguugaguauugauaauguauaucuaguuaugaguguaaaacaggguaucuacuuugugacuuguaaucaagccuaguaauuuuacccuuuuucuuuacccaagagaaaugaaaguguaugcuaccuuuacaaagcaugacuacaaugauuguaaaaccuuuucuuagguagccccgaccugggagcaagccacaugugcaucaagaguugcacaugaauacaaaauaaaaauaaauugugacaugcuagcagaaaugaacaccacucagggacuuauacaugucaguaaacugauuaaaucucaaaacguaaucgaaagaauucaggcacagggaaauagguaucgugugguaacagggaaaugcaguguaauugcuggugaaccaagcucuagcgauagaauuggaauguaauugaauauaauuggaaugaaggucuuuccuagcuugugcuauacaugcuauacauauaugaaagaugguagagaugcuggagugugucuaaugccugagcacucagaaaaagacaggcuguacaaagauguggacuuuggaaggggcaacaagucauucagcaugucagggguuagagagacaguguuacaggggucagagagacaguguuacaagucagguaagcgcguucugggguucucaaggacacuaguugcugcuuuguuuacuuacuaagcacaucaguucucuagaccauauaccagucuauaacuuccuggaucugugcauuauuucccuccuuugauguagcacucacuugcucccuguuuugaucuccuguucuaauauccuaguguaauauuaaguuuuuccaaguuaugccaugugcuuuuuuauacauugcauugucagggaaggaaaucugccugaauugugauagaugcagagaaagggguaucuuuuaugugugaaauugcaguaagagccaugguauagauuuuguguguguguuaagaacuauaauacguaacuuaauucuguacuagauaucugauaauuguuauaaugacucuucuaaacagcuauuuaaucuacuuuuauaaaugcauaaaacaaguagucagaaguaacucgguuguauaauuuuggcuucuuuuguucuuguaaucaucuuggacugcugcacuauuucauugagagaggaaaugauggcgcuggcaucaguaugcagagguugacuucuaugucagggcuaaaacuguucagggauauuauguauuaacucauuuacucugcaugauacccaggcaagggauaccagacaaggaguagcaugguggagauuguaucaaucuaagugguguagucaggauuuaaggcuagagaauaugauucuagaaugcacaccuguauggcuguuaggaagcacugaacacugugccuucuccaagauggcucaacggagagggacuuuagccacaacuucagauuguuguuguugccagugugauauaaggcuuuccuucuuucuacccauugucugggaaaauuaacuguuacaaacauaauuacuucucuucagggacuuaaaaucuaaucugggucugaguuauuuuauucauguggcuccuugguuguuuaaaacacccucucacuauuugaaauauacuaaggaaccagacuaaacugacaaugugcuacauuuguagggaagaaaaucaaugcagaucugcaguuauucaguaaaaggcuuugccacaauaucaaaagauugagcaguaaauagcauuguguguucaaaguggaaagaacccauuuaaaggcuaacaaaauggcucaguggguaaguguggcuacugccaaaccuguuaauuggaguucuaucccugggguccacauguuggauggagagaaucaacucccacacuuuguccucuuaccuucauguaguucauccauauuuguguacacacacacacacacacacacacacacacacacacacacacaagguuuaaaauauagcuuaagaaaaauauuuguuuuccagaaauagcuccuuccaagccuguuuugguuacucacucucuucuuagcuaaccaguuugcuuucgugccaccagugaagagggcaguugcugcagucaaucucgcagacuuggugacagcaggggacaccuggcccuagguuuucucuuccugugagaccccaaccuuucccuuccuauuuucacuucuguaaagguggugcuugcaggcaauuaaguccuuggguagaaaguuucaggaguaggagaagacgaggauauugaacacuaaagcccaaggcccauuuuucuauauuuucuuuugguuauuaguaaauacagagcuguaagggcuacaacaagcccacaaauauuaacuggcuuguauugagauuagauucuccuccaaaucuccuccaaauuucucuaaaguuaguaaaaauguguguuaagaauuuauaugcucaaacaucauuggugugacuuaaaagauaguacuaaaauacgagcguuggcuauauaaaaguaaggcuuagugugacccauuagaacggggucuagaggacauucuucaugcagagcaucuguagcaucuggaauuguggcugucacgugauaaggaaucagcauguauagcaugaaauucaauucaguuccuucauuacccuuagaaugugugcacaaaaagcaaacauucaguacuugccacaaugggcacaccaacacaacagcucuucugggccagcucccauaugucucacagcugaucuuuuucuuuuuucucugaaaccuuaacuucaaccccagauguucuguaauuagauagaaaccaccaacccacucugcuguucucuuaucugaaggaugagcagucaggaaccugacaaguaagacagggcuagaacaagcuuuucacaaauagcagauggcugacuucuguggagagugaagagcuagcaguuuaauuuaggcuggguacagucagaaguuuucaaagaaaacagaaauggauuauuagacaccaaacagugacuuuaacauuaaaagugcagguggauugagaagccucaugguaaaccuggcuuuccuguguguuguuagagccaaguuguuacuagaaggauaauuaauuuauuuacuagugagcuccuuuucuaggaugcuaucugaaccacaaggaggagccagaaguuuuaauaaaggggguuuuaaagaccugguugggggaauuguguguugggaggaagcacaucuguuuuauccguugacuguauguugcucaguaugcugagaauuuaaacuagacuuuacacacuauuguugauacuaauaagagcuugcugauacagcucuacccugagagacuaugccagcacccaacuaauacacagauagucacagccaaccauuggauugagcccggcccccaauggaagaagaguuaggggaaggaaugaaggagaugaaggggauuacaaccccauaggaaaaacaguaucaugagacaguacuccuuuuuuuuuuuuuuuuuuuacauucauaaguacuauggguaucacaguagacucacagcuaauuugaaaucccaaguaguaugcuguuucucaugaaagcacucaguuugacaauaggugaccaggcacuuugaaauagaaagaaagcacuauuuacaaguuugcgcaguuaacugguauguauguuauuuguaugaucacucuacauuugaagcucaaauuuguacuucagaacuaccaguaggacuuguucaaacauaggcuguagaguucuaucccuagaguuucugggucagugggucuagggucaaauauugcacaucaaagaaguuuacuagugcgguucaugggccuauccuuugagaacuugaccuaaaccuacuuggcacucuugaacucauaauuuucaguugauguaaauuuuauuucuuuuuauuucuucucuucaacuagauggucuuuuggaagcacagaggcccauaguaaaaugugcuagugucuuauaucuccucagacugguucguucuugguauuguagagucugcucaugcugagagaccaagauaacuccuuugcuacucacuugagggaaaugcuggagccugguucaaugaaucugacuucugaauuaucagagauuuaggcuuagagaagccucaacaacuaaguucauucuaaaagcaucuacuagagugaacauugucuccaaaccaucuuugcuauuguauucagcaaguugaguucaagaagcaucuugaaccauaggaaguaucuuguccaaugaucuuuuccuuccucacccacugucuugugcuaaagacuagugcagagcuuaauuaccccagagcuaaugcaguacguggagaggggcuggguacuuguuuuuuaagcauuuguuuauuuaccagguaggguagauugaaugacaaccuucuaggcaaccuauuaguaggccacacaugcaaaugucaguauaacucgugaguaagugaaucucaaaucaccuauuccagcuucaucagggauugccuuguacaugaauauuaaaaagaacugaaaauccuguagagguauuaccauuaaucgcuaggugggaugacaugccgacccaugggcuauguguucuaaugaucuguuguauaauggucguuuucccaaugauccugaucucuaugagaacauugaaaacaggaguguuaucccucauuuacuuuauacuuccuucauauauuaggcuguuaaugacuucacagauauuaucuggauuaaugcuuuguggcauugaaaaccggcaugagguuuagggagcuugguggaucagguacucaggauguuacuuaguaccuaguacuuaguaccuugugguacuaacauuaacuauuugucccuuuuuacgacuacuuugagagauguuucuccuuacuacuguguccucgcuaugaugauaauuuuuuugaaaguugucagugauaauuuagugaaaaaaacaaaacauccuaaaaauacaugacuaaggguggauggaggagcgugggagggcguggugacccguggauaacugguagauuaugaggcagaacaggaagcaagugaagccaucgcaggguaaagcagauugaaaucguuugucugugggcaccagcggcagggccggccucauagcaugcaggggauuuagauccugauagggucagcucuguugccuucagguagccgcucagggcuucggguccugcuuccuccucuugcugcugcuacagggcagcaaaugguagcucacuucccacaggcugcccgauuccccugacugaagcucugagcagcuugguguuuccucucuucuucuuuggguuuaacagguauaaccaugugugcuauauguacaucuacacaugugaaacuguacacgugugcuuguauguauuuauaaguuuuauuaaaguauaagguuuuauguguuuauagaacuuaaaauguuacuuugauauuucaaguuaggauuuagaugauuuagucuugaaauguauuuuugauuuuguauauuuaaaaaaagauaaacguguaaguuguuuuuuuuuacucuuauuuccuccauaggauuaaauuuccuaaaacaaaacaagcaaaaaccaaccaaccaaccaaccaaccaaaaaaaagaaaaaaaaaaaaaaaccuuccaaaaacucagcaguaaacaaaacaaucuagguggcuugcaugggcucacugagugcacugacacuagauccaugcuccgcccuacguguugaauugaaacuaguucaagcauuuuaaggaguuuaacugauuauuuauaaacuaaguuucuaaugaauguaaauuuuugcuauguauaggauaugaagauauaugguuuuuaagcuuccuuaagaauaaauacaaauuuuauuagaugcaauuaggauuaacuuucccagcaagaccaagcuaaaagcuccucucuguguaacuaugcguucaaacagacacaguuuuguuauauguguaugugugcaguggcagaaaaggagaaacuauucguacguaaugagaaauuuugaaagaagaaauacggcagugaacuuacuuuugagaaccaucucuguguccuuucacacgguagaaauguccaagauggacacuugugaaaguuucuuuugaauuacuacagacacguuaaacccagcugggagccccaaauaaucaauuagagcacuuaagguuuggacccccaaauugccaucgacaaauacuuaacgugccaaacaauugccauuuuuaaacacaaacugacucuacugguaaaacaugaagauugcccaguguaacccaguucagaccuaacccuuccauccacacacccagguuauuucaugaagaaucuccuuaccugcuuauggcuccuguagugcacgucagacuacacucauguuggaauaugucucaguguagguuccagaggacacuuaagccgaguucuuccucaucuucaagaagagaagaaaaaucaggaacuugacagaagccacgagauaauggguuggcugggcacugcaucugagcaguuagaaugcagucaaggcuagaaaguggaagcaggg

SEQ ID NO: 1441 - RNA, 29275 nt, Mus musculus
cgagugaagaccccuagaggcugagcagaccccaaaggcggugcaauuccauuggcccaaggcagaggugagcggcugcuaauccccucgggaagugaagggacccagagagucugguagaugugggagcugggguucagggcgagacagagggugggaugggcagaaggguccaggaaaaggaaaguacuggaggggaguugggacaaaagcagcgaccaagggaacaucgcuucagugacugaagccaggcaaaaggagcgggaaggauuauauguagccugggacgcuuucauaaacacugaugacguguuugugcaaagcaagcaauuugaggagaaacgccugggacgucggaaagaaggagugaucgauuaguacuuguaaguuuaggugaguuugagaacuaacuaaccuauacuauugagggagaaggaagagcauuccagcagcagcagcagcagcagcaaucagauaaaggaaagcuuugguuaguuuggaaauguaugauaccauuaaaauaacagaagcgccuccaguucucugaagagucagucccccagcuagugaagacuaagccuacuaagccuuuugcucccguuggaagcaaagaacguuccuucaaucaggugaaggcucuccucagaagauuuccugucucugcuuauguuacaagaggauucaaaagcaagacagaagagcucagguauugccaacucuuuuguuaaauacaguuugaggcuuaaguguacgggaacucaugugguauucauuuacggcucucuucucuuauaacuaacucuuaaggugcauauagucucuucuguuucccagcuaccuuguaccaucuuuguuuaucuaauaauagcaagcucaucugcuuuuuaaucaucacgcagagaguauucaaaaauauucagugauguaacagugacaguguaggcauagaaguaaucauuaguaaaucuuaauuuggguuaaacucauucauaacagcuccagguugggagggaucacugagccuucgccacgugcggguuaaagauauuuucuaacaagagaagcagaauucuuccuuggccaugcuccccaucacugugucaguaagcagagggguguuuccaagcagagaaagagcagacaguguuaugccugcaaagucagagacucagcccucccagcuggucaguuuacuguccucccggucauuaguuggcucugaaaaggcccauguguccuuauuggcaaggacuugcagacaugcuagaaagaaauuugaccuuuuuuucuaguggguuauuacagcuguaaaaguauuuuggaagguuaagccaaauaaauaaaacacauauuaaauaauacaauguuacaaaaauugaucauauaaagaaguacauucauaaaugcaaugugaaaaauauauauaauuuuuaucuauuuacuggugcaaaguuuucuaaauugcacauguacuauuuuuauauuuauaaaaauauuuuuaaaauguauauaaaaguguaaaaggcucuuggucaaacaagagaguuaaauuuacaaacuuuaauugucccgauaacauuauuaugaucucuaaugacagggauccugcuuuucauugggaaaugagaagcuaugaagauauguuuacaauaauaagcccauuuagugauaaaguccaaugggaagcuagcacacacugguuuauaaagagaacaguuuccugagucuaugcaaguuuacacucuagggaauaagaguuccucuuucuccagauuucacuagcauuuguugucaucauuuaucuucuugaugaugagcauuauaaguggaauaagauaggaucucaaaggaaugucaauuuggaugcccugaacaaucuuucaggucuuucuuucaguucacuagucuauucauuuauuggauaauugggggaugguguuaauuuuuuugcaguucuuauggaauuccaaaaaacaaaaaacaaacaaacaaacaaaaaaccucugaaacuagaacuaccaauccauuacuggguauguaacaaagagaaaucugcacagaauuuauugcuacauuguucauuauucacgacagccaagaauguggaaccaacuuacguagccgucaaaauaugaacggauaaagaaaauguggaaauguguacaacagagucccauguggccauaaaagagugaaaucaugacauaugcaggaaauggaugcaacuggaaaucaauugggcuaaucaaaacaagacagacucaaaaaggaaacaccguguagcuucucugacaaacagaagcuagauuuacacuuguacgugcgcauguguguuuagaauuuuauuuaguuauacacuauucuaaucugugaguguguauaaaggcaugcauguaaagcaaaaacaagcuagcugggguggguaggagagaaagcaaugagaggaguuaauaagaacgaagcauaguaacauaggugccaggaugaaaugcauuaauuuguaugcuaacuaaaccacagacaggaggcacacguucaaaccagggugaaaucccagcacagagaaggggaaguagacacaaaguuucgccacuaaccaagaagccauuugcaguugcugccugcugggaggggcguuccaguuuucuccagucugacacuguguauaacaaccaguugacaauacaaaguuggcaugauggaugguuuuugugcuauuuuucauuuuuuuucuuacuguuuuguuguuguggugguuguuguggugguggcugugguuuucauuuguuucuuuugagagagagaaggaacaugaaauuggguggguaggaagcuggaaacgaucuggaagaaguuggggaaagagaaaaauuguauggagcauauuuaaacaaacaaacaaacaaacaaaagguucauuuugccacaaaaaggugugaauuaaauuaaccaguuacgacucuuaaagaaaauauucccaauuauucccagaguugcuauguaugcugugccuaggacuuugcuugaacuggcccuauaacucugguguggugucuuuucaggaugcagaagagaggcagggaagucagcugcuugcugaucucccucacugccaucugccugguggucaccccugggagcagggucuguccucgccgaugugccugcuaugugcccacagaggugcacuguacauuucgguaccugaccuccaucccagacggcaucccagccaauguggaacgagucaauuuaggguguguggaccuugccugaucuccuucucagagagggaccacugauuuuccugguacuuugccccccaaacaccugugauuacuuuuaauaguuuucuucuaaaauggguucauacaaaccuuauauuguggagacaaugaacauuuuaucccaauagucuuuuacuagaacuugaagccccucuuaguuguuugggagccucauaauuauggggcagcuuuauucugaaugaauuuuaaaugaaaaagauacaguuucuguuaacaaucauuaugauaccaaggaagaggaauugucauugaauauuuuaaaaaagcauuucuuuugcaauuuauaaauacccauuacaaaauggcuuacuuaaaauacuugccuuacuaaaucugacaaauuauggugauauuuugaagguuuaugaaaauuuguuuauguguauaaaugcacaagaaaugggauaugccaucaccuaugugacauuagugagcauguacaguaugccaaacacuauuguucacguuuggaggaaguaaugggggugggggagcaacaaggguuauaaccguauacccagugccuuggaagcgauugcaaacaguaaagacugacauuguguucucccuaugagggaggggccuugggcugagcacuuugcaaugagcauuugcucauugugcuggcagguuuuaugauaacuugacccaagcuagagucacuggagaggaaggaacuucaacugagaacaugccugaagaagaucagauuauaggcaggccuguggggcauuuucuuaauuagugauucauggggcagggcccaguccauuguucgugguaccauuucucaggcacuauuaaaaaaaaaaaaacaggcugagcaagugucaaggagcaagucagugagcagcagcccuaaugaucucugcaucagcuccugccuccagguuccuacccuauuugaguuccuguccuagcucccuacagugaugaacaaugauguggaaguauaagccaaauaaauccuuucuuccccaacuugcuguuggucaugauguuucaucacagugauaauaguccucaugaagaugcugguguuuauaacaccuuuggacuaaauucuguuaucuauagcugaggaaaauggagcauagaaagucuccagacuacaccagaguguaaucugggccugagcuuagaaucacacccacgugcacuccacugccggggcuucuuaaccggaacacaguuguaaaagggaauuuucuguuuguuuccauuuugacauguggacuuuaauugacgauucaucugaagcugaaaaugauuuuuuuuccagguauaacagccucacuagauugacagaaaaugacuuuucuggccugagcagacuggaguuacucaugcugcacagcaauggcauucacagagucagugacaagaccuucucgggcuugcaguccuugcaggugagauagguagagggugauggaggcugagaagagaggugcaacuguggguuauacccaaaagcugcugauucccgugggagacauucuauaagcauucuauaaacuagaggcagauaucaaggaaggauuucaauuguaaugcaauuuuaugagaaaauuugaauauuaagaaaaugcuggggaaaaugcuuacacaauugcgaggaccuaauuuaggaucuccaauagccacauaaaaagcacagcauggcggcagacaccugcaauuccugucccuggaagcaccuguaucagaaucccagagacucauuggccaaacacucuauucaaucaaugaaguccauauucagugacaaaacuugacucagaaacuaauguggaaagcaucaggaagacagccaacaucuggucucuacucaugcaugaauaagggaucccagagagaagggaagaaaaaggaaggaaggaaggaaggaaggaaggaaggaaggaaggaaggaaggaaggaaggaaggaaggaaggaaggaagagagggaggaaaggagggagggaaggaaggaaagggaaaggaaaaaagagauggggagggagggaaggaaaggaaagggggagaaagaagagaagaaaggaaaauaaauaaauuuucagggauuauuagaccuuuaaauuuuauccauaaaaggucauuuccaccuguuugucuggaaguagagugggaucccuuauauaagggcagucuuuaacauaguagcauuuuauaaaccauuacaaauuuugaguuuucucuacuuuuuauccucuaccaucuucaaacugaaacuacaauuauucccacaaaugaagaaaaugcuguaagaguuuucacacaccgaagugggaaacuuaaggauuagacaagucuaacaaugagaauggggagaacaaaaagagacugcacagggagcccuuucucugcuuauaaucuugacacuugagaagcuaauugacacugcaugacuacucaacucuuuaagcaaacaaugcuguuguucaugaaaagcacaauaaaguacauaugucccauaauauucaucaaaauuugcaugcagcacauaauagcaaucaaagcaauaacacccacuguucacagagacuuuaaacaugaaacuggaacuaugucuaguguuuugacuuaggguacauaguaugcugugucuguauguaacaauguugauuuaggucaucagacagcauuuggaacauguaucuucaggaggaaucauucauguauccugcaugaaauucuccaccuauguuuauucucuuagccagguuuuucucugauggagaaacauuggguuugagguuuuacucccagguaacauuuagggaaaagcugucuauguucucaguuuggcuuuuauuuaugagggauguugguauuccagaaaauucucuuuugaagagauuacaauuuaggucaaaacagaaaaauauguaaaaaguuauuguuuuuauuaguauuucauguucuuuucuuuuuuaaaaaugguaugcuuagaacuaauuaagauuagauuagauuagauuagaaaauaaucagagagggauuugaugaaugcuaaagcaucaugaaaaauucaaaauuuuuugcuucuaauucagaaucaauuaaauucauauuacuauaaaagacagcacgccagaugugugccagcugaggaguggauaaacuguguaacgugagugcuauguagaaacagaaaggagugaaggguugaugugcgcugcaacaucuugaaaacauucggcuacaugauggaagccaggcacaaaaagccacauauugcaugguuauguuuauaugaaauguuuaaaauacauggauucuuagcaaacagaguaagauguuacuuagggucaggaaaagauuaaaaaaaaaaaaacuauugauguggaaugaucuuaauuuggggaaaagacaauuuccuaagacgaaauaguugagguagauauaguuauaucccuguggauauuguaauaaaccagcaugcugugcucugagaagggccuaaugaaggggcaggaggaagugaaaugagaugguagaaaggaaagucauauaccauggcuucucucguggguggaaucuagauauguuaauauauugacauaaaggaaggaauuguuuagggaaggaucaaaaccaacaggagugagggagacaauaggaaccaaugagaggcaaaguucauggucaauguguguggagacaccauaauaaaacuccuuuuuuguuugcuaacuaaaaccacuaaaaucuaaaaacaaaacauuuuugcacaagaauuauuuauuauucaauaaagauguuuaaaugggggaaguugaaguucauugauagucucauaaaucuuaaauguauuuaaacugcuuuuuacguuuuuuauuauuaauuacucuugcugucauuauuaucaucaucauuaucgucaucaucaucacuaaugcuuuucaccauacacaaauguaggcagaagaguguaauccacuuagugaggcaaucuuggagagggaaaggaagcggaugcggggcagaggcacacaggaggacagugagagggaaaugaacaagaaaaaauguggacacaugcacaaaaauuccauaguccacuacauuacuuuguauucuaauauuaagaaaauaauaaaaccauuucugugcacuuaucacccaggcucaacaguuaucuuggccacagauccugucucacugcauccuguccaccugaguccacuuagcguucugaauccaauccagggcaugaugcuuacuccuacacagaacuaaagauuaaagagaguuuaaaaguaaccaugacaucucucuguuccuuuagcgauaaguucuuaauauuuauggcugcuuguguauguucuaauuucucuaauauugucacauuuaguuggcaacuacuuuguuugaauugaguuggaguuaaggucccauaggauuaaucucaacauauuucuauauuuauaaacuuuucucucuuugugaaaguuccuuugagaaaacaaauaugcccauaucuuucuuuacaggucuuaaaaaugagcuauaacaaaguccaaauaauugagaaggauacuuuguauggacucaggagcuugacccgguugcaccuggaucacaacaacauugaguuuaucaaccccgaggcguuuuacggacucaccuugcuccgcuugguacaucuagaaggaaaccggcugacaaagcuccauccagacacauuugucucuuugagcuaucuccagauauuuaaaaccuccuucauuaaguaccuguacuugucugauaacuuccugaccucccucccaaaagaaauggucuccucuaugccaaaccuagaaagccuuuacuugcauggaaacccauggaccugugacugccauuuaaagugguuguccgaguggaugcagggaaacccagguaacuaucuuguuuguuuguuucuuuuuuuuuuauuacguauuuuccucaauuucauuuagaaugcuaucccaaaagucccccauaaccucccccccacuucccuaccuacccauucccauuuuuuggcccuggcauuccccuguacuggggcauauaaaguuugcguguccaauggaccucucuuuccagugauggccaacuaggccaucuuuugauacauaugcagcuagagucaagagcucugggguacugguuaguucauaauguuguugcaccuacaggguugcagaucucuuuagcuccuuggauacuuucuauagcuccuccauugggggcccugugcuccauccaauagcuaacugugagcauccacuucuguguuugcuaggccccagccuagucucacaagagacagcuauaucaggguccuuucagccaacgcuugcuaguguaugcaauggugucaucauuuggaggcugauuaugggauggaucccuggauauggcagucucuagaugguccauccuuuugucucagcuccaaauuuugucucuguaacuccuuccaugggugauuguuucuuaguaguaauuaaaaagaggacucagcugggaaaguguuaucuguaaugggaaguccuagauaauguagaugcagaaaaggaagucccccaaaugaccagugacaaugaacucuguauccauccacagcuguauuuaugcugcagugggauaacgggaagcugggaggcugagaaacuuuacuccauggcauugugugugaaaacuuugcucaucuguggcauagagaaucaagcccaugguucuuggccuaucagguccucuaguauggcccaggccuguucucagucucaaauuccucagccccugcccuucucaggcaggcaauuuguguuccagaugcugacacacuacaccuguugcagcucggaacccugcuguugccucugccuauagcucuucccuuccuuuuccgcuuuauguacucugggauugcagcucugcucagcauuaccuccacaagggggucacacugcuuaucugagcauccacauuagaaucaugaccucgcccgccacuccuguagcgugccugugcuuccuuucuugaaugaacaguauaccaaacuuacagacuuguuaauuuauagauugaaaugccugcugcuuucugcuaugucuaauuugucuaucccuaaccucugcaguagaucugagacacaguauguacuuaauacuuuuaguuaaauuguuauuauguagccauuuagaugguaaaaagaaauaaguccaccaucucucuauuaguuauccaugguucuaauaugucucaaacaugcguguaaaaagauuuuuaaaauguauguguguguaucaugugccaauauacaauauacauaucugccauauaguuauauacacacacacacacacacacaucaaauacagacaaacccauuagggcuaaaaucuuccagucaugucuaaaugacagcuucucuugugcuugaauuggcugauaauuucacaagaguuaucaaucagucaaaucacccuuauacuuaaauuuuuuccuauucccuaagcauuuugaaagccucucgcaggcacaaugugccuguuucucugaugcuugcugcaguacaauguuauuuacccauagcuucuugcaucuuucauucuuagguucuuagguguugcuuuugacauuuucucggcaugcauuauucacagauauaaaacuaaagucuagcugcucgacucuuauguauaucuauguauguaacacuuuugcaacgccaaaucauaguguagcauccauaaaaccaucuccaguagcaaaguuaauaaauaugagugacagaauugaaguccugcuggcugucugccuuccugauaauuuccugcacccuucucucccugcccacuccuucuuucuuucuaucuuuacugaacuucaucuuucuugggcaucccccggccaggaaucugacauacagaucaaccaacagagcuuacuguccugugggaaggcaagcauucaaacaagacauuccaauggugaguguugaagguuaagagaagaaagcagggcacugggagaaguaaaggaaguggcugcuuggauaucagagccaaggccuugagacguguguguaaugggcaaugggauuaagcaugguagacagacagcucacgccauuggcuuggcauagaaugacaggacugggagauggaaacuauugguaugagacuggaaacugauguaaagcggaugaagugacgcagugggauuugcaucugugcaagcgugaggcccaaaaguucugguccagguacaagcaaucaucaacaccccaagauaugagcauaauucugugaugagguuuaacuaggccagaagcuggcugcauucucagcuucaugaggucagauccagggcagugacaagcagguaagguacacaguaugucagcagguggcagguaauguuggaaaagcuccuugugguuguucaaagcuuuucauucuuucuaccuaccucaucugcacaauuuuuauuuuuauaaaauuugguaaauaaugacugugggauugcauggcacauggaaguauaauaguguucccucguccaugaaggauacuuuccaggacuuacaguggaugcagaaaaccagaaguggugccaaacaauaccguguuuaucucugugcaucauggcccaaacuuuugaaguuuaaaauacguuagcaaaauuaacacaaguuucuuuuucauucuuccuaauuucacaguuacauucucaccauaaauccuauaacuccagcagguguuugcaauauguuuuuuuuuucuuuccuaaauugagaaguuucuuuagaaaggaaccaugcccguagcuucucucuggcauacacaauugucugcauuuccacucuuguaucuaagggcaugauuaauaaaacagggauuauuugaacacaaacacuaugauaccauaguguuuagagaugccugagguugcuauuuauaugcaauuaaguguggaacauauuucaugugccuacaugggcaagaaugauuguguccugugccggggucggaccaacugagacaacaugagauuucaucaggguccucagcacuacaagcaauuucaaacuuagguuuauuuggggaacuuuccaguucauauuuucagaccaugguuaacuucagaugagaggacagaugcacaccuaaaggguuuagagugacuugcuugggccuuuacaaggaaaccacacaugugugaaacuguucacaugaauuacauuuaagacaucuaauguuucucuuaugugcuauguucagcaagugguuuaggaauuacuauguguaugggacagcacagaagucucagacuaugugacuauaguuuuugguucagagaaaauucuaucccucuuaucuagcauugaaugaccagcuuuuaaaaauagguucaucagagcacuauuuaaaauguccaaguauaugucaucucagugcccaaacaggaugccuuugugacuaguaguauaugauuugcaaacucugauauuacuggacacaguuucuucccuucccaacuaagcuagagcuuaagcuguuuugggguaauggaaacaugcuugcauuuuuuacuacuaucccaggucuuagagauuucuaagcagcguuaucuuuuuaaguaugguaaaggaaggucuacaacuguccuaaaaccuuggcauggggaacuguaguguuauuaagugcugaauguaagcuuaugguuuugauucucuggauaaggaaauguuucauucaaucaauuuuuaucaaguacuaaauauauauccagggcuuucuaggcauaauaaaugcugcuauggauaaggcaaauaacacccccauaccugugcauauuauaguguagcaugaugugugggcaguauauuuuuagaaaucauuucagaagcauaaagcauaguaacucagucauuaacuauuacauuuucaaaauugcuguuuugaguccuagugaaaacacuucuuuaaaguguucaugugcuaauuuauaaagagaccacaacuuuugaaaauaauuaaguuauuuuuauuccuagauauaauaaaaugcaagaaggaaagaauccccuccaguccucagcaguguccccuuugcaugaaccccaggaucucuaaaggcagaucuauugcuaugguuccaucuggcucguuccuguguacaaagccaaccauugauccaucacugaagucaaaaagccuggguauucaggaggacaauggaucugccuccgucucaccucaagauuucauagaaccuuuuggcuccuugucuuugaacaugacagaccugucuggaaauaaggccaaugugaucuguaguauccaaaagccuucuaggacauuaccaauugcauucacugaagaaaaugacuacaucaugcuaaauaugucauuuucaacaaaucuugugugcagugucaauuauaaucacauccagccaguguggcaacuccuggcuuuguacagugacucuccucugauauuagaaaggaagccccagcauacugagacuccacugcugucucccaaauaucaacagguggcucuuaggccugaagacacuuuuaccaacauagaggcugauuucaaagcagauccuuuuugguuccaacaagaaaaaauuucccugcagcucaacagaacugcuaccacacuuagcacauuacagauccaauuuuccacggaugcucaaaucacuuuaccaaaggcagagaugagaccggugaaacgcaaauggaccaugauucugaugaugaacaauaccagacuggaacauacuguuuugguuggcggcacuauugcccuggacuguccgggcaaaggugacccuucaccucacuuggaauggguuuuagcugaugggaguaaagugagagccccuuauguuagugaggaugggcgaauccuaauagacaaaaaggggaaguuggaacuccagauggcugauaccuuugaugcaggucuuuaccauugcauaagcaccaaugaugcugaugcagauauucucacauacaggauaacugugguagagcccuauguagaaaacaagcaugaaaauggagcucugcacacaguaauuaugggugagauacucgaucuuccaugccuuuccacugguauuccagaugcuucuauuagcuggauucuuccccggaacacuguguucucucagucaucaagagacaugcaaauucuuaacaaugggaccuuaagaauauuacaggcuacaccaaaagaucaaggccauuaccgauguguagcagccaacccaucaggggcugauuuuuccaguuuucaaguuucaguccaaaugaaaggucaaaggacaauugagcaugacagggacauagauggaucuggacuugaagaacccaagcccaguguucuccuuaagcagccaccaucuuugaaacucccugcaucaucuuugacagggacagaggcuggaaaacaagucucugggauacauaagaaaaacaaacauagagacuuaacacaucgacggcguggggauuccacucuccggagauucagggaacacaggaggcagcucccucucucugcucggagaauugacccccaacacugggcagcacuuuuagaaaaagcaaagaagaauucuguucuaaggaagcaagaaaauaccacaguaaagccaacgccacuggcuauuccacuuguggaacucgcuggggaggaaaaagacgccuccggccugacuccuccagaugaagaauucacgguucugaaaacuaaggcuuuuggugucccagaaaggucaccaacugcugacucuagaccaguaaaucauggcuuugugacaaguucagcuucuggcacagaagucuccuccaccgugaauccgcaaacacuacuacccacgcaccuuccugauuucaaauuauuuaauguuguggacagugcagcugugucaaagaguaugaaccgaccuguaacaagcaagauagaagauacaacacaucaaaacccaaucauuaucuuuccaucaguagcugaaauucaagauucugcucagguggggagaacgucuucccaaagugcacaccccgcaacagggggagccauggcuaccuauggcuauaccaccaugcuuaguagcuucaccaacaaagccaauacaguccugcagucagcaaauccaacagaaaguuauggaccucagauaccuuuaacagaaguaaguagaguuagcaguaauaacuccuuggcucacacuacuaaagauccaggcuucuccaagcgcccuucagauucccacaccacugccccuucuuuauuucaaacuccuagaaacaacaguacagguaacgugggaagagagaggacaauuuggagcagagggcgagcuauaaguccauauagaacuccaguucuccgucggcauagacacaggauugugaggccagcacucaagggaccugcuaacagaaauauaagucaaguuucagccacggagcccccugggaugugccgaaccuguucuuccacagaaaggcucaccauggcuacggcagcacugucaguuacaggcucaucccacacuacccuccccaaagcuaacaauguugggauuauuucagaagagucuaccacuguggucaagaagccaucuuuacuauugaagaacaaacaagauguagauauagagacaauaacaaccacuauaaacuauuucagaagugaaaguacccacaugacucccacugaagcaagcaugauuucugcuccaacauccauaucccugggaaaaacuccuauagacacuaguggucaccugagcaugccuaggaccauccaagcuggaacagauuuaguggugacaccaccacuuuccaguccacuuagccaacccucaauaccaacaaaagcaacaagcacaaaacucucaagaagaaaaauucccuggcacccaaucuuugcaaauaaccauaacaaagaggggaugcuaaagaaucugcaucaguuugguuuacaaaagaacacagccacuaagccuccugaaaaagcuccucuuuuacccacagaucaugguuccuccucaccuucuacaacacucuuggcaagucugacgccagcucagucugcaacaauggcugccacucggcgcaauggcacugaagugcaaggugccagaagucucucugcagggaaagagcagcccuucaucaacuccuuccuagugcuuccuagcaccacaagaaagagaucuaguacauuaagcuuccugucaguggaaacccccacagugacaacuccuccuguuauugcaucugccauuaucucugaaacccaagaaguacgauccaaaaaagcaaaagaccaaacaaaggggucucugaagaacaggaaaggcccaaccaucacccccaggcagauuucuggcuauagcacauacucaguuccaacaacaacugauacucccuuggcuuucagucauuccccgggaaaagucacugguaggacuguaaguacagcugcuccucacucagcagcuucucuccugggcauaacugaacugccccagaaaugcacucauacuucgggaaauauaacagcuucggaaacaacucuguugagcaaaucacaggagagcaccgcaaugaaaagagccuccgccacaccaccacuccucagcaguggggcaccccgaaugccuacuccuuccccuccucccuucacuaagguugugguuacagacagugaggucccagcaguuuucaagaugaugucaaauaggauggucaccauauaugaaucuucaaggcacgauauagaucugcagcaacccucagcagaggcuagccccaauccugagaucuuaacuggauccacugacuuuccccucucuagucuguugaccuccacuccuaugccagcaccaagaguggauaaaccacaggauucucaauggaagccuucucccuggccagaaaacaaauuucagcucaggucauacucagaaaccauugaaaagggcaaaaggccagaaauaagccugucaccccaccucagcuuuccagaggccagcacucaugccuugcauuggaaugcacagaggcaugcagaaaagagugucuuugauaagaaaccugcucaaaacccaacuuccaaacaccugcccuaugacucucugccuaagacuauauugaagaaaccaagaauaauuggaggaaaggcugcaagcuuuacuguuccaacuaauucagauguccuucuuccuugcgaggcuguuggagacccaaagcccaccauccacuggaccagagucucaucagguacuuggaaccauuagcuauaccuuaguuacaaaacagggacacgaucagaucuuucaggauaguaaucaaagaaccaacacuaguuuuaaauuucuucaaaauauaaaagcuagauuugacuuuuuaaguguguguguguguguguguguguguguguguguguguguguguguguacgcacuaagagguaccagauuuccuggagcuggaacuacuucucuagccccuaccagaagguuuuaaacuuuauauuuauguuauguguaugcauguuuggccagcauauguguauaugcacacgugugccugaaguaaacacaggucagaacagguuaucauacuuccuggaauuugaacuacagauaauugugagccagcaugugugcacugggaacugaaucuagguucucugcaacaacaacuaguguucucaccugcugagccaucucucuaccccuacuagaagcguuucuuuuuuauaauguguuaagaaugguuugggaggcagcuagauggcucuguguguaaagggcacauauugccaagcguuucuuuuuuauaauguguuaagaaugguuugggaggcagcuagauggcucuguguguaaagggcacauauugccaagcuugaugacgucagcuuagucucuggaacagacauggcagagagaaccaacucccucagauuguuuucuuaucacuacccacuggcaauggcaugcaugugcccauacauauacacacaaaucauuaaaacguauugauaagggaaguuuaagagaguaauuauuaaggcuagauaggauaguacaugccuauacugccagcaacggggaugaauucaaugccagccuaggcuauaaaauuagauucugucuuaaaacauuuuaaaacaacauuuaggaccaauuauuucucugauauuaaauugucugcacuaaaaccauauacauauagguuuauacauuguauaggcugagcagaucauguuuauauauauauaucaauaauuaaagaaaaagaggccauaaauuugaaagagcaagaggagauaaaugaagaaauuggagggaggagaaagggugaaaugaccuauucaaaaaugaaaacauuaaaauaaaugaauaaaaauaagaggagauaaaugaagaaauuggagggaggagaaagggugaaaugaccuauucaaaaauaaaaacauuaaaauaaaugaauaaaaauguuaaggccaaaauacuuugaaaauugaucauauauauauagguauauauauaauuuuacauaaauaucauguugaacuaucuggauuuuaaauuuaaguuuaugugaauaaaaaauugaaaaacagcuuuaaccaccugaagacuaugcuuuucaauuucauuguauuuuuugucaguucaacaaugaucaugaauucuauaauuuuuuuuucauuuuaucaggacgugaaauaucccgagggauacagaaaacccgguuucaugugcuucccaauggcaccuuguccauccagagggucagcauucaggaccguggacaguaccugugcgcugccucuaauccacuagguguagaccaccuucaugucacucugucuguggucuccuacccugcuaggauucuggagagucaugucaaggagaucacagcucauuccggaaguacugugaaacuuaaguguagaguagaagguaugccaagaccuacaauuuccuggauacucgcaaaccaaacaguggucucggaaacacccgagggaagccggaaggucugggugacacccgauggaacguugaucauccauaauuugagucuuuaugaccgugguuuuuacaaguguguagccaacaacccaucuggccaggauucacuguugguuaagauacaagucaucacagcucccccuguuauuauagagcaaaagagacaagccaucguuggcguuuuaggugaaaguuugaaacugcccugcacugcaaagggaacuccccagcccaguguucauuggguccucuaugaugggacugaacuaaaaccacugcaguugacucauuccagguuuuucuuguauccaaaugggacccuguauauaagaaacaucguuucuucagucaggggcacuuaugaaugcauugcuaccagcuccucgggcucagagagaaggguagugauucuaagaguagaagagcaagagacaguucccaggauagaaacugccucgcagaaauggacagaggugaauuugggugagaaauuacuacugaacugcucagcuacuggggauccgaaaccuacaauaaucuggaaguuaccauccaagguugucauugaccaguggcacagguaagccuuucuguuaaaauuaucuccuuugcuuacuugguguuaccuauacaaaccuuuuuuacugugcucuuucuaaaaauugauauucacuguacacucuucacuauauaguaaauccuguuucugaaaagcaaaaauuauagcuuguggacuauaaauuguguucuucaugacauugugcaaugcuuuuauaggaugcuagaaagagaugaagcugagugcuuuuccguuuacacuuguuuauuaaaauauacaugcaauagaaauuaaacauaguacauaugaauuuacauggacacuuggaaauugaagguuuuuuucccuaguauuacaguaaguugguacacaauauaaugaauaaauuuguaauuuuuaauuuaaaugucaauauuaauuuucagguuuuucaggaaucaaaauuaccuuaaauguuagacuguaguucacuaagauguaaaguuuuaaagugcuuagcuaaagagggugaacuuuagaauccacaugcuuacauauauuuucuccucuguauguguuucccaucuugacauucgguaucuucaauaguucacuuaucaacuuuguacuuauuuucacaacaccagcucgcucuagcucuuucucucaugcacgugcgcaugcacacacacacacacacacacacacacacacacacacacacacacacacacacacacacugucagaauugcugcagcuacucugacucuuuguggcucuauaggaauuauaggauugcuuuauuuaccucuuggaaggaagugauuggaauuuugaugggguuuucauugaaacaacagguuaauaauucuuuuggcuuugaguaagaacagugaaaacagaguuuuguuccaaccuaagaagacacacuuuuagcccuuuaguccagugugauauuuaugguagacuuuuucauauauaggguuuaauauuuugagauacguuccuucagcauagauuuguugacucauuauaaaaggacacuaagacucaaccaauugcuucuuuugcuucuauaaagauagucacauggcuuugucuuugauuguguuguauuaaguuuauugauuugaaauguuaagccaccccagcauuccugggguuaaccuuaauugaucauguucuaugaacauauugaaaugcugaacuaaguuuaccucuauuuuauugagaaaauuugcauuuguguucaucauggguauggguuuaauuuuuuuuuuauugcuguguuuuggcuuagaaugauggaaauggguugccuauucauacuuuaagaaauggaaguaacucuuuacauauucauauaaaccaucaguacagcuguaagauauuaagauuuuuauuagacagaagacauuucauuacugcuauaauguuuaauuacaguuucuauuucuugaucaguuuuagaaggccacaugcuuccagaaacuugcacaguacuucuaaaauucaugugauuuugccauauacuuuuucauaguaguuuuaaaauaaucuuuuguguuucuguagcaucaggguucucuagagaaacagaaccaguagcauaaauauguacuaaucaggaaugcaauuggcuuccacaacaaggucuggggaguccaauugcuguguucacacuggaaaugccgagagccaggagcuacacugucccugaagcugagugucaguaacuccagucuggcacuaaaggccuggucuucaguucaauuugacagaccaaggaggcugacuucugaugucagcaaaggcagcugcaacagaguaggucaguuuacuaacaagaaacaggggaagugggucaaagggcgucaauauucuugcuuuggaucuucuuaugucgcugcugcuagaagacacuguccacauuuaggaugugucuuuucaauucaauuaaucaauaaaaccucuccagucaugcucagauccuaaccuaaucuacacaaucuagaugauccucuuagguuugucuagagacuugcgucuuaagugauucuagauccugccaaguuacaauauuauuaacuauuguuaguaguacaauaauguuuccauuuugauuuaugugacugucaacuuuuuucuuuauuaaucuauguaaagguuuagagaugguauuuauucuccuuuuuuaaacucacagauuucauugcccuuuuguuuuuuugggguuuuguuuaguuuuuaguuuuuuauuauguuacuuuuccuuuaauuuuuuuguuuguuucccuaaguccuugaggauccuguguuugaaaacuuuuuauuaagauugcauaucauguuauaaauuuuucucaauacugauuuuucuaucauacaguuuugauaguuuguugcaauuuuaauguucuuacaauucucuuuuaaguuucaauugccuucuguccacuuaguagcauguuauuuaauuuccacuuuacuauauggcuuuucauucuuaaugaauuucacuugucugaaaagaaauacaauaaaauuuaaauuuuuaaaaauuugacacuugacaugugaacucaccuagagaaaauuccaugugcugaugauaugacuguguguuacacugguugaaugaaguauccuuaaaaguguauuagaucaguuuucucuauagugugguccaacucagguuuuucuuaguuuuuccguauauauguguauguauauacauauauguauauguuuuucuauguauauauguauauuaaaaauuaaauauugacauaucuacuaucauugcauugaacuuaauuccuuagaucuaauauuauaucuaauaauauuauauauuauauauccaggugguaccauaucaagugcauauauuuauaccuguuauaucaccuuuguccuagcuuauucuuggugcugugacaaacacuaugaccaaagacaauucaggggaagagagggcuuauuucagcuuacagguuauaguccaacauugagagaacucacaguuggaacucaaggcagacucaaggcaggaacuugaagaaggagcaugaagacaugcugcuugcuugcuuacugaaucauguucugcuagauuucuuacacaggucagaccaaaauguuuagggauggugucaacuagggagggcugguaucccuuugucaaucaacacaauccugcacagacauauucacaggccaguguaguaugcaaaaacccaccaauugagacucucaguuaauuuuaggccuugccaaguugacagcugaaggaaagacagucuugucaaacugauguuuugucucuuuuugaaguuuuuuuacuucaaagcuacuugguaguucccagcccucuccgaagcagauaagccuuuucuuaugucacuauucuucaaguguugguuaauggaggauguuacauauuguaacgaugguggaucagauuugaggcuugucaccuuagguuuuuuuuuuuuaagguugccucuuuaccaguaucauuaauauuaaccaagaacuugaaucagaagcagggauuguuuugauaaagagucuguguucuuagaagccccucagguaauugugaugcacacuagaauuugagucugggucucaaacuuaauggcccauguaagcaacuugagaauuuuccuaagcacgaggucaaugucccugaccagcucuaucugaaucacuguuacgagaaaccaagcaaugugcguaagucuggucccauacaguguaacacaguuuaagggagggacugucaagaaccaacauuuagggcuuuaguccuuagugucugcuacacauaaccaucacgccagaacaccaaugccuagaccuaccccacaucacuucucaaacauucuugccuugaagccugagcuccaaguauucuguuuaccucauguugucaaaagaaagggggaaaaacacagguguguuugagcauguucuuaacacuaaagcuagggucugccaccugguggucaacugugucaauuacgcagcaggugauucaacuucuaauucauccuagaaugcuguccucugcagcaggcaauggacagauugcuucuaguuaaauaacuaaaaaguugcuucguuaacacauuuaaaaauuagcaucaggcauuaacucagcacauacccucgaguuguuuuucauuagcaggauaugcuauuuuuguggauccauuugauauauaaaaugucuuaagaacuggcuacuuccagcauccuucucaccagugagcuguuucuaaaaguuguauaaaaaagagcugauugaaggccauuucgaaaauaauacugucuccagcaaauuaugcuuuguuacaaagcuuuuuuaagcaaauggcuuagauaacaauaagugacuuuggucuucauuuuaacagcuuuaaaaaauaauccauaaagauaaugccauguuagagagagagagggaaggaaagaggaggagagggggaggaaaagggaaagggagagggagagaagaagaggaagaaggaaaggugacaaggugaugagcuugaucgugauaaucauuuucauuuuaucuaugugucacaauuuccuacuaaauuacuuacauguauguacaacugugccagucagcucuuaguaaggcuggagggaaguaacauccuauaaauaaggcugcuucuacauaguauaauauucuguaaaugugucuacauuggugacaauauuuagucuuuuuauguguuugugcaagguaugcucguucauuuuggugugugcaugugugguggccagaaguaaauaagcauuggggucuuacacaauugcuuccaccuuacucucaggagggccucucacugagccuagagcuguagguacuuucagguacaccagcugucgagcaagcuccgggggccagcuguguccauucuggggguauggaugugaccaccuugccuaacucuuugugggcgcuggagauccaaauucaggucugaaaauugugcacuaggcagcuucccaacugagucaucuccuaagccccaauucuccccgcugcauucucacgcuugucucuucucuccuuagaaugggcagccggauccaugucuacccaaauggcuccuugguuauuggaucggugacagaaaaggaugguggugacuacuuauguguggcaagaaacaaaaugggagaugaccugguccugaugcauguccgccuaagacugacaccugccaaaauugaacacaagcagcauuuuaagaagcaaguacuccaugggaaagauuuccaaguugacugcaaggcuucuggcuccccugugccugagguauccuggaguuugccugauggaacaguggugaacaauguagcacaagcugaugacaguggcuacaggaccaagagguacacccucuuccacaacggaaccuuguauuucaacaaaguugggauggcagaggaaggagauuauauuugcucugcucagaacaccuuagggaaagaugaaaugaaaguucaccuaacaguucuaacagccaucccacggauaaggcaaaacuacaggagcaauguaaggaucaaggcuggagacacagcuguccuggacugugaggucacuggggaacccaagccaaauguauuuugguugcugccuuccaacaaugucauuucauucuccaaugacagguucauauuucaugccaauggaacuuuguccaucaauaaagugaaaccgcuugacucugggaaguauguguguguagcucaaaauccuaguggggaugacacuaagacauacaaacuggauauugucucuaggccuccauuaaucaaugguuuguaugcaaacaaaacuguuauuaaagccacagccauucagcacuccaaaaaacacuuggacugcagagcagauggggucccaccaccccagaucacauggauuaugccagacaauauuuuccucacggcuccauacuacggaggcagaaucaccgugcaucaaaauggaaccuuggaaauucggaacauaaggcuuucugauucugcggauuucaccugugugguucggagcgaaggaggagagaguguguugguggugcaguuaaaaguacuggaaaugcugagaagaccaacauucagaaacccauucaaugaaaaaguaguugcccagguuggcaagccuguagcaaugaacugcucuguggaugggaacccaacaccugaaauuaucuggaucuuaccugauggcacacaauuugcuaaugggccacaaaauuccccauaucugauggcaagcaaugguucucucauuguuuacaaagcaacucggaacaagucaggaaaguaucgcuguacagcaagaaauaagguuggcuacaucgagaaacucauccuguuagaaauuggacagaagccagucauucugacauacgaaccggggaugauaaagagcgccgguggggaaucgcuaucccugcauugugugucugauggaaucccuaagccaaaugucaaauggacuacgccagguggccuuguaaucgacagaccucaagucgguggaaaauacauauugcaugaaaauggcacguuggucaucaaagaaacaacagcucaugacagaggaaauuauaucuguaaggcucaaaacagcguuggccaggcaguuauuaguguucccgugacgauuguggccuacccuccccgaauuauaaacuaccuucccaggagcaugcucaggaggacaggagaggcaaugcagcuccacuguguggccuugggaguccccaagccacaaaucaccugggagacgccgggauacucccugcucucaacggcgacagaaagaaggccccacagaagugagaugcuuccccuacaagguacgcuggucauucagaaucuacgagccucagauucuggcgucuauaaaugcagagcacagaacgugcuuggugccgauuaugcaacaacuuacauccagguccucugacaggaagggagaaacugaauggaacaaaagccaacaucugcagacuuuauuuuuuggaagaaguuuaaucaaaggcagccauaggcauguaaaugaauccgaauacauuuacaguauuaaauuuacaauggacaugcagugagacuuguaaauaaaugcacugugaacugauuccgaguuuccauggauuucaaagcaaacucuuaacuuaaggcacuuugauuuugccaacaaauaauaaaaaacauuaagagaaaaugauccgcuacaaauuaacaaauggcgaaugcaccugaauuuucaguaaaaagaccuuucuuccgcuaacaguugccagcugccuugugucuguuuuccaccaauguuacaaacaucgcacacagaaugaauggagacaacgugaaagauuagguuugcagcccguguuaaucucaaugcacaaauauuuugucacugguuuacaaacauuuugauaaaaccuacagaaaacaagcgcagaacuguucugauuaugauuaauaguuuaccauuuguucacacugaaaguucccauuguuuuaauaccugcguuaaaaaugaaaccaaacaagacaaaacaaaugcaggcuagcuuuucuacauguacagggcagccuaaugcucacacauugggaagugcaaagcggguuucacauuuguccacaccugucauccugaaaugcucuacagguacagugacacuuccuuauaacuuuaaagccuugcucaggcacccaugguucagagccauucugaagacagacuuucuaaggcagaauuccuccacgagucuagacaacugcuucuauauaaucaaguuucacuguauuuaaaugguggguuuuauuuucauauuucaccguacuaacauuacauguuuaauuuaacccaaauauaugugggaguaucauaugauucaccucuuuuauucuaaagacugggauuuuucuagaauaauuucucuggcuucuguccaaauuucaucuacuuauaaauuuauuucaucuauuuauaaaggagccuuguaaauuaaaaaagcaaaagucauucaguuagcccagaucacuaagaccaagagcuuuguuagcacaugccauucaucuggaacuugaugccuacuuuccguaaugccuacuuucuuuuggccccuaccucagacaugagcugacuccaguuaacauugguacucuauggcugccagaggucaaaugauacccaccguagaguagucucccucuacuuuuagaugaaaaaggguacauaaaacaagaaaugccacccucuaaagauucagcuuacaauauaacacagauguuaagggguucuuauagccagaaaugguaaguauacccaauuccauuagauuucaaggucuggucuuuaauuuccuaucugcaacccacccagcaaaugacaagguucugcaauagagcuuuuuccuuaggacaauuuuaaugccaaccacaugcauuugcuaugaaagaaaaaaaaaaaccucucagaaugcagaauuaaguggcaguaaauauaauaacuaaauuuaaaauuccaguugcuuuccuuguaacgcgcagggcaaagagcucuagguuuuuccucaucccccacggcaucucagaacuagagggcuuuagcaugauuuaccuuccucaucuuaacaaauaaaacaaacaacgacaaaggaauaaccauagccuucaugugcaaaaugauuaauaaauuaacuucugcaaaguuuaaagugcaaacaaaugcuaugcaguucuaacacucguucugcuguucacaauauugagcuacgaaaaggacaagguucagauugaagcuggaguuuuaaccaucaacaaucauugaauuaagaccagagaggacaggauauggcccacucacuaggcacaacauucacacuucggugguuuugcgaaugcaaucauauggucuauuacccggggcggggggagggaggaggauagcuucgugaauuuuaagaaugacucuggagaggaaagcaaagcggacauaugggaccacugaaauguacugcacugucugagagcagagagaaugugaacucggugggaagaauggucuuuaauguuuggcaaagucuuuuccagcccagaguaaacacaaaacaagcaggcuggagggguauauuucacaguguacacagcaguucacacgaugucgccauggcaaaguaagcaaacauggaucugaggucauuugaaugagucaaacucugcaauggguaacucaccuaggaagauauaaauuauuuauaauaacaaucugcgaaagaaaucaucugaagucguacuagcuacauuuuaaaaaaguaguucuacagggucugcucuucauagacaaucuauucacaguaugcuugacuacauuacaugugaaaucauauggcaaaaagaaagugaacccaacaaaggacagggaaagaucccuacaugucuuaaaaugcccugcaauuuucacauucaaaauuguaugcaucuaauucuaaaaaaauauuauacggaauacucuuaaguuacacaaacugauaauaauuuacuguauuuuuucacucuaauaggagcaaauuaccacauacuugaacaaaguuaaaauaguuacuauuucuuuauaauaaauuuugauguauaauuuacuuuacuugugcuuuuugcaccgguuuauaaauacaguagaagcaauacacaaccaagacugacaccaacauuaauaauuaaauucaaaauuguaaauacuuaccauacaaaauuaacagcaaguauaccuuugaugacuaccagaacccucuggaaaccaugucaagucugagcacuguggaaucuaaggccagcugugagauuuuauuuuauuuuucucaaguuggcaugagguucugaagaaccuaaacuggacaguuauuuuuuuuuuuaaaccaaaacuggcaguaaguaaaauggaccgauuccaccgugguucuucuggccucccgugguuauagguuguaccuucaugaagaaucuggauaaagauuuugccacugggaacaaauuugagugcagcugcuucugagagacucccacaguccuccagguggcucuugcagaagcccugaagaagcggaaguacuaagcaacaauccguuucagcaccuuuggaccacaacaaaagcgaagccaaguccuucauaaaugcgaacgaaguuuauaaagugcuuaugaaaaugaucaacauuucaaauuaaagugaugcaaaaaaaaaaaaaauguucaccccaccgccacggucgagugaagagcuaauguguccacucccgcgagaccu

SEQ ID NO: 1442 - RNA, 5158 nt, Mus musculus
ggacuauaaauuguguucuucaugacauugugcaaugcuuuuauaggaugcuagaaagagaugaagcugagugcuuuuccguuuacacuuguuuauuaaaauauacaugcaauagaaauuaaacauaguacauaugaauuuacauggacacuuggaaauugaagguuuuuuucccuaguauuacaguaaguugguacacaauauaaugaauaaauuuguaauuuuuaauuuaaaugucaauauuaauuuucagguuuuucaggaaucaaaauuaccuuaaauguuagacuguaguucacuaagauguaaaguuuuaaagugcuuagcuaaagagggugaacuuuagaauccacaugcuuacauauauuuucuccucuguauguguuucccaucuugacauucgguaucuucaauaguucacuuaucaacuuuguacuuauuuucacaacaccagcucgcucuagcucuuucucucaugcacgugcgcaugcacacacacacacacacacacacacacacacacacacacacacacacacacacacacacugucagaauugcugcagcuacucugacucuuuguggcucuauaggaauuauaggauugcuuuauuuaccucuuggaaggaagugauuggaauuuugaugggguuuucauugaaacaacagguuaauaauucuuuuggcuuugaguaagaacagugaaaacagaguuuuguuccaaccuaagaagacacacuuuuagcccuuuaguccagugugauauuuaugguagacuuuuucauauauaggguuuaauauuuugagauacguuccuucagcauagauuuguugacucauuauaaaaggacacuaagacucaaccaauugcuucuuuugcuucuauaaagauagucacauggcuuugucuuugauuguguuguauuaaguuuauugauuugaaauguuaagccaccccagcauuccugggguuaaccuuaauugaucauguucuaugaacauauugaaaugcugaacuaaguuuaccucuauuuuauugagaaaauuugcauuuguguucaucauggguauggguuuaauuuuuuuuuuauugcuguguuuuggcuuagaaugauggaaauggguugccuauucauacuuuaagaaauggaaguaacucuuuacauauucauauaaaccaucaguacagcuguaagauauuaagauuuuuauuagacagaagacauuucauuacugcuauaauguuuaauuacaguuucuauuucuugaucaguuuuagaaggccacaugcuuccagaaacuugcacaguacuucuaaaauucaugugauuuugccauauacuuuuucauaguaguuuuaaaauaaucuuuuguguuucuguagcaucaggguucucuagagaaacagaaccaguagcauaaauauguacuaaucaggaaugcaauuggcuuccacaacaaggucuggggaguccaauugcuguguucacacuggaaaugccgagagccaggagcuacacugucccugaagcugagugucaguaacuccagucuggcacuaaaggccuggucuucaguucaauuugacagaccaaggaggcugacuucugaugucagcaaaggcagcugcaacagaguaggucaguuuacuaacaagaaacaggggaagugggucaaagggcgucaauauucuugcuuuggaucuucuuaugucgcugcugcuagaagacacuguccacauuuaggaugugucuuuucaauucaauuaaucaauaaaaccucuccagucaugcucagauccuaaccuaaucuacacaaucuagaugauccucuuagguuugucuagagacuugcgucuuaagugauucuagauccugccaaguuacaauauuauuaacuauuguuaguaguacaauaauguuuccauuuugauuuaugugacugucaacuuuuuucuuuauuaaucuauguaaagguuuagagaugguauuuauucuccuuuuuuaaacucacagauuucauugcccuuuuguuuuuuugggguuuuguuuaguuuuuaguuuuuuauuauguuacuuuuccuuuaauuuuuuuguuuguuucccuaaguccuugaggauccuguguuugaaaacuuuuuauuaagauugcauaucauguuauaaauuuuucucaauacugauuuuucuaucauacaguuuugauaguuuguugcaauuuuaauguucuuacaauucucuuuuaaguuucaauugccuucuguccacuuaguagcauguuauuuaauuuccacuuuacuauauggcuuuucauucuuaaugaauuucacuugucugaaaagaaauacaauaaaauuuaaauuuuuaaaaauuugacacuugacaugugaacucaccuagagaaaauuccaugugcugaugauaugacuguguguuacacugguugaaugaaguauccuuaaaaguguauuagaucaguuuucucuauagugugguccaacucagguuuuucuuaguuuuuccguauauauguguauguauauacauauauguauauguuuuucuauguauauauguauauuaaaaauuaaauauugacauaucuacuaucauugcauugaacuuaauuccuuagaucuaauauuauaucuaauaauauuauauauuauauauccaggugguaccauaucaagugcauauauuuauaccuguuauaucaccuuuguccuagcuuauucuuggugcugugacaaacacuaugaccaaagacaauucaggggaagagagggcuuauuucagcuuacagguuauaguccaacauugagagaacucacaguuggaacucaaggcagacucaaggcaggaacuugaagaaggagcaugaagacaugcugcuugcuugcuuacugaaucauguucugcuagauuucuuacacaggucagaccaaaauguuuagggauggugucaacuagggagggcugguaucccuuugucaaucaacacaauccugcacagacauauucacaggccaguguaguaugcaaaaacccaccaauugagacucucaguuaauuuuaggccuugccaaguugacagcugaaggaaagacagucuugucaaacugauguuuugucucuuuuugaaguuuuuuuacuucaaagcuacuugguaguucccagcccucuccgaagcagauaagccuuuucuuaugucacuauucuucaaguguugguuaauggaggauguuacauauuguaacgaugguggaucagauuugaggcuugucaccuuagguuuuuuuuuuuuaagguugccucuuuaccaguaucauuaauauuaaccaagaacuugaaucagaagcagggauuguuuugauaaagagucuguguucuuagaagccccucagguaauugugaugcacacuagaauuugagucugggucucaaacuuaauggcccauguaagcaacuugagaauuuuccuaagcacgaggucaaugucccugaccagcucuaucugaaucacuguuacgagaaaccaagcaaugugcguaagucuggucccauacaguguaacacaguuuaagggagggacugucaagaaccaacauuuagggcuuuaguccuuagugucugcuacacauaaccaucacgccagaacaccaaugccuagaccuaccccacaucacuucucaaacauucuugccuugaagccugagcuccaaguauucuguuuaccucauguugucaaaagaaagggggaaaaacacagguguguuugagcauguucuuaacacuaaagcuagggucugccaccugguggucaacugugucaauuacgcagcaggugauucaacuucuaauucauccuagaaugcuguccucugcagcaggcaauggacagauugcuucuaguuaaauaacuaaaaaguugcuucguuaacacauuuaaaaauuagcaucaggcauuaacucagcacauacccucgaguuguuuuucauuagcaggauaugcuauuuuuguggauccauuugauauauaaaaugucuuaagaacuggcuacuuccagcauccuucucaccagugagcuguuucuaaaaguuguauaaaaaagagcugauugaaggccauuucgaaaauaauacugucuccagcaaauuaugcuuuguuacaaagcuuuuuuaagcaaauggcuuagauaacaauaagugacuuuggucuucauuuuaacagcuuuaaaaaauaauccauaaagauaaugccauguuagagagagagagggaaggaaagaggaggagagggggaggaaaagggaaagggagagggagagaagaagaggaagaaggaaaggugacaaggugaugagcuugaucgugauaaucauuuucauuuuaucuaugugucacaauuuccuacuaaauuacuuacauguauguacaacugugccagucagcucuuaguaaggcuggagggaaguaacauccuauaaauaaggcugcuucuacauaguauaauauucuguaaaugugucuacauuggugacaauauuuagucuuuuuauguguuugugcaagguaugcucguucauuuuggugugugcaugugugguggccagaaguaaauaagcauuggggucuuacacaauugcuuccaccuuacucucaggagggccucucacugagccuagagcuguagguacuuucagguacaccagcugucgagcaagcuccgggggccagcuguguccauucuggggguauggaugugaccaccuugccuaacucuuugugggcgcuggagauccaaauucaggucugaaaauugugcacuaggcagcuucccaacugagucaucuccuaagccccaauucuccccgcugcauucucacgcuugucucuucucuccuuagaaugggcagccggauccaugucuacccaaauggcuccuugguuauuggaucggugacagaaaaggaugguggugacuacuuauguguggcaagaaacaaaaugggagaugaccugguccugaugcauguccgccuaagacugacaccugccaaaauugaacacaagcagcauuuuaagaagcaaguacuccaugggaaagauuuccaaguugacugcaaggcuucuggcuccccugugccugagguauc

SEQ ID NO: 1443 - RNA, 838 nt, Mus musculus
cauggaugugucugccuccgaguucuacaggucuggcaaguaugaccuggacuucaagucuccggaugaccccagcagguacaucacacucgaccagcuggcugaccuguacaaguccuucaucuagaacuaccuagugguguccaucgaggaccacuuugaccaggacgacuggggugccuggccgaaguucauggcuaguguagacauccagguggugggcgaugaccucacagugaccaacccuaagaagauugucaaggcaagaagucaugcaacugcauccugcucaaagugaaacagaucggcuucaugaccaagucucugcaggcguguaagcuugcccaguccaauggcuggggcgucauggugucccaccagucuggagagacugaagacacuuucaucaccguccuggugguagggcucugcacuaggcagaucaagacccaugccccuugcggaucugagagccuggccaaguacaaucagauccuuagaauugaggaagagcugggcaaaaaagccagauuugcuggcagguccuucaggaaccccccuggccaaguaaagcguggacuggagaucccuggagccaccagcugauuggcccuccauccuugaugucauccagguagcucaaguccggcccagugcgugccccucccacgucacugcucgcuuagacaucugcaccugaccaccagaaacccugcuggagacccagcuuuguaaucaugugauuagucugaaucauuguuucugucaccugucuucccagcuaguguagagcccuuggaacucuagggugcccaccauuaagaccugccgccccccc

SEQ ID NO: 1444 - RNA, 2219 nt, Mus musculus
uacaagaaaaaauguauuuguuaauauggcacauaaaauacauuaaucaguagauugucaagaagggcuugguuccauucuugggugggucuguuuaaucaugucuucagguaggaaacaauccauuuaguuuacaauuaaacacuuuuuuuuuauauauugcccacauuuuuuaugcauuuggaacccuagacuaagauuuacaaaaaauaaaauaauuacauuggucucugucuaaauuugaaagguaucuacuagaggaacaggcauuuuaagaaauaagauucacaauaaagccaaacuguaaaguuaucccucaacaaaugaacccucuuucuuuauaaagcuguguuuaauauucagcuugauucagaaucauuuucacuguagucucuauuauuuaaauguauguaaaugguaacuggagguuggagggagggcgcuuguucuuuccagcaaguguuagcagucaaguuggacugaugaugugugcugcguuaacuaagcaguuagaccagguucuuauguacauucucacaauaauguuaccagugaugccgguguauuagcauuuuucuaaguagugcaaaaaauaguauuuggauaaagcaaacaacaauaaaaacaaacagacaugaagggcagaaagcgacuugcccaugccgcuuaccacccucacucauucagagcuggcacccucugggaucagcagguuccuacacgcguugggcaaagcaaggcgcugugcagggccagggcgugcccaccugcaaaccgcugguugucuggagccugcaaacaccuugcgaguuccggggaggcuccggagaugucugucucagacugcucagcucaaagcuuuagacacaacgcugccagcguccagaagguuuucagcgugucagcaacuucacuuuacagagcuagcugguggaggaccgaggaaaccccuccagccauacgcuggccagaagccaccgcugcccuagagcaccuuuuguucugaccacugauucgagugguggcggccuugccaggcgugcaggggcaccgcgaucucugcuuccagaggccaccucccgcccugggcgcccagcccugagccggcggcccggagcuugcacggcggagacacgccccuugccuccccgcggagcacagacucgcccgggcuccuaggcuccgcccaccccgcugggagccuggcuuucucuccugcccccugcacucgagacccagccgagcgcggagacgagcugcagccuucauggacugugagcgggguacaggguagguaguacgccaggguccgaggccacgcgcucuccaaaagaccuccaagguugagcgcgggcucagaauguggccggaagaagagucgcggcgucccuggugaaggucccggguugcaagguagggaguaggcagauggccaggcaaaguugaucagagaggaggugguuggccugcgccuucgggccgcugggaacagccgaacuacuuggacuugacccgccgcgccccaggcgcucugagcagcgccuaucagucgcccugcgcgggagcgcacuugcaaacuugguggaggugcccugcgcguccuguuguguaaccuccgcgccgccagcuggaccgggaaguugcccgcacguccuucagcuuagaucggucgcagcuccgggcgaauuucauggcccgcgacaaaagcgcggccagagccggcgugggcgagccccugcgcgcuccgacccguggggaacucccgcgcgcggucccuggccugcgccuccgaugcgcgcugagucucucgccgcugcugcccgcucgccgcggucugcccuuucuaguagcugccugaguuggaaagaagaggaugaccgaggugccuuggucgguuguccccaacgggacggaugcugccuuucuggcgggccugggcucgcuuuggggaaacaguacugucgccucaacugcagcaguuuccucuucauuccaaugugcccugaccaagaccgguuuccaguucuacuaccugccggcugucuacauuuuaguguucaucauaggcuuccuaggcaacagcguggcuaucuggauguucguuuuccacaugaagccuuggagcggcaucuccguguacauguucaauuuggcucuggcugacuuuuuauacgugcucacccuaccagcccucaucuucuacuacuucaacaagacug

SEQ ID NO: 1445 - RNA, 1063 nt, Mus musculus
cauggcacugucgaugccccugaacgggcugaaggaggaggacgaagagccccucauccagcuuucgucaaggccagaagugauggcgaaagcaucggaaacugccccuuuucacagaggcucuucaugauccuuuggcucaaaggagucguguucagugucacaaccguugaccugaaaagaaaaccugcagauuugcagaacuuggcuccugaggcccacccgccauuuauaaccuucaacagcgaaaacggauguaaauacgauugaggaauuucuugaagaagucuugugcccacccaaguaccuaaagcuuucgccaaagcacccagagucgaacacugauggaauggacaucuuugcuaaauucucugcuuacaucaagaacuaagaccagaggcgaaugaaucgcuggagagggggcucuugaaaacgcugcagaaacuggaugaguaucucaacccuccccucccugacgaaaucgaugagaacaguauggaggacaucaaauuuuccacauaucgguuucuggacagcgaugagaugacauuagcagacugugaccugcugcccaagcuccacauugucaaggugguggccaaaaaauacugcaacuuugauauuccuaaaggaaugacaggcaucuggagguaccugacaaacgccuacagcagggacgaguucaccaacaccugucccagcgacaaggagguggaaaucgcguacagugaugucaccaagagacuuaccaaguagacagcacuuuugagagagauggcuuccgaucccccgagaauacgcuuuccuaacagacugcacugccccccuaaagcagaaguguauuuugcaugaacacacaguuacucuagacuaggauuaaggcuagacaaguaggccucuccaguacacacuccugagcaguauuauucuaaacuccucuacccagcccaccuacccuacccugcccugcccaucugcugcccuccaguuuggaggcacuucgccacaagcgugucacccaagaggcaguuugcugucacuuuggagccccgaccaucacguc

SEQ ID NO: 1446 - RNA, 31285 nt, Mus musculus
ggguuuguuaagacguuccguccuggacgcucgguacgcuggcguuauuccucccucgggguuagaaucgagggaauuaaugguuccuagcaaacguugcucgcggucgccgccaccggaacuuguucugauucgcuggcuccgucgggaggcacggaacccauuuuggcagggaaccacuucccgaagcgcgaggcaggaaguuauccuuuaccucuggugucuacugaggagggugcccgcugcagugucagcugguggacgggcaagagagcguucgaguccccgcugcaguuaagagccagacuccgucgcagcgccacggcacgcuccgccagccucaagccgggugcggcugcacggggagcucuugccggcucccugaagucgcuccugugggcagcgacccaggcuucgccugggccaccugccagggaucuggcucccugcugcaaaacagcgaccagucucuccgcguccgcccucccggcguugaaccaccgugacccggguccagagagacugccuuggaccugggacuagacugaucaaaacgccagccucaggcccccacacaccgggcucugcgucgucucugauaugucaccgaccaucucccacaaggacagcagucggcagcggcggucaggcauguuuagccacgcucuggauaugaagaguggcccgcugccaccgggcggcugggaugacagucgccgagacucggugggcggggagggggaccgggaaguucuucuaggugaugccggcccuggugacuuaccuaaagccccgcggagcuauagauccgaacuaaguagcauuuuguuacuacucuuucuuuacgugcuucagggcauucccuuaggccuggcggggagcaucccccucauuuugcaaagcaaaaauguuagcuauacagaucaggcuuucuucaguuuugucuucuggccauucagucuuaaguugcucugggcucccuugguugaugccgucuacuuuaagaacuuuggucgucgcaaguccuggcuugucccuacucaguauacacuaggaaucuucaugauauauuuauccacucaaguggaccguuugcucggaaauauugauggcagaacaccggauguaguugcucucacugugacauucuucuuguuugaauuccuggcugccacacaggacaucgcuguggaugguugggcauuaacuauguuaucccgggaaaacgugggcuaugcuucgacaugcaauucugugggccaaacagcuggcuacuuuuugggcaauguuuuauuuuuggcucuugaaucugcugacuuuuguaacaaauacuugcgguuucagccucaacccaggggaaucguuacccuuucagguaguguacuuaaaacuauuauacuguuagguuuauuuuaugcuuaugaaugcuuuugaugaaacaucagaugggagcucucauuuguuugcauacauuuuuuacuuuuaaugaugcacaagauauuuuacuucauuucccuuucaaauuaacacaauauuggauuccauuaugagauuuucauacuuugcucacaaucacuuccauaacacagccuuguucucuacaucuaccuccuagucgucuuccuuuaaacaguucacacacacauuuuucuuuuccuuccagauucuuucuagaagagaaaccauuugauguuuguccuucugcuugcuuuugaauuuuuucugaauucuguuuacaggauuuuuaaaaggcucuauauauccagcuugagacacaguccugcuucacccucccgagugcuaauauuacaagcaugugccacuacagcuggcuuuuuaaauuuuacugggaacuuauaugauagauaccuaaguauguuuucuguuuuauuaaagugugcuucuuucaaguauuccuuaugucagccuauuaacacagucauauugaucaguacucuuuagugaauaggaaaaaagcaaccgauagaaucacaaaauuucugaauuaaagauccauggacauuugccugacacagaaguauacauuuuaaaaugugggucauaugguucacauuuuuucuuuuguguuuuggugaauguuuucuugcuuuucaaucuuuuuccaccuuuauuucacaaguaguccccauuuacccaucuacugaaugggaagaguauuuaauauaagcauucuggaauuggcuaaguggcaggauucugaggaccuacugcaaauaaagacugucugugcaaacuaggaacaguagagaugaacauugcugaggcccagaauagccggccagugaccaugguagagauaacaguugacuuuauuauuaguuaaaccuuuauguaagcuggugugauuuuuuuuucuuuuuauuuauuuauuuuugguauaacuggaauuugaacuuuguucuccagaagauucuaaaauagcuuacuuuaauuaauuucuauccauaguugacuuaugauuuagucuaaaacauuuuaaguuaaagaguuuuuaauuuuaaugcuuacacauaaccacauuacuaguuuugagguuucuguaauuugguaauaacauaacuauauucuguguauucuguuucuguuuguguguuccugguucugggaaaugaaccuaguacuucuacauaaaagggaagccaucuucuacugugcuaagucucaaucccauuauuaaccagugggacuuuuuccuuuuuuuccucucucagugcuaggaaucuauuauugaccuuugucuagccccuaguuuucaacaagagucuagacuggucuuagacuucuauucccuaaggacacauauaguuaauuauguacaccaccaugcccaguuuaacuaccuagugguucugaggaauuuaaagaauguggaaucauaaggaaauaucguugccuagguaguuaaagagaagauaaaaacaguaucuagaaaaucuguguauuggaaaccguaacuugaaacaaagaaaacagccaaggguuugaggaugguucugcugauaaaaggucuuguugcucuugcagacguuuuaaguuugguucccagcacucauaugguggcuuacauccuucuguaacuacaguuuuaggggauuuaguacccucuucuggccuccacagacaccaagaaugcagagugcauguacuuacauucaggcagaauacuaguacacaugaacauaaaccuuuuaaaaacauuguaauucuguaauuaauuauggauacuacagaaggaauauacugaggaaugguuuggacauuuaaaaagcagugcucuauagacagcaaauugagaacaggaagaugggaugagauaagaucuggaggaaacaaccuugguuauauugacugcuuuuuuauagcuucauaacaguucugaaccuuuucucucauuccauuuguuuuccaagaaccucuagaggcaaagacagacccuuaaacagcgaggaguaaguaaugaacaggacagaaggaugacagauguggcuuuuccuucucuauaaugagaagaauguugucaagaggcuauuuacagauagaugggccaggcagugguggugcacaccuuugauccuagcacgagggaggcagaggcaggcggauuucugaguuggaggccagccuggucuacagagugaguuccaggacagccagggcuacacagagaaacccuguuuagaaagaaagaaagagagagagagagaaagaaaaggaaagaaagaaaugaaggaagaaagaaagaaaaggaaggaaggaaagaaagagauagauggacuuggaguuagguauuuguaacuguuaauaugauauuuugucuauaguugguaagaaguuaguggaauccucaaggaaaaccuuaagauggaauuaucuuaauauaaggcuuuuuuuuaugggacaaauauaacauugugauucccaaguuaucugaaagcaucacccacuuuuagaaugccugauucuuaguaaugauagguuaaaguuuuaauuuuuuaacugacuuaggcugagccaccaugucaguucuguacgcuuaauugcugagcuaccuuuccagccccugugugacuuugaaauuuguuuuaaaaugaguaugcauauauaggagucgaucagagaaaaagaggguauauuucuuuggaaaaaaauguaauggauauaaauccuauaucuacugguaaagcacuauuuauaagauaagcauuuugaacagggaagaaagcagaccaauauuuccuuaauaauaaauuugucuuauaguacucauuaccuuuuuaugaaacaaaugcuuuuuagaauuuaagcaagcugaauugguucauuacuaaauagguaagucauaaguuguuuguauguuuuucuaauauuggcuauacuacauccuuuagcacucaugcgaggcuuaaaggauuacacugggagaaagcuccgcaccugaaaagggcuugcaccacaagcccaagaccugauuucaauugcuggaacccacaguggaaggagagagccuacucccccaaacaauaauaaacaaaauauuaccuuuccuucagucauacggggagaaguuaggugaccauugaugggugguaaagcuuuuuucuaauacuaggaguuaaaaauggaaaaguuuaugguuuaacuuuuuuuucuuuuuuuuuuuuuuuugguuuuucaagacaggguuucucuguagcccuggcuguccuggaacucacuuuguagaccaggcuggccucgaacucagaaauccaccagccucugccucccaagugcugggauuaaaggcaugcgccaccacgcccggcuaugguuuaacauuuuaagaguaagauuuaucuuagaaaauuuaaaacauggguuugguuuguuuugauuuugguuuuuaccuuaaaacucaacuuuuggguuugagagaugagucaaguuaagggcucaauacugcucuuguagaguacuaaaguuacggucuccguacccauguuggauuguccacaaacaccuguaauuccaucuucuggagaucuggugucugugguuggccuaggccccugcacacgcauacaaacacccacucacccuuacacauaauucaaaguaaacuuuaaaacauuuucaacuuuuagggaggcacuagagagcuaggucagcagcucgcuuguuuacuacucuuccagaggacacuaauuaacugucuuuauaacuccuguucugggaauccaacagccucauuugcucucuacagguaccugcgcacacauucuguacauucauaagacacacccacauacacauaaguaaaauugagcuuuuuagguaaguaauauucaacgugaauaauaugaacccuuuuaauuuguuccucucuuuugccuccaaagagaccagguagugagcauggugagucuuuuaauauauaagcaaauacagaaaguuagaacuuauccucaaauguuaguaacaaauguagauucagggaaaauuaaaaccagagacccacuccucagaaagaagguuguaaagacuuuuuuuuuuuuuuuuaacacaaagcaaaggaaagaagguacuggcugcucuuuuuaccaaguaguauguggaaaaugcuuugguauguaaggccccucuacacaguauacuguguacuuaaaaaauaauauauuucaaguauauucugaaauucacuuugguuuuaggggaugcugggaauugaauccagacguccuguuguuaaagggugccaugcaacugaggacuguacuacuagcauauaaauuuaccaaugaacgaauugugggaccucacugauuauaagaaguguccuauuuucacuuuuaguguguucauaggaacuauuuuuaguugacaaaauaaagaugaccauuuugcuccuagagaauuaaaaacacaaaaccugaaacuccugauuuugcuuacccuuuuggacacaauuguauaugucuuacauauacaauuugcacaugcauguuauuacauuuauuuuuuuccucuucauuguuuucacuguucccacugguaggaauguaaguagaaauuaguuaacucaacaaaagagguaauuucaguaugucuaaaaaaauucaaauuucuuuucaagcauccuaaauugucuugguuuugaaaguuuuauuucuuacuccuaucauagucuucaaaguuugucuuauguuuuuaauuuuuauuauuaacuuuuuuugacagguucucuccucuccuucucucccuuccacccucucacgcucucuuuuucucuguagcucugccugaccugcaguucacuguguagucugggcuggccucaaacucacagacuaccucccaagaacauggauuaaagguguacaucauguguggccaauacuuuuauauauuuaaguuucauguuuuuaaauuuucauuuagaguguguaugugugugugugugugugugugugugugagagagagagagagagagagagagagagagagagguaagcuuagacucauaggagguugcaaagaaauguucagaggagucugaugaaccuuucuucagcuuucacuugccagcaucauauguauaguauaauauuaaaauauugccuuaauauauugagucaagcaagauggcucagugccuaaggaugccugaggaccagaguuucaaucucuguguuccacaagauggaggaagaaagcuuucuuccacaaguaguucucugucugcuacacacauacauacauguaccugcacauaaaaaaguaaauaucaaaccagaaacugauguggauauaagcuauagacuuaauucagauaucacuaguuaaacauggauggguguauaugugauaguguguauguguguuuccgugcaguuuuacuccuuuguaacuaguaugacaaucauagcugacuguuuaguucaccuuaagauuacuuuguguugucaugcccuuuuuauucuuaaucugauauauuuccuuccucccucccucccuuccuuuuuuucuuucuuccuuucuuucauuagaggacagacugagugagauagucucacuuuguagcauagucuuccugggcauccuaaaaucauuacauaaccuggcugaacuuaaacuuguagugguccuccugccucagucuuccaaaugcugggcuuccgaguguucgcucugagcugggcuugcuuuugauuuauaacuguuacaugagagaagcguccagaugagauugugcaguauauucccuuuggaaaacggcccucuucagucagaaggagccaucauugcauccuagugguugcaggcauuagcaugauuuguuucuuguuagcuuuuaucuaguaauaugaauaugcuguauguguauaagucagggcacuugugccacaauaugcaugcgggucagaggacaacuuucaggaauuaguucucuacuuccacagugggaucuugggaugaaacucgggggaucagguuuguguagcaaacaccaucaccugcuggaccaccucucuguucucuguucuuuacaguaauaugaaauauuucauuuauuaaacaaguauuucaucauacauccaauggaggauucuauguacuuuccaguuuggggcuuuuccuaucugaaaacaagucuugauuccugugauaaaugcugagcuuuugcaaguccacuuucaguauugaaaggcccugcuaugguauuuucuagcacagaugggcauuuuguuuugauuggggcaaaauguuagucugugguccaguugagcccuacauucacaguccuccacuagccucucuagugcugggauuacagguguguaucaccauguggacugcuugugcguuuuauguuuguacuaaccccuaggaaauaacucauucucuuucuaugcucgguauucuugcuguuuuucauuuuaguugcuuucauaguuuuacagaauaauaugaauuauaaaggaauauuggaaccugacuuguguuucaauuuuugagacaagguuuuaugcagccauggauagucuggaaguugcuguguagaccaagcuagucucaaauuaagaaagacccaucugucucugccucucugucuuccacauguugggauuaaaggugugugcuaccaugccuguaagauuuuccuauaagauuuauguuggagaaugucaauagcguuaaguacuaaccucucuaaaaguacacuaugaacucuaaaugaaaaugcauaaaauaaauucauaaauguuuuagauugauauuuauuuguguguaugcaccucuaucugugugcccauggagagaucagaagacaacauuuuggagugccagagguaggacuccgguagucaggcucauaaagaaaguaccuuucccaaggcccucaaccuugaguuuuaaaugaguuguacugcuuuucuccugaauuuauagugaacacuaggguacuagccuuuguagaagagagagugagagagagagagagaguguguguguguguuucuguguuucuguguuucugagacagccuuuuucugcaugauacuggcaauacuagaacuugcucuguaguucaggcuggccuggaacucagagauccagccugccucugccucccgagugcugggaucaaaggcaugcgcaccaccauuuggcuggccuuuauacuuuuauucaucaguagugaauugcuacaugcuuuuaauuucugcauauacagguacauuaggcaaguuuuuauaggcacuucagaauauguagucaaaacucaugcuugugaaacugugacaugaacuuuguuaucuuggucuugcaucaguagacagucauguuauagagcugauggcauauauacauagugauuguuacacuaugcuauggaagagauguuaauaaacaggcaaaugguuaguguuuuuaauaguuacguuuguagcagugaauaagcccuucuuucugagcuguugacuuuucccucugcuguaugugugaggugcagagacucuucgaauccuggcucugugagugucccauugugacuauuuuccauuguucaugcuguucuuuuucccuuaaagcacaaggaagucugaaguaguuuuaccuaugcauauugcagaaucuuguuuaauuuauuaacaucuuccuguuggcaaugaaauaaaggaauuuaaauucuagaugguuucuuuccauuaaaauuguuaagauauacugagcaaauuguuuuuccuugcauuuuucccuagagaaaggaagcuccugaaauauaacuggagcuucuuuauuuuucauucaacucuuaacaagauuuuuaauuggacuuucuuuuuuuaauuggcagcccuuauaaaccaccaacaaaggcuuucuuaaugaaaauacugguauaagugaaacucucuaaaaaaauaaucauuuauuucauuuuaagauucauuuguauuauuuuuaaucguguauguggggguaggcgaguaucugcaugugaguacaagugucuuuggaggccagggacacacugggacuggaguuacaggucaccagguugugaguacugggaacacuuugagcacauguauuugggucugaaugaaggggaaugggcaacuccaaagccaguuucucagugagcucaaacagcaugugauaguuuaccaucuaauguaucuuacagaggggacauguguaaaaaugcugugcacacuuauauuauacgcuaugugcuuuguuauuguccguucuagcuguggugaagauccuucuagucauucuucucucccaccaauacaucuguuaaagcuccugcagugaaacaauacaauguacacugucaccagucauagauacugcaaggagguuaauauuaacaugcuaggauggguagaaauagaaaaugaaauaugugagcuggcaaaaagaguacuuaucaugcaguggguaaauacaaugcaagccuggccaucugaguucaguucauagaaccacaguagagacagacuucccaaaguugguuuuugaccucuacaugaacuugcgucugcacucucauacacacacucaagggacuggggggaaaucugauauaaauaauuaugugauugauuugggaaggaguauuuaguuuuauuuuuaaacagggcuacauauacccaaggcuggcuuuaaacucccugucuaguggugauccugcuggcuauaucuuccaagugcuagaauuauagguauguuccagcacacccugucuauuucucuuuuuugagacagggucuugcucugugauucugacugaccuugaauuaacuuuggagcucaggcuagccucaaacuugccucaguguccugagugcugggguuacaggugugcaccaccaugcuugguucaaucaugcauucuuaucaucugcauugucauaauuuagcacaagaaaugcuuggauauguaaguauaacuaaugaaccuuauggucuauaaaaacauuucuuuacccuaccuacuuuuuucucuguaaaaagugacaagauagucauacaaaauucaaucacaucuguaaccucaccccugacccaggauauguaucagucaguuuugagucucuaugcuuaacagagucaggacuguuucauucauuugcuaagccucaaaccuaaaguuuauagcauaaaauuaaaaaaaaaauguagguuaagaaaaguuguguuuuauuuagcaucaaugaaguuaauuuucaaaaauuaauuauaaacuaaaacacucuuaauuucagauuuucuauuuuucuggggaacuguauuuuuaauaacaacaacauuaguagcccuucugaaaaaagaaaacagagaagcgucaauaguaaaagaagagacccaagggaucacagacacuuacaagcugcuauucucaauuauaaaaaugccagcaguucuggccuuuugccuucugauucuaacgucaaagguaagagauguuuaaacaaauuuaucaucaugggauacuuucgaugucuuuccauaaguccucuucuaauaccauagaauuuaacaaugcaaagcaauauuuccugccuacuaaauauauuuuaaaagugaugauaucaaauaucacuucuaaguaaacuuugucuugaaaucuugaagacuuuugucaaugugaagcuacugucgugaauaguaaugguuggaaugagaaugaucaccaugaagcucucuacuguugcagggaacgagcccuuaauacuggguaugugagugugccuuacaaagaugaagaacuauauggggauuuauuuaaaaccuauugaauucaauuuuaaaauccugaaaggaaaucuaccagaagacaaaugagauuacuggugacuuauauuccucauuaagauuuguuugcuuagcuggguggugguagcacacaccuuuaaucccuuggguggcaguggcuggcagaucucuaugaguuugaggcuagccacauuuacagauaauuacagccagcaauuuccaggacagccagugcuacagagaaaaacacugucuugaaaaaaacaaacaaaaaacaagaagaaagaucaacaaguauauuuucucauaauaggcucuagccuauucccaacaccuauacuuuuacaguguuuucuuuugaaauccaucuaugugaacacucuacagcucugacaggccucaugguuuuuguuuuaauaagaucucuuauuaauaauggaaaaguaaaguuagaaggcagguucauggaagauaacaagucaugucaagucaugucauuuggaaaugaauguuuuggggcauguuucuuuguuuuguauuauuuuuuagauauguuuucacuaucuaaacuagacaaccccuugcuuguccagaacucaacauauagacuaagcuggccuugaacucagagagauguuauucuuuuugaaauuccuuuucucuguuauauuuaugcauguaucuguauauacauguuucauauauguuuauacauacaguuuaaaguggaauugaauuauacuguauauaacuuuauaguuauuuugucuuacuccaaacaauuccugcaucauuuaauauuuuuaaguguguuacauuaaguacuauuacauuaauaguaauaguauguaugcuugucuuuuugguuuugggguuuuuuguuguuguuggugguggugguuuguuuguuugauuuuuuuuauuucuuucuuuuuuuuuuuuuuuuuuuuugagacugagucuaauuuuguagcccuggcucacucugaagaccaggcuggccucaaacucucagaauucaccugccucugccucccaagugcuggguuuuuaaggagaugauaucauguagcucagggccugucuucaaacuuagaaaguaacugcugaugacagugaauauuuuuuaaaagauuuauuuauuuuuguguaugucugugcuuugcaugcaugcaugccuguguaccacagguaugcuacacuuguggaggcaagaagaggauguuggauccucuggagcugaagaugguugugaguugccauugggugcuagaacugaauucuggaagagaagccagggcucuuagcagucagccuuccuacaagcuuaauucugagcucuugagcucccuaccucaucucccaaguguuaguuaggacuguguuuucuucuugucuaauuuaugauguuaucuauaguggcugcuuguucaucucauuacuuuaaauuccauuuuguaaauauaccaguauuuauuuuucagaguuacuuagauuguugugguuuguuaugaauaguaguccuauaaauauucauggagaugauuuuuuuuggugaggagauaugcuuauuacugauggguaaauauugagaaauuaaauaauuagguaauaagaaugaggaauucauuuuuuaaaacauauuuuuauugauuauuagguauuucacaagauguaccaugaucacacucauuuuccaguccucccaggucugcccagcuacccuuaugaccuucccuccacaaagacuccacaaagagaagaaaggggguggggggauggagagggagggggaggaggaagaaaagaagaaagaaagaggaggaagaugugaagaagacacucugugucuguguguguguguguguguguguguguguguguguguguguguauacacacacauacacauauaaauauauuuuccuuuuuacaaauuuaaagacaaaacaugaauuugaauauucaaacagccaguaagaaaaugaaagaugcuccacuuccuuaaccaucuggcaaauguaaauuauaaauacaacauggugccacuacauacugaacagaaaugcaaaauuaaaguuacauguuuucaagaaugugaaacaaugaacucacacuguuguaaguaaggaaguugaaaccaaggacagaaagggaaaacuaguuuggcaugggaagggaaacaauccccuuacccuggacuguugaagcuguugacaguucagagcccagcacagcugggaggaguggugcaagccuuuaaucccaacccacauggaguuuguggccagauggucuacguagggaguuaugccucagccagguaggcauccugcuaggaaaacaaaaaacaaaaacaaaaaauaaauaaaacauccugcacaggaacugacccagaagccucucugaaaacuggcucucagaguaucaaacagggcugugcaugcugccaagggagagagguaaucacugaccuaccucuguguauauccugugaagcauaugaaccccaacagaaacuggacuggcaagauaucuacaauaguauaauaguggcacuuuucuuuagugaguaaccaacagauaaucucacuggacuugagguucacucaacaguaggaaauucaugugugaugcugaagaccuagauaacuaucugugaauggagagcucauacagagcugagaccugaguggaaaaccuauguguauguguguaucuguucauguggagaacacagggaccagaaagaggacaucagaucgcuuggaccugaugcaauagguugcugugaacugcauaauauggaugcuagaaaugaacucagguccucuggaagaacaguaagcacuuuuaguagcuaagccauccagccccuaaauugugugugugugugugugugugugugugugugugugugugugugcauuccagaauaaguggugcacaucacaagcuuuccuaaauaacuuaagugcauauuucuugauaacaaaacaucauuuaagaaaaaugguagcucacaguugguaguggaauacauuugugauugagaucagaaggaguucagggucauucucagcuuuauaguugaguuucuuggcagcauaaaacccugucucagaaaacaaacaaaacaaauucaauaugguucagugaauaauuaaaaccuuuuaaauuaagggaguugccaaacuaucauaguuagggcuuccauugcugugacaagauacccugacuacagcaacucuuauuaaagcacuuaauugagacuggcuuaaagguugagagguuuaguccuuuaucaucauggcauaaagcaugguacuugccaugagauaaggagccaagaguucuacgucuugauuagcaggaagcaagaagagaaacacugggccugccuugggcauuugaaaccucaaagccuaccuacuccccagugauacaauccuccaaaagggccaccuacuccuacaaggccacacccccuaacagugccaauccuuaagagccuauggggcguuuucauucaaaccaccacacuaaccauagcuuauaucuuaguuuuacccauuguucagaaaauggucuuucucauuuuaugcuuccugguuguuauacaauucaggauccucuucggcaugcuguagguuaaaguuugaccacaacuuugauguuuguuuauuuguuuguuucuaagaauacagaccuguuuagagggaggcaugguggcucacaugucuaaucuuaggaucuaggagguugaggcagaaggauugcuuugaguaccaugucuaugagaccauccuggauuacacaguuccagguuagccugugcuacaagagagacuuuguuuaaaaacaaauaagccaaauaaaaccaaaacccccaccaaacaaaagcuaaagaccagauuucucuagaaugaccuucuguuuacacuucaauuuagauuauguuauaugcaguuuauguguagauugguaggaguaucucagaaguaauauuuuauugucuucagggaaauguaugggauccacauaaugguguuaucccuauuguuuucuauacuugguuacuuuguuacgacuuugggaacuuacuguuuccuuuugcaaccaaggagauccuugagacugucuuaucucagacuucaccugcugcuuuuaucauccuuacucuuuauugguguuuuuaagaauuaaucuaaauuauacuuuuaguuuuucuaccuuuuuuucccuucaagcuaggguuucucuguguagcucugacuguccuggaacuggcucuguacagaccaggcuagccacaaacucacagagauuccgcugccuugccuccugaaugcuaguccuaaaaggcaugcacugucuucuaguauacuguuaacuucaaaucgauuucuaauuguuauauauacuuagaaauuuuuauucuaauuuauaaaaaaaaucaccaaaaacuauguggcaguaauucuuccuuugaaucaaauuauuuauaguuaagcagaacuaacaaauguacgcuacacaaagcagugaguaaaauguuaacuuguaguaguuugagcugguguugcuugguuugcuuuuauuuuguuuguucagggucucucuauauagcccagacuauccuagaagucacuauguagaccagccuggccucccucaaauuuacagagaaguaccugcuucugccuccuaaaugcugcaauuaaagguuucccacuucagccaacuggaguuuggugguggugguggugguggugguggugguggugguggugguggugauggugguguuuuuucauuuugucuuuuaguuguuguauauuuguauauuuguuuuggguuuuguuuguucguuuuucuucuuucagacagggucucacaguguagcccaggcuacucacuguauagaugaggauggccuagaacucacagcugcugccccuucuaaacacugggauuaaaggccuugguuuaauuuuuuucaaagugaaaauuuaguuguaauuaaaacuaucuacaguuguaccaauauugcauuuucuauuguuuucaguacauaauguuaguaaaccauaaugcaaaauauaccucuuauaacuuggcaucugugcgcuugugacugaugggccaaugauggaauugaaggucuguaggacugcacgugucugacaaggcagcucaugugugagaagcucagccacgucuguuuuauguugcagauuggcuucucagcagcugaugcugugacaggccugaagcugguggaagaaggggugccuaaagagcaccuggccuuacuagcugucccaauggucccucugcagauaauccugccacuccucaucagcaaguauacugcagguccccagccucugaacauauuuuacaaagccaugcccuacagguaacuacagaaccugcuaacuagcaaguugucuuuagaauagugcaugucaggguagauuguguaggcgaaacuggguaggcaugaacaucgucagugucauuuggguguacuuuuucucuuuuaagucuuuuagcacaucuuuuuguugggggggggcaguauuuuguuuuauuauugucauuuugaagcagugucucaguauguaguuuugguaguucuggaauuuacuguguagaccagguuggccucagagauucauuugccucugccuccugagucugagauugaagacaugugacaccaugccugggucuacccauuuuuaauacagguuauucuuuaaccuaaaguggaugucaacucaguguuucucucuuugcagauuauugcuuggauuagaauaugcucuacuuguuugguggacuccuaaaguagagcaucaaggaggauucccucuauauuacuauauuauagugcugcugaguuaugcauuacaucagguaagcggaggcaaagugcugagugaaaugaguaugugggcccuugggcacaaacguaaaggccagagcaggauguuggcugucuuacucuauugcucuucuucuugccuugaaacaggguuucucaguaaacuggaagcuugccauuuucacuaggcuggcgggcuagugagcucucuggugaucugucuguuucugcuccaaaagcuggaguuacaggcacucacucacucaugggugagguugugaacucaagucuccgugguaguagagcaagcuuucuuacauaccgagcugucuucuagucccugaagaaacauuuucacagcuacuuuaaugaaguugaagauuucccuaugaguuagacaauaaaguaauuugaugaugaaccugucaaaugucuuucaacuuugugaggguuagucaugaaaagggaguuuuaaguuuauuuauccacucauguuucuuuaaauuguucguuuauuacaaauuuauuauacuuaaaaauauuuuccaacuacguuuacucuugcaaacuaaguauaccuuggucuguucuuagauguagggggaagaacuuuuguuuaugucuguuuauuuugaacucacgacauagcuuacacuggccugaaacuagcgcucccauugauuuuccugccucgugucagucuuccaagugcugagcugauagauguaagcaacuguacguggcucggguuuagauucuuuuuuucauuuuauuucauuucuuuucuuacgauaagagagauggauacuggauuuaagguuguaaucuuugacuuagauguuguauuaaaaagcuuagugugagauuuuuuuggcaguauaugauaaacugccuuuucuuucugaguuacaagugcuuccaguccacaaaggaagggaucucuacucugcuuuaaccucacuucuguuucagaagaggguuuugauucuaaauauaagggacucaaguaaaugguacucaacuguaauauugcuaauauauauuagagagucacugcauuuuuuaauagaaccucaucuaaaucuuugaaaguaagauauaaacuucuuggcugaaaccucaacagucucaacaguuuuguuuauuuuuuuccccacacaguuaaauaauuuagaauccagguaugguaauaccauguauguagucccaacauuuuagagguggaggcaggaagaucuagaguucaagggcaguauuagcuggauugugaauuggaggcuagccuaggcuacaugagacugucucaaaaaacaaaacuaacaaaaacaaucaauaaaugagaauuccuuggucuaucauauguaaccagccauguguuuguaaaauuauuaaaggcagugugucaaauauauuuuccuuuauguuuuucacaaaguuaaugcuagguacacaauaaaaauuaaaaagcauuugguucguucacuguuucacuauugacccaggaaaagaaauguauggacuauauuauuauaguccaaaggcuuaucucuuuagcuuuugcuuuccuugaagaacuucucacguguagucagagacgcuuaggccuuaaggagaaaagcguucaaggccuugagacaugagggaugaugcaugacaucaugcaucguguauggcagcagugccaucacuuuugaugccgucacacuugccugaaagcagcuguccuaaguuuugggaaguaacuaagaaacuuuaacugagaagaucaggccaaagucauugcuauuugugggauuuauguauuaaaguuaccagaaagcuuuaccaugaaaggcacuuguugaguucuguggaauuugauguccuugaguuugaugugacuuugccccagcagugcagugagcugcucucucugccucugcauucacuuuguaauuccucuuuuauaaacacaucgcagagcacugcuaagacggauauuaucauggaaauaauuuauccuucuaauuaauuuuaccccuuuuuuguuauuuuugauucagugucccagaccaaccuuaaacaugaaauccuccugccucuuuuucccugguacuaggauuaaagauguuugucuccauucuugucucuuaauuuuuaucucucuaguuuguguuauaaauuuugaaaugauauucuucaauaucauuuaucacuauuuuuagaaauauaacuauauauauccauguuuuguuauauuuacaucuauaaugaagauauauaaauguauauauaaauauauauuuaggugcagaacacauaggaauuuugcuucuuacugugugcaccguucaaugccccuuaccucuuacuuucucuucagucuucuuugacuguauaugguagaauaaaucuguuaccuuuauccuaggaguacagugugugcacuucuaguauguuuuaucuuaauucuuuauuucuaguuucuccagcauauacuacauucaagagaagagcaguauuuuuuaaaaauucauccuuauaguaucauguucuuaaaguauugcuuauaguguauacucaaauguuuguugaauugaguucagaaaaaauuaugaaaauuuaauuuuuaugauuuugauguuccuaauuuaagcacaguuuuguaagccugaucauaaguucugaugucagaaaacagggcucucaaauuuaugcuuccugcuuggugccccccaccccugugcuuaauucugaauacucuuccuacaaaaaaagaaaaaugaaaagaagaaaagaaaaucuccuuccaacuuucuaauguucccuucuucuugcaggucacucuguacagcauguaugugucgauaauggcuuucaaugccaaggucagugauccucuuauugggggaacauacaugacccuuuuaaacacugugucuaaucugggaggaaacuggccuucuacaguggcucuuuggcuaguggauccccucacagugaaggaauguguaggagcuucaaaccagaauugucggacaccugaugcuaucgaaguaagugaguuuuaguuuuagauaaccaugaauaagcuuuaagauaugauuacugugucuaaaaaucacacauacucauaguuucucauauggaaauacauuauuuuagcucuaccauaauuaagaguaauuacaagguaguaucaguaagacuagcuucuuagcaaaggaagacauucucccauaccacgagucgcuccacugcauacaucuuguaaacauaauaaguaacuuuuagagugcuaagaaagggacuccacuggcuccuuaaacacagcagcuguagcuaaagcugagugcaaaaugauucauuggcaaaucacuguaaaguaaacuuacccuugggccagauaagcugaggcagaggcauguggcacucugugagccccaggccagccuagucuacauaagauuagccagacuagccagucuauacagugagacccuuucucagaaaaaccaaacaauuuuaccuacuucuauaguaaauucauugauaauuucuucacaguuucaaauaugaaaaaauccauuuugaaaaucacuauuauuuguaguaagugcucaaaauuguuuuuaauucaauaguaucauugaagaaauuaaguuuuaugaacauagacagugauauaugauuauaauccuagcacuugggaguuugaggcaggagaauugugaauaugaggccagucuguauuacagaaaagcgugagccacguacuaagaccuuguccaaaaauaaggaaauaagacuucaauuuaucuuaccauuuacaauaaaugaaguauugaaauauuuucucaaaauguacuugauuaaucucuuuaauuacaaaauagaaacauuaauuauugaauguuuccauauuuuaaaaaaaaucacagaauaugggcccugaauauagcucaguugguguaaugcucaccuagcacacacagagcucugggaugcacaccuacaaucaagcuuugugaugcaugccuauaaucccaucacuugagagguggaaggagagauucagaaguucacgguuauccuuagguacaucguuugaagcuagcuuaggccaucugagacccugucucuauaaagcaagcaauaagaaaaaaaaaaguuauagaauguuuguuauaauuuuguuuuuauagcuuugcaaaaaacuuggaggcucguguguuacagcucuggaugguuacuauguggaauccauuaucuguguucucauuggauuugguuggugguucuuucuugguccaaaauuuaaaaaguuacaggaugaaggaccauccucauggaagugcaaaaggaacaacugaugccaacauuacuggacauucuagaagguaacuguagcuuaguguuaccaagaaagcaaugauaaucaguguguaggaguguaaaauaccguuuuaggaaauuuuuaauuuaaaaugccaaauaguugaaaaguacagauguauuuguauguuugauuauauuuuccuuugccuuaucaauguauugaaaguuuacuuaaggcuaggaaacaacccuuuugguuuuauuacuugauuucuguuaauuuacugaccaaagcauauuuuaagcugcaguggaauagucauggguggucaccaugcugccaaguauuguuagugccugucauugagucguauuuaacauguugguacaauguaucaaguggagcaaagcuuaauaugcagguacucacuaacuagauuaaccuuauuggaaguuaauucucacuuugaauuguaaauuuguaaaaauguaugugaaauuugauugaaagaaaauguagacuacuaaaacauugaguuguuuuucugacuauaaccacauuguacaaaugaaucuguuaaaaauaacuauuuuaaauguacuuucugcuuuuguaagcaugaaagauuuauaaaaagauuauccaaacuauuuuuuuauaaaaugagagcuaugguuuuuaauuuauugauuucccuaucucucccucccuuugggggaagcuauuuugauuucuuguuaacucuugcccuagguuuacauaugauuuugucacaaauacaucaugacacacagacaacuaaugaggggaucaaguuugugguguguuugugauuaugacugaguuguaaaaauaaaaauuuaaugucauucuuacuguaguuuuuuuuaauuaccaugagaagaaaauguaaacuuauaauuaaauaaaauuuaaaugaguaacacuauaaaucucaaagcuguuuuuuuaaaaagagagauuuguguguguguuugccuuuaacaaauuaaaucacucugugggagauuauuucuuaauuuuuuuccuuaaucuuaacuaagcauuuuauuaguaaaaaauucuuauaauuacuuuaugccaaaucacgaacaauauuccuguuucuuaaaacacaggcuuucaucuguaaagaauaaggcucaguugagacuugcuagacugggagaauuagaagcaaguacaacagcaguuuccagcaugcuauauccucuacaugcuaucaaggcuuugagacagggcuuaacuguacagcucugacuuuccuggaacacucuguaaaccagacuggucucaaacucacacucaccuaacuuugugugcugagauuaaaagugcacaucacuaauccagacauuuuuuuaauaaaaugucucuaugaauuucaucaaaauguauggugaauauaugggcuauauaccaucuugucucaaaaggaaaacaaggaggugagcugggcacggugguauguuuuagucccagcacucaggaaggaaaggcaggcuuucggcauaguagaaccugugcugaaggagaggccugggaagcuggaugacucaggaaaugugagaaacugggcagauuguguaaaucacuagggaggugagguguugcuucugccaucacugugacacauuuccuggcaagaguccaagggaggagagaguuuuuugcuuugcuguuuugaaaaaauauuaguccaucacaguugggauacauggcaggaugucugagccuugcuuuaggaaccauaguuccuuguugagaagacagaagacaggaaggagaaaguucaugaugggucaguaccaggaacaggaaaacucucaggucuuagugacucauuuugaccagccacauuuuaccucuuaaagcuucuguggcaugcaaaauagcaccacaagcagggggccaacacaagaacagccuaaaagagauauuccagauucacacuacaauaggauucauaacaaaguaccaacacuggguagcuugagagaaauuuguuuacuuucauuccagaggcugaaaauccaagauuaauguauuggcagaaguuucuccugaggucuuuaguugagaguaguugagagucacucucccaaugugucuccacacagccuucuuccacuauaugcaguaauccugguuuuucuuccucuuggauugguucugaguggucaaggcuuauccuuauucucccuacccccuuaaacuuagcuucuuaaaagcccuauuucuaaaugcagugauaaugacgguuaggacuucaguuuuuuucagauuuugacaggacacucaacucagucccaaagaggauuuauuguauauaaacauuucaaaggaagauggcaccuggugccauggaggcaucuugauuuugcaaaucugaugaaauagaauuuugucuacuuucuagaaacaaauauuuuaaagcccaaaagccucccauagugccaaggaccagccugucuuggagagugguucugagagaagggguguuugagagaggcaaaacaaaugaccugaagucaaaauguggguccaagcugacagccuguguucugcuggagauaguuuucuggauugcccucuguguucugcuugugguuucucucucucucucucucucucucucucucucucucucucucucucucucuuucucucucucucucucucucucucucucuuucucucucuaaauguguguguguguguguguguguguguguauaaauauccagaaagcucucugcucaggcuuuuuugaaauucuaaaaacucucuuguuagcucaucucuuauaaaucaaaagcccagucuuuuauguauuaauucaauuauuauccauguucuuuuuuuauuacccccugagucaguauucuagguccccagccccuugauucuuagagacagcaaagaagaacagacauaaguuagcugagugggaccccucccgacccugcccugaaauugccaucaaacuaugccuggaccuaaauuagcucuaucccagacugaccuuacacuugugacuugcacaguccaccugccuuuguuaccauaaaauaaauuagcuaggugggauguggcccaguggauugaaccaccagacagaacugguaagguaguagcaaaguuuaggaccaugacaaaauuuauaauugagaacaguaggagaucaaacuagcucccaaccagauuuccuguccuggaguacgaggccaugauaccccauuaagaagaccaugacaacuggucagguagcauagaacuuaggguucuucaugcuaaugagguaucuagaagggagccaaguguuuaccuacugaacucucuuccugaauauuccuuccugcaaagagcauuuaaucucuguuucaccccgaguaagucuuauacaucuucaucugccaugaauaaagguacuuuggacaagcaaauccuguugucuuuaucaggaacugcuaggggacuggagugggguggggugggguggggggaagagauucucaacucuucauguuucucaguggcuucugggugcucaggaacaugagaaccuccucuauuccagcccccugcuuguuuucaccuggaagaucaugggcugggaccccuaucuuagacuacauuuugccuacccugagcagugugucagcaagugguucaacaccgcaguggcaagguggaaaugcagacccacaguggaauauugccuugcaaucaccauucccuaaaucucuuuaucucccacacuuaguauccuuuugacaaguuggcucacagugcagcugccucuguuccuuuagaucugugaaacuccuuauuuaauuuauauuacauccuuacauuuugcauaguugagaauguauguauuuucaaacucauguuuucagcauucuuucccacacccuuaaaggcugcccuaauggucacagcauucaaccauuuugcugagauauagacaugcccuugccuccuggacccaugcugucucugauuaucauggagucauuaauaucgaaagagaggacauuccucaaaggagaaaugugaaaauauguacacuguuauacaaacaagccuuuaacccacaguagcuauccacacuugagggggcccacacccuguuggcucuguuccagggccaggaaccaugucaugccaucacuuacacaugaccaagcaggacuuggcacccuaggauaaucuguuuucaacuaagaacgaagauuucuuuuccucucuuuggaagagguuagggcuucuauacagcugccaaauauaaccccagauucauauuuugggacucuuuaccuauuauccaaaguccaauauauguagguuuuuaucacucugacagauugguauggcucuuauugauuaccugcaggugagaguuggccguggugaaccaaugaaucugucccugcuacagaaauguuguguguacuuuuaggacuguguaaauauauaucuuuaaaacagauauuuuaaagcuggauauuaguguaugcaugaaagccagcacccaggaggcagagacaggaggacaagcagaaguuacaugaauaugacugucucuggggcuggggaaggaagagaaagccaguguuggugguggcacaugccuauaaucccagaacucaggaggcagaggcagguggauuucuggucuacguaaugauuucuaggauagcaagaacuacacagacaccugucucaauacccaccaaaacccccaaauuaauuuuaagccauuaacuuuagcuuuauccuacuugaaacggaacagacuauuaaaguauuauuuauuaucuaucuacuuuuuuaaaaagagaaguauugcccagacuguucuggaaugcucaaucuaaaaugguccuaaacuccaaacaauccucuggccucauucucccaagugcugggauuacaggcagaagccaccauaucugacuucauaaguuaguguaagacauucacauggguuuaauguuuuaaguuaauaucuuaguagugcguugagaguagagacaaaauucugaagucuuauguagaggugguacugaugcuaaggguccuguucuccaauugguacuugaucuaucaguaaagaagccaugggccaauugcugggcagaaggaauaggcaggccuucuggguucccaggaggcaggugacagaugcaagaagagaggagagacaguuuaccauguuucugagggagaaaaggugaccagccuuuugaggucuuggaguggccacaggcuggcuacuccuauagucagguggcugggaguguuuaccugggacuagauguaacugagcaacuaaaguugagaacagguggagagauacggagcuaagaguauugauaagggcacacuucuccaggugggagauaaguaacacccagcaauugugcgagaaaggcaaagugaaagagagcaauguguguugucuguguuuuuaaugcauggauucaagggaaccugggugggggcuggaagcacagcccauuccuggagcuuaggcagguagauuuagaaaaggaaaaggaaaaacagaguucagaaauugugaagaugaguuguaagggauuuguuaccucuaggaaacaagacaauggcuguaugagugugacuagggacuguuccuauacaaguguuuuucuaagccguugaaacugaguauugucuuaaauuucugagucagggaaauaagggcacaggguguacaggagaaaggggcaauuuggaggcuaaacuucuagaaacagaagaauaaagaauauaguguuuaugauuauuguugauuaauuuuuauuuuugugauuauuuauuguuuuaugcuuauaaguguuuugccucuauguauguauguauauguacuauguguaugccuggugcccaggaaggcuaaaagagguuauuugauccucuuggaauggaguuagaggagugagcugccauguuuguucugagaauugaacccugguccucuguaagagcagcaagugcucaaaaccccugagccaaauauccagccccaagaagguaguauauuucaauauuuuaucacuauaaaaauuaguugaucaacuucacuauuuugucuuuuuuuaaaauauuuuuuguuacguauuuuccucaauuacauuuccaaugcuaucccaaaagucccccauacccucccccccccacuucccuacccacccacucccccuuuuuggcccuggcguuccccuguacuggggcauauaaacuuugaguguccaaugggccucucuuuacagugguggccgacuaggccaucuuuugauacauaugcagcuagagucaagagcuccgggguacugguuaguucauaauguuguugcaccuacaggguugcagaucucuuuagcuccuuggauacuuucucuagcuccuccauugggggcccugugauccauccaauagcugacugugagcaucuacuuauguguuugcuaggccccggccuagucucacaagagacagcuauaucaggguccuuucagcaaaugcuugcuaguuuaugcaauggugucaucguuuggaggcuaauuaugggauggaucccuggauauggcagucucuagaugguccauccuuuugucucagcuccaaacuuugucucuguaacuccuuccaugggugauuguuuccaauucuaagaaggggcaaaguguccacacuuuggucuucguucuucuucaguuucauguguuuugcaaauuguaccuuauaucucgcuauacuaaguuucugggcuaauauccacuuaucagugaguacauaucauuugaguuauuuugugaucauguuaccucacucaggaugaugcccuccagguccauccauuugccuaggaauuucauaaauucauucuucuuaauaacugaguaguacuccauuguguaaauguaccacauuuuuuguauccauuccucuguugaggggcaucuggguucuuuccagcuucuggcuauuauaaauaaggcugcuaugaacauagugaagcauguguccuucuuaccaguugggacaucuucuagauauaugcccaggagagguauugugggauccuccgguaguacuauguccaauuuucugaggaaccgucagacugauuuccagagugguuguaaaagcuugcaauaccaccaacaaugaaggaguguuccucuuucuccacauccucgccagcaucugcugucaccugaauuuuucaucuuagccauucugacuggugugagauggaaucucaggguuguuuugauuugcauuucccugaugauuaaggauguugaacauuuuuucaguugcuucucagccauucgguauuccucaggugaggauucuuuguuuagcucugagccccauuuuuuaaugggguuauuugauuuucuggaguccacccucuugaguucuuuauauauauuggauauuagucuccuaucugauuuaagauagguaaagauccuuucccaaucuguugguggccuuuuugucuuauugacagugucuuuuguuuuggagaagcuuugcaguuucaugagguuccauuugucaaucucgaucuuacagcacaagccauugcuguucuauucaggaauuuuuccccugugcccauaucuucaaggcuuuuccccacuuucuccucuauaaguuucagugucucugguuuuauguggaguuccuugauccacuuagauuugaccuuaguacaaggagauaggaauggauugauucacauucuucuacaugauaacaaccaguugugccagcaccauuuguugaaaaugcugucuuucuuccacuggaugguuuuagcucccuugucgaagaucaagugaccauagguguguggguucauuucugggucuucgauucuauuccauuggucuacuugucugucacuauaccaguacuaugcaguuuuuaucacaauugcucuguaguaaagcuuuaggucaggcauggugauuucaccagagguucuuuuauccuugagaagaguuuuugcuauccuagguuuuuuguuauuccagaugaauuugcagauugcucuuucuaauucauugaagaauugaguuggaauuuugauggggauugcauugaaucuguagauugcuuuuggcaagauaaccauuuuuacaauguugauccucccaauccaugagcaugggagaucuuuccaucuucugagaucuucuuuaauuucuuucuucagagacuugaauuuuuuaucauacagaucuuugacuuccuuaguuagagucaugccaagauauuuuauauuauuugugacuauugagaaggguguuguuucccuaauuucuuucuugaccuguuuauucuuuucugcaaaaacuauuccacaaaauagaaguagaaggaacucuacccaacucauucuaugaagccacaauuacucugauaccuaaaccacagaaagauccaacaaagauagagaacuucagacuaauuucccuuaugaauaucaaugcaaaaauacucaauaaaacucucgcuaaccgaauucaagaucacauuaaagcaaucauccauccuuaccaaguagguuuuauaccagggaugcaaggaugguuuaauauauggaaauccaucaacguauccauuauauaaacaaacucacagacaaaaaccacaugaucaucucguuagauguggaaaaagcauucgacaagauccaacacccauucaugauaaaagucuuggaaagaucaggaauucaaggcccauaccuaaacaggauaaaagcaaucuacagcaaaacaguagccaacaucaaaguaaauggagagaagcuugaagcaaucccacuaaaaucagggacuagacaaggcugcccacuuucucccuaccuauucaacauaguacuugaaguccuagccagagcaauuagacaacaaaaggagaucaaggggauacaaauuggaaaagaugaagucaaaauaucacuuuuugcagaugauaugauaguauauauaaguggcccuaaaaauuccaccagagaacuccuaaaccugauaaacagcuucggugaaguagcuggauauaaaauuaacucaaacaagucaauggccuuucucuacacaaaguauuuugucuuauuuuuaaaaauguaaaaguuguuaguucuucauggccaguaucaaagcaguuuugcuaauugcuucucagucuagagcugcauaccagcccucugaugguucuuccuuuuaucuauauuccucuuugcaaguauguagauuuccaguaacguguaaucaaaaaaugaaaacuccuuuuuuuucccuuuaggacauauggugucuccugagugcugaaauuauucuccauuaucuaaaccaaauaccucaacaaauccuucccaucauaauucugccuacuaccugcagugagaggcucccagguugaaggagagcugugagcucaaguuaaacuaaagaacauauccuauccguacuucuuuaaaauuagcagugggagcuggagggaugggugggcagucaagagcacugacugcucuuccaggggacuuggguuccaucacaucuuccauauggugguucacaacccucugugaccccagucccaagagauguguugcucucuucugggcgcugcaugcacuugggugcacauccauacauguagaaaaagcaccaucguauauaaaaauaaacaaaucuauaaaag

SEQ ID NO: 1447 - RNA, 46473 nt, Mus musculus
cggggccgguuagaggaggucgggcggaagcuggaggcagggccugcgcgcgcuucuguguucugaggccgcuguuagguuccgggcugcucuuguucuucacgcuucugccggucccgguguugagccucuggcguccaggccuugccagcagucugcacccgcggcguugguccccgauggcccugugcaacggagauuccaaggucagucugugauuggcgucucugccgcccuccggcagcgugagcgagaccuggggguccguccgucucccucggccgggucaguggcgcucuacaugugucagcccggccugcggcgcggcuuuauugcauccgaggcgcuuuguuggcuuugcuagugaagcaucgaguuccagcggagaggcgaccuggcugugggccgcgauucuuggggacuucggggcccuucaaccgcagggcagggucggggccucgccugcggcgguccggccaggcgggccuguauucuuuccagccuagugcaggccuuucugacucuauugaccacagcuucuguuccugggcccaggugugcuucucacccucuucucccgccauccucggagggguagaguuaaagguucugcuccugcgcacucugucucguguauuacgugcuaguuuucggggacauuuucccgccuuuggggccuuuucuugggagccagguucuccacgggugcuggaaaaaguuaacugcguuagccaagacgcgagagcguugggccguugaugcccguuuguggcuuccaacucccagccuuagacaucguucuuaauugccuggucugaauugguccccuuucccuuccgaccuaaucgucuuugaccuggagagcuuucugaccuucacaaagucaguuuugucaucgagaaacugcgguguuggaauauaauuuacuuuagcaagguguacaucacgcuugugcaugcuugugaccuagcuuuagcaaucugguuaaauuucucuucggguguaugaaacuccaaacuuuuggauagcuguucuagagccaggaauaauuucugcccuugcaaacauggagcuuaagugucacaaacucgcgaauggcugcuuaauauguaggaaucauucaaaaaccuguguugaacaaaugaauaaacauuauuagguagcuccuauauuuucaaaccuaggcaccugucauggucugaagaauaagucucaccuuacaguuuuguacauuugucuuuaauuuuuaaucuuacaacucacuggaacucaucuuuaugguggaugaguucgcugcgguuuuauagaaccuacugcgaucuagaagaauauuuucacaaaauuauuucaguauuuuuucaacauuuuuuaauuauuauuuugcuuuuuuuuuuccgauacaggguuucuuuguguagcccuggcuguccuggaacucacucuguagaccaggcugaccccgaacucagaaaaccgccugccacugccucccaagugcugggauuaaaggcgugugccaccacugcccggcucaauauuuucuuaagaugauauuuuugaucauugugauuuauuugaguuuaaggugaauagcuaaauuuuaugucaaggucaugugguagaguggccaacucacagcugucuguaauuccagcucagaugauccaacauccucacuuggucccuguagacacugcaugcaaauggugcagacaaacauauaggcacaacacuguuauaaggaauuuaaaaauaaaaugcaaaaaaacuuaauaaaaguaauaaaguaauucuuaagcuggccuauuaggauuaaccaucacagaugcuauuccagcaccgucagugagaagacauacaucaguguaaggcuagccuccuccacacacacacacacacacacacacacacacacacguacauuuaugguguuauucuugcaagugugucuguguaccacauguucgugcccguguggucauggaggccagaaaaugacauaagaucccuugggacuggaauuacagacaguugugagcugccauguggguucaaagaauugaaccuggauccucaggaagagcaggcagugcagugcucauaaccccagagccauuaacccagcccuuguuuuuaaaacuuuuagaaauucuguaccaauauuuuauauaaaugaguguucuguuuggcuuuuuguuauuuggaaagauaaauagaaagcaguuaagaaaaugccucccagguggacgguaggcaagucuguaggucauuuuuuucuuuuuucuuuuuuaaacguggauaggauggguuaccuuguaggaggugccagcccugggccgguggaccugggcuguaaaguacuauaccacuacacuauauaaugauuauguuacuaugacuuaacaguuagcuauagccaugagaaugauaauuaaaaggcacaggaguaaagaacuuaaaacuguauuauuuuucuuuguucagaaauuugugcgccaccugucauugucuagccccauuuuauguugucucaucugaugcuaguaagcucuugauuuucucauaaugguggcaaaauugaaacaagaccacuaaagggcuucuuacuuugcaggcaggcagucuaacugaccuacaucuucuucuguguuucucccauuucucuuccucccuucuagucccuucucuggauccucuccccagucccaggucuugcagaaaccaugauaagagcccagaccaaaauagugcacuggauuuaucauccaacuucaguugcuuuugggacaugggaaauuuuguuucauucauucccacucuucuacuuuugcauuauuguccaauacauaucucuuagcccuuuuguccuaguucccuuauuuucuauaauaaggcauuuugaccacaggcaacuugguaaggaaagggguugguuugguuuacacacuuggacacaguuuaucauugaggaaagucaagacuuaacaugugcgaaaugaugcuuugcaggcuggcuuucuugcuucuuuccaaacuuacaauuggcuagcuuucuuuaauaucccaggacucuuugccuaguuaugauagucuuucuuugggccaggccauucuguagaauuuagcccucagaaaaugcccccccccccagcucaaacagauauagguaguuaagguuuucuuucccagacccucucaacuccuccuccccccgugacucuagguuauguuaaauuggcuguaaaaaauaaauaacaccucuagguuuugcuaaauuacuuucuagagguguuagaaauuuauacuuagcaggcaaguuugaaaguuuaaaauuaagaauaaaaguuaguguucuagguuagauguguguauucuguuuuuuucucagguaaacaguaagaaaauucuaaaguaagagauuuuaaaguggaaguggccauacuacauucuagcagcaggcuuuaaugaccucauugauguuuuuaggaaugcugugccuaauggggugauccuaucacuuucuguccagaggaggcacagauaguaugagugcuggcauaacagccagcagucagaccugcuaacagagcaggguuguuuuccuucgugagggugugcauaaagcucaguaggagugaccacaucagucagaaauggcaccuuggacucacagguucauguguccacgaaaggguguaucuaacaucuuacacuuaaaagaacuucugaauccauaccuuagaaauacaacauaaguuaacaguuuacauuucugucugguggagcugacagugaccccauuuuuuaaaacaguguaauuaaacauuuuauuugguacauauggagacacagugugcauguggaagucagaggacagcuuacaggaauugcuucuccaugugcuuugccucaggcaucaaauucagguccuuaggcauggcuacaagucuuucuuuuccugcugagccaucuuacuagccccuagucauacaauuuuuguaagcaagaauuuguguuuguuuuacuuguagccggagaaugcuggaggagaucuuaaggaugguucucaccauuacgaaggagcuguugucauucuggaugcuggagcccaguaugggaaagucauugaccgaagagugcgggagcucuuugugcagucugaaaucuucccauuggaaacaccagccuucgccauaaaggaacaaggauuucgguagccucugauugauaaugucgucaaugagauugaguuuagauuuuggaauauuuuauaauuaguuuucuugggcauugacuuuuucuauaaaaauccagcguaauuuuguaagaaauuuccuauagcucugauuuggaauuaaaaaggaauaguuuauacauuuaguccaaaaaaauuaccuugauguuuucaauuuuuguuuguuuugaugcugcuggggagauuaccuugauuuucguuauacagcugaccaccuuguugaauaguuuauauuuuauaugauuugugggucacaguuagaugcaguuauagugaucauuuguuuauuguucuuagaguaauuaaucaaaggaaaaauguacaaaugguuggauagaguagcugaaagggaagaaguauuuauacagaaguuccuuguuuccaaccaugaaaaucuuguugcuaaaggagaaaaaccuaagccuuauaaggcuaguuccaguggccccugucccuaacaggcaagacagccaacgcaugugaggcuuguaacguucuuuccuuucauauggauuggugccucaccguuuuuccccagaagugacuacaauggccauccuuaauugacuuagacuuuuacacaaggugaaugaaaauaaagaaauaaaaaaggaaggaaacgacugcucuuaaguaugguggagaaaguuuauuguagguaaagaggagagcacagucagagggagugaugucugagagaguccagagugaacaugaccuugagccagccgggucauguaaggagagugggaagcuggaaggaguuuccuaccaagagggacagucuuggccaagagaguaaaaguuacaccagaaggguaguuaacaaaaauggcuguggggaguggcugugcuggagaaguucauggccagugacauacccugagggauauagggagccugcaaaccugguggucaguguacccuuugaccuguuaaugggcaccucagccaguugucuaggguuugagacuuaauacuaggugugcugucuuucucuucaaaugucuuauuuugaaaaugaaacugugugcguguauaaguguacaucuacgugugagcuugaggcagucagaugacaguuuaugggagcugguuuucuccuucgccauaugaaucugaaggaucaaacucaggucaucaggauucggaguaagugccuuuaccugaugaguuguaucacaggacacugaguauauuuccauuuuucuuucuuuauaaaaagaaaacaaaacagucucuugccuuguagcccucucuggcgguuauugaauucaauauuguagaaauuuguggugauuuucuugcaaccucccucccaaauacuaggauuagaggcaugcacuauaaagcuuagcaaugugguuuguuguuguuuucuuuuucuuuuucuucuuuuucuuuuucuuuuucuuuuuccuuuuccuuuccuuuucuuuuuccuuuccuguccuguccuguccuuuuccuucccuuuuccucccuuccccucccuuccccucccucccuuccuuccuuccuuccuuccuuccuuccuuccuuccuuccuuccuuccuuccuuccgagucagggucuuuauguaguccaggguggccuugaacuugguauguaacuugaggauaagguugagcucaugauuuuccugccucccucaagugcuccuucuccucuuacugcuccuccucucaccuucacacagguuuuccuucucuguauaccucugcugcacacucagcuuuucaaugcguggucuaggcaauucuucucacccuucucacacucuucaucauaaucccagggguaucugauauagaacugucuuccaaguguguugagugucaggaacaacuacaguauugagaucuguaaagagagaggacuuuuuuuucaaccuuuauuuauacauguguguguguauguguguguauauauauauauauauauauauacauauauauauauauauauauauacauauauauauuguauuaaauaauuaaaaauuaguagucaacauuguuuacugacuccucuuccaaucaauccacagggcuauuaucauaucuggaggaccuaauucuguguaugcagaggaugcucccugguuugauccagcaauauuuaccauuggcaagccuauucuaggaauuugcuauggcaugcagguauaucugugaauugaguuugagaguugacuuaauguuuucuucuugugauuuaaauacuauuugucucuaagauaauuugggcaacauacuacuguauauuacuauuuugucauggaacugaccuuguaaggaaaccuguucauaaguaacuagaucacuuagcaaauuacuauuuauuuguuuguuugucuuuccguugguccauccauccaugcaucuauucauccauccauccauccauccauccauucauccauccauuuacuuauuugagacagggacucacauguaccacuggcuagccuagaacauguaaguuaggcuagacuugaacucagagauaguccugccacugccucccuaauuggugggauuaaaggugugcuccuuuaugugccacgacuguacacuuuuaaacagugagaauuccugcugucucuccuaccuacuuucauuuguuguucucaaucauggucauuuuaacuauuuauuagacaagaacaauauugaacaugauguuagauaacauuaaacaaaaacaugcuaacaucugacuuaucaaagaaacaauuuuauuaaacuagaucuaagggaauaaaaacauaaaccagauauguaaguucucccuuaugcuuguaagccuaggauuaucaaguuacaacauuuaaacauuggcuuacuugauuggaucaucuggaaagagagcuagaaaucauccuugcauaauguauuauugcauauuagcacauuuucucugaccccacccccacccccucuccuuucaucccccucuacuuucuuccuucuccaucuucugucucucucaucuugcuuagguaaagaacuuuuugcugcauaguccaaacaauccacaaucguuacucuucccgcugaagcuucaugaguacugugacauuuucauuuaaaaaaaacaaaaaacucuccuucucuccccauauuagucaggguucucuagagggacggaauugaucaaaugaaucugucugucugucuaucuaucuaucgaucuaucuaucgaaagggaauuuauuaccguggcuuacaggcuaugguccagcuaguccaacauuggcugucuccuaauggaaagucuaagacuccauuagucugagacuagacaucucaguuggucuugaguauacaucagaaucuuaaagaaguagucucuaaugccagugagguaagcagagguaaacaggcaaagaccaaaguuuguguuucuuguccuucauguuggcucccuggagaagguguggccuagauuuuggauggggacaagguuucuucacccucaaucuugauuuaagggucugucuuccuaugucaaaugaaccaauuaacuaaaaauuccuccagaugugcccagcaacuuggacuucaauuaauuuuaguuuuggucaagaauagccaucaugccuacauuugcuuuuaaacucaaguguguguguauguguauauacauacauacauacauacauauauauauauauguguguguguguguguguguauguauauauauauguauaugaauauauaauauuuacuauauuaauaacuguacuaauauauauuuguguguaugcauacacacaccacacacacacacacacauauauauauacauauauauauauauuaucuacucuuaaggguuuuuuuuuuuuaauguuaauagcuaagaggcuguagagaugauucaucaguuaagagcaaacaccaggguuugaauccccacacucacaugauagguaaaacagauugaauaacauacuauaguuggccacuuuugugguuuacagauaaaguuccaugcccauuuuucucucucuucucuucucucuucucucucuccucuccucuccucuccucuccucuccucuccucuccucuccucuccucuccucuccucuccucucuucucuucucuucucucuuccccuccucuucucuucucuucucuuuucuuuucuuuucuuuucuuuucuuuucuuuucuuuucuuuucgauuuuuuugauacaggguuucuccauguaaccuugucuauuauggaacucauucuguagaccagcuggccuugaauucugccucccgggugcugggauuaaaggaauucaccaccacugcccuacuagcucauccccuuuuuauuuuuauuauuauuauuauuugccccccaucccccaagacaugaauucucaguauaagagccccugcuguccuggaauuugcuuuguagacuaaaguggucuugaacuuauggagauccaccugucucugcuucugccuaugccucuaccuccuaagugcugguauuaaagacgugcuccaccaugccugcaugcccuuuuuauuaaacacaagacauuugauugcacugcgcucuucuaauauuuugccuuucaucuuucuugucauucucuaauucacccauucaaauuuguauaauaaucaauguuucauauuuuauuccuucaugcccuaacuccuguguuguugcuacagguuuuguuuuuguuuuuuguuuuuguuuuuuguuuuuuuuuuuuuaccuacaacggcuuuuaaaucucaaaguaccuuuguagcuggucugacuuaagaauuaaggaaaaauuucucuuucuguuuucuuuuugagauaagagucucacuauguagcucuggcuguccuggaacucaccuauguagaccacacauggccugagcucaccucccuucaccugccugugcuuccugagcucuggcauuaagagcauaugcuccaggacaccugaccggauguuaauuaaagcacaacaaaugggaagucucucaguguuugucacagauuaaccucaggucaaauuccuagucaaauuuuguuaugaauuuaugcucauuaacaauuuuacauauaguaacaguaguuaccuacacacauuaaacaccuguuuacucauauuuaugguacaaacaacauuuugaaggcaaaggauauaaauaauuauuauuagcauacaaacuuuucuuuugauucauauuaacauuaguuuguuucuuugaacagaugaugaauaaagucuuuggaggcacugugcauaaaaaaaguguuagagaggauggaguuuucaacauuaguauggauaauacguguucauuauucagguauuauuuuuuaauuacauuuauuuaauuuuggguccauccauauguguaugccacugugugugugugugugugugugugugucuguaaaucagaggacaguuugugggaguugauucuccuuuuucaggcuuggugacagaugccuucaucagcccagcuagcuugcuagucccauguauuuaauuuauauguguauugaguuuuuuguuguauuuauuuuuugugucuacauacaugccauuggagcauauguugaggucagagaauaacugugggaauuggaucucuacuucuaccauguggguggaucacagggaucagcuacuuuucauaguuaaauaccauugcuuuucuuuuuguuuuugcacuagaguuccaccuugccugcuguguugugcuuauuucuagguguuuuuuguaaacaguuaggcgauacguauuuucuguuuuuagaaagauaaaaucaguauauauaauuauuuuuauauuaauguaaaaguuuauaggauuuuuauuuaaguauucugauuuuaauaucuccuacucuuaaucugcuugccugccuuccuccuguguguguguguguguguguuuuuccaugugugaguucucugacauggguacugggaacagaaugacucuagaagagagauaagugcucuaaaccauggagccaucacuccagccagccugauuauauaguaaccugcauuuuacauauacugaacagauagcuguagaauaacaaugucagcauuaucacuacuaaugugacagugaauuauuaagucauugaaauaucuguuuuaaagauaaaaucucagaaaugaaauguugaaauuacaguuuuauuauauauaagcuuuuuaguguaauuagaguaccagccucauauauucaucaguucaguuuucaaguuuaaaaauuaucuguguguguguguguguguguaugcuguagguggugcauggugugugugugcuguaugauggguauauguuguguguguguuuaugugcauucuaugcacacaugugcauacacauagaagugacaggagaauguuagacacuauucuacuacucucugucuuauccucuugagccaaguucucugacugaaccuggagcuagacuggcagagaggaaauacuugugacuucucuuuuguuagaccacaagauugggguuacagguccacauguggcuacaacugacuuuuuauguggauacuggggauuugaacuuguaugcuuguuuuaagcaaguauuuuaaaccacugagauuucugaacaauccccucguccucaauuuuuauuaguugcccuccuuucagauuuaauaucuuuuauuggcacucuuuauaguuauauauguucaucuauaaauucuauguaaauuuuuacagugucccauugcuauacaguuuuuaccuucugaauuuuccuaaucuacuauacagcaaauuuguauuucuaaacaaaaugauuguuguaguuaggauuucuauuucugugaugaaacaccaugaucaaagaaacuuagggagggaaggauuuauuuagcuaacuuauucuuagucaggacaugaacucaagcagggcuggaaccuauaggcaggagcuaacuaauguacaggccaugaaggagugcugccuacuggcugacucuucauggcuuacucagccuguuuccuuauccaacucagagccaccagcccagggagacaccgcucauaaugggcagggucaucuccagucaaucacaaauuaagaaaguauccuacaaauuucccuacagccuaaaucuuagggaggcauuuucucaguugaggcucccuccuuucugauuauucuacuuguaucaaguuguuauaaaacuaagacaguucauugaccuaucaauuaugguucuccuugagauauuaguguguaaauuuuacuuuuuuuaauguuuaggggccugcagaaggaagaaauuguuuuacuuacacauggagacaguguagacaaaguugcugauggauucaagguuguagcacguucugggaacauuguggcagguaaaaauucagauuucauuaaaacuuuuuucauagugaucaugauucuauaugagauauucuuaaauuuucauuuaaaaucuuuacuuugcuuuauuuguuuuuuaaaaacauuuauugugccugugggucagaggacugcuacaguguucuuuccuucaccuauuuggaucucauuagguucagguuugguaccgagugccuuuacccauugaauuguguuguggguauguuuuuauuuuuuucauagcuguuguaaaugugguaacuuaauguaguaacauuacuaaccaaggaaauuauucagaguuuacauaggcuuuaaaauauuuaacuuaaaaaauaaaauucacacgaauaaauuaaaacauaugaauguauguguaucuguauauaugugcucaagaaggugagaagguuacggguucucugaagcugagcugcaggcaguuuugagcugucugauguauauucuggugaucaggggagaaaaaguaaaguuuagcucaggaugguagaagugcuagucauaucuuuggauuguaauaaugcuccuaguggagagacaaagauuugccaauggauugaguguggaauaccaaagguaaaacaaucgagcuuuaaaugcuggauuuuuaauuuuuuuaauuuuuuauuuuuuuuuugucugaguaacauagggguggaauuucuauuuaccuaauggaaaagacuucagggguuucggguuucauaugaaauucagggugcuuuuauuacauaacaucaaaauaaagguguccagguaagcaguuauacaucuugauuucagcagagaaaccuaggcuggagguauacuaaugggccgacauauggaauauuagguucaugagaaugugagaucacuuaagaguuuaugaagaagauauuuaaggccugaguucuggcagauucuauauguagagauaggccaggugaagagggaccagcaaugaagagugagaagcagcaaagagugaauaaguaaacugagagugguacccuggaagacacauagaaaguauaaagugccucagaucuugagccucccaggcaugagcuauaagaguugagacaaauuucuugauccaugaaccauaaaauaaggauaaugaugcccaugaaaauccgcuagcucagcaagaauaaaauaaacauaagaauuuguuaaacucuuuggucaaguaugugcagucaaucauguaguaaauauccccaaucugaaugccugaaauuguucacaauccaaaacuauuugauuacuaacaaauaucacaauugcaaauucuauaagugucuucaaaugacaagugguagucaaaaugcaaguacacuuaaaauacugugucauuuuaggcuacuuaucuaugacuuucaugugauaaaacuuuuccuagggagauaaaacacucaguugauaaggaacccacaacagaccaaagcauggcuauuaccaaguccaguuagaugaaccaaugaauuucccugugguuaauacaggaauaugagugagagguuacuuauaggaacagaaaugacuuauacaacuuuauuaccaaagccuaccacaacgugggugacaguucacaaagcugcgaaccuggaacacuuugcacuacuuguuggcaucuuaacagguuggagaguaucuauucuaggugccaaaauaggucuaaaccucuuccaggcagcccagcugcuuucuguuucuuccaggcagcugggcugcucuuggucuucuuuguagugcagcuucucccgucccagagggacucuagugaaucuggucaauuucaggaacuuccagaagcuauuugaauuguuuguuuaccuuucugcuuaaggaguuuccuaguaugcaauguuucaaucuuggaaacuguuacacuaugacaacuuaaaacacuucugaaccuggacauuucagaguagggcuauucaaccuguauuuguaguuacuggaacuggaaagaaaauauuagaaaauagugaaaacuuuugugguaugaagguuuuuuaauguugggcauuagagaaugcuaaguauauguggaagucauguaggacugagaaccaaaauugaguuuuuuuucuauauuaaauagaugaaaaagucaaaauaaugauagagaaauaagaaucuagugaaauagucucugcuuuguccuaaaccucuuuuuuuuuucuguauacuuuauaaagauuauaguaacauagcuuuuuauguauuuucuuucucguaauuaaaaguugaauagggcauauacauuuaacauuuauagagaaagguuuugaggaauggagaauggauugugaauauuaguuguaucuucaccauaaaguugcuuugugauuuuuuuuuuuuuccuugaagguauagccaaugaaucuaaaaagcuauacgguguacaguuccacccugaaguugggcuuacagaaaaugggaagguaauacugaagaauuuccuguaugauauagcuggaugcagugggaacuuuacugugcagaaccgagaacuugaaugcauucgagagauuaaagagaaaguaggaacaucaaaaguguugguaaguguuugaucuaagucuacagacuuaggucagaaauauuggaauccauaguaggauugauaagcccugacaacugacaggcuacauauauaguuuguguguugcauccccucagagucucuuguuuguuuauucugcuugauuuuuuuuucucuuuauuuacagguuuuacucaguggugguguagauucaacuguuuguacagcuuugcuaaaucgugcuuugaaccaagaucaagucauugcuguacacauugauaauggcuuuaugagaaaacgagaaagccaaucuguugaagaggcccucaaaaagcuuggaauucaagucaaagguauuaauuuaucauggagaaguugauucuuaccagggguuauuucuucaagcugugugauuuaguucaguucaauauuaaaaauguaguuuucucuaaaaacuaaaggcuaaacaugccuuuuagauuauauucauaaauuuuuuguucauugacuguuauacuaauauacugaaacuuguaaaguugccauuuugcauuuacuauucuguccucaaaaucucccuaaaaucuguccucucacaauauucuuuaugcaagugagcauauacuauaaauacagguuguauucaaucaagcucauacaaagaaaguagauuaaaagucuagaauuauuaagacauguuuguuguaugcaccuguaauccuagcucuuaggagaccaaggaaagagaauuguuugauaucaggaguuuggaauuagcuuaggcaacauugucagacuuaagguaagccauguaggcagcucaauugauaaagugcuuccuacagaagcaugagcaucugaauuuaucuuuagaacccauauaaaaauccagaugugucaguaugccuauagucacccaaacuaggaagauguagacugaugaauccugggggccugcuggccagcccaucuggcucaacugguuagcuccauguuuagugagaggcaugcugaggaagacacaugaugucuuguguaggucagugcuugcagacacacaaaauugaaaaaaaaaaaaguaacauccucaguuacuguugauuauaggucaagugauaaucacuaauaaacuuccuuuaacugauggcuacuaugaugaaaugauauaauagauuaaaaguacaguuggacacaguuuaauugugcuaaaaggcugaguauaaugaugacuccuacuuuccuuuuugaagcaagacuaaaagcaaaggcacaguuacagugaugaagguggaaggaauaaggaaacaguucaaagaacacuagggaguaaaauuuggguuucugaggcagauucucucugauaagcuaauuaacuuugauggguccuuagugcuuuucuuauagggaccuagcagugucuucacuugucugaauauuuuuggaauuuacaaauuacaaaauuuaaucuucuuucucuguaugagcuugauugcaaaacaaucuguauuuguagaaaggcuuagauauuaacuugcuuaagugaauaucuuaugcaaguaaguuuacaaauuuucaaauauauauauauauauauauauauauacacacacacacauauauuuguuguggcugucuguuuaugggguuuacugugaacguuuugagaucaggauaagaaaaaguuggccuagagaugccuuuaguuuuaguuuacuaguguuuguaauaaccauuuuugcauuuuuuguguagccacauuuuuuucuaagguaaccuucagaguagagaaacuucaaugggacaaaaacuuggaccaauagaauggagguucaaagucuugggccuaaagcgggaaggaagccaguaggaaauacacuauuuggccugcagacuucuaggggaggcucagguagugagaacauuggauuuugggagaacuagguuacuggguuugccuaaagcagggacuauuugaaaacaugagaagauuguuuuccuuaaugcagagggagcuacuucuguccucacguugagaaagcuaaugguuuacuaagaggccuuggacuugcaacccugcaccaggcauaguugagguuacagguaggacuguacaguagaaacagaacuaagugacauuaaacggugauuccugccuuccaucccuugcccaguuuaacuguacaaauguugauggguaggagcuuguggguaacugaccagguuaggagaagggacuacagguauuugauggacccugauugaaaccuccagccuucaucaucucacggugaagguuacuaguaguuauccuuuauuaccaaauaguggucuuaguguuuugucuucagaugcuucucauguuugguagugcuaggaaucaaacccacagccuucuaggcaaacacuuugcaacugauguaccaugguuauuuguucuuauguaacaauaaauaaaaggauacccacauaauuuuaaaugcauaaauagaaguuuggaagaaucauugugcugguccgagggcuuugguuuucuguagaggaacuacuguuuuugacugucuuggggauauagauauauuucuucuagugcaacacugaccagagagaaagcaaccagcacuguuggcaggcagguuuguggccucauaucuaaacgucacagagguucugaauaaauucagagaucucugaucucuagaucugaccuguuacugcugguuuauugcuggguuauuugaacauaugggaaaauguaagggacaucaaaugguggguuugccuugguuuuucuuucuacgcuuugacuuacuuaugauuuaaagaaauauaauaguuuaaaauacuucucugauuuuuuccagugauaaaugcugcucauuccuucuacaauggaacaacuacucuaccaaucucagaugaagacaggaccccacggaaaagaauuagcaaaacauuaaauaugacaacaaguccugaggagaaaagaaaaauuauuggugauacuuucguuaagguaccuuucuuuuaauguggauaauguauacugucuuaugucuguuuuaguguguuuuuauuauuaucauaucacaugccaaacuuugcuaauucuguuuuacuuuugaauaugcacuguauguguguguguguguguguccuguggacagguagacacuguuuugguuuaauagguaugcauguugcuaagcugcuguucuagcauuuagggaugguccuuuccguuggcacugcacuucuguuggguuuaccaguggccauauuuuagguaaugucgaagggaaugcucacauacauguuuuaaucacaugcaauguacaauguuuucagaaauuuauuuuugugaguuugauggaucuacuuuccugguugguacuuuagaaagaaucaaauuuaauugaaacuuuguugaaagauugauuucucagaaaauuguucugcucucgugguaacagauugccaaugaaguaauuggagaaaugagucugaagcccgaggagguuuuucucgcccaaggcacuuuacggccugaucuaaucgaaagugcgucccuuguugccagugguaaagccgaacucaucaaaacccaccacaacgacacagaacuuaucaggaaguuaagggaagagguaaaggcuugugagaacuuggcccuaaaguauguccaugcaacauguacuguucuuccauccuuuuuuguuucuucucaguacuuugaagguugaguaaccauuaccacaaacuaauuguagaacauuuauauuauccucaaaaggaaugcagugcaucuuguacucauuagcagcucuucauucugacugcuucccacaucuccugucaacccuagacaaccacuagccacucuuuuucuuuuuuuuuuuccaauuuacuuuugaagacaugauaucuguuuguauuccuggcugacuggcuggccuggaacuugcuuuguagauaggcuggccucaaacucucagauuugccugccucugccucccacaugcugggauuaaaggcuaucauucccuucaaacuacuaauuucugcuuuuguaguuuuccuuguuuugagcacuuuguaugacuuuaucaccaauaccugcacuuuuguaauugacuuuuuugcuuuguuuuuaaaaagaugaucucaaguaaugcgugucuuugacuuguuacacagccaaggcugaccuuggugaucccacauggucuacugugcucaucuucaguucuuacguguuuucaaggcucaucuauuguguaauguauauuagaacuuacuccuuuuuauagccaaauaguauuccauuguauacauauuuucgcaauuuucaguuggacauuuccuguuugggcuguuagaaaugacauuauaaauauugguuacaaauucuuguaaacuuuccuuuuccucuaguggauacguagauagaguauugcuagaauagcacaccauggugcugcauugcuguaaaccugucacuuagggagucuagacuaucauggucuuucagcuacauaccaagugaaaauccaagauuauagaugaaucuuuuucaaaaacaaacauaauuccuaaauuucaugucucuuuaacauuuugauuuuuuugaaagacuguuguccaaaauguugaauucauacauucccauuugguuuccauuucccguaucuuaccugccuuuuuaaaaaucauuguauaaaacauaaaauaaauccucccaucuggaaucaauaguagaaucuguaacuuucucugcuugcagaauugaaacuuacccauuaaacacauuccaacugcccuucaauuuuuaauucuauuugacuuccuuauauacuuacuugauacaagugguaucauacaaacaugacuucccuuuauucuguuuuuaguagugucuuguuguuucuagcuuauuucauacuuagcauauguccuuguaguuuuaagguuauauuaugugaucugauucccuuuucaaaugcuaaguaauagaacguugcauucuggauacuucauuuuuauucaucacugaacauuugugauacaucuauucuuugaacauugugaguuuugcuaugaauguagguauauauuuagugcuucaagaauccuuucaguucuucaguauacauacuuagaaguuuaauuuucuuuuguggaaaguacaugcuaucucacauagcaguugcagcauucuacuuuuuaaccaaaguaccacaggaguucuggcuuuuguguguucacuguuuuuuauuuguguuuaguagcuauacuaauagcuaugccauuguucccuugaaaaguaguaucucuguuauuuuuugucccuugaaacaggaucuccauauguuucuugaaguuacuguccuuuuaccuucccagcauuguucuugcaggaaggagugcaagcacugcuaugcuaagaucagugugguuucgauuuuuauuucccuauaguaaugucuagaaucuuuucagaugcuuauuggucauuuguuuaucuuagaaaugacuguucauacccuuugcucauauacugaguuuucauuugauauuuuuuaauuggggcuggaaaaauguuucugcaguuaagaacacuuggcugcuuucuuagaacuggaguugaauucccaacaccugcaaggcagcucacaauccucuauaauuccaguuccaggguucugaugggcaugcaaauggggugugugugugugcauauauauauauauauauauauauauguauauauauauguauauguguauauauauaugcagauaaaguacuuaugcacauguaauaaauacauuuauuuauuucuuaccaugacuuaucuuuuuuugauacuguugagaaaaguuuuguuuuguugucuuuuuuuagaaaugcacucugcauagaccaguguagaccuagaacucauggagaucuggcugccucugcauucccacugcuaggguuaaagguguuuaccaccacacccaguucauuuggacucauuagcaugaacauuauuuuuucuaauugccuucuuuguguccagugagaaauaguugagagcugaugggucucuucauuuucuuuucuuuuccuuuuuuuuuuuuuaauuuuguguguguguguuugauugugucuuuguguauguuugugcaucaugugugugccuguugccaguggagguuagaaagaggguauuggauccguagaugauuguaugcaugcugagaauugaugcugcauccucuggaagaaaggagccagggcucuuaaacagugagucaucucuccagcaccagaauuuguuuuucuuuauaagacuuguaaggauuauacuuaaaauguguuucaacaaagauuaugaaugccacugaauaguaaucuaauuccuucuaagccucacaggagaaaauaucuuaaaugauagucuacuuuuuucauuggucccuuauuuucuuauagggaaaaguaauagaaccucugaaagauuuucauaaagaugaagucaggauuuuaggcagagagcuugaccugccagaagaauugguuuccaggcauccuuuuccagguaaaaacacaccuggguuuuguugguuggugacggucauguggauucaguuuagaccauucugaaucguuucucuucuuagggacuaugugacaugacaaagggagagggugacagggaacacauucuuugaagugccuacuguauuuauaccguuaugugacucauucucuuuuuuguuuguauuuagauacuauauaauuccugggaguuuagcauauaguauugcuuccagaugaggaaguggagcauaaagauauuuuaauuacauuuguacagaauucuuaauuauagaucuaggauuuuuauaccaugaguacuguguguauuccauggaaaaaagagaauuaaaucuucauuucuccucuucuguuuuuaaacauagggucucuugaaaaauaguucucuuaaaaaauaauaagauuccucucacucccaccuccagguugcuuuggaugcucugaguucaugcauucgaggucagccuggucuacagagugauuccaggacagccagagcuacacaaagaaagccggggggggggggggggagaaaaaaaaaccuggaugguauucuaaaacuaguauugagacugagggcaacuaaugggaauaugauuuucauuuugcuucuagacaccucaagggauuucuuuuuuucauguuauaguaaagcagcagaucuugugcaugccuuuuauucugugagguuuauuuuguuugcauguguuuuugccuguguguguguucuccaugggcaugccaggugccuaaagaagucagaagagggcaucagaaccccugagauacauagugcuggcaacugaaacuuaguacucuuaacuacugagcaguccucuguaucuugcuguuuauuuauuugcuugcuugcuuacuuaguuacuuuaugacuauuacguauuugguaaauaaaagugcuagcucgggggcuggugagauggcucaguggguaagagcacccgacugcucuuccgaaggucugaaguucaaaucccagcaaccacaugguggcucacaaccaccuguaaugagaucugaugcccucuucuggugugucugaagacagcuacgguguacuuacauuaaauaaauaaauaaaucuuaaaaaaaaaaaagugcuagcucacauguuugcauuaaacuauuuucacuuuuauauuuuaauuuuaaauagccuaugagauaaggugguucguuauauuuuuuuacauuuguguaugauagagaauucccucaagagauuaucaauaaauuaccauauauaguaugaauuaaaauauuucuuggaacaguuuugugagaauacauagauuagucaauuuggaugggaaauuaauacauauacuuaaaauuaaauauguaguguucacuuguuuguuuuaguuuuagauugagccccauguccuuuuacauaccauugacuuuaccaaagagcuacauuuucagcuuugaaauuuagaaugcuaagaaucagugguagacuauuugcuagcaugcaugaugcccuggguuugaguucuaacacuaaaauaaaaagaagaaaacagaacacuuugugauggcaguuagauccuaauuuuauaaggguuuuauuuuuuagagauaguaucaguuuucuacuaaaauuguaacuauagauuuuauguucaaaauuauuuuuguuauuuagguccuggccuggcaaucagaguaauaugugcugaagaaccuuauauuuguaaagacuucccugaaaccaacaauauuuugaaaauaguagcugauuuuucugcaaguguuaagaagguaauaaaugauuugacauaucuagucaauacauuguacaaaauagauugcuguuguauuaauguuuuaaaauuuauuuuauguuugaaaauucagaacaauauuugcaaugacaguguagaaauccugacacagagacuacuagguggauuugucuaaguaaauaagacuacauaucuccugucuguaaaaguuccagauaagcugcauaagauggucuuucacgguaagaaaguaagucauaaaugaaguagaagggucaauucaggaagacuuugugcuccugugaaggcagcauuccauuaguucacuugagcagaaguaucugaaaggagacccugagcugugaagggucugugauuagaucacaaguuuucuuagcaggacuuuagcuacaaauugauaauguguagcaguuucccagucucucagauguggauugcuaacuuauaaccuucaaagcuguguuugaaaguagcaaguuaguaacuuucauuugaagugaaccucgauuuguacugcuucuaagaagucaggcaaguagcaacagguucucuguggaguaaucuucacccugguucccaaagaaugcccacaguuucaaaagaguaagagagguuacaaagaacaaaacacagccauaaggcccagaaagauauaaauaacgagcagaauauccucagugacccuggauaccagaguuuacaaacagaagacggacgagaaagugaaggaagaaggugagcuauuaauaguauuguuuuuguuuguugagacaggguuucucuguguagcccugacuguccuggaacucacucuguagaccaggcuggccucaaacucagaaaucugccugccucugccucccaagugcugggauuaaaggcgugugccaugacugcccagcuaauauuguucuuaugauacuuaaaaacugagauaguuaaauucuagaaauguuuguaacugaaauuaacauauaaagagagaauucaagcauagauacuaugaaauuucuagaaauagaacaaaugaucagaaaaauauuaaggauagaaaaagcucagauaaaauugaguuuagcuuuaaguaucuccagagggucacaguggacaagagaaguuuuuccaaauuggugaaauauaauggcuuugauugagcaaaugacacaucacucuggguaagugaaauaacuugaccccugguagggaauuguucaugaaaccaagacugcuaucgacagcagcagccauacaggaacaaacacauaccugcaaaacuaagacuuuaaaagcaguagcaaaacuaaagugcucugcaaauauguugugauuauauagcuugcugauuuugugggacuccuaauagugggaaugggguugucucucuuugaccugcuuuugggacccuuguccagccaugauaugggggcuugugccuagucuuauuguaaccuguaaugccccuuucaguugauaucccugggagaacugcucuuuucugaagggaaguggaucugggggagaugggggucacagguaugaggaguggaggccaaggaaacuguaaucaggauguauuauaugagaagaauuaaaaaaucaaauuaacaaaacaaaaaacccaagggguucaagagagaugacuggugcaugucaaguuguuuuaaaaacuaaagcaaguauucaaguaaagucauuucuagauaagagcauauauuaccaacagccguugacuugaggaauuuaaggcaguaguuuuucauaaugguuagaaguaaacuaugagggugggguuuuuuuguucuauuauuuuuuuaaaaaauaaacuucauuaagaaaaacuuauaagccuccuccuccccucaguuaacuguguaauuagaauaaccauucuaagguugcaaaguuucauauuggauuuuacacucuuugcauuaaauguauuuuaacccagcuaucuaagaccaaaaaugaagucuaagauaacuaggaaaacaauuaacuauguuuuuuuuuuccauuauuuauguccauuaccuacauucaguccuuccucgucuccuaaauaaauagcaaaaagaccaaaaaaaggcuaaauauaaguaguaauuuuuuuuuuuuugaggcaguucuggcccccuaucucauuuuccuuagugcuaguacccuggguguaggcuaugucugccuguaagggacucuuugauauuugcacuucuagaguuucugacugguggucuggaguagggcucuagcuuuaggaaaagcaaugagguagagagucuuagguguacaugcaagaggaaugcuugguaagcaaauaaaguuauaaauggaagacugacauaaacauagacagcauaaaauaaugacaacaauauuacuauuugagaacuaauaaaauguaaagcauuaaaaaugauuguuuugccaaaggacagaaagguugauucaauuuaauuauuaacauuaaguaucauguagaaaucaaagguuuaacuucaaaccaauaaaggaaagguaaaugagagaaguugggagaaucaccaguucaaaauagagcaaaaggggcaaaauacaaaauacaaaggugauacaagaaauacacaaaaggugaugggaaaguaaacaucucaauguauauaaauuuaauuuauauuuuuuaccccacaaauaaauuucugcuguaguguauagcccauagcauauucuacaugaucuacuauaaggaacugguacauaagauugugauacuuuacaacaugaaccaaaauuucugucugguuuucucagccucauacacuguuacaaagagucaaagccugcacaacagaagaggaccaggagaagcucaugcaaauuacaagucugcauucacucaaugcuuucuugcugccaauuaagacuguagguguacaggugaguuaugugaguucacuuacugggauagaacuugcgguuuguuuguuuguuuguuuacaaaguuugaauuugaaauuacuuuggaaaauuaaaugugaaauuauuuucuaaguuuagaaagguaaaauaauuuuauagaugguuauggagugaaugaacuuauaagaacugaacacuuaggcaaaguuuuauaguuuuuuuuuguuuuguuuguuguaucucuagucacaggaaaacuuucagagaaccauuuacuucacaguuugcugauaaaaggucagguccuuauuuguuuguacacuuagaauauauacugugacuugagaagccuuucuuuagcugcaagaaggcgucagaugagucuguacacauuuagcuucuggccugcaagcauaugugacuaaggauugaauaucacuuaacacaaaaucauaagcuuauuaaaacauugaaauuuuacuaugguuuguacaaauuauuuuucuaguuuuuuuuuuucaaauuagcuaucugucugucuaucuaucuaucuaucuaucuaucuaucuauuuauuuaauguguacgagugcauuacaucacauuguagauggcugugagccaccaugugguugcuugcaauugaacucgggaccucuggaagagcagucagugcucuuaaccacugggcaaucucuccagcucuauuuuucuaguuuugugugugugcauacauacucauauaccacagcauguauacacucauacaacagugugugugugugacuguguguguguguguuuguguguuguagaucagagggcagcuuuuauccaucaguucuuuccuguguguugaggcagagucucuuguuucugccacauuucuuacugcaggauggcuggacuaugaacugagugauucgccuuucucuccuaugucauguaagagugcuuagacauuaaguucuacuucauuacccuucaaggaauuuugagcuuugcucugauauuuacaugcagauaguuguaaguauaaaaguuaaagugcauaucuguuuucuuuaaacauuucucaguucuuacgugacacaugggguucaaucucaacacaguuaaaacaacagcaguaaaaaauuaaaaauguauuuucaagacccaaguggucuuucuuucgcccuggcuauucugaaacugauucuguagacaaugcuggucuugaacucagagaucugccagccucugccuuccaaguucugggauuaaagaugugugccaccauucccaguuaaaacuuaaacucuaaagaaaguuuacugaucacagggcccccaauagaggagcuagagaaagugcccaaggagcuaaagggaucuguaacccuauagguggaacaacauuaugaacuaaccaguaugccggagcucuugacucuagcugcauauguaucaaaagauggccuagucggccaucacuggaaagagaggcccguugaacuugcaaacuuuauaugccccaguacaggggaaugccagggccaaaagggggaguggguggguagggaagugggggggaggguaugagggacuuuugggauaguauuggaaauguaaaugaggaaaauaacuaauaaaaauauuaaagaaaaaaaaaagaaaguuuacuaaagaaacuugucuauuugcagcuccugugagauacggaguugaaauaguuucccacuauguuuuauuuucaaaggaguuuuuguuaagauucauuugagguauuuguuuaaugacuaauuucuuuucaauuuuuuuuuaauuuaguguguauuggauguauuuccugcauguaugucuguaccaugugaaugcaguuuguuuguuuccuuucuuucucuuucuuucuuucuuucuuucuuucuuucuuucuuucuugauauuuucuuuuuuuuuuuacauuucuuuucuuuuuuuuuauuacguauuuuccucaauuacauuuccaaugcuaucccaaaagucccccauaccacccccccccacuucccuacccacccauucccauuucuuuggcccugucguuccccuguacuggggcauauaaaguuuguguguccaaugggccucucuuuccagugauggccaacuaggccaucuuuugauacauaugcagcuagagucaagagcucugggguacagguuagaucauaauguuccaccuauaggguugcagaucccuuuagcuccuuggguacuuucucuagcuccuccauugggagcccugugaucuauccaauagaugacuaugagcauccacuucuguguuugcuagggcccggcauagucucacaagagacagcuguaucuggguccuuucagcaaaaucuugcuaguguaugcaauggugucagcguuuggaagcugauuaugggguggaucccuggauauggcagucucuagauguuccauccuuucgucaaagcuccaaacuuugucucuguaacuccuuccauggguguucuguucccaauucuaagaaggggcaaaguguccacacguuggucuucauucuucuugaguuucaugcguuuagcaaauuguaucuuauaucuuggguauacuaagauucugggcuaauauccacuuaucagugaguacauauugugugaguuccuuugugauuggguuaccucacucaggaugaugcccuccagguccaaccauuugccuaugaauuucauaaauucauucuuuuuaauagcugaguaguacuccauugugcaaauguaccacauuuucuguauccauuccucuguugaggggcaucugaguucuuuccagcuucuggcuauuauaaauaaggcugcuaugaacauaguggagcauguguccuucuuaccgguuggaacaucuucuggauauaugcccaggagagguauugcuggauccuccgguaguacuauguccaauguucuaaggaaccgccagacugauuuccagagugguuguacaagcuugcaaucccacuaacaauggaggaguguuccucuuucuccacauccucacaggcaucugcugucaccugaauuuuugaucuuagccauucugaccggugugagauggaaucucacgguuguguugauuugcauuuccaugaugauuaaggauguugaacauuuuuucaggugcuucucugccauuugguauuccucaggugagaauucuuucuucaguucugagccccauuuuuuaaugagguuauuugauuuucuggaguccaccuucuugaguucuuuauauauauuggauauuaguacccuaucugauuuaggauagguaaagauccuuucccaaucuguugauggucuuuuugucuuauugacggugucuuuugccuugcagaagcuuuguaguuucaugaggucccauuugucaauucuccaucuuacagcacaagccauugcuguucuauucaggaauuuuuccccugugcccauaucuucaaggcuuuuauccacuuucuccucuauaaguuucagugucucugguuuuaugugaaguuccuugauccacuuagauuugaccuuaguacaaggagauaggaauggauugauucacauucuucuacaugauaacaaccaguugugccagcaucauuuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaucacaauugcucuguaguaaagcuuuaggucaggcauggugauuccaccagagguucuuuuauuuuugagaagaguuuuugcuaugcuagguuuuuuguguuccagaugaauuugcagauugcucuuucuaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagacuugaaguuuuuaucacagagaucuuuaauuuccuuaguuagagucaagccaagauauuuuauauuauuugugacuauugagaaggguguuguuucccuaauuucuuucucagccuguuuauccuuuguguacagaaaggccauugacaaacaguuaauuuuauauccagcuacuucaccgaagguguuuaucagguuuaggaguucucugguggaauuuuuagggucacuuauauauacuaucauaucaucugcaaaaagugauauuuugacuucaucuuuuccaauuuguauccccuugauguccuuuuguugucgaauugcucugccuaggacuucaaguacaauguugaauagguauggagagaguggacagccuugucuagucccugauuuuaguggaauugcuuccagcuuuucaccauuuacuuugauguugucuacugguuugcuguagauugcuuuuaucaugguuagguauggaccuugaauuccugaucuuuccaagacuuuuaucaugaauggguguuggaucuugucgaaugcuuuauccacaucuaacgggauguucaucugguuuuugucuuugaguuuguuuauauaauggauuguguugauagauuuccguacauuaaaccaucccugcgucccuggaauaaaaccuacuuggucaggauggaugauugcuuuaauguguucuuggauucgguuagcgagaauuuuauugaggauuuuugcaucuauauucauaagggaaauuggucugaaguucucuaucuuuguuggaucuuucugugguuuagguaucagaguaauuguggcuucauagaaugaguuggguagaguuccuucuauuucuauuuuguggaauaguuugugcagaacuggaguuagaucuucuuugaaggucugauagaacucugcacuaaacccaucugguccugggcuuuuuuuggcugggagacuauuaaugacugcuucuauuucuuuaggggauaugcgacuguuuagaucguuaauuugauccugauuuaacuuugguaccugguaucugucuagaaauuugucaauuucguccagguuuuccaguguuguugaguauagccguuguagaaggaucugaugguguuuuggauuucuuuaggaucuguuguuaugucucccuuuccauuucucauuuuguuaauuaggauguugucccugugcacucuagugagucuagcuaaggguuuaacuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuuuucuagagcuuuuagaugaguugucaagcugcuagugugugcucuccaguuucuuuuuggaggcacucagagcuaugaguuucccucuuagaaaugcuuucauuaugucccauagguuugaguauguuguggcuucauuuucauuaaacucuaaaaagucuuuaauuucuuucuuuauuccaaccuugacugagguaucuuugagaagaguguuguucagauuccaggugaauuuuggcuuuccauuauucauguuguuauugaagaucagccuuaguccaugguggucugauaggaugcaugggacaauuucaauauuuuuggaucuguugaggccuguuuugugaccaauuauauggucaauuuuggagaaggucccgugaggugcugagaagcagguauauccuuuuguuuuaggauaaaauguucuguagauaucuguuaaguccauuuguuucauaacuucuguuaguuucacugugucucuguuuaguuucuguuuccacaaucuguccauugaugaaagugguuuguuucagucacccacuauuauugugugaggugcaaugugugcuuucagcuuuacuaaaguaucuuuaaugaauguggcugcccuugcauuuggagcacagauauucagaauugagaguuccucuuggaggauuuuaccuuugaguaugaagugucccuccuugucuuuuuugauaacuuuggguuggaagucgauuuuauucgauauuagaauggcuacuccagcuuauuucuucagaccauuugcuuggaaaauuguuuuccagccuuucacucugagguacugucuugucuuuuucccugugauggguuuccuguaagcaguagaauguugguuccuguuuguguagccagucuguaagucuaugucuuucuauuggggaauugaguccauugauauugagauauuaaggaaaaguaauuguugcuuccuuuuguuuuuguuguuaguguuggcauucuguucucgucuuuuugguuuguugagggauuacuuucuugcuuuuucuagggcgugauuucugucuuuguauuguuuuuuuuuuuuuuuuuuuuuccuguuauuaucauuugaagggcuggauucguggaaagauaaugugugaauuugguuuugucguggaauacuuugguuucuccaucuaugguaauugagaguuugaccuuguauaguagccugggcugacauuuguguucucuuagugucuguauaacauauguccaggcucuucuggcuuucauagucucuggugaaaaguuugguguaauucugauaggcuugccuuuauauguuacuugaccuuuuucccuuacugcuuuuaguauucuaucuuuauuuagugcacuuguuguucugauuauuaugugucgggaggaauuucuuuucugguccagucuauuuggaguuuuguaggcuucuuguaugaucaugggcaugucuuuguuuugguuugagaaguuuucuucuauaauguuguugaagauauuugcuggcccuuuaaguugaaaaucuucauucucaucaacuccuauuaucuguagguucugucuucucauugugucccggauuuccuggauguuuugaguuaggauccuuuugcauuuuguauuuucuuugauuguugugccgauguugccaauggaaucuucuguaccugagauucucucuuccaucucuuguauucuguugcugaugcucgcaucuaugguuccagauuucuuuccuaggguuucuaucuccagcguugccucacuuuggguuuucuuuauugugucuacuucucuuuuuaggucuaguaugguuuuguucauuuccaucaccuguuuggauguguuaucuuguuuuucuuuaaggacuucuaccuguuugguuguguucuccuguuuuucuuuaaggacuuguaacacuuuagcaguguucuccuguauuucuuuaaaugagcuauuaaagucuuucuuguaguccucuaccaucaucaugagauaugcuuuuaaauccgggucuagcuuuucgguuguguuggggugcccaggacuaggugggauggggugcugcguucugaugauggugaguggucuugauuucuguuaguaguauucuuacguuugccuuucgccaucugguauucucuggagcugugcagaauacacucgaugggguccuggaaccaagaagucugcugccgaugcucaggcaaaacgcuuccgggccggguggaucucuauccucugucugggaaaguggccagcugucuggggcccgaaaagggggcugccauagaagcucuguaguuccagccuuuccauaagcuuuuagcuucuguauuccguacucugaccugugcagaauacacucagcaaggucccggaaccaagaugucugcugccgaugcucaggcaaagcgcucccgggcugggcggaccccuuuccucuggcagggaaaguggccggaugucuggggccuguucagaaucgauauuuucuuuauauacauuucaaaugcuauccuggaaguucccuauacccucccuccacccugcuccccuacccauuggcccuggcauuccccugaacuggggcauuuaaaguuugcaauaccaaggggcuucucuucccagugauaaugugugaauuugguuuugucguggaauacuuugguuucuccaucuaugguaauugagaguuugaccuuguauaguagccugggcugacauuuguguucucuuagugucuguauaacauauguccaggcucuucuggcuuucauaguaugagaacugaacucagguccuuuguagcaggagccagugcucuuaaccacugaguuaucucuagccuuuguuauuauuuuuaaaugaaaacaagcacccuuuuggugacacuaacaaggcgagugaauccuccccaaaccccuucaguuaggaacaggacguugaauucugucauucugugggauccuucucauucagaccaucaucucauuuguaaacuuuauuuaguugaaguauauuucuucucuuccuaguuaauguuuuucuaagaguucuuuuaucuguuuauguguaugugcauguguauguguguauguaugcagggacugcuggccucagguuuagguuugggaguauagcucagugacuaagagcauuugcuguucuuccagaggaccugagcagauccucagucaggcuguucaaaucccccccauaacucuaguuccagggcaucugguggguucuggauaccaccacuaccucacccuuccuccaccaaugugaaugauuuuagaaagaugacguauuggaccuguccuuuuuucugaguccuguagcuuggagaaggggaguugcacauggcagguggagcacugguaaugcauguguccuaugugucuuguucuccuguaggugugauaggcgaaugugcagugucagcuagagcugcuaaccuucaggagcuuccuccuguaguaccaguuagaccuuggagucugaucuuggagggccucucaccccucuuagaugccugauuguaugcuuugggguguuauuuguccuuuuugggguuaucucuucagugcagauuugagcuguggaccaguacugccuuucugcuaccauucccaguuaauaggaugcuuugaugcacauaugaauuguauuaugcuuaagucugcucuuaaacauuuacuauugccauguauuuaaauuguucaacuuuaacuuuguaacuuuauaucuuugaucaaaccuuccucauccaucuucacgucccuuaacccuaacuuucuccagccucugguaaccacuauuguacucgcaacuuaauguacgauaaacuauuuaaguucuaccuaugagugugauugugugcuacuugucuuuugaugcacaucuuacuucauguaaagaucucaaguucuacucuuauuguuacaaaggacuuuauuuuucacguggcugaauagcauuucauuauauauauauauaguaauuuugaguuauuuugaugaauacauaaguuguuucuauccauuuauuuuuaaguuaguauuuuaaguguauuuuuaaacaaaaaacuuguuuacucaaucgauaaauauggguguuagagcuuuccugucaaaccaaauacacugguuugccauaguugggcagccauuuggaauuaaugccaaguggacuucugcauguuucauaugaauuguugaaagguccaugaugguuucuuuauuccugaauugauccaggugggauuuaaugagcagaauuuuaacuuaggaccuaauuuguauuacuagauaaauauguauaauauacuuuucagauauacuuuaaaaagcaaaaagcaaauuacuauuaauaaugucacuuuaaaaaauauuuucuaaugcaccuauugacuuaacuguuaaaaguugauuauauuuauuuuuauagggugacugucguucuuacaguuauguguguggaaucucaaguaaagaugaaccugacugggaaucucuuauuuuccuugccagacuuauaccucgaaugugucauaacauuaacagguauuccacagguggcagaggggauguuggugugaaugaaguguggugggaaaauauguccuuuaaggucuuuucuuaaugaaagauuagacgacuuaaauauacuuguacuuaagauaggagaugagagugguguagucucuacucuuuauaauaugcuuugaauaacuuggcuuuuuuuaugugcuuuggcuauaguuaggggaauucuuuuuuuuuuuuuuuuaaagauuuuuauuuuauuuauuuauuauuauaaguaagugcccuguagcugucuucagauacaccagaagagggcaucagauuccauuucaggugguugugagccaccaugugguugcugggauuugaacucaggaccuuuggaagagcagucagugcucuuacccacugagccaucucaccugccccagggggaauucuuaauauccuauauuuuuaucccucaucacaguauaauuauuuuguuuaucuaagaaaaauauugaaaaaaagauuaauuuagggggcuagcuagauggcucagcaggaaaagguucuugcuacaaagccagaagaucuaaguuagaucccugggauccucauggcaacagggaagaaggaauuuugacaaguuguuuucuuaccuccacacaugugauaugccauauaugcauccaaaaaaaccaaagacagcuuugcuggcugcuuuuauaucaacuugacaucagcuagaguuauuugguaggagggauuuucaacugagaagaugacuucauaggauuggccauaagcaaaccuauagugcauuuucuuaucagugguugauuuaggaaugccuagcccauugaaugcagugccacuccugggcuggaaauccuggugcuaaaagaaaccagacugagcaagccaguacacugcauuccuuaauggccacuguaucacuuacugacuccaaguuuugucucuguuugcauuccugccuugccuuccuuugaugaugaacuguugcuuggaaguauaggaaauaaauccuccccuccacuaguugccauuagcucugguguuuuauuaccccaaucgaggccauaacuaagaaaacaguaaauugguauguuuuuuggccuauagaacuagugcacugcuuuggaucaguaauggugguggugguggcgguggugguggugauuggaaagcaaauuaaacuugggcaguguugaagaaggaggacuagauugaaccaccauagucuguuugcuuaggaaagcaugucaggccacuggauucucuuacacagaugccaacaagaacacaggguagaggaaggaaacacugauagagaauuuugagaaucccagcaguggauccuuggaccaggauuggucucugcuggaauugagggagaaaaaugcagauuuaauagcuuaucuuuaacaaggacacuaauggggcuagagagauuucucagagguuaagagcagugacugcucuuccagaggucuuuaauucaauucccagcaaccacaugguggcucacaaccaucuguaauggcaucugaugcccucuucuggugugucugaagauagucacaguguacucauauacagaaaauaaauaaauaaauaaggccauuaaugaacaauaaucacugucuauuuauuacaaaaguaaucacaugucuuuuagucuuuaccaugauguuauuuguauaucagccuucaauucagaucaugaaaagcuuacagaaaauuucuuuuggacaguccagauugaaguaaaauuggcuuucaguaaagugaauacaaucuuucaaaguaguaauccuacuuccauaaauacuaucaugcuucugguuguaagauaaagcuggacuuaucuauuaaugcucaugacaucagaaauauggaggaugugaccugaaagauuggauuaauacuuaaaugaugucaauaguuaaaauaauaugcuuaguaaccacugaggaacucuuaacugucugagcaccaagcaugacucuugugugugucuguuuaugaucaccagccugucacaggcaguaguuaagaugagguagcaucugucuuuauuguuuaugccaauuuaauuagcauucccugaauucaaaguguuuccuuuugcuuacagaaaggcaguuuagugugguuuauguuaucaaagaauuacuaaacauuauacuuagugugguacauauuaucaaguaaaggauacuauuuaacauuucuuaccaaaaaucucaaguuguuuagugucagaauugcucauuaaauguuauuucauaguuguuuccaguuuuuuuuuucauaaauauugguugcuuaaccaacaagaguugcuugagacuucuuuuuuuguuuuuguuuuguuuuguuuuguuuuuuugucuuuaguuuguacaaaaauuugaaauguaucuguuaggauuaaccuggaagaguuguuguguuaaaaagagaaagcugggaaagccagaauuccaaguucaugggaucaugccagcuugaacuguccuaagaugauugaaagccacacauacaguuucucacaguagcauguuucuucugaucuguuucugucuagaguugucuauaucuuugguccaccaguuaaagagccuccuacagauguuacuccaacuuuuuugacaacaggagugcucaguacuuuacgccaagcugauuuugaggcccauaacauucucagggagucugguaagugcucauucuguuuaucacagcacacuguauauguaacagaauuuuuguuuuuguuuuguuuuuuagaaguuuggccuuaauaauuugaaacaguaggauguaacuuuugcuguuuguuaugggaguuuccauaauacugcaguuuuaaaauauaauuuucagcuauucacagauacguagauuagcaaaaaaugugcauagccaugcuugucuucacagcagcugauguggacccgagcacuacucaucuuguuugagcuuugugcucaaguguucuugucauggucuauuugcuguugcauuuucaacauuuucaggguuuuuuuguuguugauuucgcuauuuaaaaaaucacccugaaguguaacacugaagagcuagcuagaccccagagcacaagaaagcugugauguaccucauuugaagauccagguguuagauaagucaaggcaggaguuguaguucaguuaauguaaguuuaauuuugauggaucuaaaauaaauguuaaguuagaugucuuaaaacagaaauacacucuaggcuugauuuugcauggagcacauuugaccauagguuuaugggaaccuauuucuauuuccauuuccccugggaaaagugggcuguugaucacuaaguuggugugggacuauacugaauaacagaaauugauuuucuuuuauguuucucauugcugcagcauugcuguggacaaaacauucuuuugcuuauguuuguuuucguuugugaugggcucucguuuuauagucuggguagcucucccuuuugagacuuuccugucagccucucacguggugagaguacagauaugagcgaucacaucugcauaugauacugcugcauccacuuucaacacuguagaaguauuugaauucagugugugaccaguguuuuaugugugcaaggaaggggaagagggagagcuaacuacucuucuuugcuaggaucuccuugagguguguuaguauuucuccaucgugggaugacacuaaacacuacaugguucuuucuuuaggguuugcugggaaaaucagccagaugccagugauuuugaccccuuuacauuucgauagagauccacuucagaagcagccuucaugccagaggucugugguuauucgaaccuuuauuacuagugacuucaugacugguguaccugcaacaccuggcaaugagauuccuguagagguaauuuaugucacuuuuucuaauacacaugugugucauucccuuauauauuaccagguacagugauagauauacguugugacaauuuauauuucuaggauugguucuuuauaagauagguuuauuuuucuuuguuuucacuuauuuaauacaguguagcaggaagggacuuuaaauauaauacaacuuugagauaccugcuuauugugauuauuacauagagcauaaccuaacugcugauuuuuacuuacuuuaaauaguuuucucauauaaaggacacaauccuaggaguggaggagaguugggauuuuuaagaauaaggaugagauuugaugguauuuacaauuacaauuauuuuuuaagaugaagucuugaaucuuacacucucugugaaccucuggcuaaggaugagcuugaacuuccgaucauccugcuucucccaagugcuaggauccuaggcaugugccacccuggugggguuggagcccuauggugccauuguuuuucuucaccacucuccuuguguuucaccaagugaaguuccagaggaguuauuuauacagcagccagugaaacguggaacugagaauuugauuaguagagcucuucuuuacagcacuauugcgaggcucugucauggacugcuggauggcuuggugggguguguuuaauuaacaucuguuucuuaugaccaacuuugucauaucuucaagacagucaggugcucaaacuguuuuugacaaacauuauuauuaagagugcuuacugugauauuuugguaguguuggaguucuauguuaaagcuauagacaauuuacaaaauauuuauuaacacauaaagugauauacuuggaugcuuauagcacugucaaacacuuugaggaguauugguucugagucaguauaucuguagagcaaauaaucagaaccaucuuucaugugugaaguguaauagccaaaaaagaucauguuuuaguuugaagaucaagcauguauucucauuuuuuuuucuuguaaucuuuguuugguaaacagguggugcuaaagauggucacugagauaaagaagauuccuggaauuucuagaauuauguaugaccuaacuucaaagcccccgggaaccacugagugggaguaauaaaugcuuuguugaggaacuguguguaacugaggcucauuagaaaccacuuguuaaugguaugcaguacugugaaaaauguucgugaaacagcuacuucauaucugagcucucauagcagugauccauggcuuaguguggagcugaggaugauuaaaauggaaggaagcguuagugugucuggguaaauaaucauggcaccauugcccaagugcagacagauuguucuuacuuuugccucaguuauguauagaccauugauaucuguauauaacgauggaugaccagcuucugucugcuugcuaggaacuguuagaaacaaaacacccuuuaauuaccagugugacuuucugugugugccuuuuggagaguccaauuuuuuuuuuaguuuuuuuuuuuuuuuuucuucagcaggugaggaaacccuauuuaugccauagaaagguauaauaaagguauuuugacuuuuuuuuuuuuuuuuuuuuuuugugugucaugacacaaggaaaguaaaauguaagaugcuucaaagauguagcauaccagggauuuauuauggaaggaguuuaaugauaccccagcccuggguaaaaaggaacugacgacguuuccuacggaugccaugcuuuucacugucaucuuguuaauauauaagcaagagcuuuauccuucuggcccugugucacuaguuccuacaucuguguacaaagaguauuuaaucucuccucaaggcugucugagaacuuguucuuuuucuuugggagagggaauguuucuauuacuuaggaaagagcuguguaaaaggacacccaaggucuggucuauagacagguuuguuauuccuugcuaagaagucuugacugaugcaggguauuugccaacaucuuuucuacuaacuucuggagaagguucaagaccagggcaggacuugauuccauugccaauaguucucacagguucuuuaugacagccauacaagccugagaaaguaggcaguacaaaguuaaguucuaaaaaauaguaccauguuucucucacuugcuuuuaccccagguugcagucuguugucugguuuagaagaucuuuucuauuacuucaguaccaguuucuacuuaggauucaguguuaaaugaaaacaaaaguggaagucaucuuuuugacuagucuauagauagccagaaacugcugcugaaccaagaggaaaagaucucuaacagcagacauccacacuggaaacacuauuugucuucuacaaaagcugaaguguucauugucccagugagaaaguucugauggcuuucuaaaaggaagaugugguugauagauuuaggcagauugaggguucuguuauuucugagugggaacugccaaguacagaauguuuaccaaaguaucagugcauguuugauuacauagaaaaccuuguucuagcaaaaguaucugcuguacacagcaagaaucaggaagaauaugggauguucuaacccugaaguuuuuuguggcauacugaucacugcuggucaggugaucauauauucugggaagagcugcuuauuugugacuuuagcauucuggacguuugugguauauagaauacucagaaagauuggaguuaaaauguauguaguguuuuucucauauguucucuuagaugacuuuauguaauccuuaaugcugaaaagaaaauuucucccaaaaauaucuguacaucauauagaaacuuugugagacugagagcuaauuuucauguuuacuaucuauuuuucuaugugguuauuuugccugucacaauaguucaugugggccauugaaaauaguuacagucaagaagacaaacaagcuuaacuuggaaauuguuaccagugacuuuaagaaccaacugggaggggagggagcuauucuucuguuaaguguauuccagcccuaaaagcucauauggccuuacaggcuauuuacuuuuugcuuggauaguaacauuuaucgcucgauauccugggcaguuuuggcuuauacuauuaguuauuugggacacuuacauaauuguguuuuauuucuucguaacuauuagaguaagcgagaucugugaaaaugugauuuauucuaaaauuggcagaccagaaaacauuuaaaagccgaauaaauaaauccuagaccuaucuuagggaaccuaucagugauggucugucuaugggauauaacaaccucauauauauuuuuuuuuacuuuuauuuuaguuuuuaguuuuaagaguaauuuauuauauauauaugaguacacuguagcugucuucagacacacagaagagggcaucagaucccauuacugaugguugugagcuacuaugugguugcuggggguugaacucacgaccucuggaagagcagucagugcucuuaaccucugagucaucuauccaguuuguuuugaggacaaguuuuuagauguaucucagugaugggauuauaccauuucuccugcccaccccaucuuguaguagcugcaugcaaccauaaaucauaaaauugauauccuugcuguguuagaacuuagauucucauagccaauuuuagagaauaacugaauucuauucuguauagagacugaagguauuuggguaaaauagacaauacugcccaucuuccugguuuuccuugcuauuaaggauguguuguccuggaaagauauuuaaucucauugccucgucuuaugaaggcccaacaucaaccagacucugcauagguccucugucuccuugaaacaggauuuauguggcucauccucaaguucaucauguauuuuucuacaccacaaguacugucuucaguguuaugcuacugguaauugaacccagaaccacauguguaugccuggaaaacacuaccaauugagccucaugccuaguugcauuccugguuauaagcaagaaaaggcauggcaagagacaguggaaaagcuggauagcacuuaaaaaaugaacaaacaaccccccccccaaaaaaaacgaaaaacaauaaacacaaacauucaucuguggccaccagcugaagaacauaccaucaagauuuggucaucucagauucuuuaaaaaaaaaaaagcucauuugcaguguuugcagacuuucacuuuacuuugcauuuuuggaagagcuauuagaauauauuucuguuuugacaacagauaaguauucauaacugcuaacuauuggcagagcaggagcuggauucagguuuucugauucucuguugagguucuguguacaacucaucaagaauauacuuucacaguauugccucaacugggguucuggggggcccauugucuuucagaaguaccagcauccucccucccaguguucugaccuugcuuucccacugcuccccugugugauccuccccaguccccauucuucuagacucugcagagugauguuagaaggcaagcccucguuauuauuaccucagugaaggauauuccuuuaauuagcccaagucuagcuuuaaguaccgguuagacguuuuugacuugagaauuccuucuugauugaaguagcuguaccagauggcagagggaaacuaucuuuuacuugaggcuuuucuuucacugcaguaauggcuuuugcuacaucugcauauguguuuuuguugagauuggggaccauuugugguaauugaaucuagguccaguuguaguauguuugugaguauuuaacagccaaaugaguccccagaauaucaagaugccagcuuucaacaguaggcacgcuguauguagaagagucacagcccauggaaauguucacguuugccaacuuugguugcugcugucugaggaauuuaaaaaacaaaaaacucaaaucugacuaaauugggguguguggggcacgugugcagaguuuuuaaguuucucagaaggaaaaauuacuauuaagggauauaacuggucuauuguuagagucaacuaggugaggaauguaaacuggagagucuugcugggauccucauuaacuaaguucagacccuagguacagacuuuuggaucucauugcaucuauguuccacagaaguuagacauaccagccuguguagggaaucugaaagguaaccgacauuguuacccauguugagaucuguauacccccauggacugauuuacccucuuucuuccuauuucuuuuuuuuuuuuucucuuagaagaaaucuaccccuguguuauagccaccugcaguucugugauugcucaggucauaggcuaaacuauucuuacauagcugaaaaaaaaaacuuaggaacugugcaauuugguuauuagcaauuagaacuagaaauacuucaacuagucauuuaauagcaccauugucauuuuccuacuaagaucuuuguuuucugugaaccuucgggcagcuuugaccuuauuuagaguuaguaaagacucaaaagagguuuguuauuucuuucauguguuaaauucagaaacaccaaaauaugaguuguugaagaaccugaacugaguggaaucuaguggagucacauaccuuugaagaauacacuuguacugucuuuacaugacuguaacuauuaccaccuggauauuuacauaaagugaauguagacauccucugagaauauuuuuuaugaagugcuacuuguuaauugaaaucaauaguguaguuuuugugaauugcucuguaauugcaagugacugccauguauuuuauguugcaguaauauugacuauaaaaucgccuugcugaauuaaugugaaaugacuaaaaucccuuuugucuucaguaaauuucauaaaggccuaaaugaugauuucauaauuugucauuaagucuugguguuaaucaaaaagggaagcaagaaccagaaggaccugacauguucagauuaucaaaacacugcauauauuaucgaggguucuaaacaguaagcuuaaucaacuuccuuagguguguaggaauaugucaacuucuuguccagucuuaacaguggacacaaagcuugggguuggucuucauuuaaacgaacaacuaaagguuuguguaugcauguaugcuuuuaaaaucauauucugaauauucauuuuauguaaauuguuauucagcucaaaaugcagaauuuacuaauucaguguauuuuauagugcuguaggucaagcccaguaacugaugugcaaucauuuuucuucagcuacaucacaagcuuuggguucuuauuugcuuauagcuauauuaugaauggagcaaagcuaucucuugugagagaagccuagaggaaacggugcucugccuuguuaaugcuuccaaucugugaccugguauggccuucugcuaacccagauaacaaauucaacuuuuauuuuugagaagguuuuuacuaucuuaacacagcuuaaaaaaauguuucugaguuuaaaucugcagaguucauauaaaucaaaacugucauucuucacaguauuaaaaaauaccguguuuaacaugggggaaauguuuuucauuuuuaaaguuauuugugauuuauauuacacgaguuuaaguagauuagauccuaagaaaugaauuuagaaauccuuaucuagccuugauacuaaguuaaauccuuacuaaaguugucuuuaguuagaguacugugccuucauuacuauuuuagacaacaugucacugcccaaaauacuaauuuuucuuuuaaacaguuagugaaaaucauuaaaaaauucccacuuauguggcucuguaaaauaauagagcacacagagcccuuugucaagguguauuugucuacauugcaaugacucauuuacuccacuuuguggaauaaaaaaguagcuaauugcaaga

SEQ ID NO: 1448 - RNA, 68606 nt, Mus musculus
cguugcgcugacgggucgcgggcggauacgcggccuucugaaccuucccugccucccugcucccggccuccagucuucagcucggccauggcucccaaaggcggcuccaagcagcaguccgaggaggaccugcuccuucaggauuucagccgcaaccugucggccaaaucgucggcgcuguucuucgggaacgcguucaucgugucugccauccccaucugugagcuucgggcgggcggcgguggcggcggggacguggcgggcgcggcggggaggccuaguguccggagcagcguccucgggaagucacucgcggcgugcuucugagccgggcgcggguucuggcccggaaucucuuuuugguacacugcccuucuccucaccacuguuggacacuaggaugucuuuaaugaaccgggcgggggagccacugauaaaccuucacugaauuagcagcgugacccguggcaaaccuccccuuacucccgagcauccuuuggacgugcagaaugccaaguuaggccuugcccgagguccgcgaucagccuuguuuaggauuucaauaacuccuagagagcagcucgagccuucucgauugaaugagaaacugcccacuugaaggccaaaacugucuccaaguccagguuuuccgaguuuccugucuccugacccgcacugccgcagugcugcaggccaaucauguccaaaaaaaguucuuuguuauuuuggccuuguaaaaagcucagcuugcagugaaugugguguggagcccccuggguucacuggcccgacaaagcauuguuuggauuucagugagcagccacgucagcaaguuaaccaaaguuuugggacagcgguugauuuaaaauggcccguguuuuaacuuccuaguauuccaugagugaaauuguuauuauuuguaauccccacucccaguuuguucucaaguuagaagaugaaauuucuagacuagcaauauccccacagccuaccuuucuguacugggaaagcccugaacugggacaaacccaguuuauugucuaucucaccucuagugaaguuuuucggauacugggugggauuuacugacucucauuuaccuggcuuagcuguagucuggcaugugcaauggggcagugauguugugugucccuugcuuuugucuuaucucaggguuguauuggagaauauggcauauggaucucauccagucugcugugcucuacagugugaugaccuuaguaagcacuuacuuaguagccuucgcguacaagaauguaaaauuuguucugaagcacaaguaaguacccuaaacccaaccccagucugcauauuuuauguuagggggucuuaaacaugauuuauaagcauuaguuugaaauguguauguaguuaaucgugaaccauaugacacuucuguggaaauagguuuugaggguggaguuugaauauucauucccagucuucaauugaugguuuggucagaaaaacaagucuauuaaaucaaugaauguuuccgaaacucaguggauuucuuucuagaaauuauuuuaggcugcccauuuacuaauuuuggaagcaaaaaauuaaaaauucucugacauuuucaaugccaguuacuuuuuuuuuuuuuuuuuuuaaucuuguaagucuauucacuguagaagacaacccuauuucuugaauuucaagaucacguauaagacgaauuauuuuacuagcuuuaggagaagaaaacccaaguuuuuuuuuuuuuuuacacaaaguucuuucuuuuuaaaaaauuuuuauaugaguauacuauagcuguuuucagacacacuagaagauagcauuggaucccauuacauauauucuaugagccaccauuugguggcugggaauggaacucaggaccucuagaagagcaguuaguguucuuuaaccacuaagccauaucuccagccuggaaaaccuaaguuuuaccucaguaaauuuuuauguuuuaagcacuuguguacucugcuuuccuaaaaauaaaacaggaggguguagcaggcuauucccuuauuuguucaauagggccuuuuagguuuuucuuugaaguauuauuauuuuuuuuaaaaauaauuaacucuuuuacuuuugaacugcgcuuguguguuugugucugugguuuggugugucucuugccugaggggccagaagauagugauagauuucuggaacuggaauugcacauaguucugagccaccugauagaggugcugggaacugaacucagcucuucugcaagagcaauguguacucuuaacuauugagccuucucuugagcuucuaaaguaauuuuuuaaaggcaguagguauuccgaucuuaaauuugucaucuauuuacuguuuuaaaauuucucacaguauccacacuugacuagaaacuaguuuuguuuagauugauauagcagucugcaucuggucucuugaaacaaaauuuagaguguacucugacacacauugcuuaaagcuauuugaugauacuuuuccuugcauuguuuauauuuuaugggauaaaaaaucacacaugcucgugaggggcuggagugguggcucauugguuaagcuacucgaugcucuuccagaggacucaguuucaauucucagcacccacaugguagcucacaacugucuguaacucuaguuuuaggggaucuuaugccuccuggucuuggguaccaggcaugccuguaguguacagauauacaaacaggcaaaauacaucaccaucaucuuuuuuuuuuuuuuuccaagacaggguuucucucuguguaguccuggcuguccuggaacucacuuugaacaccaggcuggccucgaacucagaaauccgccugucuguaccuccggagugcugggauuaaaggcgugugccaccaccaucaucauuuuuaaagaucacauaucuuagccaaaugucugagaaguaauauauugcucuuuaucugucauuuuuauuuugcuaacuaucucaauacaucauguccuucuuuuuucuaauacaguaacaccaaaaauccuuucugguccuuagauuuaaagucaucugccuccuuccugugaguuuagccuaagccuucagauuuagacuuagccuucuugcuuucuauuauaugucuguuauuucaagacccaguaaacuuuugcagagacuuccugacuuugcucguucuuugguuaucuuucugguuggcucuuauaauugacaaguacuuaguaguguauuaugauuucaguuaguaggguauuauuuaagggaugggccaggaguggccucagcugcuuucuugcuguccuucugggaggcuugggcuucaugacugaaguucugcuagaccagcagacucagcaggucaucuuugucaucuuuuugcuuggcagcuucuuuccuaccuguuauuucaagauucagcucauuugguccucuaguauucuggacuguguucuuaugggacauggccgccuauggauagagacuccaucagaguauaaccuuguaugacuguccuuuaugaucccguggcagcuuagccacugucugugcuuaccuugcaucuagacucuagauuuuagaggcucuugugguugaaucaagacagaaacccacugccucaaaugaaugaucuuagguguucuuuuggaguccaaccuaguuucuccaauuuuccuggguauacugacuaguacuaaauaccgucugguagugugagucacuugaacacagugacuaggcuuucuucuguuucuguguucucuccuguugggaugucauagugaaugcucuuauagugguaguaccauggggcugguagguacucuauagaaguuugcauguuguuacuuucucuucuauaggguagcucauauuugugaaaauauacuuuguugaauauaacugucuuagucuaugggcuuuuuacauuuuauuuaaauuuauuuauuuauuuuuacuaauaaccccugugauaaaauugauuuguaggcuuuguguuguuguugcuuugaucuguauacuuuuucugagacaagguaucagguagcagaggcuggacuugaauuccugacgcuugugcuuccacuucccaaaugcugggauuccaggcauucacuaucaugaccagcugaugagucugcuuuucacauacaucuccuccucucagaucugcagauucugaucugaguucuugaguucuuauucaaaccguuucugucugacguaguguuaacucaaaccaguggcuaauuuaacuaaaaauguucuggucagcuucugaccaugcuuuuacuauuucuuuuaaaugaaauuguccuuuggaauggaguuaaaagcaucuuuuuaagauaguuuguuauuuuucuucaugaauuaaaucaaauugucuauucuguaguuuacuuggaauugaaauuggaucauucagguugugaacgucaggaaaauaaaauguaguuacaguauuccuaauugaauugugcuaauagcauuugacuuuuauacccauauuaaauacuugagcuuuggaaaaugcuuccuuucaagcagaaaucaaaucccauaacuaagaaaccacauuuugagaaguucuugaacuucucuuagguuguguaguauaauaaacucggaacuuuuuguuuaguugacuuucuugaaauauaaagagucacucaguugacaguagaaaacacgagugcagaguguguuuugagacugacuuucaucucuagagcuuguggagaccuuuuccuuccuguguucucuuucagaguggcacagaagagggaggaugcuguuuccaaagaagugacucgaaagcuuucugaagcugauaauaggaagaugucccggaaggagaaagacgaaagguuugauugugugugugugucugucugucugucugucuguguguguguauacacauaaguuuacacauuagaggccagaagacgugucagguaucagguaguaguuccucugucacuuuccacuguguucuuugagggucuugcugaaccuggagcagcccacaaggcuugguggccagcaccuugucaucuucuguuuucucagagcuggaauuacaggacugcauucaggguguaauacaggauaacagguggggccauggcuacuggguucuuaaucugucucucuacccccuuugacuccuuauuuaaagugguagucagaaaccuugguaggaaguccguuuuuaaauucucauuaaagauguugggauuguguaaauaguagcaguggugaugguaauggcugacuuuugaauuguuaaccacuagaguguuuucuuugguuuauuccaaagaguaccuauauguaaaguaucugcuacauaauuccugcauuuacagcucaggaaucauugcugaagagggagcucucuaugaaccaaaggaacaggaaguuugcugugagauucucauccacuaaaaaugucagagaaguuacacucaugaaaucucaucaacacggcugacgugaacaaggaagacacugauagucugauguagaaggggaacacccaugaggccccagcccugacaaagagcuacaggccacuaggaaugcuaagagcagcagaaauaguccgucuucaccaggggagcucacacccauugguuauccaguaccaaauagucaggucugcaaacguaaacauaguaacagacagacagaacaggugguauuuauauaguuaggaauaggcaugacauauaccaucaccaccaccaguuaaggaaacggcugugaauuugaaagggagcccaggggcauucaugggaggggguguagagaaaaagggaagggagacagaugauauaauuauaaucacaggcacaaagacugagagaguaggugcuguugugaucuccauuuuacacccaaggaaaacaggcauuagaaggcuuggugacuuguuuguugauacauagauccaugguaauagacuguccaaguuggaagcuuaugccaguaacuguuuuacuggaauuuaggaagcaacagagcuuguauguuguuuaacccaaaucuguaggguacaggguauuauguuaacauuuuuaguaguuuugauauugaaauuccccagggguauccaugcauguaugaauacuugauacacugucugggggaaagaaagaacugggauuguccuuuguugauugagguuguggugguauguuuguuaacucucuucucccucccacccccaccucgacaccccccccccaaacaaaacaaaacaaaacaaaaaaacccuacauaguaugaacugccugagucccaaauugaugaaauaaauuggugcgaggcaagcaaaucugugaguuugaggccacccuguguaccagguguuuaauagcagcauggugcauaguuuacuuucauggaucuuaagcuuuagcacugugcuuugugggacuuucacugcauuuccuccaggaagacuuugugugagccuuaugaaguaauagaauuuuauaagaccaagcagcauuuaaaagcaaggaaagcuguuuaaaugaggacuguggaauuaccucuaguguuugagcacuguacuuacuugugagucagagugcucaggaagcaugugaggucaugcugguuuuacucugauggaaagcagcaagcaagcccugcagaaaggaaggcuuccuggcacuggcccuuggaaggacuuuaucaaguggauccuaauuuaaggaacaccaaguaacuuaaugaacaaugcuucuacagugguuuggaaaggaacugaacauuaacaaacugauuaucuucuuugaauacuuuauaaaaauaaggacucgauauuaaaauggcaaaaaaggccuguuguagggagcaguaaugaggguuggcugcauagcugguuuugcauaauuuugaguaggaauaaaaguuggagaaucuaacccuaaaagugccuuuguugaauuguguaggacaauauuaaauuggaguacauauuauuuuuaccuaaauuucagaguacuugacacauaaauuaagauuuuggagauggucauauuggaaauggcaaauaggucucagacuacaccagucugcuguguguauuguuuuuucuuccugggauaugucucaggauuuuuuucagugugguguucagguggucaucacaagugaguccaagcacugggagucccaguccaagaacugggagugagaccucucugucauuuguuaacuuagcuuuuucaaaguugucagguugauguauaaagugcauauuauaaaauuucucuugccaacaacagaaaugagugcuauuaguauuuucuucaaagauaguuuuacccaggucuagacucaugauuaaucuggauaacagaucagagacucauuaagauuugauaaguuguuuccagaggcuauguugcuuccaagagauuugauguaagaaaagaugcaacaguuugucuucaagcuccauugauaacuguuuuggcauguuuguauuuugccacucagggacggaaauaagcaauggcgaguuagagauucaagcuccgaagugggacucuucuugguuuccugaaacucuuuugacaguauuaucugcuuguaacaauuucuguuuagucuacucuuuucuccugucauaguuggcugucccugaagaaugauugcuugggaaauacucuccuaagcuaaauuuucuacuagugaagcuuuuguagaggcauugguaaugaauacauuuggaguuuuuuuuuuuaaauuauuucacaauaaccaguaugugguagacuagaaaugcuucaaagacauuuggaugguucuggcuuauguagccuaauguaacaugggagcugggguaucaucauggauuggaucgucagacuuccaucccaguuguuuuggaggugauucuguuucaggucauggcacgaagagaguuagggagaccugcucagaugucacugggaugauuuaaucagcagaauaaaagcauaccauagcucacugggucuuaugccagaguuaaaaauagcuguguugauucugaguauuuuuuagcauucaggugcagcuuacugugccugauuuccuuggagcagcguaagagugucuuuccuacaguuuagauucauuuagucuuugaaaucagaauguuguuggcuauacuuuaauguggcauucuuccuguuucccaaagaagaauaaauucauuaaguaggugccauuuauaagaucaaagauauagagcguauauaugagacuacagauuuuauagugaagauuggugaugcuaucuuuauuuuagcuccuguagccaagcuucuugaauuuggauuaaagcaugugcuaagguagaaaugucaauuacuugugguagugggugggagggcucuguaucaucugacuucagaguagaauaucuuccuggaaggacaaagcaucuagaguugggacuuuuaaucuuuuugacgaugacuccacagugaagcagccaaguauaauaauuuguacauauauacaaaugcuucuggaaacguagcugcuguaaucugugugguggauucucaacauuuuuuuuuuguuguuguuaaagaagaaaagucuuaacccagucaguuaacccagaucaguuuauuugacuucauacccuaccagugggguauaauuagucuuuaaaaaaugauuuuguaaaguuaauuagccaaguggaauaaaaucugcuuuaaucacaaacauucagaauauuaucuuggccucuuggauaaaaagcagauacauaugggagcauuuaaaacagauuuaaaaguaagaauuuuauggaaguuaaaaacaucuuccuuaagauuauauagauuccuuguucaaauucaguaaagacaacuaaagauagauuuggugaguuugugacuguauucuuggcauuaucucuuuaggguguaaaacuaagagcuuaagcuaugccucuagagaagauaaagucaaagaagucuaugucauaucaaccauugagaccaaguuuuaagugcagcucuaacuaagggcaucaaccuuuugauguguacgugauaugacaucauccauaaauaggcuacaucuguagcagcccugggacacauauagcugguccacaggccucagguuggauagucccuuuucugggacucuuaaacaaagaugccuguuuuaggagcuuacaaaaugaugucaguugcaguuaguaucaguccccucuacugaagccuuggcuguuuggagaaaugguaacacacccaguaacuguuaauuuagcaucaauaagaaaaacagaauucaguagaaaaaaggagauaauuugcucuaaauuuaauaaaugaaaaugcauuuucacccuugaacacaaagaaagguuuguuuuuuagugaaugagaaccauuugguaugucaagguuuuggucauguuuauaaacuuacuugacuuguaucucuagaauccuguggaagaagaaugaaguugcugauuaugaagcuacaacauucuccaucuucuauaacaacacucuguuccugguucugguuauuguugcuuccuucuuuauacugaagaacuucaaccccacaguguauccuuuagaaaguuuuccuauaaacaguaguuuguuguguuuuuaagcuaucugguaugcuuguggaaacagaaacuuaccagacucaguuaaauaacauuaacuauauguaggugucuguggacuuagagcuuaagaguuucuggcuugacuuaguguuuuuuaaaucuauaaauuguaguuuuaugguaaauaguguguuauaaagcaauguuacacugucugacuucgucuaccuuccugucuacaaggagucaaagucagaguaaaugugcugucuucacugguucugucauuuaugcuggcuuuggggguuaggugauagucaggguaguuacaaaugcacaguuuauaauaucuucauaguguucaagaugcuuuuaaauugaacuuuggccaagaguuauuuguuuuuuuauuaaaguaauuuuuuuuuaucaaagguauuauccagaaaagcacagccagacuuuuuaauaaucagagcuuaugguguaaugaaauaucagacacuuuccaacucaucuuuugggaauacugguggaccuugccagagugcccccaacaugguuugcucagucucuaaguagccaggaaccuucagaaccuccuugccuuauaggcugacugguagcagcacgcugauugacuagagguuuccccuuuacuauuuugcuugucugcaugcucuuugaccaguucuuccaugaggguuacauggaacuaggauguguucuuuguuauuauuuguuuuaaguuugucccaagugucuuuucaguauugaagcauauugcuuguagguauuuugucauguuuauagccucccaugcuguagauuguguuuacugacaguccaacuacaucuacauauuugugucaauaaggaaaagucuuauuguuaaaaaccuaauuuagggggucucauuuuuuuuccuuaacauuaaaucuuacagaaacuacauuuuguccauaagugcuucaucuggacucaucgcccucuugucuacuggcuccaaauagaccauguagcuuggcccucugccuuuguaucucgggguggccugugguauaugggaaagcaucaggguggccagguugggagacacauaaguuguuuuuauagucuggagcuucaggguuuaaaaaugcaguagaauguaauucaguguuuguuuauuggcuguuuuugacagauugcugaaauuaaaugaauugaaagggaaacucagaguaccagggcauuuuauuaaaaggcaaggagucuugcaaugugcuguaaucacgaggagaaaauaacuuguuuccuacaucugucagaggucaugguaaccuggacugagcuguuauuauuuauaauaggaggaagaaguuaauaacugguucucuguguuccaagcacaauauuacaacuuuucgaacuguaaaucuuagagugaauccucuuccuaaggaauuaaacagaagccucauuuucuuuuuaacaaggcuucaaauuuguaauuuauaauaacucaaaguuaauuguaaauuacagggccucuccaauuugagggagggaaacuugcagaaucuuuuuuuuuuuuuuuuuaaaagaaaggcagccaagguaguuaccuaaaaauaguacccaggccuaugaguguuggccugugaggccaaagcacacacuguucagcuguauggcuuuggcccuggguggccgggaggucagcuugacccugccauguugguuugaugugcgaagucacugggaucauugugucuaugaccaggcuuucgcaccacaggcagaauauuaagugagagaguauuucuacugugauuauugacacaugagagaccaaaagaauuuuugugaacguaacccuggaauucuuugggcucuccaaagaauuuacagugguuuaaaaugguugucagcauuuuuccaugaggacuuuaauaaacuuagccccguuugcucaagguuccuuuuaauugugaagugcugaucacauacauuuuugggggggucuagcaaagaguagccucauguuguguggucauaacccccacccccccaugucuuuuccccacucauuauguacagauucugauuuuguaugcaaugacuucacaguuugcaaagugcagcacuaugaucacugauuucauauuccuauuugccguucaccacacccaagaacuuucuguaaagggaaauauuacuaauaucuaguuucugcuuguaaacuuaagaggaacauaugacucuauuuuuaacuuuaaagauauuuacaaggaguagagcuguuucugugcugguagauguuucuguggucugugcuacuuagggaacucaagaggagugcacuuguauagucauguuacuccuuacugucugccuggagaaucauuuuaucuccaaguguucaguucuuuucagugauacauuguuaccugagugucauuuccagguaauguggaaugaauggggaaaugagaagggauucaaagcaaaguacauuucaguaacacauaugagguaggcuguuuuguuguuuuauuuuaaucaguauuuggcugguaaaaugauaauuugauaaaccaucauguuaccaaagcuaaaccaaacuccuucuaagugacugcugugaacuugccacuagguggcggugccuguguagcuggggagaaagucaccaccuuuaucuuuaucugacaguauggucagaagcucaagaaaucgggaugucagccucaaauuuuuaauuuuaaguaguaaccaaaaguuuguugggagagugauuaugcaguuuucuucugucuugacuguuuccugcgacugucuuuguuuuuaacucugaacauguucucuaacucugugcuaccacauuucugugugugaagucaugcagccaguguaucagcccuuuguacuuagaaguguggccccuccucucuagccucuucuccaccauugaacauugcacauaggauuacgaaguguucaguaagacagugaaaucuguggcaggcagaguuuguaccauaaaaagaccccauacaucacaccaguaaaauaggacauucagagugcucacauucuuuccuuucucauaugugugauagguagacucuuaguguuaagaauuuuuauuucacgauuuacucauuuauaacuuaauagaagucuuggauuaaauauacaacuuguacuguuugauauauuguuuuaauuuggaaaggauaauuugaaguuaacugaaaugauggaaguggaauuuauacucugcauuuuaaaaaaagucuuguuauuaauaaguaugauuaaacuuuguuuuuaaaaauguguuuuguuuuucuguaauucuuuaugugaaccauaagaguauuuauuacacacuuuauauuagaccucuuuccuacacguguaagugcccuguugaagucucuggccagaugucugagacagugacaggcguagcacaguuacaggaaggaacaguccgucccugcccuagugugcugcugugugccugcugggccuuccuaccaggcauuauguuaggaaggauuuguaugaauguacacgugugcauguaugaagaauaccagcauaucguuuauuucccaccuauuuugaagucuuaggguaguuaauaggagauugggcgggucuuucauuuuauuuaauuuuaauuuuauauuauugugcggguagauacucggacacaugcacaauagcugagguagagaaaauugggguagcagggcaagugugucaucauguauacaugaagaucagagacuauuucguggaguagguugucucuaaaaacaacaacaacaacaacaacaacaaaaaaacccucauauaauugaguguaaaaacagcccuauaaagaaaaaagucuuuaaagagcugugggcuagcauacagggacuauggguuguaaugaacuagcaguuugggucaguuucuuuaucuguccugaccugaguuccuuguuaugcaaguaguggcuuugccacuuagguuccuugaagcagugcuguugcugugugcuugaaugauauuuggcagucuaugauguuucuaucaguuccugaaguaggaauccaggcccagaguuuguaguuuguauuugucuugcuugagaccaguaugacuaguuuuuugccauggaguuuugaagaggaaauuaguaaaugaagcuuuucuucauaaggguaaaacugaaaugcauuacucaguuuaccuugguagauauguccaaauuggcugcuuccacagcuaacuaguguugcccauguuugguuuaaauuugcagcugcuuucaagaggguuugagaaccuucaacuuuagugugcaguuuuccaaaauccacugaaaggaaaggaguuugcaaaacauuuuuuaguuuucuuguaagugcaguccaagcuggccacaaacuuaaaacccauccccccaguuucucaagugcuaugauuacaggugugugccagcacgcaaagcuugcagcacaaaucucggucuuuuuuucuuuuuuguugggaugguggugguugagagagugucuaacauaucugaacucuggauccugugcauucuguuuccucagagacgggaguuccuuguuucagccuguuuuuagucacugugacuucucuuaagcauucaguguaguauagcuuucaguauaauuuauuuaggggauuauuguuuauuucauggugacauuuuauuuguauuuuauaaugaaagacccaaaagauguauuaugagauugcagaugccuuuauuacucuaagcaaauaaauugauuuuuauuuagacagcacuccacucauuuauacguacaguaguucaguggauuacauuuacagugaauagauggaaaguuagcucaucucuaucauuauucagauauucacgggugaaacucccaaguugccugcuggaggcuagcuagguagucacaaucauauuucuugguaucuuucacugauaguuuaagauuuagaacuuaaccaugugguacauauccgaaaaugauuuuaaguucguauauuucuuguguaaaucuuaaagugauggagaacuugcuaacuagaugaaguagaauguugcccaucuauaguuagacaaauaagaguuagaaaaugaccccaccuuuacagaaaacaaaacaacaacaaaaaccccuugugucuuauccguauuuacagauagccacacaguauauauaguuuuacaguuuuucucaagugggauacagugaggggaauuagcccguagaggcagagcuaaguguaucucagauucugagugcaaagcuaggccccuuuauuccaugcaaagagcuuucaugcauaugguguagggugugauacaauucgaaccaggagcuucuugaauauuuugcuuuuucuuugggcaaguuaagucaucuagcaugugccgaggaaugagaaaaaaaauguuuuuuugucuuuuucuuaacaucgccuaugauuuguuuucauguuaauaacuucagaaaauuccaagcauuauaugauaaugucccaaugguaaauugaacacuugccuuucuggguauuuauagguuuaauuacaaaacugaacauguauguauuuuuaaagucaaauauuuagccucaacagaaguugugccuacaagcaauugaaaguaaauguaggcuuuaauagaaaguaaaaaaugaacacuuaacauuuuauuuaaagcuguuuccauaacauugugaccuuuuuauaaaucagcauuauguaucuauuauguaucuugggauagucaugccuuuauaacuaugcaaauggauauguuagaacccugagagacaccccaguuaaauuguacagggccaggcaacaauauaacuuuagagauagugaaagcaaauaucuagaaauuuuauuugaauaucaggugacauaaaacuugcuagugugaauaugaaauauggggggaaaaaucuaguucaguuuguucucccgagcaagacuaaagagugaggauauccuguuuccuaugcaggucauauacuguaucuugugaaauuuguucuuuugaaaaaaauauauauguacagccuucuucugaagauaauagauuccccuaccccagcauucuuuccauugcaaaaacaugagguacacagaccagugccaggguaggggaccaguccaagauaagaaaauagaauggauuuucuggcuugugaauuuucagauguguucagaauucagggugcacagugguagcaacagcagaaaccucagagaauccugggacacuagagguugagcagcaaacugcuaagugauugaaaagaguggcugguaaggccguucugcacugccuacccaucaugacuuuacccaugcagcuuaaguggcucaugcauugccuuaugaucuauaguccuuuuugcuguagggcuuguugcgcaguauguuaucaaucucguucaccacgugagaugucaucuuagggaggaccugaggguaggggagaagcacagaggguuaggguugcgcauuugucuuguggaguccacauuaagcagucauuuauacuugcgauauguuugcaagccauagcugaaaugaagauccacuaccccaugccccacaauggauaagcuucaagucagggauuguguuuguugacuaaagaaaugaagacauggggcuggagagauggcucagcgguuaagagcacugacuguucuuccaaaggucuugaguucaauucccagcaaccgugugguggcucacaaccaucuguaaugggaucugaugaccucuucuggugugucugaagacagcuaugauguacucauauaaaugaaauaaauccuuuauaaaaacauauguauuuaaaaaaaaaggacuaaagucucaugaauacagaguagcuuaaucugguagaauuucaguguaagcaauuuauguuuuaauuuuucuagcagguaauaaugcugucuuuaaaauaauagaauuaguacauuuuauuacauuguagucagccaacacauuuuuacuuaguaucacuuuaaugugaaaauuaguauagaaaauuaagguacuuuugaggguaguacuaaguccuucaaguccuaugaauauacacuuaaguaccacacucgggugcacgcacacacacacacgcacacucacguuuggaagggccaucauucguguauucagauagucgcauguggcuggaagcugcggcagugguuagcacugcagcagugguuagacugggaauggaccuuccagcugcugcuuagaacugguaaaggauguuugcagcuuaauaggccucccagauagauggaacagcacgcacaugaacagugaaguggauaccaaggacagacuaguggagaugguagggauaagggaacagaagcuggaacguguaagggagcuugggugccacuuuauaagaaugaaaacaccauucuccaggcuguugugaaaccuaaggcagugguucucaccuuucuaaugcuguaucccuuugcucuaauucaugcugugacccccaaccauaacauuauuuuuuuuuuuacuacuucaaaacuaauuuugcuguucugaaucauaauguaaauaucugauauauagggcaucugauaugucaccccuuugggugucgugacccacagguugagaacugcugcuccaaggacuugcuuucccccaucagauaccagggaaaaguugaaggaugaguuggaggagccugaaagguaucugauagucaaagucaaagucugagagacagugagggagacuuagcaaggcuagugauaguggaaugggaaaggggaacugggggugggaucagugugaaguaggauguguugugugcauguggagcauuguguagagcugacuuggguagaaucugcugcucauucagggcuaguguuauaccaugagacaagggacaaagaccugcuuucucucuggaauagucugacccuguguagacagacuggugagaugcaauuaggaugaccaguucugagguuugggccucgcccuuugcugcagcccuacuggccgaggugaccuugucuccagggcugcccuuagcagccuguggguuuggcaaaauagugcagcuccugugucugggaaacuugugguucugguuauugguuuuuuuuuguuuuuuuucuaccugaagucaaaggaggcguuuuguuucccauuagcucuguagucucagguucuaaauagcuaaaguuacuuggagacuucugagacuggaguucaaaaacuggguuugguggaagagaaauccaguggacuagccaugugaaaugaaaaaagagucacugucaaaauaccuaucagcuagacacagugaaaacauaaaacuacuugaguaaaauaugaaauugcaguguguguaguauuaaaggaccagugucuuuuaaaggagccauacuuucagaauuuuaugugaaaucacuucuaaaaaaacgcagcagguacuuuacaauauuuuaagcuguugugcagauuuaaugagauuguuccaguuguacaaccuuauuguauugccuacaggacuuggugguguaaggggagguuuggcuaggaauguuuuucuggggcugagggucaucagggccuccaggacugaguucuuugaggaugauggaggauuuuugcaaguuggguggugauuacgguggugauuacuguagagauagaacauggaccacugcuaauuugcaugugugugugugugugggguggggugaggggggguuuguccugaaguauuccuaguggcuagagauuagaauccugauuggggggaaguguggggggaggggaggggagggagggagagagagagagagagacaaagagacaaagacacagagacagcguacaugugcauacaagaauguguacacacccguggcauaggcauuuuucauugcucauacuuccacaguccuugagaccuuuccguucuuuaugguagccagcauuccacacuuucuguacauuugcggccaauuccaacaaguguuuggccucucuagauaccuaguguacuuuucaccacauccagggcuucugucacaccaugucuagacuguucugugcugcugcuuggggugaaggagaagggaaguuugguaaggccuugugcuagcagugaggcugucuggguaacagcccuguccuuugucuucugagaauagaaauuccauccugcugccagccagagccuugcuagggagggacugcuuugggaguuaaaguauccuuuccucgcugcccaggaggcuccugcagcucuaacagcuuagacccagggugcugcuucauuucugccccuggcaugacuuccccugggauugaggaucauagugcuagcaugauaggaauccugcauuucucuuccugccaggauuuuuaucuguucuucccagaucugcagauccauccacucuaccuccauugccuaggugaugacuacaccugcauccugcuuuccuuggggcagccuuaggaauuccgggacauucaaauagaagcaugucuguccucuacauuuuguaaaggauuccucaccuauaaggagaaggauagucuggcauaagccauguacccucuugacgagguccuuuguacugcucuuucuuguuccuaaaauguacuucaagguuucuuuaugcuauggcaaggcauacaauccaaacucagaauaaacaucuuauagggagggggcuuuugcaaaguuaugucaaguagacccaccuuucucaguugcucucuaguguaacaaucuguuugcuuaauaacucaugaucugaaauuuuguucauuuuuauuaguccccuaguagaauguaagcuuguuaaagacuggacaguaucuuguguccuguggugguguugucaguaucugguacaucgugagcuuucagaggccagcuuuuuuaaagcauagguuucuuaauucacucuuuccaccagcaguuuuaggacaggaucuugcucaucacaguaacccaacugucuccuuggugccagaugcaggaaguauuccaaacacgagugaaauugaaacuuuuauauugaacuuaaguucuucuggguacaaacuguguccuuuccccauccucauuguguaaucuuguuuucccagugcauaacagaaaaugaaugaagaugguaugguucauuagaugaggcauucccuguaaaggucccacagaauccaggaggaaccauggccgggcugaauuuggaaauagcuguggaguauugccccacugccugguccggcgaaaggugguggcuaggcaggcaaucuguaccauuuacauaccaguguauucugguuuuucucacccucccugcccuuucucucuuucuuuugagacagggcuuuucuauguaguccuggcuguccugaaacucccucuguggaccaugcuagucucaaacugacagagaucuacauaucucugcugggauuaaagguguguaccaccauucuggucuguuucuaaaaggggguuuuaaaucuucauguccacguucaucugucugguuugaggagaggugacagggcuuguuuuaggaauagauggauagccaagaagccaugagucuguucccagugagcaacagggaaacauguuugcugguuuuagcaggcuguggcuaagcagugggugaacucauccuaggacucagcgaagcugagaggagcaggcucagcacugagauguguucagugcugaagaaaggugaucccaacagaccaccagcgccacuccuuagaugccccugaucaucuucaacauauuccccaggugcugcugcaaccacaguccagcgccuggccuucagaccaucacuugggggacaggaucuugguauggaauaggccuccuggauuuucuuucuaggggaugugauccugaaaguuccaaacaggaauuuauucuccaguuacuucuggaguaauaacuaagggccacguaguaggaagugggaagugaguggagaagagagccacaggucucugaccuuuaggcucacaguacagcagagggcacagacaauuaucaugcaucuuacacuaagugguaugaugagugggaucacgggaugcuguuagaugguuaggaguauggcauaguauauuggcaauaguuuauggaaggaacaaaugaacacacaguauguauuguccuauagccauuacaucucaagcagacaguuaaacaugcuuuuaugguuagacuuaucaguugccaggugugacacgggagugcaccaccccacacagaugauccgcuggaauuugagacacuuguuucuuaaguaagcagaggacagccuggguucuguguauaauguaaauguguuguugcgucuuacaacuuuguguuuccugcuacuuugucuaguucucugcuugcaaacacacuguaacauccccuggaguuugcuagaaggagaaggggcugcaguacuugccugaauggcaccaagguuuucaaugaguuguuccggaguggaugaucccaggagcacagaacucacacccucauuucucaggcaccacgcugaaaagggcaaagcacuggggucaggauuauugauacgcuuguaguuaacguguguguguguguguguguguguguguguguguguguguguguguagguuagaggacacacuguuuucugggcuuaaauauuagaacagcacccuuuuccagaaguuuaauagaauccauacauuugauaguacguuuguggcuuucuggcuuucuuguauuuugcuccaacuaccaugaaaauacccaacauugcucaccuacuuauaaugucuggaaucuuguuccugccaggcucccucugucuuauacaggguaucauuuuuccucaucugucagcccuuugcauugauuaucucaauugcuuuuuuacucucaaagccccaguccuuccucugcuuuaguaaaucccauaaaaacccaaccuguguuuucuacuuggggcuaguagaguaaaccagagauuaccauagaaucuuauagucuggcaccucuuauguccccucuccuuugcuaucuugccauugggccuuaaccaggcugacgaaccucucuuugauccuugaucauccuuuccucaaaugacauaaggucugcccuccuuuggagcuguuugcuuuuuuauuuuuguuuguuucauggaaccgggcugaucuccaacuugcuauauagccugagauuuuccuuccuuuaucucaugagugcuggaauucuaggcaugagcaaccauguuggcaggaucucuacccuaaagccuuguauuuacucucagcaggugaccuuccucgaacuuuaucuaaaauauuaaauccaccaaggugaugguuuguauaugcucugcccagggaguggcacuaucagaaaguguggcccuguuggaguaggugugucacagugggugugggcuuuaagaccuucauccuagcugccugguagccaguauucugcuagcagccuucgggugaagauguagaacucucagcuccuccugcaccauuccugccuggauacuuccauguucccaccuugaugauaauggacuaaaccuuugaaccuguaagccagccccaauuaaauguuguccuuauaagaguugccuuggucauggugucuguuaacagcaguaaaacccuaacuaagacaaccagguagaauauucuucauuugucuaccuacuuaguacccacaaugauacuguccaguugcagacgaugcaugcuguuuuggccuaaggucaaacugcccuggauccuucuccccuuuuuuuuggauuaauuaaacauuuauuucucugcucccugaagguuuuguuuccuguuuuccuuugucaguaaagaaugcuccauucauuuucacuguaaaguagucucugacuuuguacuugcuuagacacuucucuaacucuggaaguucugaacggccaguuuaggcuccuggucuggccuucaucauaguccaguccccucuuacccuguucuggaagccaaggccccagcgaccucuugguuacagugaauguaaccaagagcgugggucugcauguuucugcuggaccuucccgccuugcuuugccaguuccauuuggcucagcgucagcaucuuugccucccuacuagaauucugggaccuuuaggaauuguccuuuuuuucugagucucccuucccuuuuaaauuccaggucgaguugguuauuccucguguuccccuaaucuauugguucuuacccuuuagcauaugauggggaguuaucuggagggccucuguagcauccuuucuaggccucaagagcuuuuacuuagaagaucuugccuugagauaugggcuucuacguauuuaguugauaacauuuuuuuuuuuuuuuuuuuuuuuguucaagcuggccuugaacauuuuauguagcucaaggaugaccuuaaaguucugacacugccucugccuccugagcccugggauuagaggcaugugcuaccaucccaggcuuaugagauacugaggcaagcauuuuacauuugcagccugggaauuuaaacugucuucuuaagaggagggagaggaacaagcuuuauugaacuggaaauuacauauaaaaaagaauuuagccuguuuuuuuuuucccgagacaggguuucucuguauaucccuggcuuuccuggaacucacuuuguagaccaggcuggccucgaacucagaaaucuaccugucucugccucccgagugcugggauuaaaggugugcgucaccacgccuggcuugaccuguuuuugaguguucauuaccuuaaaaaaauaguuuagcagcccuagcaauguuagugugcagccauuaccguuucaaauucaguuaguggaacaaucccauaccugagaaaauaccuaugacaggccauaacugauaacaaacuucagcccuacauaaucacuauuuguuuuuagaucugucuuucugaacaguucauuuaaauagaauaaagugcccucaucuuuuguguuugauuucuuucaguuugcagcacauguuuccuuguuuccucugugguguaacaguguaucauuucagugcugcauaguauuugacgguguagacaccuggagggucucugcucugacucaucucucccaugccgcuguacacaauccauccucaggagcucuguccaaucgcugcuuuuccuaccuuuugcuucagcugccccucuguuaauauagaugcccuaggccuagcugcagcuucucuaaguuucaugaugccacuuuccugacuucagcuugugccuaacaagauccuuuuccuuuaagaugacauguauuucuuacucugguaaaucuuauuguccauucugccucucugccuuaauuuuuguucuucaagaaaacuaguuuguugaucucucuauccugaaauaucauacuggcuucccuugcugggaauagggagaguccuuugccuggauggcacuuuuugcccucacuuuuucuuuguccuguuaauaucucauccuuugagguuccuaauggucuucugccuucuuccuaaagccuauccuaaaucacagaccaaccagugugcccauaaccugcacugaaaucuguucaucuucuggauaugcccauuaggcugugggauguggcuaucuugaguuggaugcucagcagccuaccccauccuuggcccaugggacacugauuaaacgcuugccgggaagacaggucuggaugauugcuucaucuccugcacaucugccuccuuuuacucaggccccacucucugucagcugauccucuaagcuguuaccagggcuccgaggcaaucacugaauccuuccagguggucauagucagcacccucucuucccccuuggcuuucuugcaguucacuuugcacuuaaaaccccguuuggaaccagugggaguuccuggucaaagcgaggcccuaagcaguugcugcuguagcagcuaauuccuccaagggcuacagggcuaagagaacgcauucugucugcagagcuggccgauccauggauagccccugccugcagcugcuucuuuacaaucagccugucucccuggguaucuaucacuagcaagcacacgcacagugccuguuagcugccagugagcuaggagugcuggcuucugggcaggugugugcuggggaacagcaugcagacucaaguagucugucuuagugccggaagguucccuucuccaggucccgccugccccuggagaccaaaggcagugaggcugggaaucaucccuuuuuggggucugaaaauucuguggauagaaauuacuuguuuguaaagaaagaagaaaacaugacaggaaagaaaaccauguagagcaguggcucucagccuuccuagugcugcggcccuuuaguacaguuccucauguggugaaccccagccaugaaaucauuuuuguuguuacuucauaacuguaauuuuacuacuguuaugaauuguaauguaaauaaagauuugauaugcaggauuucugauauauauauauauauauauauauauaaaaccucugugaaaggaugauuuaggcccaaaagggucauaacccgcagguugagaacugguaaucuagggcauaguuuagaaaggaaugggaggaaaagccagcacgugucaguguaaaccuaagcucugugcaaaggauguguccuaaauaucuaacacccagugaaagucuaaauuuuuaaaaaguuuucucucuaggaagauaauguucugccgcuucuuguagagucuaauauaaccuucuugguauucguggaagaucaguucuaccuucuccccaaagcaggagcacuccacucuguuuuauaaaaaugucuuggcauuugcauauauguucuccuguauucuuaaaaucaucucuauauuacuuauaaugcccaguacaauguaaauuguugguugacuucauggucauggaagucugagugcacucaauucaugucacuaccuaaaaucuuauuuacaguaguagaaucuauuuuccuugugugcuaaaaccucaagcccagaaugucuaguucuacccaauauauccuuugucaguaucaccauccuuaccgcuuacugaacuuacguguacccagucuuugcauguacaauuuuguuucaguucaagcuuauaagguauaaauuauauccauuacccaugagaaagucaggccagguaacuugucuaugaucagccacuuugcuggucuugcugaagcugcagauacugccuuaaacccacgccuuaacucuucuaaagaaagcauuaagguggccccuaaggccccgugggcauaugaugagccaccucccuucuucacucacucagugugaggguguucacguggucauacagcagccagagagcaacucuaggaguccgaucaaccaggucauuagccuugguacuccaucucuccaacuuucauuuccacuguucuagaacuguuugcuguaauuuuuuaacuucuaacuuuagcagagccaagcuaucggcaaauauucuauuacuauuugcacagaccuuaccacuggcuguuuaucucugugugucaauguaucuguguuugguuuuuguuuguuuguuuuugcuguguuuuguaguuauuuguugcuguuucuuauuaggacccucuccccccccccccccccgaaguuaacaccgauuuuauugccaugccaguucuaguaaaucaucuagugacauuugcaagacaagguuccuccuagcaugcaccucacaggauuguucaaagucuaagagucaaagaagguacgacaaugaacaugaagugcauauaacacagcgugcccccccaucaccccccccauaucacccgaaaguuugacuguuccuguauacagugugggagccauuaaugugugaaugcugagcccauggucaggcugaagguacuucagaaguuaaacacacgcuguuuuuuuuuuuuuuuuuuaaaaacaggcugaaaaacaguauuuaaaaaaaacuaaguaauuuuuuauauuacguguugagaugguaauuuagauagauuguauuaaauaaaguggauuauuaaaaugucuguguuuuauuuuaaagcuuuuaaaaaguauuugcuaugugcauauuuguguauguuugcaugaauguaugccauaugucuucagguaccaguggaggccagaaaaggguguuggguucccuggaauugaagucacagaagguuucgagucacuggauaugaguguugggaaucaaacucugguucucuggaagagcggcgaacacuucggcuccuguuuuucuuucuuaauauggccauuggcaaauuugaaaagaaauaaguaguucccauuauguucuaauggacagugccagugcauuuguuuuuuggguuggccgugaccuuucacggacuccacagcaugagaagaacaauuuucauggcuguugaaaaguuuccaggagaagcugcccuuguggugucaucuuucaguguggcaggagccaacggccucuuuguagcucuauuucucaaucucucaccaacccugucuuagugucaacagggggaggaaccugagccagaagaaauggaugucauuguguagugacacaauuuaccucagacacuggagauguguauauauuuaaauuauuuuuuauauaauguuuaucauuugccuccuccugcaagucuuaccagauccucucuagcugucuacccacccaacuuuguuuccuuucuccuuucuuucucuucuuuucucccucuuucccucuuuuucucucuuguacucucauacuuguguucucucucucugucucugucugucucugucugucugucucucucucuguauuuucacugauauauucucaugcagcugucuuauaaggaagaaaggaaagaaaaagaauguagcauauagaaaauucugggaaaccucgaauaauccccuuucucuguuuuguguaccagaauuugaugcuucugagguuagccugucccuaugguagacauuuuaccaugacagggugugggucaaccauagaaaaguaugcuuuuuuagucauaucagugaaaguaacccccuaaugcagagccuggucugccauccccucguaguuucuuacccacagccagcugagguagcgugcaccccaggcgcucagcgauuggagagaggucuuucagcuuguuuugcuguuuucucccuucuucacuuacgauucuuuccuucaaccacugguagcacuggaaauuaugauaacacacauaagucuuauaugaaugggauguuaaaucaauaaaauauaagaacucagguggggcuggagagauggcucucaccaguuaagacuguuuacugcucuuucaguggaccugaguuugaguuccagcaugaacaucaggcaguucacaaccuccuguaacucuagcucccggaggucuaaugccuuuucuggccuccaagggcaccugcucucauguggcacacguguacacaugcaugagugcacacagguacacacagacacacccauguauacacacauagguucagcuuucuguucagagagcuggcuccccugaaauaucauagcuuugcauuauuguuguaacuguucucccuguugccuuauuucaccccaaaucucauuguuauuuaaagauauuuuauauguguguaugugcauauauguguacguggccuuggagacaauaagaggauguuagggcuguaagagcuggaguuacaggcaguugagagucguccacuauggguucugggaacugaagagagguucucugcaagaguagcacguguucuucaucacugagccaucucgccagcuccuuaauaccaugauacgauaauuacaauauuuacaauaauaauauuauuauggggacuuuguguugacuuccucuugugguuuguuuuaaugccacaaauuagaaucaauagaguauuuguuuaaagggcaacccaggaaacuacucuuuaaacaugggaauggauugagcaugacccuguagcccagugaaugaguuuacuucccucaguaugaaaagccagucaggguuuuccacugcccuucuuugcagaaggcucugcuccuacagaagauggaaauuacaucccugauguacaaggcuagcacugacuagcaacagccacaggguaagacuucuuuuccuugcaaccauggagauggaccuucccagagggagcaggaagcuccagaguuggcagugcgccauaggaacuccucccacaugauuucaauagacugcuggcuuuuguuuuauuaaguauuuuuucaucaccaaagaaaaggauaaccacauuauguuuuauugugauuuuuggaauaauuuuacagaugugaaaaccaaagggcaaguugcccuaguucugucugcucuuagauauccaaggcuuauaggcuggccccucacuugggacuuugcuugggaaaauggccaaggcguucccagcuucagccuugagaagucucugguuuuuccagaggaaaggugccugaagugacaucuccagagaugacagcuggggccaauggugaugggguggauggcugugaacuacaagcguaugaucaggucccaggcagccuucuuaaaccugggcacuaccuaugucagacaucccugaauggcuacagaugcuuuaagugggaaaauaucaucaaccuuuacuuaaauuucauguucuuucaggaaagcugcaucucugauuaugacucaaacacaaaaugagaaaguaguagaccaaugcuuuucaacacuuuuaaaaaguagaguuuuugagauuucaauauguaucaggcacauuaagaauguuugauuugagcagggcguggugcugcacgacuuuaaucgaagcacuugggaggcagaggcaggcagauuucugaguucgaaaucuagccuagucuacaaagugaguuccaggacagccagggcuacacagagaaacccugucucgaaaagccaaaaaaaaaaaaaaaaaaaaaaaaguuugauuuguuuacucuauuuuugaaauauauguaguaaguucuuuuucuuaagauugaaacacugugugugugugugauaugcacuuaaaucaaccauaucggaagacuucuaaaaauaaggaggacugaccuggagacauggcucaguagguacacugcuugccuuacaagacagaagacuggaguuuggauccgcugcaccaugcaaaacuggggaugauagugugugccuguaacugcagcacuucugcagugaaaaggguggcagaggcaggugaauuccgggaaccguggaccagccagccugauguguguagcagugagcaacaaaaagagacccuuccuuacacuaugggaggugaagacugacaccagagguuguguucugaccaguacaugugcacaguguaugugugugcccacacguacauacauaaacauuuacuuauugaaucccugucuuaucacucucaauauuguaaacuucacuguuggccuaaucaguagaauauauagggaguuaggguuuuacaaaaguguuuacacauucuuaauuccaaaggaaacaaugguuuuguuguuguuuuaagaaacagcuucaauuucuguucaaaggggaaaaugcuaacagugggagagaugaaguauaauuaaaauauuaauuaaauaugaaaguguuuuuaggaagguugguggcaaauacgguugccaucugguuggcacagugcugcggguucuguugcuccauaugagaaucauccacaagucauuauuuaggaacuuaaguguuuuguagcugagugaccuuccugcuucagugauuuuguuacaagccaugcucauagcaccuucauuuuaucuaacaaagccauauauggcugagcugaucaauguuuucucuuuuggcuacuguuguuggucucacagguugaacauugccuaacuguggucauuguuuucugguuugaagaaagaaaaaccaucucugacaggucuacugagcccagcuccucucuauccucaaggacugucauugugacagugcaguucuuaggaugacauuguucacguugaggucugucacuggcagcccgagaacuugaggccuguguaagaaauguugaugggauaaagagagggaagcacuuacaacucaguaacuguaucaagcaagaagcuuuguucuuaagacuaagauggaaggacuacaggagagugaaaacacccggggaagccaaggaaagagugcagugcauuuggguagaaagucaaaugacauggggcuguaaagacaagaacagaaaaguagacuugacuuagauucuaagaggauucgggauuuauccuguaagcaguaacugagaggucacgaucgcauuuuaaaauggguccuuuagaaggacagcuaaccacaagggugaguugcugagaagaaggagcaaaugaaagcacccaaguugagucccgcaguaaaccugggaaggaaagaccuacauuaggacugugcguggguggacccaaggggcaggauauggucuggaggauuuagauggagucuugcuaggcagagugaggaugaaaucugagguagcaguaugacaucuggauggcuaggucuugggcagaggcguugaugauauuaggguuuaaauuugagcagaggguagugagaguagauuccauuaggcuugacagauagccaugagauaucuacuagacuggaagccgugcuuugcuuuccaucagagcagcgagagcugauagcguuguaagaggaauggggccagccagaagagguugcccagaaaauucccugccuaaucgugcuuacuguaagagcccuggagagccacuaaaagaagaaaaaaaaaaaaaaaaaagacugacuuuucaguuguaguucaauaagcagacacaaaauauuagcauuucagugauguaauaucagucaguguuaugugagccauuuuuaggcuguauuagaaguugccaguguaucuuucuacuugucuuuaauuuuucugcuagcacuagaauguaguauggaggguaucgugcuauuuguuuauuucauuuucacuuuuauuuuucacuuugguaguucugcuuaaguagccuuccccagagcagacguguugcucuggaaacacuuccuugguaguguagagccuggagaauguguggcuaucugcagcccuuugcuuggacagguucuaaauggucgcugcuaaugcucccguagcacucaauuugauugacuucaugaaagccaaucaaacauuuacccaguuacuuuugggcuuagccacaguccaacauuuugaauguucucccuacccacuuucugcuuuuguuaguacauuuguggaaguuuuccgucugugugugagcuuuuuaucaaauacugauagaggcauaccgaccaaauacagcucagcuacaucuucccuuuaaggaccugagugugaaaggaaacagaugucucgagggaaagauaauucacugacaucaggaggccuggguucucacgucagcuuuaucuguuggacuuuauggucuuaauguugcuuaauguccuugggcuucaauuucuguaucuagcagaagccugccucuuacaggauuucucugagaacaaauagcccacauaugugaagugcuuugaauuuuuuggaaagcccgugaaaguauauacagauggucuuccagcuuauaauuguuugacuuaggauuuucuuacugauaugcaagaaguguauccauacaaucucuguuuuucacuuucaguccaauauucaacagauuacaugagauagucagugcuuuacuauaaaaagaauuuguuuuagaugauuuggcugucuuuuuauuuuuguuuuguuuuuuuucaagauaagguuaggcuaagcuaccauauucaugagguugccauaaaugcauuuuugacagggcauuuggguuuauaauguguuuaucugggcauuaccccaucauaaguagaagaaugucuauauagcaauuucguguagccacaacugauugcaagccaucuguguccauuucucaucgggaggauaaaaggaaguaaagcauaacucggagcucacugcuuggcacauggaagaugccagguaaagacacaacucucacuauuuccuuuuucuucaugcccccauugccuuccucuuugucacaucccugccuuagacgccguuuucuucauggauuuguuuagagucuguucugaaugaccuucaguuuucaggaguaagaucucauuaaauauucugagauaacugugcuuugggauaauuaaaaaaugagaacacugucaugucagcaugcuuugggggcuauuuauaucuugugauuuuagagaacaaacaagcuaaaagcucaacagaaaggagagugaaaaccuaaagcuuugagaagguucuagcuagggagguguugguggucagcuuucucaucccaucaugucgguguccugucacuccccugcucuuccuccgcuacacugguaaaugucagggcuuggcuugggugguucugcugguucagugcuaauggaggcuggagcuugggaugggcauacgcuuuucucuuaagaugacuggcuugccugaauuucuaagauuccuguauucuuucuccuucgacacuacagaguaauuugugauucuaauguuguuaaacauucucucaggcuuuuaaaacacaggcaucuugugguuaauaagaaaagaugucuguagugcuccccacugagugaaccaucaggaaggggucuaagaugggacuggacauugaggagugaauguguuccaaguaugugacacaacugaacaaaaaugccacuaagaaacccaucauuuguacaauacaugacuaaaaaaguaaaauaaaaagacccacagggcagaguggaggcuggugaugaccaacauguucuguaucuguuuccugaggcccucuuuuuuuuuuuuuucccuguccccaaaggcguguaagccuaucccaagccauaccuagcuauagcuguuuacuucaaauggauuaagcccuuauggcuuaaguauuguuuaccaaagaacaggaaaauuaaauccucuuacauagaaaagggauuuuaaauucggucacuucuagacaaagggcaaaauacccccuuuaacagaagaauaaguaagaauguaagaauguagggauuugcaucugcaagucaacuaggucauuggacacguucuuccaguccccagagacagauucucugugcaggcagauuaugaagggcugacugaugccuggccagcagcaaagaccugggcagggcugaggggggcccugccaaggucauggcuggccaaggccacagugugcucaagcugggaagcccugggcugcugcucugcuccuucuaauucaucucccccccccccuucuuuucuaagaguugagggaaauaccuucagugaagcucuagaacuuucuggcaccccauuuccauauuuuccugaaauaauuccacaagcaaguggagaccaugucauugcaccaacuccuguaggggggaaaaaaccaacaaaaauacacaaucagaaccuuguuuaugccaaguaggaccaaaagugagggcauguuuaaacagccuugucaguucuagaggaaaauuggccagauaaaugaguuaauaccagcauccaucuuuccauuacaacuuaggacuuacaaauugugccucauucuuuuagaaaccaauuaaacguguacugucuguuccugggagugagccauauaagugaaccuggaaauaugacuuauuugugaucuuuucauggccacaguucacagaccaagagauaagagcuuuuacuugcaaaaaaggcuaguauuccacuuauccacucugugccuggcaguaccugguacccggaagaagcacagcuuaccacacagcaaaugccugguacaugaucaaagcagcagcagcagcagcuauuguugaauugggguuguuuuuaauucagcauuuuccuauuuauuuuuaggaaaaaaaaaguaaucucugaaaacugcuuuaguauauaagccugaaaaaaauguggcuuauaaauguggcuuauugauguuucuaauaucccaaguucuuguguuuauauauccucacccuccaggcacgacuuucacacaaacaaauuguaccugacuugcuguuguugaauguguucugucuuacccagccucgggcacagcacaagagacagauguggauaucuauaugcuugugaaugcuugcucagucuacucauggauacauguuuaggcuaaaagaagcacacaugcaaacugaguuuauucagugcauccugguugugugcaccuaugcaagucaaguuuauccaccugauccucuuugugugaacauuguuugaaggccuguugaguguauauauuacagccaauuuacaacucugcggcugucagcccaguaccuuguagacgauggaucuaccugauucugccaccaucucugagaugcaucguucuugucaucucuucauuguauuaauuggggaccuuugggaaagcauuucccuagcaucccgugcccccagucacugauccucacauugugaagaauaagcagaugugauaguggagauuaccuauuuuaugguagagcuccggcagcuggaccuccaccuucucucucuggaaaagaugguacucagcuugcucacagacaggcgggaucauguugaacugccgugcgacagaguaggcuuccuaggggcagaggagagugcagcuaaguuuauucugaugggcauuggagcuucaccaugauucauuuucguuggggaucuucauuucaguggguuaaauaagaaggaaggagauaagacaaauacaugcaaaguugugaccauaaauaucaccaagagaaguaccaaauguggggaauccuuguuauucaggaagguuagacugaguaaagucuggggcaaauuaguuaaagcuugaauuauggacuguugucaaggacauguuguuugaauaugcuuaaguucuuaaagaaaaaaaaaaccucagacuaaaaacuuagacaaaaguggucuauaaguggcaugguauaagcagaauuguaagaaagguagaauacuuuauacacauaucucauuagcuuugaaauucucucugcccuuucccccccccccccaacacacacacaaaggacauacuaaaacaugguuccuguuugcagauuuggcccuuguguuuguucugaacuucuggcuccagcccucacauccacccccuuaaugacagaacggaugguagaauuccaauggcauggucuuguaauaaaagccugcagaagaugcugcaacuuaaacaugguaucuaaacaauaaugccaaggcgcccagcagccauuaacaacagaggcuaacucaccaugaucuccaucgcgcuccaccucgaggugccccaguacauggccaugccuugguugaucacgugcgucauggcucgaacgauuucuauggaagcccaaagaguguuccgugagcucaccuacuuuacagcgcugaguuuuccccuccucuuuccagaguuuggaaacgcaauaugauuauuugauuaguauaauuacucucucccugcugacaacauaacauuuaccgucaguggucuggaggcuugaccguacucuuagguaaacugacagacauuuucaguuuucagcaauauuaaacaguauugaaaauguaaugaccacugcaggcucuuccuuuacuugaugguucuuguucugauaaaugaagcugagggucugguacaaggugagaagggaggggaggcauuugcugugacuguagaaugcagggccgcagaggaugaacggccuguuucucccgcaugguggauuugcagagcuguuccuuucccucaauagccauuuaauagagaugacucaauaacugugucuagcagcaacauaaacauacaaagugcagaacaaacagcugaggccacgggggcccaaagcccguuuugacacacuguguccuuggccacucugaacugaacugaacgaacguuguucuaggacauccguauaacugaucucaccagggccugcuggugggaccacccuguuuacacauuugccucuuuucaguuuaacaucacacuuccucuucccagaggguggagcgaagcuaauccucuuggcaccagccagaugagauaggaagcauaaagaguuucaaguuuaaguuagcaaaauccucagacagcuuccacaaaacaagucaacugcacuccuaggaugccagaucacuggacauauuucaagggucaaggucuuggacuucuuugugucccaguaguacccucagaugaaguguccuucagaaugaaauucuugcucaauauagaauugggguagauuuguucuuuuuucucuuuucucucuuuucccugccuccucucaccucuuucccuucuucauuuuuguuuuuugagucagagugucauuguauagccuugccuggacuggaauucaccuauguagaacaggcuguauuugaauuuacagcaauccuccagucucugacucccaagugcugugauuacaacuguaugcugcuauuucuggcuuggaguagauguagucuuaaucguauuuaaguugauacggggcaggauuuggauugagggagccaagguuagggucguagaaucguuguuuggcuuacauguguuauuuagagguuuccuugguugguuugucuugaagauggggaauguuuuuauucacuacccucuaacaaauaauuugguuuauuagcuaaacaccuuuucuugugauccuguaucucaucauagcaccuaacuguaagguuuauuuauccuuuguuaaauaaacgcgauaaaaauuguaagaaaccuuccccucuucuuuaaagaguguacaaauggggaugauaaaggucucuggauacuggggccauuuuuugcaucuucgccuuagauuagccaccugcaccauugcaaacaagucccuuccuguucauauccuguuucucccagagcugggagcucauccagucaccauguucugcagguaccuguuguucugggagcuggacuugccgaggugugccaaacugaagggguucacagagagcaagcugaauuggaagacucccccaucuguucucuacagacagggugaagaagacagagaggccuuguggccaggcugugugaaguuaucgaagccugaaccagagcaguuaagguggaaauugugagucuuccaagacucauucauuuacuuguuggacacauuugguauagaauuucuagacuuggggaguuuaggguuggauggcaaggguggagaaauaaagaagugauuuuaaaauauaggacagccagcgcuauacagagaagcccuguaucgaaaaaccaaaaauaaaauaaaauaaaauaaaauaaaauaaaauauagaguguuauagaaaaauauaagcaguuccagauaggaaaugaaauggaagcucuauggagucagggcuaggauugugucacuucccgucauguauuauguugaagcauugaaacaagcuaaccguacaaagcaugggagaacagcaucuuaggaugauggaacagcauggggaggccccgaaagcaggaccaugaauuccagugauugaaaugaaguuagguagcagaagcccagcaagaaaagacaggauugagauaaaguugccagaggacaacaaaccaaacuguaugggcuaagagguagaugggguuguugccauuuuuaggugagggagacauccugucgucggaguuugugucucagaaugccaucccugucuauguugugaagaaucagugaaagaggaagccucugggagcaaucugccaugaugcaagagugacccggagggggguuuugguaauuaagacugagugugguacagagugggcgggaaggaaucaaggucuccucccagaucccugacuguccacagcgaggagggcagggguagaaaaccuauuuuggaugugaggaacuggaggguauguggagcuggugugggugaaucccuggguuaaugaauggccacggugggacccugcugugugaagaagugcagcuuacucccugugcuaagucagagagagcaguggaagucugaagagaaaaagagaaggguuuucauugccagcaugcagucagagagaggacccugugcggucagucagcugacugaccaggagccagaggggagggacaauuuagagccaagaacagaggguacuucaagaaggaggcccacaggauggaacacaaggaacaaucacgucagaggcugcagaagugucugccacacacacacacacacacacacacacacacacacacacacacacauccugcagagcaugacgagagccauuuuagugucacugaaagaccaaggccaaggugucgugagggaagaauggagggcaggcagguuuggagacaacuugcacaaauucuuucagcagguuuucaaaggaaagaagcacagaaaauaauaauccaaggaaugccaggagaguucuuuuuauagauggagaggugagagacugucuggguaccauugaggaugaccuagcaggaggguaucccagaugagacccacugugagacugggaagggaggagagagaacacugggcucagagggaggaggcaggugcuuggggcuggggacccccaccaaggacaggguccagcuggguuuguggaacucagugguagacuuguuugaugcuaucuucucgauggacuacaacacaguguaaaggaugugggugugagaggugagucagaggcacauggcuuuacuugcuggccacacccucucucuguuguaugucgcucugaagaaagggcagggagaaaggggggggagguaccuggaguucuugucuguggaggagguuauuuuaaaagaaagucaccugaauuuagcuaacaaacaggaaaucaccuuauuggugacuuaggugggauuuuuacaugguuuuuacauaguacuaacuuguggacacuagagggcagcauuguugaaagaaaaaaaaucccgccacauuguuuuacuuguaaauuauggaaauucauuuuauuuaucuauuuugaccuugauagagaaaucuaaguguaagauuuuaaaauaaaagugaucauauuauuugcuuauguauguauguauauauguguguuugugccugugccauaguagcuggugaaggucauaggucaguucucccuuuccaccacauaugaguccuauggauggaacuugcaguaagaaccuuuauuuacugagccaucuugacagcucacagaaugcaguuaaaggacaauagaaugaauauucaaggugcuacguucauacucugagaaagaacacucagaaaugugguaaagucugccuguccaggacugauccuggcucucccugucaggcuggggcgcuggcaugaauaucuuagaaacuuggccuaguugauucucauacacagccugggguaagaagcccuuuacuuguagcucuggucccuaagugcagcgucuaggcaacagcuguguagcagccggggacuuacuacaaauguacagccuggaguccugccuugagaccugcuuugaguccugcuuugaggggacugcaagucauguggcagaguccacaugaacucugcccccugaacuuugaggaccacucacugugugcuucccaagcaggccaucucaagggcgaaguucuccaugcuccucuuccacggucuucuccccaaugcuuuauguaaccuucgcuuuagcuauuugccucaguucuuaugcaaguggagaguaaggugaacacacguacacacccauacacugacaugcgucagaucgccugaagaagcugcagaaagaccuaguucugaaucucagcuuccuuuaaugagacuuuaugccccgucucuucuucccauuuucuucuuuccucccuuuuuauuuccucuuuucugucuccgaauagagucucucuauguagcucagccuugguccaguacuugcccgggcuagcuucaaauuuguaguccuccuggcucaguuuccugggugcuuagauuaauacauaugcaucuguaauuacagguaugccuggauuaucuaucuaucuaucuaucuaucuaucuaucuaucuaucuaucuaucuaucuaucaucuaucuauuuaucuaucaucuaucuaucuaucaucuaucuaucuaucuaucuaucuaucuaucuaucuaucuaucuaucuaucuaucaucuucuaucuaucuaucaaucaaucaucuaucuaucaucuaucuaucuaucuaucuaucuaucuaccuaucucucuaucaucuaucuaucuaucuaucuaucuaucuaucuaucuaucuaucuaucaucuaucuaaguggucacaagaucuugcuaggccuucccaaccuuucucagguugaaaucauucuucuuuaaaccugaugguucucccuggggcucugaagccucauggagcugaccuuaauaaauucuucaagucaguugugcucucuucgugucuuauuuccaccuguaucauuaaggugaugucaguccuguagaauucguuggcagcuggugaagaucaugcacauagauguuuugaagcaccaacauuuccugcauagucaguaagugaguggcauguggccuccguuccuccacaaaagccuagcacccacauuuuauuuaguacauucuucuuucagugauguagcucaucuauguuuaaagcauuucuuaccaaaggaauugauacagauacuuggagugaaaaacuuuggaugauacauuuuuaauuuuggaaucagaccucauauacagauacacagcuugcaaacccugccuuuguugccuucugcugaauaaggaauggccugcauaccuuaagagcugagcagauaauaagauccugugggcaauaaagcaugaggaauaaggacauaaauguauugaaauuaguguuuagauuaaauaccauuacucaaauuuuuguaauggaaaaauacaacucaucaacuaggcucuauuuaaauucuacgcauuuaacuaaacgcugccuuuagagcuagaaaguguuugaacauuggcaguguuaugugguugauuuuuaugguuucagagcgcuucuuuuuuaaaaaagaacuuaaauuuuuuuuuuaucuauuuacguuccagcucuugcccccccccccccauuccccaucccccgucccccuucccacaguuccucaucccauuccucuccccccuugccuccccuccgagggggugcuccauucccaagcuucccacuucuucccuggggccucaagucucucagugauuaggcucaucuucucccacugagucagaucaggcaguccuuggcuauacaugucccgggggccucaggccaaccccugugugcuaccuggugguucagugucuguguguacccugggguccagguuaguugagacuacuggucuuccuaugggguggcccuccccuucagcuucuauaauccuuccccuaauagggguuacccacuucaguccaguguuggguauaaggauaugugucugucuuagcugcugguagggccucucagaggacagccauccaggcuccugucuguaagcucaucauaggaucaguaacaguggcaggcuuuggugccccccaugagauggaucccagguugggccagucauugaaccgccuuuccugcagucccuucucgaguuuccucccugcaguucuuuuagacagggacaauucugggucagaaauuuugacuguggguugguaaccccauccccccacuugaggcccucuccccacuguuggucauuuugguuaaggucaccuccauugaguccugagagucucucagcucccggguuucugguacuuucuagaggguccccccacaacccauuccucgagguugcauaucccauucauucuccuggccuucugaacuucuuuccuaucccccccucccccgccccaucucccacccaggccccucucuucuucugucagaagcacuucuuuaagaggcaagggcucaauuguuuuucugaaauuuucaacuuuuucccagaguuauaccugauuauauauaugcguguauacauuauaggccaggaucugugucugagggagauuaugcguccaagggaguuuaggucuaaagucuaaaaaccaagagaggguaauggguaaacgaggaaagagagaauacaggcagaagaacgggagucaugaaagaggguagaaaacuaauuuguuucuauuuucagcuggucucaggacugcuguucuuuucuuuucugcuggaugugugaauguaaccauuuuuauguauagaaguagcaagaaucauuuugcauucuaacacaguccagcaugaguuaauccuuuggggcagugggugugggaguuggggcuuucuuuuuaauuccacagaucauuaguggaguaggaaggauacguguguagucacuggauauaucugcucuacugacccacuuagaaaaaugauuuuuuaaaauaaguguuuugggaagagggauuuauagccuuuauuuucccuuccauuuaaagcuaccuuaagggcguggccaggagaggggcaaugagcaggauggaaagugaaaaaggaaaagguaaguuuaaaaaaaauuuuaaaauucacaauauagacauaguauuaccuuuaaaaauccugcagucuuuaaacuuaaauaccuuaaaauuuuacuucuuuuaaaaauauacaaaaucuugaugcuagagaaaugguucagugguuagaaccacuuguuguuuuuguagaggacccagguucaggucccaguaucuauguggcaacguccaacuauucuaacucuaguucuagagaauccaacauccuccucccauagauaaaacauauugagaaauaaaucuaccuuaaauuauuauauaaaguguuaaugcaaauguaaguuguauugcuauaacugaaauaaaguaagauuuuaaaggaaagaggcaaggcuuagggagagacuggcccugccagaaauggaagaacuagguuucaucagagauguuguuaugaauguggacagaaaguguaagucuagaacuggacacaguuuuuaaauuauuauuauuucaaaccaguuguuuuauuucucugucuuugguuuucuuucuuucuuuguuucuuuuuuguuuguuuguuuguuuguuuuuugcuuuguuuuuagagacaggguuucucuuuguagccuuugcuguccuggaacucacuuuguagaccaggcuggccucgaacucagaaaucugccugccucugccucccgagugcugggauuaaaggcgugcgccaccacgcccggcuuuaguuuucuuguuaaacuccagcagccagugcuuguaguuucuuugcagcuuugagaugucucuuuggauuuguaugaguucaucauuuucuggacugcagagcuccuucuggcucagaucucagagcuuggagcuagaaggcuggcuuuucucauagguuuggagccugcucagaaguagagcgaggugugcccagcacuggccccaacuacuagcauaagagcuguugauugaacuaggagaaucugguuuccaguuauaggacacacacaggauccaggagaccuugauaaccuuggcuuucuaucuagacuuugcuucagugcagaacagauugauaauaauuaagcaguguguaaucuuuguaaugacuguuuaaguuaguaauauuucacccucauuuuauuugaugcagaaccagggauguggaaaagcaaagucacuuuggcaagguucuaguaugcagccuugauguucuggagauauguguguguguguguguguguguguguguguguguguguguauggccuugccaugggacccaagucuaaaugcauaauuuauuuauggcucauauaugccucauauacauagauaaagguaauuucuucuaucuaucuaucuaucuaucuaucuaucuaucuaucuaucuaucuaucuaucuaucgugauaggguuucuuuauguaguccuggauguccuggaacucccucuguaaaccaggcuggccccagauucagagauccaccuaucucugccuccugugugcuggaauugaaagugugcaccaccacuccugguuuacuuuauauaaaacacuguuagcauuugaaguguaccuauauuuuuacugugacccaguccaggaggucaggugugggauuuuccuuuuaugguguuaugucagugcugaacauuuggauuuugaaacauuucugauuuuaaauguuugaauuagggauuuuuuuccuugugucuuucugggacagggguucucagacacaccagaggagggcaccagaucucauuauggaugguugugagccaccaugugguugcugggauuugaacucaggaccuucagaagagcagucagugcucuuaaccgcugagccaucucuccagccccugggacaaggguucucuaugaagcccuggcuguccuggaacuugcucugugcaucccgcuccccaacucugggauuaaaggcaugugcagucacugcugccuaccggauuagggguguguaaccuaccucccgguaggacguccaugcucuguacugaucacaguucaaacuuagugaaucccauuugugaaacuugcaucuaagaaaagcuccuugaagaaaggcugacuaugcugugacuucucuggacagacacaggugucccugggaacucugcucauuccuggcauaccucacuacagaaggaggcucugcaaagcuguguguuuuuaguguuucuuccuucuucagacaccugcucuuuaauccuagcaagacagugacuucccauuuuaccuauagggaacacuuaaggugaaggcagagcucacuagcuuucuuuuuuaaaauaaagaauuaauuaauuaauuaaugcauuuugucugcaaguauguguaugcaucacauaagugccugguacccugcaggccaguaaagagcaucagauccccuggaaccagaguuacugugccauaucuccaguccccaaacauaucugucuugucucugaauucuccucuucacuccuuuuucccuguaauaauguuaugaucgcaucugcucuuucuaacuucucaccuagacuucuuuuguuugcugagacucuccaagguguaauuauguaggcuauggaucaaaaguugcaauuuccccaucaaugcaaccuugaacaggagccaacaguuuucuaauccaaacuggugauuucaaguuauuggacuguuuccauguuugcuuaacacuaagugguaguaacuaaagagucaugucuugugcuaauagaagggagagaguauccuugauaaguguagagggcaaagcugcuaucuaagaugucaaauucuuuaggaucaguggacaauggaacaaauuccaaugaauuaaaauucguugggagcaaggcgaugaauaaauaaaacuaaagagacaagccuaagugaacuuaaaguccuggauugugaaguuuuucuagauaagugauauuaucuuaaucuguggagccacaaauucucuguucuguagguuaaggguguuucucuacagauccuaggaauuccuuuggcaguguuacugaagucacccugaaauaagagaacguuccuaguuugaagauggcugugcugguuagggguuuuuguugaccugagacaagccagggucuucugggaagagggaacuucgguugaaaaaaaugccugccucacauuggccuguagacaaaucuguggguuuucuuuuuuuaaauuaaugguuggugugggaggaaccagccugcugaggcuagcgcccuuccugggcaaaugguccugagauguaugagaaagcagccugaagaagccaauaacccauaucccuccacagucccaguuccaguuccugccucuagguuucugccuugaguuccugccucgccuuucuucagugauggacagucaccccuuuccuccccaaguugcuuuuggucaugauguaaucauaacaguagaaagaaaacuaggucgacaggccuucgccuauuccagggugucccccugacaaaaggaaaauauugaaacaugaaaagaggugguuuuuuuuuccucuaaaaauguaaaauuuuacacuugucauguuucugaccuauaaguuauuuuaguguauggaugguauaaaauaaagaccuaguuucauuuauuucuucuuaccacaaaaauaaucauuuucuccuggcuauauuucccuucuucuuuucccuuucguuguuucuuuguuucuuuucaauuugagacaagauaagggugaccuggggagaaagcacuucaguuuuaaaaaugccuccaucagauuggccuguaggcaagucuguggggcagguuuuugauuaacgauugauaucagagggcucagcccauggucaguuauuguguaguaugauggaugucuaaccuuuugacaguguggaguuuccaucuacaaacaugucauggcucuucugggauaauguggccuaggggcacagguuggacaggccuaguccuugucccauguuuccuuauuuaucuucuaugccauauugcuaugggucaaguuuuauucuugcuaaugucuguguuuggcaucuccauggguugaguaucccucauuggcauuuuacaucucaguguuucaaacugcacauuucugaguuuggggauuugaauccagcauucagaaaguuuuggauuuuguagcaauguggauuucagauguucagaugaggggagagggauagucacccugcauucuguagcuaguuccuccugugaggaguuguuauugaggcuuuaaggugaguguugagacccggcagggccccugcagugcuugcuuuucucagugcugugacaacaaauauaaggcaggaauggcuuacucagcucaugaucagaggggacagucgccaucacaugggaggcaugguguugggagcagcucguggcugugguagaaagagcuugccuguaucuaggcagauuagaaagcagacaggggacgggagccucaugccugccuccuagagacccaauuccucuagguaggccccaacuuauacagguuccaugacuuuccacaagaaugccaucagcgggggaccaguuguugaaacacaugagccugugggagaccucgacaucuaaaauguaacaucagauccuucucuuccacguacucaucuccaggaauuauuuagacucuucuuagaccuuuaguuucuuuauaaaugcuuaauuuguuuaucauauuaauuuucaaauggcagauucagcuggaaaagaucuaauuuaguagagcuggcuaguuuaacccuuaagacuucccauucaugguccugguauauaucuccugucuaucuucuauacauggcaccaucuuuauaugaucaacugcucugucauuucccaaauaaggccacgggguccucugguuuuucaggcucacuucuuuacuugggucuguaucccucuauucauucucucucuuucucucucccucucucccucucccucuuccucucccuaucucuaugccuaucucucugucucuuucucuauauuaugugucuaucuaaucuauaucuaaucaucuauaucuauauagauauaagcugaaagaggaaaacagcacugaaaagggacauagaaguuuaccagggaggcucauguauuaaaauuuguuucacuaacaccagcauucucaguugagagaauuagucuguguaucuuagaagucaaaagaccacaguggaaguaauugcuucaggguguguguacuggcuaguuuugugugucaacuugacacaggcuggaguuaucacagagaaaggagccuuccucuaggaaaugcauccaugagauccagauguaaggcauuuucucaauuagugaucaaggguagagggccuauugugggugguggcaucccuggacugguaaucuuggguucuauaagaaagcaagcugaaaaagccaggggaaaccaguaaguaacaucucucuauggccucugcauuggcuccugcuuccugaccugcuugaguuccaguccugacuuccuuuggugauuaacagcaauguggaaaguguaagcugaauaaacccuuuucuccccaacuugcuucuuggucaugauguuugugcaggaauagaaacccugacuaagacagugugugcgccuggauggaagauuaucauuucuucuggggcuugagauauugugguucaugcuaguguguugguauauugcuccauuaauuaccucaaaucuaucguaauggucaagauaauuuuugacuugaaaauucucaaaacugauauucucaguugcucuucacugucauagauaaauucauuugaauaaccuaauaauuuuccaaaggaacgaaccagaaugaauaaucuacaaauguauaaagaaagaaaugagaaaguuaaauagcuauuuguauuuauuucauggaaccaaucuauuauaauuucagaauagcuaaaugucucuaucucucuaucucuuguaugucuagcucuuguaccuccacuucuuauauaucagaaaaauauaaggucacucugguguuucacaauaaccauaaucaacaacacgggaagauauagaaguuauuaauucauauuuaacuauaauauugaaaagaucucaagaugauguuaagaauuacuaggguuuuuuuuuuuuuuauucuaacguucuugagcuuuaaguuguagcuuuucuuacuaagaaauaaggauacaucuauccucuuguuguauugauuaggauuuuuauucuauguguauggagguuaggcuaucaaaaacuuaguugaauguucuuaaaacgaaaggcauuuauuuauucaugcuugucacuggaugguucaucuuugaagcuauugaggacuaaccuuuauccccaaacucccugcuaucuuuaagaugauuucucuuguggcauuaauauacuuccuauagcaucugaggauauugcacaugaacauauucagcaugaucuuuuggcucaugauuuuaagcaaaacucugagaugccuucucagugggcugcuucaguggcacgaaccaacaauuuggaaaaaugggcauugucuuagucaggguuucuauuccugcacaaauaucaugaccaagaagcaaguuggggaggaaaggguuuauucagcuuacacuuccauacugcuguucaucaccaaaggaagucaugacuggaacucaagcaggucagaaagcaggagcugaugcagaagccauggagggauguucuuuacuggcuugcuuccucuggcuugcucagcuugcucucuuauagaaccaagacuaccagcccagagauagcaccacccacaaggggccuuucccccuugaucacuaauugagaaaaugccuuacaguuggaucucauggagguauuuccucaacugaagcuccuuucucugugauaacuccagcugugucauggugacacaaaacuagccaguacaggugugguggggagauuggcuuauaacuuacucuguaacugaggcccagccagggaagaggaggcuagccuuccuguggguuagucucagggacagggaauacacugaaugaaaaccuguauaccaagaaggcaauguagaccaauguaggcaauguacuggguagauaaccaacaauucccacgaguuuuggauuaauauuacuggacauuccaggcagguggguaucuagguuacagggcaacagaggaacacagagagagcucacuuuacugcuugucagcuaucugcuagacuaugugcugggaguuuuuccaacauuacugcauuuauguuuuuauuguaguucuaugagguaauguuuugaagauauuugcucucaauugaaauauuaccuccagguggaagggaggaaacucagaagccucuagcagcuaagaacauuuauaaagcucaggaaguucaugaaacuuacauggcuucggaagccccaggaguuacaauacuggugauacccuguaccaaguucauguaaguagcaaaugguugcuggggagaaggagacucuucagcagagcugcuugcaaguuggaaggagaauuccaggaauuuagcuuucaugagcugucacuuaaugaugggacggauguacuuuucugugauacagcugcuuuugaguuacccaugcuccugugagcaaaucacuaccuguuucuguuaguaacccaguuaacucauugguucaccaagcuagacuugaguggaauaaugucuuuguucugcuaucacugugcuaaucugggguaaauagauagcucuucacguuuccccagggacagucacacagcaagugguagugccauaauguuauauugcauuugaagaaaccaaggcccagaaagaugaaggcucauuucugcuaguugaaaauuuccccuuuaaccuccaugcucagagaaaugaagcuacacaccccauccaucucucuucccucgucuucaugguucaugcccacuguuuugauuauauucuuugagacacagaguggcaacaauauccgaaucgacugaagaaauaagccuuugggcaugucagaaggaaauauauugggcaaaauucuuuuccaaacauucuuugagcugcugaaaauaaauuuagccagauccuccagugcugcaugucacuuaguuuuauaauugggagcaccugucacuucauuacagcuaacuggcucaaggcuuuaauauccgauguuuuaaguuaugugaaugccauccucauuggucagacagauggauauagaaucuugacacauaguuucuugcucuauuauccugucugaauccuuuuauuccauaacugucugugaaucugcuucuggggacaggcuuuuaacuauauuuuaaaaggcaugcuaucguguggaucaacgaauaaagcaaacaacuuggcagagauugaucagagugggaaaaauaucaacccuaaugagauuuuucuacuggcaaauccaguuuaaugauccaaaggaagcagucuuuauugcucuuuuaauagucgaagcuagcugucucuuugguccugucaugggagaugucuggaaggagaagcuaucuuaaucuuaaugacauuaaaaaccuucuccccuuacaucccaggcugccccuggcugccucuaguccauuuuggcucucucauacuucucugugccugccagguaucugguaaccaaaaggcgacuuuuaaccuugcugugguggagcagaauaagauucucagcuucucaucaccuaaacuaccugguaaugaagaguugcugaccaacuaauguuuuuaacaaagcacucacagcugcaucuguaugcaggauggcugggcaacuugcaguucugaagcuguuaugagaauggccuguggcuaucuauggcuucuguaugaagggaacaaagguaucaaucaauggcuuugguguuugacagaggcuguguuuagagguggggccuuuggaaagugauugagucaggagugcucugccuucaccaacggauuauuucaauuauggauucagauguugaauaggugguaagauguggaaggugagccugguuggaggaagcagcucaccagucuuugagggguauagaguuugguucuggcccuucuuguuucucucaccucuucuuggcuacccauaagguaaacagcuuucuccuuccauguccuucugacaugauggccuaaaagcucugaaaccaggcacccaaaccaaccuuuucuucuuugagauuguucagguauucuaugaugaaaaagcugccuaccaaagcuggucucuguggggcuggccugccacgcccugugcuuuauugcugguccuguuccacguucugcuuggaugaagacuuucuuuagagcuucccuuccuguuugugggggacuucuccaccuuucacucaacaguuucccucauggacucucucagaguccucugcuaaaggagaguguagggaggguuuuaacgauaaagcagugcuuccuccccacaguccacggaacagccauaaacacgcuguuuagacagcuugggcucugucacaaccacuuuuuuuuuuuuuuuuuuuuuuuuuuuuuccgagacaggguuucucuguguagcccuggcuguccuggaacucacucuguagaccaggcuggccucgaacucggaaauucuccugccucugccucccaagugcugggauuaaaggcaugcuccaccacaccuggcauaugcaagcuuuuuauuucguaccauaauaaagauuuaaaacgaauauauauaccuugauuaaggacuggugagauggcucagugguuaagagcacuggacuccucuuccagagguccugaguucaaaucccagcaaccacaugguggcucacaaccaucuguaaaggcauccgaugcccucuucuggugugucugaagacagcuacaguguacucacauauaauaaauacaucuuauaaaaaauuaaauccuugauuaagauugacacaggaaaacugucuccuguuuacuuugguuuguucagccccgcuccccaccuccuccccacuccugcucuugcauucacuguccugugaugcgcacaaauacuccuugcccaggaaccaguuugacugagucuucuaccuccugaaugcucgcauaucuucacuccagauuuugugacgcugcuugcauuaauguuagagauccuuuaucaccuaggguguuaaaaauaauaguucacacuuacauagcacuuaugguguuccuggcaauguucuaaacucuuugcauauauuaaagaacccauuucuuuagacaauuuuaucaaauaggugauuauuguuguuuuauacaugagguacacgaggaaaccggggcacaaggaaaaugaguaaauuauuaaaaagaaacaaaggcaggagauguauugggacuccugggaaaagugggaggaggaguuuggggugcaugaaaaugucaaagauuaaaaauuuuuuaaaaaaguauguuuuuuuaaauguauuuuuuuaaaaagagaaaugaggccaagcacuuuucaucaguacaauaguaaaucagcuagucccuccccaucaaaggcuuugggguaaacuuugagaagagauaguuacuaggacaucccacuugcaugggguugccaagggaagugcuuuccuggguucaguugccuaaggauuccgaagcaacuguagccggggugcaaaggggacugacuagugcccaggcuguuugcagaucuugauguugugcgugugguauugguuuugcagguacacggaacagaacaguuaugcuaucaugcgcccuuagacagguaaccuggaggagagccugugaggccagugugcagcaggguuggauuccccuuucagggaggcccugcucggguagcacaugaagcugugagagugaaaccuaaguuucaguggagaucucaggaguggggagaugccaggaauguggaauaucugcagagggaagcuguaggcaauaaaucgaggcugccaaaacagagcacauguggucugcaaacgccaagccaugggaguggggcugcuggagcucacgucacacuaccacguguccuggaugcuggacacagaugcacaggagguuuguccaaacuuucuuugguauccucuuauuuauccuuuuuuggaauagaaauguuuaaucuuugccauugucuguuagaaaaguaauguuaauaaucaauuaguugauguuagaauugauaauguucauuuuuuuuaggaguuccuaguuaagagacuaccuugaaucucaguagagacuaacuuugaauuuuaaaguguuagucuaagacacugagaacucuggaaaugaacuaaguccucauugcauuaugagacagcuguuagccauuuagagccagugugaaauauucaguuugacuaugaaacguuccccaugguccaugggcuuguguuuugaauauuuguucccuagcuggugguagcugaucguggaauaagggguaggaaaauuaggauggcucucuguuucuaaacccuaaggcugugauuggauuuugacagccacagucauuuaauacuggccacuuacagucauggauacuuuuauccuauuugugugugaguuguuucagucuuuuguuuuuccaaaguuacaugugcacauuguuuaaagagcuaacauuuaaaacgauuguaacaaaaagccucaguccccuugcacuuguauccaagaaauaucugauauaugacauuucugauagauacauguuuccucugguguuaauuucucuauuucucagucauuuuuggacuuuuuuuuuugagacuuugcuuguuagcuuucccucauauacaguuauaccucuauuauuuuauguauugcuaguugcauugacucugaagggaugguaggaacuucaccugcucccagcaguaggccccuguaccugcagcacucccacagagagauuuguggccaccagucacauaggggcaauaccccaagaccuuucacauguagaugaggcaucccugacaucucagaccaagacaauaggaaaagagaagugaccacaggucaacauaggcccaaaacagaguucuccaugcuauugagguacauagcggccugaaguuuauuagccaauaaacuucccuuccuagacauuccucccuguaaaagguauuuaaucucaggcccauccugagaagugggguaugguuuuaugcauucacuuucaacuaugacaauaaaucguuuagaaccauuggcugucucuuuccaccaagaucugccauggggagcuauggaaaaggccuugaccuacagagccauagccuaaucccucauagaagggcucucuguacugccuagccacaaucaacaccaagccugccaucuucaagccaaggacaaucucucuguugggagcuccccucuuccuccuccccugcuccaggcuagacucuguccccagcccucuagcaccgacucuggucucuccucuucagggacucccagcagcaccuggauguccaagcgucugagaaccccauagccccagccuugucgcaggccuugggaccccagaacaaacucugguuuccuacaucuuagacugugcguucccugaauucguaccucagugcuuccuuauggcccagcauuugcccuagcauggcucagugugggaugagcacaaacuuaguguggagcuguguguacuguaagcgagagguaguauaguuaggaucuguuagcaugcccuuuuaguaucaucuucacuggcuaggucuuaguagacaggacugcaauucugggucuucaguggacacuuucagucuggagaaucaugauacucucagauccagaaaugcucaugacaaauucucaauuuuauuuuuuccucucuagauagccuugcauucagccgguacuggaucuccuggucagaaagaacauuaauagucuuauguuuucacuucucuucuauaugcuuuucuucuucacauuuucuagaacauuuaaacuaaauauuuaacaucuuuauuaacugaaaagaaucuuagccauuauauuuuuaacuucuaagcacuuuuucuaauuuuuugguauuccugucacucuugcauuguguguguguguguguguguguguguguguguaugcguaugugcccaugcaggccagaaaagcauguuggauguaccaugugggugcugggagcugaacucuguccucuguaagagcaacgguguucuuaguggcugaaccaucucuccaacuccagguggagauugucuugaaugccaagucuucuguucuuguuuaagaacaaaaauuuucaaauuguguuugaacaaugcuuuucaauuaguguaauucacuguaggcauaauuuaucacacuugaaauucuuuuguuaauuuuuuuucuguaguguuauuaucauuacaauuuuucuugggauaauuucuuccaagaaauaugguaguguuuuuuuuuuuuuuuuuuuuacaugagcaugguauguaagacuuaguuguugcugauuugguugugagugauaguaggauagauuuggaaauuuaaauguauauacauacaauuuccagucaguagaccuggccucauucauuaacagggaagggcaggaccuugacuguagacguguccucuaaaucuaucuuuccuuuagucuauggcaucuucugaagcauuggugccccuuagcaucuuaagcauugugucaugcauaccauuuacauucucuucugugggcaugccaacuagccaaccaagcagucagacaguuaaccaaccagucagccaaccaaaaccaaccaacuaaccaaccagccaaccaaccaaaaccaaccagccaaccaaccaaaaccaagcaaccaagcaaccagccaaccaaccaaaaccaaccagccaaccagccaaaaucaaccaaucagucaaccaacuccaaccaacuagcuaaccaaccaaaaccaaccaaaaucaacccaaaaccaaccaaccaacccuaaucagccagccaaccagcuaaaaucaacgaaccagccaaccaacuagccaaccaacuaaaaccaaccaaccaaaaccaaccagccaaaaccaaccaaccaaaaucaaccaaccaaccaaccaaccaaaacccaaccaaaaacugaccaacuaaccacccacccgccuaaaugcauuccuuuucuccuuuaauguauauugcuccagguuuucaggugucuucuaugauaacaaagcuucuguuucuguucauugucuucugcugauuggaucuuuaucugaugacauguaaacauauacuuugguauucuaaaugcagaaguuuucucacuuuugugcaaauaagaaagccauaaguaaggacuaaguggcucuugauuuccaguuucacuugcuaugugaguuagagaucuccaccgugcugaugaugguagacaguuccuuacccaccucaccugaccuucagcagcauucaauguacugguauuucuucuuucuuugggguauuuucuuuaccuccuccuucaguuaccacacucuucucaccuuucuccaaaccagcuaauauuggagaacuuuaggguucaguccuuaguuguuucuuucuauguccauuuucuauuuauuuuacucuauaugugauuuuaucuauuacauucuuaagauuuacaaacaccauuuacaugcagacugagugucagauucaguguccaacuuuagcaucucucuuuggcugucaaacauuucaaucucaggaugauaaacccaaaccuucacuaucauucuugcuacacguggaauuuucauaucuguuuggagcagcauuucucaaaauguggguuuugagcucuuuggugaaccauaacaguagcaaaauuacaguuaugaaguagcaaugaaguaauuuuauaguuggggucaccacagcaugagaaauugaguuaaaggguuguagcauuaggaaggugagaacuaccuaaaguuuagagcaucuccauccuuccaaugauucaagccuaaaccuuguagucauuuauguucuacucuuugucauauccauaaauaacccauuuuacucuuaugugguccacauugcuaacaucuuuaucuaaccauggacaucucaccgacauugugguaggcauuucuuaagauuguucccugcugguacauuugcaucaacaauauagucacaauaauucacaacacuaauucagguggagggaggcuuuugacaugcaaccugccucauggucacuuugugauugaaaauucagagggcucaagggauguggcuccaucaucucaccuuuaucccuacauuuucacuugucauucuguugcugccccacugauguccucaaacaagacaggcagcucucaucccacggcccuuacauuguuccuccgaaagagaucaucuacaccgcucccaguugauagcauggccccuuccagucacaggcauccucaccucccugcgcucacuggcagcuuugugaguguuucugucuucacagccugcugguuuccauucuuucaaagcacuuccccuuugucuauguauuuauuaaaguugugaaugcuguacuguucgugucuuaccuccucucuuagauuaaauuugucucacagagaugugacuuucuccuauuuugaauagcuuauucgugcuugguguguaugaacaagugaggagccagcuuugggcauggguaucguacucuccccuauguucugguuugggcuacgucauauggugacguuuaaacuguauccugucaauguuuugugaaaagcucuugacaaucucaucuuucucagaaagggaguagggaaauggaagggagaaacagaauuucauccuucuuucccuaagauauucuucguuuuaguauuuccauuuucccuucuguuuuguuuucugugaauucuugucauauuguauuuugucucauuauagaaaacacucccuuuuaguuggagauggaguuuguucuguaacaaugcuuuuucaguuucaaagccaaugauauaacauguuccauuuccccaaguaaauaacaauguuggugacacuuucuacugcucugcacaaaucccuuccauuugcuggcccuuaaagcccucaaccugguuuuuauguguauguaacauauggucaucuauguugguguuuuuaaacguucaaaaaucuucuuguuuaccuuuuauuauuuuugugugauugggggcaacugaagccggcuagucucccagcuuuuccuuuguaaaaguaaaacuuagcacagagacacaucacaaaagauggggauguuucagauuguugagcuuguggguguguggcaugcaauguccuccaggccuugaacgcugacaauuacucccuagagcggaagaaacucuugcaaagccuucagauuccuaaugagggucuuugggauguaaugagaggacacgaagaaugccuaccugcaauguauagcuugugcaaagguagucaaauacccaauucuguaauuuguggaaauuugaaucucaagacacagcacuuuucuacacuccaauuauauugacucuaaugguaucuuauuuugaaguaaacacauuuucuggaacuaauggaaggucauuuaagucagauaguuuuaaaacaugcaaaauaugugggcaagcaugacuucagaugcaaucgcuuagcuuauuuuugcauugccuguugguccuuuauucuaucagccucagugaaaucucacacuugucccauagcuuuucugcccauaguuaggcauuucaaaaauaauuuuaaggacuaaacagauccuuuagagguuucaaucaauaguuuaagcuagaacucuucucuuuuuccccaccgggagccugaauagcauaaaacaacaggauaauuuagagugugguggcuuucucuauuucucuagucuuugaaccccucugcaucccuggccccaauucuagauccccucaaagaggcuuugacuaacacagaacacuuucaccuggguacucugcuguccucaggaggguggcacuuagcuagcugugcuaucaaggcagaucgucagcccaacacuccacuucuagauuuuccagacaaaaguagggucccaacucacuguguuccucagccauggacugagggggaccagcuagaaaccuaggacaaugcaaauuuccaggcaucuauaagggugacccuagcuaagauuccuagcaauaggggauauggagucugaacuggccaucuccuguaaccaggccagauuccaauggauggauugggacaccaacccagccauaaaaccuuaggugugcaguuuguccugccuacaagaugugcagagguaaaacauggagggaaaagccaaccagugauugucccugcuugagacccaugccaggagagggaguccaccccugacacuauuaaugauaugaugcuauuuuugcagacaguagccuaguauaacugucaucagagaggcuucacccagaaacugauggaaacugaugcagggacccacagacaaacauuuaguagagcuugaggaauccuguggaagaagggguggaaggauugaaggaggcagaggggucaaagacaccacaagaaaaccuaccgcaucaacgaaccugggucauaggugcucacagagucugaauugucaaccaaagaguauacaugggaugggucuaggcccucugcacauguaacaauguugugcagcuuggucuuuaugugggaccccuaauaagaggagcaggggcugucucugacucuguugccugucuuugaauuccuuuccccuaacugggcugccuugucuagccucaauaggagaugcacuuagucuuacugcagcuuuauaugcuaagucugguugauauuccugggaggucuccccuuuucugaggagaaggggagggggguaaaugaggggaaggugaggugagagagagagauugagugaagggaaggggcacuuaauuaaguuauguaaauaacuuaauuagagaagagaaagaaaggaagaaagaaagacaagaaaugaaaggaaacuccaagggcccugaaaguuuccagaagaaaguuuccagaagaaagaaacccucccugcugggguggauggagcucagcagccuuuuuccucccugcugggguagauggagcucaccagcucuccuucuucccugcugggguagauggagcucauaguacagguuucuuucuuuuaccuuucucagcugggucccuucucuuucuugcucucucaggcuucauauucuuaugcuagagugagauccagauugauggaaaugaauggagagggggcaaaaagggaagcucauuuuauagaauaauuccagucauaagcggagucaggauuucaccaucucucagcuccacugcaacagucugugugagugguaaggcacucagcucuucacagcauuuagagucacacuaagguuauuuucuaaaagucaaagauauggcaccuguggaagugccugucaggcuucacccugcaagauucaccuuaaacugaacaaugguggggcacagugguccuucuccauccuuggagaggcacugaggaagaccccgaagugcuuaacuugaucuaaccacaagacgagaucagauagacugaucaggaggguucuccaaaaccaauugcagggaguuugccuguuuggccaaggucacuaaagagaaaaugggguggauaaguccuuuuagaugaaaagagauugacuagccacaacagaacauccuacacaacacuguaggaaucuccuuuuccuuucuuuagugccagggauuggagccagggucgaacgcaugcuaguccaguacuccacaccuagcugcaucccucaggaucacucacuguggggucugucuuuucagagaaaaacaaaacaagacauccaaauccauaagggcacuggagggaacaggggcaggccuugaguguugcauuacgggaaugugcuggacugucaugaucauaugaggacugcuuuguaaucaggagauaauggagaaaguauucaugggugaacaagagcagacagaacuuauagcagcuugaaacauggagacaaggcauaucaaguguucauucuuccguuuuucugugauuuuuaauuuucucaaaaagcuggaggaagaaaagaaaucauggagccagcuuugauuguagaagugcuuugucaccucauucugauauuucgauuguguuuuaggaccuaagugaaaccccaucuucaucuuauucauauaaaauccuaaacgcauaagcauaugcaacaacaauaagcaccuugaaauauuuauaagauauucccacuuaaacaaacacaauucuuggucucaagguuguuggcaagagaaugugucuuucccauucuuccuguuuuauaaauaagaaucagaggaagaggucuaaccagcucacccuaguccgcacacuggcacccaaguccucucauuguaucuucucagcacaccuauaaauauccaggacuuuaacaaaaccacgcacuccucaacucuuuuuguaaagaguuaagaaggagacugugagguacuugcucaucucacugugagaauuacugauuagcaacccuacagguggcugugcucccuccauucaacaugggugcgagugcugugaccccucagagagacacugcuaagaacagcucuguucugcagcccaucugugcagguagacagcuaguauggauaucugucuccaguuccuaugcaugccaucacagaccugcuguggagcaaggaggaaccuauaggaauggauuccccugagagugagucaacauguccuuagcauauugaguuaaaucaugucacaucucuagaugucuuuuagagagcugacagcucacggaagggagugcaugugagucaccgauagaauacuaagcggcucugucuucaccugacagcuggggcgagcaaaagcauucucucagucucuucucucucucucucucucucucucucucucucucucucucucucucugucucccaccaacuucuccccuccuucccacuucucucuauauauauuuguaauggaaaacaguuuaaagagaaagauggggggaaaacaaaaacaucccccaagccaaccaaccaaaaaaccauuuuaaaccuggugggguccucaaccuagagaggacaaacagcucaccuuguuucuuuaugagucuacuaguaggggcugcauuuacaacugaaugaagauggagagaaaaaagaaaguagacaggagagagaaaacacaggaaguuguacagaauauauucauguccuuucccaagaucauccauuccuaccaggauuuuauagauuggguauucagucuauaacugaauucuaaccaaagcacugugugacaaaaacuggauuuuaggaaguguuuuucuuuacagucaacucuuuacauauauccugcaggguaacauuucaguauccuauaauucuucugaaguuucuuucucaaucuguggugaacacugcuaaccaggacccuguuucugacaggugcgacccuagugaucugugugcagaccuucucgggccucuccuaacucggggccauuuuucagcaggucuugaggacuccuugugaagcaguaugacagccacuagcaugggcacucugucccauggacucugcugcuuuaccuaagaucauucguuucucugcaggaagugcgagaaacaaacaaggaaauaaacgggagaaaagaagcagcuggcgagacaugggcacaauuuaccaaucacgguaggauuagaaacuacuguggaagcagccaagacagagagaggaaggacuggacacuuaugauauuccuaacacaucucucucuguguuuuaaauuuuaaaauuauuuuguguguuucaucugcacauacguaugugcaccuaguguguguauaacugguacucacagagaccaggucuccuggaacuggagugaccaauggucguaagccaccaugggaacgcuggggacugaacugagucuucugugagagcagcacuccuaacacccugagcugucccuccagucucccacaugugguuuugaaauauguaugcaaaugaaacaugaagacguaauaagaucuucaauuagcuguccacugcuggcccccauacuagccuugaacauacacuguauaagacaugcacauaguccuuaggugugcaucugguuaacugugcauuagcuggugaucggcagcuaauggccagcuggacuugucccugguuuguuguuguuguuuuguguuuauuuguguuuuuuucaaacccaaaguguauuacugagccauguacuuucugcugagugauauuuuucaaaucucagaccugaucccuaucaccacaucacgcuggggaaagccaaaguggcagagagaggacagcucccagggccucugugugcccgggguugggaauuugggucuuuccgcacguuucaguccuaacugcuuuagcugucccuagcgcuccuccauuuccucuugugcuuuguuucaauugauuugauaaaucaugugauucaugcauuuuauuuauuuauuuauauuauuuauuuacauauguguggagucuggaagugugcauacccaugugugugaacauauaugcagaggccagaggaggacaucugguguccuguucugucacucucccuguguuguucccuugagauaagguuuuucacugaacgugagccuccuccauuugaucaggcugcucagcuucugagaacugccugucucuucuccaagagucuguuguuauaggcacgcauggccaugcuuggcaaccuuuaugugauugcuggggauuugaauucaggucuuugugcuuguguagcaucugcucuuauccacagagccaucuccccaaccuccagcuuucuuaguuauuauccaucugcccagcaaguaaaaauguaacuucuauaagggcaauauuuuugucagacuuauuaacaucuaauucuccuggguacucagaaaagugcuuggcacacgguggguauucagcgaauauaaucugagaaugaguugaucuuuuuuguguuugcuuguuuguuuguuuuugguguggauaccuuugaaaauaacugcaggcacaagaccaucuuuuaggccgaggccuggaaaaaaaaaaucuaugauuaaauuaaugcagagcaauauuccaaggagaaaacaaauaccuuauaagaaaauuauauugcgcccucaggcuugauccuucaugaccccacagacccuguuuagcccuguagcuuggccuucauugggguuucagcaucuuauaauuucaaggccuugagugucucccauaguuacccaugagaagaaagguguauguucauuaucugguccacuccacaaauaaggcuuaagugcuuagccuuggcucugagggagguggugaacucacacuguuggcucauucccauggugcuuugccuuuuagcucuguauuugagugaggagcugagguugagcagggacaggaaccugccugaaugccgcuguggccaaagccuggaucugaagcugucugcucugcccugugcucuuugcugaaguccugcuccagugaggagacccgucccagacuguggagggaagcugacuucuccccagggccgacuucucuucuuuuggcuucaguuacuacuguucuguaagacugaauucaaaaguaagcaacuaauuuguuuggagaaggaaauuuuaagacagaguaacauucguguugcaguguggcuccugcuggcugccuugagucaaguuuacagugagagucaagaacaaaaccagaguagaaugauguaaacaaaauauuuaauuuggcccgaaaacauaguuugacauagaugcauucaaaguugaagacaaaucaggcauagacaaaaggggccauaacuguuaaagaaauuagugccauuaaaaaaaaaaaagcaaaaaaaaaaauuccacgggggacauagaaagaugucuuguuggcaagaucucacccauugaagccuuggggauauaacaaaugcacacucauuuggaagacuuucuuuucaaaggaugccugaaaagagagaguagccagggcuccuugcuggaaauaggcugcucagggaagugucuuuuuuuuuuuuuuuuuuucucuuuuuuacauucagcuucaaaguacuaugaggcuauuucaaccauggucuagaggggccuguuuacuuugcagacucgagaagaacuugagauaauacacaugaaacuggcuuuucaggcaucaggaacacaagaauuacaagacugcaagauuuuaaagaaaagucuagggagugggcaggcuguguguguguguguguguguguguguguguguguguguuuagggaauagacuucccauagggagccccugaguaggcuagucaugaaguuggaaggguaaaguaaguugaauuacacagcccagaugggaugcaugcuuaggaaacuuguaguaaguugaguggauccggcucaggagggagaaugugugugcugcaggcagcacagaggugggcugcucaagugcacuggagcucagacgaugccauaucccugguuaacguguuggacauuagcuauaggauuuaacacuuuccucugggauuuggauuuugauuucauucauuuuuuuuccccuggcuuuucuccugucccaucguuugugguggggauguuuacucugggccauugcacauuguaaguauguaauugguuuuuauuuucacagggccuuacagauuccuaucuacgagacugcuuuaagucucauuagauacuugggaguuuggacuuuuaacagaagugggacaguuacgacuuggaggauccuugaagcuuggcuaaaggcuuuugcauuguaagaugugaacaucuugggagaugaauagaaucuaaaauauuucccaugggcuuguauuuuaaacacuuguggccaauugguagcaauacuugaagaggauguggaaccuuuuagaaacugagccugucugucagaagucacuaggggcuggaaaucacugggcgcaugucuuagaagcuugcagccuggcucccaguucuaaccugugucuaguuccuggguuguaguauuguggaacuucugcugcacgcuuccgguaaugucuucccugaaaugaugggcuggaaugucucugaagcuacuaugagugaugcugcauaucauagucagagcaacacagacacacaaggcuaauaccccaugcugcuaucagacugggaggagcuuuuaccucugguuauacagaauaguuuuccugacacauagggcuuagcauaugaaauguguaaguccaaauuaugguauauacuguggauuucaaauacuuaguaugaaaagaguaaaacauacauuucuaaaauuguuacauguugaaauaguaugaguaguuaaaauaauacuguaaccaaaccuaucuguuucuuuucuucuucuuuuuaguaugguuaauaaauaauucaaauugcauaaaugucuuguguuauaucuuucuggcacaacauugucauauggcuugcagagguuuucuucuugcuuuuauuaugauuuuggggccaugguggggcaccuuuuagaggcaugaaauaaugaaauaaugccucugaaaugaaagaauaaugaaaguuagagccagaugcacugaccaguuguagguacaugauauauauauauauauauaucagguguuuaaacuuuuguucuaaaacauuuacuuuggaaaguaaaguacccagguucuguauuuucgaaccaauaaaagauugacaaucg

SEQ ID NO: 1449 - RNA, 12356 nt, Mus musculus
ucaauugguaaauucauguuacaaguuuuaauucaaaauuaucuucugauacauuagguuccaaucagguuuuacauuuaguugcuagcacuaccaggccauuccuauuuccuuuuccuauauacacaacggccauuacauaauguaggcaagacauuguaauuauucuaaacugcaccucugcaaaaaaaaacaguuaucugccauaaaaauuuugcuucuuggcaaucuaaauaagauauuugaaacaguuuauaaaaacaagauuuguauuuuauuuccuuguaaaaaucuuugcccaugcagacaaaccaguguuaggaaaguauucaccaucauuuaaacaaauaaccacuuaaauacaacaagucugcaaguuucaucuguauaaaaauaagauacauuuuuacagaauuuaugcuccaguucuuauagcaauaaacaauacacaacuauaauaaaguacaauugaaccugaccaugguuuucaauuagauacugcuagggcauuuuaaugugcaaaaaaccuuaacauaguucuuuuccaaagaaaauguccucaguguuucuagaaaccuagacaauuuuaauaaaucauuuccuaaucaguuuuuuuuuuuuuauguuucgauugaguccacacaucauuacacugcauaugggcaacaccaggaaccgcugcagugucagaggaugaaagucagcgccuaugccugccauguccugagcgacugccaccauggugcuugccuuuaugggaccucucaaaggagcgagaucguucacgccugucucugugauguccccuuucgugccuguguuucuugguaacaucugagugaucccgagucuugcucugagaucgagaccgagacuuuuuccucuuaugaccgugucuauuugagcuuuuuaaaucuucucugguauguuuggccuuaaggugaggagaaccaugauuaugaugucuucgagggcuuucacugugacugcgagaccugcuucuugaucuugagcuguauguuccagaucgacuucgccuauuauuauaacuuaagacaauaaaaauuucaaguuuagguucagugucuacuggcaacagaucaauaacuguuguucauuaacaaguucaaacaauuagcuaugaguaaugacugaccauguuccucucuccccauccugaccccucaauugaagcuuuauuguuagguaaaacacccuauuucaguaaagugcaucgccaauguguccuaaagcuacacgguuuccacugagucgcucccacaugcugaaacaucacaagaaagcuguuaacacagcugacugagucuuagguuguguaguacagcauuagcggaauagucacguuucuaacaaacuggauagaaggcauuuuucacauaaguaacaccuacacacacacauugccuggacauuucaagaaacuaugggggacagggucgggauauaugaccagaauaaacaaaaaugcuauuaaggcacacaacuagagucaaugaaauggcucaucagguaaagaugccugcuaccaagcccaaagucccugggacccacacauacauuugaaguuuguccccaaaguuuuuuccucuaugcuaaaaguccaaguaauuccuagcaaauuaaugcuauauacuaaaacuugcucaaaacaaaacacaacauacaaaaacaugaaauacuuauuccuaauucuggaggaaaaaaaaaaaaaaaaacaacauguuaauuuuaagaguccaaggccugcaccacccaggaccccuuacuuacugucuucuugggcugugugaucuggaacgggaccugguucuugaccuugaucuacuagcacuucugcugguucugcuucucuugcugucuuuucuuacacuuaaaaaaaaaugcaggcaauauuuguuauauuguuuccggagguguaccaccuguuacaaagguguaacacugagugcucaagcccuugagguauacauacuuacccauuguaagggcuuuuugacgccugcugucuauccucagguucuuuuuugacugucuucacauuaauggagacuggugauuucucuucagcuuucacuucucuuggugaugcuuuuaauggaaaaggacauauuaaaaacaggauuuagcugaggagaaguuuccuauacaacauacacuauacuucuaauccuuaagcugauuugucgcaaaaccaaaccaagcaacaacaaaacaaaaaaacccaacacacacaauacuaacaauuucuuaaugguuucuaggcaacugaccaaugccaaaacuuucuaaggaggauacacuuccagugccuacauuuuauuuaauucugaauguaucucacaugguuuagaggcuggagaaaauccaccaagaguugaaagggcuggaguuccaucaagauucaaucccuuugcuuuuaacuuggcuuccuguaaggcuacuuuucuuuuuucuacuuccuuuuccagcaauucauaguuaggcugauggaugaaagugacauuaguuaguauuccuuuuauaacaguuacaaucuccaaaauggcaucagcaccaaccgaguaacugagauuaccuuuuuccugguauaaagucuaagcgucucuaugcagauuuccugaaucuccucuucugugguaccaaacagaagaaaccaauggggccgaguuggcaagggaaucuaaacaaaagaagaaugguucaaauguacgcuuucucagaaguaacaaaacucuuggaauuuacaaaacacagcaggcuaaauacuuacuugaagugcucuagcugcaagguagauacaagcacaugcuauagucucugguugaaagcgaacaaagacauugguucgaagacugucauucauguaauuccugaaaaacauuucagcucuaaguuuaguucauaagcaaaccaguucuccugaaguacacauaaaguuggagacucaaucuacuucauucuuuuuucuucuccuuauauucacaucuuuaaauuguaccauguaguauuuucuaaccacuuccccacagcacuuuaaguaauucuacauuacucacauagaucuuacucccaaagccgccuccuaacacacaguuauagacagcaauguuuuggaagucaguucugacacaaguucagaauucaccacucccaacaagacuucaagccuuaguuacugaccaucucuccuuuauccauaacgaaaagcagugucaaucaaguucuuuaaaaauacuaucaacagggguaaaaaggcauuuuuaguaagaacccaccaaaugacuuauaauuaaaaaaacaaaaacaaaaaaacacuugcaaaaaacuagguagagaagugaacaauaaauacgucacaacagccuuguuuaauauaccuuuugcaauuacggauaaauaaaaacaaugaccuaaguucaauuaaauaaacuuagaaaucucuagugaagcuuccccaugaaauuucuuaaauagaaaacuuuacaauuugcuaaaaagccugagcuggaaauuaaauggauuauuucuauaaaauccuuuuacucauuacuguauuugcuacauaaacacguuaaaaacucaugcauuuuauaaagagaugugguuuuucaaauguuacaguucagugucuacugaauccgagagaagcauggcagucauaaaaacacauuucugaaagauccagaauuauuuaaugcuuguuuaccagcaguuacaugaaucaucuaugacuaaaccacaauuuccucgcuuagccuuucucaaagguccaaggucaaaaaauauuuaaagaacauuaacuucucuuuuuaaaauuaauugcuucuuauaucacugccugcaguagcucaacagcuggagauaccuaaaaaacagcaauggguacccauuuaaagcuacaaguguaagguagccucagccuccuuugguagaacggaugcuauacacaccgcaaguugaaauuuaacugaacccaauuaaaaaaaaaacaaacaaaaaaaaaacaauucauaauggcuggacaacaaucuaucaaaaaugaaauagucauuuugauagucacaggcauacaugaaauaauacauaggcaugaugcauaguuacuucuagaagcaaauauacaaauccuuuugacaccccgacagaacuagaagacgcugccagauggguauggaccacuucagugaaucucggaugagagcuugcacuggacuggcuggagagcaggcuagccaaucaggccauccugaggucaugggcugaagugcagagggcagaguucuaugacuuaccaucauggacuacccuuuaauuaaagaguagaaaaaagaacaaaguuaaauugaguucuccaucaaauguaauuagucaagccaagaaaacaggaagcagaaauaagcauuauuuaccuuuugguuaaaaaacaaaaacaaacaaacaaaaccacaaaaugccccaaaacaaacuuauuucauuauuuuggaaagagaaaaaugaaacuuacuuuauuucugcuucuguuuuccugacuaaagaagcaauguaaaagaggaacuuaccaggcaguuugaaccaggguuugguuacguucacauucuaagacuuguaaauacauuacaaugaucugaggacaagggagaaaagaaaaccacuuagcauauuggugguucuuucaccgcagaguucaaugaauaaaacaacuggaaaauguuaguuacaauucuuauaaauuuacaaauauacaccaaccuaaauaaaacaugcaugagacccaauguugguuacuauauuacucaauuuuuaaaaacugugcuuauaaaagugguuaauaacuguuuucuaauuucucaggguauucaccaaaaaggguaaacuuuauguuaaguacacaauggccacaguauuuucuagaacacuaaguaauuucuguaguacagcguagcauacugaaauuucuuaaauaaaagcuacauauaucaaugacugacauacugucuugcauuugguucccagcaagacacaagugcacauagcuacuaaguuuaugauagcuguuucuggaccuacauuaaucaucacaugucagauggugaaugcugagugccaucuggcuaucagcagagcuagccaucucggucccaguucuuaggacuacugccuagaagaguaccaugaaagccaaggaaaagcucuuauucaugguuuacaguaagcagcuaccaccuucaacaacugaagugugacacguuccucagauauguacauuucauuccuucugucaagaaucccacaagaauguguuaggaggaaaaacuagaauuuaaccacaaagauuauucauuuucauguaaagaagaauaaagccugcucugaaucccauuuuaaaaacaaauaucaacauccaaaagaaagcuuuugaaaacuccgguuaacuuaacucuccacacugaauucaaaauuucagaaaaagcccuaauacuuacgaauuguaaugucuguacuuuacaacucaccuuauggggaugcuugacaugaacacaaaaucccaacuccuuuagcacccuccucucugccuugauaacuugauuuuugguguuaauguaguucugaucaaggaucagggggcuuggaguccuauaguuuguaagaaauaaaaucaaaacuguuuugcacauccaaaaaauuuuauuuguggcaucuccauuuucccuuccaaccaacuauuggcaacagaaaccagcuuuuuaaacuccugcuaacaaguuaaagcauuaaucuuaugcuguccaaguuaugcuaacuauacuuaaguagacaaagcucuaaaaccuaacacaacuuaaaaaaaaacaaaucuaacacaacuuaaaacucacaugcucuuagaucuacaacucuccuuuugaacuuacaacacagcuucaauaucagcacaaaccuuaucaggcuuccaaagacaauauacuucugaaaagauugaucaucaaguucuaacaugaacaaagguuuuaaaaaacugaauauaaacccuuugcuaaaugcuuggucaaaauaaaagcuaaagaaaacaaaagguaguuauucugacuucccuuuugggauaccaugcuauagacaaauacuccaagaauacugaagugcuuaguuagcacucccucucauccccagcaaaaccaagucagcucaguugccaaaugaaaucucuacaacuaggucagagagugaauuagagagcuugguuaaugucguuccuaugagauugauuuuaagggcacagagaaggaacagagacucagaccacauugugaccugugagggaugccccagaguuguaggggaagaaagggauagcuaaccacucauauauacaaaaaaacaaaaaaacaaaaccucaaaucauccuguguauaaguuuccuuuaaaaauauaaaugaagucuuucuauggagcucauccugaagccagucaugugucccgucagaggcaagugcaaccagaucuggcuuuuccuacaacccgccaauuuaguaauuaucauguuuuuuuggauauacucuuaccuuuaaacagcaagguguauauuuuuauuaaauacucuacaauaaauauauugucagaguaacauuguaauguuuucuuaaauacucauuucauuuucauccaaguuaccaagucuuauacucuuuuuaggagauuauacuagcaaauauacaaccuuuaaaaaacaacaacaacagaaaaccaaccuauuuuauauccacuuaaaaguaauaaaacaaucuaaccuguaauauugagccaugaguaguggcucaccucauaaucccagcacuuugcagggguugggguagaggcacuuggagauaagaguucaaggacauccuccacuccaucaggugagcugaggcaaaccugaguuaacucaagacugaaaaaaaucugaaaugaaguacauuaacuaccucccugguagcaggcuagcaagaguaaaacccaauuauauuuuucuuguuuucacuuaaaaacaagacccaguuauucuguaacucugcauuaagcuauggcagaauuauaaacaauaacaaaugauggaaaauuucauuaaguucaauuucaauuacagcgucaaaaagucuaagaaauggccugauuugaaucaacuuuaucagaauagcuauaaacugcacuuuuggagaaaaagucgacuuaacucaaaugggagcaacccauuuauggagaaaaacuccaaugacaccaaguucaugauuuuucagguuuuauaugcauucuaagaaauuuuggagacaaacccaauacagacuaauuagaagguuccccuucaacugguauugggagucaaagaggcugcaguguaucaucuguacagagcuuggcucugaauucaauuccuaaaagccagacaguaaacagcaccauuaaaaauccauauacgaacaguucacaaacagaguucugucucacuuuucuucaaacauuaaauuaugaaauuauuuuucaauuguaauaaaauuugcaaacagaacacuuguuucaaaacuauggcuaccaacuggugccaaauuaaauaaggauucaucacuaauucugcuuaaaguaucuacuauuccucugccguaugcacauuccccaccucaucagaaucugcaagaaccuauaaagguuuuguuuaaucucaagagugaagggguucagcacaaggaucauaaauuacuggacacccuguacgacacagccagagucuuaauuuccaaaccucucaucaacuuucaaacaggccaaggaaacaaucccacuaacgaucuuacuaaagcucaaccaucuaagcucacucagucuugccacuacuagcucuguaaaugcauacucuugucagaauucauuuuaccucauaaaucaaggcaggcucaacgaauacaaaauugucaacuaccuuaauauuuuauaccaugaugaaacccagaaaaaaaucuccauaaaucaggaagugaagauucugaaaaagcauuuaaagcagaagcuuucuauauuagcauuuauauuagcaaagucaucaauuaggaauaucuuuagcaacacagaaaguugaaucaaggcuugccagacugucuucccaaucagguaaacauccuugaucaacaaugcagaggcggcacuacacauacacacuaagggagacaagccucauguacucagagaacucagggauagguaguaacacucaagaccaccagacgccaccugggaaagguucucuauuaccuauucuuuauuugcucauuaacuuauuggaaaacaaauuugucuuuaggaaauguuggucucugguuauuaagaauuuauaugauaguuacuuucuguaguaugccugaaacacaugaauuacaagcauuuagacugggaguguucaagcauggcuggucucacucaugaguuacaaggacugauacucugaaaguaguucaaggaaguauacugugaaacagauggcuaauacaagacugcuacucaacacagaaaucucuaaagcuuauuuuuaaauaggaacacucuuucaaugucaacaaacugaagguuuuaugcauugaaaacagaauaaacagccaccaauaaaaguaguuaaaucuuacaaguuuaucuucuuguaacagaaaccuuaacuucuuuaaagagaagacugggaacauuacauagaaacagcaaauuuuaucuguaaaccgcggauauaaauagcuuuaacuuuccuuugaauucagcuauucuaaagaauuaccaaaauauaaaaaacuaaugagagauaagucaauuaucucaaacugaggacugaaauguuuuguuuuucuucaaacacuugaucguacuaucuacauguagcagccaugacuagaaaaggcuauguaccccuuguaauugucaaggccauagaauaaccuaguuaauuugcacaaauuggacuaaaauucaagacaaaccaauaagaguaucagaguaaaacauuuaugaauacuuucuaaccaugcccuaugggggggaaaaagggaaagaaaaaaagaaaaauaaauaaaaaccccaccaccuuuuaaagcuauaguuuuaauaacuuggacagcaaagacaaaagcuuuuaacaagaaacaggaguuuuuuguuuguuuguuuguuuuucucuaaaugguucaccaguggccaaccuguuaguccccgauuccagugaccuauucucagaacacuggcuucuccuuggggauuucgauacuucacucacuguugccaugacgacagcuucaucucuauguaccacuccacaucacccaggcuuugguaaauguagcuggucgcuguauagucgguugcaagggaaaaaagaguugaaguuaauaacauauacaaguuacaugucugaguaaacuuguaauaugcauagaaacacuuauauccugcuuuuaaaaggggggcuuccaugcaauuaacuucuuuaagaauuucaugcuauaaucaaauuugaaacauugaaacaaaaucaauuucucuuuaaugaugaucaaaaaugaaguuuauauccaauacaagccagucagauugaauuauuuuaaauuuugaaguuuuauaaaaagaugauccuauucugacaccuaggaaggaagaagucccacagaaaaacaccaaacgaucaugugauuauaguuggcucaacaacucauauacuacuagaaaauguuccuuuauucacuaaaaauaagaauucuguauuucaguguuuuguaaaaacacccugaaaaaaaaaaucagccauguaaucuaaaauacaaguauaagcucagaacauacuaaacacuaauuugaaacucccccauuucucaacuuucuucacaaagaacuaaaaauguuuucaaacagaagaaauuguaucugggcacauaguuagaaaagauggggcugaauaguauagagaaaaaaaugcuauaaaaauugacuguguuacucauuucaaacuuccacuaccaccaacuuauagcuuccacaauaaagacuaccuauguucaauacgcauuaggacuaagcaacacccaacucccaaaacagguuaucuugucauagcuaaauuccuuccaagcucacaguuccuuagaaacuaaucuacaccacaaauauccaucagccuguccuagaaucaccuguagagccuggaguacugcaacaagcuuugguacugccuuauaggcccacauaaaguuaccaggguaucacuacaccuaaaagauacuguuucagacucuauuuucuuacaagaucgaauaaagagcccuaucugaagcaacucaaugaguuauuuuucuaaggaacucacugagacuacaucugaccaaaacagaauaccuguucaaucccuuugacuucaaacuuuaucauccuccaguccuuucagaugcggcauuaugcgauauaucguaguucaauguugagaaguacucuaacaaaagccaaccucaauugaugaagaaacugggacuccaagcagaaaaacgaccuacacggaacuuugccacaacauuaacuugaacuacagggcuuacauguccagccuucaguuuuccagagaggggaggggaaacacaacuuacagaauacacucccacuugagccaaccguacucccuuucuuguuuaaucuuaagccaagggacuggcuucacagcacucuagaauuguccacaaugcaacugucucuacaaacuucagauagcugguuaauggaggggauuuuaaaaguuucaauguuccuacgugaauuucagcaccuaauguccgcuuucuuuugcauccacacugacuugagggaggggagaagauguuuugacuggaugauuggugcacaguacagcaagagauacuauguucaacaggccaaucuuaccuuuuuccucuuaacuggcggaggugguggaauacauuaaucacaucucuuauucuucuuggcgcuucuucgauuuuugacgcaagauuaauacaggccauagcaacaaucugaaagaacccagguaaaaauccaagugaaguuaaacuagaaacaguuuaacaaagucuaacaacccuuauuuuguuuuguuuuuagauagggcuucucuguguaguccuggcuuccaggaacuccaucuguauguacaucugccugcccaaggaugugggucaccaaggaccggcaaagaacccucuuuaggauacaacgggcuuuuuagcgaaauaaaaucgaagcugacauuuuuagaccagcucuuacguuuuauugcucaacugcucuuaauuuugggucagaaucaagcuaccucuugcuagaauugugcaauggcuugaaaacguaguucuugguuaacagagcacgugaacuggggauccauuuucuaguucuugaaacauugcucuacgggccccauuuccuucugggugggaacgagguacaaaggccuaagcuaaccacucccuuucuggaaaagcugguuccuacccccuuccuccccgcuuccggaugaagaaaucccuucuuguccgccuccgccgcgcuuaccucgaaacuguguuugacgaacgacuuggaguagaagaaccgauggaacagcaccugcccuguagccaucgccaccugcagacgagagaggagaacggaagcgccggggucaggcgggcccgcaccaggcgccgccgccauuuugugcggccgcucgcuucccuucccccgcccgggccgcgcggcgccgcccgcccccgcauccccacccucgcccgcccgagcucccgccgccgccgccgcccggcgcaggcuccggagaaaccuggccgcggcggagaggcccgcaaccagccgggguucucaccugcggcagccggaggaggaugccggcggccuggaugagcucgcagcccaagaugcgcagauccgucucgcugggcagguccaggccguccugcauggacgggguaggcgagagccgcuccuccgggaucagcgaguggucgauggugagcgacaccuccgaauacaggcggucgccgaucaggaucccuccggucguggucgucgucgugguggucgugccggagcuggagccgcccgcgcucggggcggcggacgaggcggaggcggcagcggcggcggcggcggcagcggucgaggucgggugaggcccggacgccauaguuccagcgagcuccacgcacgcccgacgcagccggaacccaaagcgagacuaaccagcguccucggcgcgacggaucuucccgugaccgccggcuuccaggccgccgcacgcagcgugcgcuucc

SEQ ID NO: 1450 - RNA, 5932 nt, Mus musculus
acgguuuccugagugaaggaggaagagggaaggaaggcgcugaggagcgagcaagcgcgcacgcccagcccagcuaccgacugacuucaccaccucaccgacacccacuuggacacccacucggcuggccagcacuccacacugacgggacccuggcugcacccgccgugaucucuuugaacuaggauagcccgcgcugucucccccaagauggaaaucccacccacccacuaugcugcguccagggccgccucgguggcggagaacugcauuaacuaccagcaggggacuccccacaagcuguuccuggugcagacgguccagcaggccagcaaggaggugagucugcgaggagaagcccugcgaucggcucccccuacugcccccaccccaucccggccgcgggacccugcucugccucugaauagcauugcuaugagcuccccuauaugggacucaucccagaacuguuugcuuucacgguaaagcagaggaccuaugcagccagauuuugugcauauuaguuuaagggauugggaaauacacgggguuaaucucacccuuuccuguggagagaagaggucuagggaagacagcauucuaaacaaucuggaagcuguuauaguuucuccaucugccgcuagcuagccuuggccaacaaaagcucauggccuccaaacgacuccauaaacuuuuaagaguaacucuuaagcccuuugcccaaaacgacgggaaaacgcaagaaauucgccccgaggaaaaaacaaaggcagugugggcugcucgggcuccagccgcccacauccugccugacaugcagccuugccucugcugaagccggcuaggcuaaagggccucaccuaccuagcgagugucccuauuuuuuuuuucuuacagcucaagauuuuuuuggcugacaaagaaaugauuuuuauuuucgaaacuguacuagauaauauaaauuaguuacacacuucaaaacuggcuuucauuuaaaagggggauaucuaaaugaucuauucauaaggucuuuugaagugguguuugacaggacaguaucaacagcacuuacacacacugucucugagcacuuggcacucauccaccacacgucguuuacucacugaacacucugguacccccggcuuuaagacaaacccuuccaaagaugugccuacugccacugcaucuguguccucuguacguuuccacccgcuuccuagaccuaccuaaauaaacuugcuagauacugccaaguccaugcuagacacccgaugaccgccuuccugagcagccgggcuugggaagcgaugaaggaugguaagauguacagucaugaggaacgucagaacaagaccccugggauguuuuaaaagacgcaaaacuuuaguguauuucuucccaccagccacccucccagucacguaauaagaauguccuaacuaaaaagaugugauauauuacaguauucuuuucuccacuauauuuuuuucuuaauuuuaggauaucccaggaagagggcacaaguaccaucuuaaguuuucuguggaagaaauuauccaaaaaguaagugagcugucuuuucuagaauacgcgugcguucucaguguugcggcucauucucgcugaggguuuacccugggccuccacugcggcugcugggagauucugaguaugggcagccauggcucugcaggcagagcuucacaagccaguguggacugccugagcacuuucuuucuguucaauuguuuagaaaagucuguguuucaguucaaauaaauuacccuuaaguagauuccaagcagucugaauucacgccuuguaggacugaaagagguaauuuacucuccagucaugacuguuuucucaugccugccuuuuauuuugguuuuuaauuggauauucaaauuaaguacauuuagaaauucaggaacaauagaaccuccaacagugauuccacuaaucuugcaguagugggacaggaaaguuugaaaauuuugaaugcaugucaaauuaucaaugaaauaaauguaaaagaagggaacuguaguuggcgccacagccaucuugaagccgugggaaguuuuccucuccccgaggagauaacaagaggaaauccccugaaaggcacugagcuacuagacagccaucuccauagcaggcugcaacccuuacuuuauauuaggagagacugcucgggccacauuugggagaaacaguggcuucacaagcagagggaggggguauggaacaagcuuugguagcccuccuuugguaggcagucaggcuaaaauuugacauuguaaaccaccaccccacuaacagacagggcuaacauuccuaagauucuggaaccuagaaacuuacaacaaugaauggccaucuguaagacugaucuuuuguguuacuuuuguaaaaaaugcucucaacagcaaguuacagugaacugcacagcugaaguucuuuacccccaaaugggacaaggcucugcaccagaagucaacuucacauucgaaggagaaaucggcaagaacccagaugaggaagauaacacauuuuaucaaagccucaugucucugaagagaccgcuggaagcacaggacaucccagguacacacauagcgcaugggaaaugauguucugccaacuugagaugcaccucugcuguccauccucaaaacuguuucaugguaucuagguuggaaauaacuagacuuuugcaaaaauacuuacuucgaaucuaagccagcaaucaaaagaggcuuuuuggaauuuuauacauucauggcuuaauuuaguguuuacccauguuagauagcauaacuaugacuuaauuuuuaaucuaaaauguuuucucuaccagacaauuuuggaaaugugucuccacaaaugaagccaguccagcacuuagccugggucgccugcgguuauguaauguggcagaauucgacugaagacacaugguauaaaauguuaaaaauucagacggucaagcaagugguacguagucucuacacagugugcuauuaacaguaauacagacaaggcacuggaguuuggaguuggauaguguuccuauugcugucuuguauugaaaccagugaggcuggcagucugaaggcacugcuagucagucagcuuagaggaagcacggagagcaacaacacugguccugaaggucagguggcuuguuagagagaacccagacgaggccucuguucauaauaccugccuucccaacagcugccucugguuagugugcuuuccggggucacccgauaugggaagugagugugagcaagacuaaggguuuucuaugaagcaccuucuaauaaugaguaguucuagacugcauuuucacaggcuuacgguuugucuuucaugccaagaaauucagauuuuguuaucugugaugcuuuguucagauccguuccagagcaaaaggguuguagcuuuguuaguacguauacaacaaacacucagauacacuguacacuuucaaggaaucacccugucccuaauuugguuuccacagguccugagggccacuuuuuauagcacucacaaguaaagccgcacuuccaaaacuaucaaguugugaguccaaaucugacacuuuuuaauguuuuuuaaauauauauauguaauauauauaugauauaugauauauauuuuuuccuuuggucuuaaagaguagcuccuuuagcaaccucacuagugaaucugaacgcuauugucaaguacugcagagcuaacugcauuuuucuuuacugaaugcuaguuccauggcuacccagagacaagacuggcauuucccccuagagagaauuguggcacuguggucucugucuguaaacuuggagcaguuugaguuguuccuuggcucauucgggauucuuuucucuaauccuuuuagucacaguuuaugaccucacauuuuguuaggagccguaugauuucuuaagccugacaccauggucauggagaaaugcauuuuccuagggcagaaaugcauaggaacauguucuuuaguuuauaccuuuugagguuaaagaggaaauccaacuaguaucuaauggaaaacaagaaugaguacugggaagcaaaaagguuguuucugucaauucugagagaaaagggcuuccugcugcccucuuucagcuuucaggcaaccaacagcacagcaucacugucuucagggccucugucaccacuuacuagacacagccggugacagcucucggagacagaggccaaagcuuacgaaauagagucugcuuuucaggugcauucacagauaccaaccaaccuuggccacggcauuccuuuaaaggcccugaacuaccaauccaggccagguacaggccauacaaccacagucaagaaucuucaagcuacauccaccaacauacaagccagcgguuuuacgcucacaaaaauaaaccuauccaucuucucuguauuugagcgguauccccgagagccccggcagcaggcuuaaguacugcuuaguucaugcaugucauacgucuguaccuauuaaaauccaacauggaggaugccauccaugucaacaaugacguuagggaacucuuugcuuccacacucaaaggaaaacuuacuucaguagggagugguagcugugggcugcauguauaacaaacagugcgagcuggaggagccccaggagcgugugcugcccacuggagucucagcacagcaagaagccuucagaagccgcaaccucauggggcacagcacacuucucaugaugucuacagcuacauagaugcagugguucuauguagcucacugcauaauugcuuuuuauuccugaguaacaaucaguacggaacaaagcuuuaacuguaaaaucagauagcuuagucauuacauuuuauuauugucaguuuucuaaagaauguuauauaauugguuucuuuuaauaugaguucccauugccauuacugacacuaggguucauaaauaaaaagcuacauacaguaaugcuuuuaaauagcugccacaaauuggaaggugaaaaaucagagaagcgauuuuuuagaguaacaaaugccaaguaaugauuuuuaaaaaauggcuugaaagaauauuugaaagaagaauuguuauuauuuuaagaaacuaguuuucugccaggcuaaccugaagugaauaaaucaacauuaaugcaaaaaagaaauuaagaugucauuuuugccaugauguugucuaagcauuuuguuguuguuguuguuguuguagcaaagaaacgaugacuucauugaguuagauuacaccauucuacuccacgacauugcaucgcagguaacauauacaacuuuucuuuauuugaugccacucugaaaaucaagaauugcuuuguagccacacagucccuuuacuccuuuugaaacuaaguaaaaguuacugacaguuaagacaggcaccaagucgaaguguaucauccuuguagcgacuggauuugccugaugcuauuucugcugaagacauuuuaaauaguagcaucaagacaauagaaacccaauuauauuuucuagucucacaaugacauuagcuuucuuuacuugcaggagauuauucccuggcaaaugcaaguccuguggcauccacaguacggcacaaaaguaaaacacaacagccgccucccaaaggaagggcaggcggagugaacaagacgcuaacccguagacaaccgucagcaugcucgcuaaccacgugugugacuggccucacuggcaucuagccuaacgggccaaaggaauaccagugucacucuuuaugucuuggcuacaguaccgagcugcauagauuccauaauaaagaauaguacuaccuaaaaaugucuuuccaacaguaaugguacuaugucuauccccuaauaaaacuucacuucagccucacggag

SEQ ID NO: 1451 - RNA, 478 nt, Mus musculus
auuuuuuuuuuaacaaaaagcacaggguuuuauuucucacccuuugggcaggguucuucaggccuuugcagggcagggagcaggcucuacuugccagugaugagcggguuccgcagcaccacgaugaccgaguccccacgcaggaauaucuuggagauguagcaguccuuguugacaggcuuggacuucuucuugcccuugcugcucuuggggaccucaguccacaucuccuucacauuuuccagcaccauguugcagugccugucaaaggccuucacccggcccagcagcuucuucuuguugcgacaguuaaugagcacuugcguguuguucuugaccgacugcgagagcacugagaggggaccuguguugaauuccuccuccucccgcuucugcagcuccucuggggucaucucacucuuagguuuauugaggagacucaugguguagguuucgcucgcagaucacucccgcccag

SEQ ID NO: 1452 - RNA, 765 nt, Mus musculus
uugugggaauugaaccuaggaccuagagagcaacugcuccaccgucccucuuucuaugugugccagagcuccaauaucggaguuagcauaagcuucuuuccacccacuucacaggacuucuuuuggacauugguggguggagacuagcaaagcucaguugugaggcauggaccacacaggauggaagugucuucuguggguggagaccagcaauguacaguggaggugugggcuucagaggacgggaaugucuuuugcagaugugugccagacaaauuaucaugauucagccucucugaacucauuggaauugaaagccuggguacuaacucugaguacacauaacugucaucuuccaugccuuuaaacuagauggaaggcuucugggguucugacaguuugaagauucaucuuccugcaugcauuggaaucuaaaagucacaaugacaaagacaggugugccuggagguuggauccacaguacucugagaacucuauagccucugggguaaaugagaagccuacgaugaguacuaaggggguucucuguuuauguacagacugcagcggaauauguaaaaucucgacucccagaggcucuuaagcagcaccuucaggauuaugagaaggacaaagaaaacaguguucugaccuaccagaccauccucgagcagcagaucuugucaauugaccgggaaaugcuggaaaaguugacagucuccuaugaugaagcagguacguuacugauacacuccggcccuaccc

SEQ ID NO: 1453 - RNA, 1528 nt, Mus musculus
uggacaggugaaggcgggaggaucggaaggccagccuggacuacuagagacugucucaaaacagcaaaucaaauacugcaagccucuaagcuuuugaaagaaaauguccugagcuccgucauuggugggcgcucacuaaggugguuuagacucuuucauuagcauuugucaaugcuaagcaaaaugcagacuaggaagugaggugugguuuauauuuaaucuaaugcuguguuuauuuaagucagagcacacauccaaguuagcguagagagauuuccaaggaagcaaugacauuaucugugaaaacaauugaaacagcauuuccgacaaucugagaaagcagucggucugcugcugcuccuuaccacaacagucagggcagagaaccuuucugcauauuguuuauuucuaugcuuuauguauuuauguugauugcuuuauugugauuuauguuuauuuacuaugauuuauucucuaugucccuguaugugaccuuacauucuguuuuuaauuguccugugugcuugugcaugaauaaauaaccuauggcucuuugcuaaaaagauacauuaguauggcuuugagugggagggaugguggggagagcagacccauuucuacuugagaguuacugagccuguggcccuaagccuuggggccagagucuggaaacaggaacagagaugacuucuuauccuucaugccugcaggaugccaucuugucccagguuaccuugagacaguuucccagacugcugcuuagaucugcauuucugggcucuguucucagaccagcaaggaccauuauuucuauucuuaguagaucacuagcaaggcagccucgcagugagcccaaggaucagcugcggagcuaagggagucacguggugcaggccaggcaaggcaagaguugagcaggcugugaauuguguuaaccugagcccucugguacacccgggaccugcagauccauuuccaggcagucacucagcuuccgccugggaggugaggacaaagcagccacaauguuucagcgauucuggauggagcugagagcugaccugaagugaaauuacagagaagucucaucaaacacuggugugauuuuuagagaaauagcuuuuaaagggggaggagaaaugugcuguuagcaauuuagaaagucgcugaagggucccccccuguugagacuacuuuacucccuuugaaauggaugauaccugagaguuccuucccugguuuaauugagccauuagugucagaauuaucaguuguccaaaacggaaagccauuuacugucacgggaaggaacugacugcacuuccagaaaaccagacucaggagagugggaauuauuuagggccuuccagguuuucucucagagcauuuuagagagugcaguagcaucccuucacgggaaguuuuucccucugacagacuggcuuucuccauguguuucucaaacagcuccuaagggagggggaaaccauaaggcuuccuuacuuuuaucuuccaucaaucugucucu

SEQ ID NO: 1454 - RNA, 25044 nt, Mus musculus
cugcuuuuuaaaaauccuuuauugacaaauugauuacucaguagaaaacacacacugggaggguuaacaauacaaccugggucuuccacuuccccuuucuagcuuacacacugugauaguaaacacuaagaccgucucagccuucugugccuuuaggaaaugaucugccugaaguucuuauuauucccaaauucuuuggaggauaaugagacagaugaagugacaucgagaaacacugacuacauuuuuaaaaaacuauacaaagcuugaauuuucuugcuuuaauucucuauguuuacagugcaacagaguucaacagauuacggacagucaguaauaaccuuugaugucacauuaacgccacauuaauuaaacugaucaguggugaauaaaacaaagcucaaaugugaaaggcaauucaucauauaauacugagaccauacauaaccuuuaaacauuuagaaaauugaaaugacauuaaauaauacuugauuugauaacucuuacguaccauaucauugaguaccuugcaaaugaaaacaauacaaaugaauguuuucaauauaacucuguaaagcuuuuuacaagaaauauauauauauaucuuuacauaauaaccacuuaagauacacacugaaccauuauguaacuauacugucuaauaaauacaacuccacacuguauucuggcuguggacuaguuaguuuuucuuuuagggaaaucuuaagaaauucuaaucuacagccugagccauccagacugucugacccuuugauuugguuagcaaaacucuucguuugcauuauguuugacuccucugucaccuuuaaacgacccaaguuaaauucugugaaagcaaucacuaaguucaggccuugacuccugucuagggagcuccaugaguuucagcccaggcaaaccagcaugcucaacuucccgaguuucccacagugcuaacucugacccugucuacaguguccuuccucccuugccuagaugggugauggaugggcuuaguaauggcaugugguguuccucagcaucaccugccagaaugugaugaucuccuuggaagaaaagccaugggcugcaaucacgcgucugagcugacauacauccaaguggauucuguacagaaagaaaagguuugugucuucuggaauaugaauguccacuuuuaacaaauucaaacagaugccaacauaaacgucuucaaacuugaugggcuucacgugacucaucaucucguagacccugggcaccaggucgccggacauaauguagcccagcccgcugcaguagggagggaacaccuugaagggguacucuugguaugaaaugugguuuuuauggaaaaauccucuauaggaauaguuaucaauuagaggauagcccgugaaaaacuucucugagugguuuagguuuaaaagauacuugacuaaauugccaguguugaugaaaacaucagugucuguuuucaugauauacuuggcauuggggcaaaacuccauuacccaccugaaagccauaaugguuuucaaggucaaguuauuauaugugucuagaaagucuugccguauaauaucaccauagagaacgugcucauccuccaaggacagggcuaacguuuugucuucccuuucagccugcuggccuaguaagaaaaacgugagcaccucauauccccaccaggacuuuuucucaccccaaguaacucuaauggcuugucuggcuuucacaucugaggggcgugaggucaccaggaugaccaggaauggguucugaugagaacaguucgaguguucgcggagcgugaagcgaaagucuugucuguaaauuggcucauacucauagaaguacauccaguugacgcgcucgaucacauuguagugggggaggcugagguaccauaucaccaggaagcucagcagggacagcagcagcaggcuccacuugagggaucucagugacauccuauugggaagggcagucaagacagccggggccauccacagcagcagagaaguucagaaggcacagguucuacaggaagagcaaaggcugggugaguguccaccaccugaaccucaacucaucagucaaugucauacagucauuuaaugcacauaaauagaccaucaugcagacgugcacaucaagacccagguuaaaaugaccaggaaucauuuucaaacaacaccucucauucuauaugaauaacuguaauccuagcuacuugggaggauuuggcaagaagaucacaauucaagaccagccuaagugacuaagauagaccuuguuucaaagacaaaaaguaaaaagaaagaugggaaggaaaaaaaagggaagaaagauggaagcuaaaaauauuccacaaacaaguaagaacaugaaaucucugucuuugugcuggccucauuuuauuccauuuaaguugcaucaaaugccaggauucuacccucugauagcugauaauaccccucuuguagaaaagcaucuugcuuuuauccucuccuucaucaccgagucuccagcugaucccguauccuggccacugugcuguacuaaguaagcacuugucuucugaaugcacucuaugugcccacauuagcaacaccacucguaccaacucauccuauaaaaauuaaucagaaaauacauuauaccuaauaaauguuuuugguuuuaaucaaaaaaaaauuuaaucagaaaauggguauccuuuauaauacaggaaaaaaacccaugauuuaaaaagccuaucauuaggaaaccucugaggugaaauuacagcugucauucaacaggauuuguucacucauuacuugaaauuuuguuucccauaauuucuucaugucacugacuaaaauauggggcaauaaacaugaugcacaugagccuccucugaaaagacagagugauaaaugccagugaauucucuaugcacauaugcagagcaaggcauccacaaggaugugcugacugagucagcgcuuauguguuuggggccgccagaagagcuuccucuuaccuucuggaucacuagauuacaaaugugaugguuuggauuuccugucuuguuuuguaauaaaaacaaagcaaaaacgcuggauuuugugccugugcagugccaagucccacuaaguggaggugaccuuaugcuagagguugggagcccaagaguuagccuguccuggcuuuccaccagaggugugaccaucuacaagucagacauugcucucaguuaauguucucaauuauuuucauacauauccuuucaagccaggggaugcuuggaaaagcucauuuggaucggcagauaucacacaguaucuuacccacaagcaccagcacaccuugcucagagagguggguuuuacuguaccuauuuuauaagugaauuuuagaguauucacaugaaauauaaagaauauuuucaaaaauacuaggacucgggauccaccugugccugccucuccucugccuucagcuccagagugcugggaucaaaggcaugugccacugugccuggcuauugaggaucuauuuuaauaugauggaaacuaaggaggaguggaaugcaagacgcaaagguaaaguaggagacuaugaaaucauaccgaggacucuaaucacagcuacaagaaaagaaaaaggcaagaacaaaaauaguuuucccauggagccagagucgugguucucaaccugugggccaugaccccgggggagucacaugggucaccugagacuauuggaaaacauugaugcuuacaucacaaaugcuaauggcagcaagauuucagauaugaaguagcaaaacuaaucauuucaugguuggggaccagcccagcaugagguguugaaggcuaugguagaggugguagucagaugacggcucagcuggucaaacacaggagccgcacacaugcgagcaggguccucaagcugcacauucccaccauccugucccugaggaggcagagacaggaggaucucuggcauuuguuggcuggucaucagugagcacuagacucagugagagacagagucucaaaaaaguaauguagaaggcaaugcuguaauucagcggcagauggcuugcugagcgcccaaggucgcuggggagcaaccacuccccaguccuacaaaaucaaaaacaaaauuucugggggaaaaaugaaguagaaaaugacugaggaagacaccugacgucacccucggcuuucauacacauacacauaccugccuccccacaaacacucacaugaacaaguacacacacacaaagugaaauuuacacuuaacauaccagguaaaaaugacaaggugggggcuggagauggcucagugguuaaaagcacugauuacucuuccagagguccugaguucaauucccagcaaccacaugguagcucacaagcaucuguaaugggaccugaugcccucuucuguugugucugaauauagcuacaguguacucacauccauaaaauaaauaaaaucuuuguuaaagaaaaugacaaggugguaggcugaggagaugacucgguugauaaaaugugugccaugcaagcacagagacccauguucagauuuucagcacucacauagaugccaggcauggugccacaugccugcaaccccacuggggcacgggauagcuagguaaagacaaauggaucccuggcgcuugcuagccuccagucuaaccaaauuggugagcucuagguucagugagagagcaugucucaaaaacuauggagagaacugaaagucugauguugaucucuagucuccauacacacacacacacacacagagaccugccugcaaaagacauuauaaaugaaaaacuuuguuccauaggaauaaggauaaacauaguauucugcuuuuaaaaauguguaaaauauauauuauauauguauacacagagagagagagagagagaggugagagagauggcacagggguuaauagcacccucuguuuuuucaggggaccuggguuuugucccaccaccucuacauggcucacaaccauuuuacagguccagaggaccugaugcccucuucuggucucuguggugacugcacacaugagcuacacuuucauacuugcaagcaaaccuaagguaaaaauacuaaagaauacacacucucacacacacacacacacacacacacacacacacacacacacacaccuucaguaagaagaauaaaaaauaaguaaaccuucagcauaaccagaagaacagauacggaccucuaccuucugagucaaaugacagaaaaaaccacguauucaugggaagauggaaagagagaaggaaagcagagaaguguggcagauagggaacgcaaagacagcugcuguaaacgcacaucaucaaggcgagagcuuaccuuaaccacaggggcugucacagcuuggccuaacguuuugccauaugcuacuuagaaggcucacaccuaaaacaaaacacaaaguguuuacaaguuaaaaaccagaaaaguacguaccaugaaaaugccaaucagccaccuaggacuauaguccaucgcuaaccacucauaucaugucuuuuaagugaggagcauuuaaaagaaacaaagaaaauuuuguugccagcaaaauuucuauuugaaagaucucuucauaccacuguguuuuguguuugccugcauguguggauaugacugcaugcauguacccgugugaaggucagaguucaacaaaaacacuggaaaauguaacaaucauagagauacaucauaaaucagggccugacccaccugggacuuucucagggguccugaugaaaggacaaagggaacuuuauuccuguguccuuguccaggagcaggcucggcaaagcuggccuagggcuggagcagucagugccuggaaggagucaagguugcagcuccugggcacccagucuuccccugagcugucugaggcauuccacuucuguuuaccaacacugucuaacugagcucucugcugaccuuggccauauucccuccugcaagcaguguauaugauacaagaagcucugcuucuuaauaaacuugcuugggccaggugugaugaugcacaccuuuaaucccagcacccuugaggcagacacauguggaucugaguuucaggcuagccugaucaacacaguggguucagcacauccagagauauagagagaaaucuguccugaaaaggaaaaagaaaaaaaacaaaaccucgccuggcaucagucaugggcuucugccagaccugcugaucccagcuguugcuuucguucuguuuucucuauuuuucauccccucucaucuguucaacaccucaccaugugggacucuuacuccugcugguucaggacacuguuguauaugaagcaaacccugaaacaucugcuuauaaauccaaccccacacuaccccaccucccacgugcuggguggcaaguagguauugccacucuggucuucaagacuuucccuguaucucuuaaguacucugaucugaacaguuuggcccccaauguaauggaguuuauaugguaguaaggggaagggggcucuacccucacagagaaauuacuacaguucccaaugaaaugaaucgggcaucuuggguuagcuguuacccagugggccuggcaucucuccugagccccucuuguaggugggcaccugugccaucuuaucucuucccacuuuauguggaacagcauauagacgcauuugagacacuaacacaugacaccaugcuuucugguuucuaauacaugggcuaaauguaucuguuucuuaagcguacccuggccacaauuuuuuuuguucuagcaacagauaauagcugauagucgauacagacaauguacuaacagccaugugacuacuccacaaugaaguaguuugcuacaacccuuacaaccuuucugaccucuuccagcacgcaugucaguguccucacagaaggaacuggcaucucaguuacugagcaaaacaagucuaccuucucccuucucccuucucccccuuucugcucgcucccaguugcagcucccucuaauucagagauguaacagucucagaagugccuaggacuaaaacaucuggaaguaaucccaacaaaccuaaucuacuuaaaaacaaaacauauauauuuauauauaucaugugguugcugggaauuugaacucaagaccucugcucacugcggucagccccgcuugcuccggcuuaaagauuuacuuauuauuauaucuaaguacacuguagcugucuucagacacuccagaagagggcaucagaucucauuacggaugguggugagccaccaugugguuacugggauuugaacucaggaccuucagaagagcagucagugcucuuaagcacugagccaucucuccagccacccccgcccccaaucuacuuuuuucaguguaaggcuucugagagauuucugauguauucucuaagaauaugcaauguuuaucaaguuauugaaacaaagaaucuacuuuaguuuucagugucucuagcugagagaaaaccacucagagaaauuagcuuucagugucucuagcagggagaaaaccucuuagaaaaauuagcuuucagugacucuagcaaugagaaaaccauucaaagaaaucuggucgugggagaccuuuacagacaucccacugaaauggcuucuauggauuauuuuaggauuauuauuaggcucauaauaguacucuauuuaggucaacucuaaagugaaccaccuaaaacucucuugcaggugaagagagaaacagcaacaguauguuauucacaaggaaccaacugcuaccuggcacaaugucacaugggucaaagagagcugacacccucccuaggcugaagagcagacagacuguggugguggaacccacugcuggaaccccaggggaagaagcacaugugagaggggcuaagacgaugcucuagcaucccucccgggcaagcucugacuuuucauguguggagccacaggagugucguguguguaauuucaucuuagaaccuguauacuucuuugugagucacacuugggaaccuaguagauuauucuguccauuugucaugguuacaaugaguguaggcaggugucuauauaagccaucggacucagacccagcugugugacaggaacaccaaguuguucaaaggcaucagcucauaucaucuccaugagagccucagguugaugcaugguggaggaaugucuuaguuaagguuuuacugcuaugaacaaacaccauauucaaggcaacucuuacuuuuuuuuaagauuuauuuauuuauuuuauguauaugaauucaccauugcucucuucagacacaccagaucccauuacagaugguugugagccaccaugugguugcugggaauugaacucaggaccucuugaagagcagucggcacucuuaacuacugagccaucucuccagcccccaaggcaacucuuuacaaggacaacauuuaacuggggcuggcauacaaguucagagguucaguccauaaucaucaaggcaggaacaugacaggauccaggcaggcauggugaaggaggagcugagaguucuacaucuucaucugaaggcuacuaguagaauacugacuuccaggcagcuaggaguagggucuuaaagcucaugcccacagugacacaccuacuccagccaggucacacuuccaaauagugccuaggccaaaacauauacaaaccaucacauuccacucccugacacaugagucuaugggggccagaccuagacauaacauaacaaaagaguucauuuaguccaacuuccaaaguucccaaagucuauagcagucuuaauguuauaaguccaaaguucaaagacacuucugauauuugcccaaucacuuaacuguaauccccaagacaagagaggaaaacagcuggccuuacucuaaacaucuccaugucucaugucaaagugaucuucaaaucuccaacuccuuuuucaucuuuguuaacugcaacaaacuucuuucuccugggcagguuccacuccguuagcagcuuuccucagcauguaucucauggcucuggcaucuuuaaaaucuuugggucuccaagacagcuucaguguuauagcuuucaaugucuaggauccacgcaugaucuucugggcuccuccaaagggugucacuucuccagcucugcccucuguagcacucuaagcugagguugauccacuccacugcugcugcuguucuuggugauaagcccaugguacuggcaucuccaauacacuggggucuuccacugcaacuaggcuucaccaauauccuuucaggcucucuucauggugccaagccucaaauccuuuacaugacaccuucaguccugggccaucaacuacaacugaggcugcaccuucaccuauggccuuccauggccucucacagugccaagccucagcugcucuucaugaccccuucaugccuucagaaccaguaccaccugggugacucuuacacauuaccaagaccagcugcagcaugagguacaaccuuggcuaccuuugguaaacagcuucuuugugcucuaagaaaagacuucccaaaagauuucacuucagugaugcuggucucuuuuuaaucaccacugauuucuuagcuccagcuaauagucgauacagacaacguuuaacuggggcugacuuacagguucagggguucaguccagaaucaucaaggcaggagcaaggcaggauccaggcaggcauggugaaggaggagcugagaguucuacaucuucauuugaaggcuacuaguagaauacugacuuccaggcagcuaggaguagguagggucuuaaagcucaugcccacaaugacacaccuacuccaacaaggccacaccuccaaauagugccacucccugggccaaacauauacaaaccaucacaggggaaaacuccaauagaauucugcauaucccauuugaggcuagcaaauccugaggagucuacugccugcccacugcuccuacacuacagaggcccuugugaaagagcaaccgugagauauggguuuauagcuuugaaagucaaugaaccaggacacacacaguaagcagacuuacugcuuauuacacaugaagacuaaagguuccuacucucaaaaccugaagugaauuauuaacaagaauaauagcuaaucauuuguguugauuacauuuucuuucacauuauaggaaaggaaggcauauaagcaacuaaacaacaguauaggggguuaugcaaagaaaagccugcagagggguucuuugcuguaagaaucagaguccaccaaccaucugcuuacagcuuaaguaauuauaggcagauucaaagguuucccauuuuggcccacugcuggcugaugccagcuaaacaacguuaagugauaaacaucucuuguggucaacaggguagagagguagaaucuagugaaauaagugacuuugguucugaaaaucaaauuacuuuaguuugguaauuggcauauuucaacccaaauggagguuuagaaugguaugacacucccuccucucauuuuuauaagguagguuucuauuagcaauuagaguugucauuucuuucauuaccuuuugcuggacaagggcaguguccgaugcaggaagccuguggcagccuuuggaaucagaaguuuugaaggaagaugcagugggggaggggggguguccuuuucaauggccgccuagccagcuaccuaauguuuuuccuucaaaacuugagacucuaaaauaacuuaggagauggacaucagaucacuguggcuguccagauaggagagagcagcacucaaggagaaagccaaagaaccuaguaaggaggagggagccauuaggacuccaacaguauggcaaaaccaagaguggucaccaaaaaucccagaaacaggaaaaggccuggaguggccacucucacaguagggcaaagccugagggaccaccaucaggaccuuuagagcuccugaggggucacccucaagaacugaaagaaagaugaaauuucaagaccuguaagucauauaaaguacucagaaauugcugguuguuugugagccuagaggcugccuggggcugagaaaagagaaaaacaaaccuggguaugccccguaguucaaacauuccugggaacagcuuaaccuuaaagauaaagaggaaugugaggauauaacagggcuaucugaacugagucaacaacucacagaacucugacacccugcacguacauguaauuuuucugcugauguuugaauaagccaauagugugucgcuaugcugaauuccacaccccuaagccccuuaccccauaaaagccccuagcuuucgagccucgugguugacauccguuaucuccugugugggaugcaugucaguccggagcuccguaauuaaacggccucauguaauuauaucaagaugguccuuugugauuuuuuuuuugggugcacgccaaauggggaauugaguggggauuuccccacuagguucuaucagaaccuaauagaauguagagaacacaaguguggggagacccagcuacaaauggccauggccugagauccucugaaaggacagauauucuaaauagaaaacaaauaacagaauagacaccagagcaaggaguauucaugagacgccaacuuuucacugaugaggaagaugcagggaaggcaucagaaagcaaagacagguuuuaacagggcugcuaucuacagacuuuccuaaaguuaaucccauuauauaguuuugaguuugggucacagaagugauaagucacauauugaagaagauaauaaauggaagaacaaaacauaucaagaaccucagacagaagagauuguuugggcucugaaucugcaacaguuuuugcucuguauacuuguugucuuaguuacuguucuauugcagucaagagacaccaugaccaaggcaacucuuauaacaggaagcuuuuaauuggggguuuguuuacaguuucauuacaucaugguagagaggauggcagcaagcagguguggugaugaagaaguagcugagagcuaaauucugaucuguaggcaggcagggaggcagagaaaaagagggagagggagugagagggagggaaggagggaggaagacugagauggagagauacugguccaccccuaguggcauaccuccuccaaccaggucacacuuccugguaacuaagcauccauacauauaagccuccaggggccacucuuauucaaacuagcacacuuaccauugaaauucugacaacagaguuauagacucacuuuaguucuaacacagcacaacacagcaguauuugauguaauaauagacacacugugcuugaaagcagcacauaauagcagaugaagaagacaggacccauaaucgagacuagccaaguuuaaaugcagcucccuccagacgauucgaguacagcaagucuaaguaaccagauauggggaaccugauacugucuucaccugcacucuuaacagaaucaagaucagcaucauucuaucuuugagaaauauagcaagaaacuuuguaaacaucccucaaaaauaguaggauuugagaaauauaaaauaugguacuguuguacuuacuucccagggacuuuacugugaagaacuuccaaaucaugaaugagaguuguucacuuacaaucuagaggacugaguuuggcauguaucuugguuuggguuacuacugcugugaugaaacaccaugaccaaaaagcaagcuggggaggaaaggguuugcguggcuuacacuuccacauccuaguccagggcaagaggacaucaggacaggaaugagacagggcaggacccuggaaacagaagcuagugcagaggccauggaggaguguugcuuucuggcuugcuugcagucugcuuucuuauagaacccaagacuaccaaccagcccagggguaaaaccacccacagucaguugggcccuuccacauaaacuauuaauuaagaaaaugcuacacugccuucagcccaaucuuauggaggcauuuucucaauugagguucugccccccccccaugacccuacccugugucaacugcacccaaagcuauccagcacaacaggcccaccuaaguuuauauaacaggccaaauuuauaaacagauuuaaguuuuugagcaguaaaguaaguuuuacaguuauuauguaauuuaucaaguaugucccaugagaaaucauuuugcaacuuuuuuggggggugggggcggaguggggggugggaaauguuacaguaguauccucccagcaagugauagcuuuacccaguaggaaagcguacccaacacaucuggagaagucaaaucacagguuuaaauauuccauuuagugaaaaaaauaaaacaaacucuucugccuuuuuccuaaggucaguuuuuguaagcauuucuaagaaccgaucuauacuuaagaaaaucuuacuguugcaaauagaaaucugccguccauuuuaucuugauguuacagaauuuugcauugaggaauuauaauucuguuagcauaauaaaucuuuuagagaccuuuauaugaaucuuuaucugaaguaauauuaauuuuuuuaccaaagauauauuuuauaacucacauuuaauaaguaagggaaaacuuggggagucacacugucucaaaagaaguuaguucuaaccccaaauacacuguagaagagcagugcuaucaaacaugcgcacacacuggauugauuagucaguguucuccagaaaaacacaccugacagaaugcgcacgcgcaggauguauuaacccgguuuacacuguagaccugacguccccaacaguggcugucccccaguggaaacccaaaagguaagucuguagagagcuuccuugggugggagagaaagauucugcccucuguacaguuuuacucucccaaccccuuugaaauaccgucuugucuuuuguggcuuugugagaguggugcuguggccggucugggagccccgagguggggauagaguucagaagaggggauuacugcucugggucucugguggaugagucccugugguaggaagagaaugagaaggagguguggcugaggguauuuguaggcuaaaagggggauuuagaagugaguacuggacacaaacuagcucuuuuaaaauguaacuuaagagcugaaucagguaaaaguggacuguaagcaaggaaggacuuuguguccuagacuauuauccaggguaaaccgugguuuuccguagccacgcuccagcagugggggaggggagaggcuguguuagaaagaagccacaagcaugugggaucagcugcgguuaccuguuaccucccuguuaccucuggcagccuggaggcaaacccugcuggggaaacaacgguacagccagccucaaggaggaaaccagcggaauacugagggaaggacgucuagacagaaagcuuuucaaagggaagagggcagcagccaugagcugucaugucaggugauucaaaguggagccacaggaagggaaccugaauguaagcauucuggaccaaccucccuuaucuggccugggcugaggcuggcuggcuggcuggcuggagagcuacagcugauuagcaagggaugaagugggggguaggaagugaugacaggcaaggaacgggugcucuucagccagccagagcaacaacuuucuggagaguuuucagucuaaggauuuagaaaggcgagugucgagugggcugcagagaagguagagaaguagaacaggagcagcagagagaaggcacacgaaggcuugaaccagggagccucacagcacucucccugugccacaggaagaaagaagccaaggucucuuagaauuuggaagccaaacaauccacccucuggccaauguuggccauacuagaggugguacuuuggccugagcauauucaguagagcauggggcauuuugacucaacggagccucaguuuguuguuugucuguuuaaagaggauuauuggcccacugagaucuuucccauauauauauaugaaaagauauauauagauagauagauagauagauagauagauauagauauagauauagauauagauauagauauagauauagauauagauauauaaagcacgccaaaaaagggcaucccccaacucaguggcuacuuuguaagggcacuuaucaugaggugcagacaucugcacuggucuuugaaggaguuugaaguacuguccaaggaaaacucucugcccauagauggaauuuuggaggaagagcuacucccccaguguggaauaaggcaaugacagagaccaucuggucucggccggagucccuaaagcaggagccggaaagcagcuagugagaagagcagagggaacuccuuuggggagcccacaacucaacucgccaucagaucaacaagaagacaggaaggagcaacuccucaguaccagcuuuuauucagggaaacccuuugguucuuuguguuagaaacagagcuugcaaucugcuuucaggagggguucauuacugggcuguguuaaugagaauggucccuaguuggcggaacuguuuggaaaggauuaagagguguggccuuauuagaugaggucuguaacuaugagugagcuuugagguaagaaaaccuacaguaaaccauuguuucuacaaauuaccuaggucacagugugucuucacagaaguaggaaaguaacuaagacaggagcucauggcagggagugggcuacuauucugacaggucugaccauggcuuuuggaggaaaguggaagauuuuaugacguaggacuagaaaagugguuaaaugcuuuagaaggccuuuaauggaacauucuaguaggaguuuggaagauagcaguacugagaacaacgugaacucuggaggccuagcucaagaaguuuccgaagggaacuuuaucagcaauguuguuaaagaccauucuugugauauuuuggcaaagaaugugacugcuuucugcuccuguccuaagaaucugacuagaguuaaacugggaagaguuuugaaauaauuucauuggcaaaggagauuucaagacagccuuaguacuaauucugucauacuguuauuaauaaucacuguuaugcugaacuacaaugaaaaggaacgagggggcaaaaagcaaugcaaaauguacacuuugaggagaaaacgacacuaagaaacauaaugcuggagccaugguuguguugaaaagaugauaauggaguguguguguguguguguguguguguguguguguguauuugugugugugaauggugccccuaaggcagaccccacucagccaauccuacagcuuguaaaaaggccuaaggaauuaucuguucuuaaagagcaaagacaaauuaaacaccauaacuccagcggggccccaaacaagcagcagaagcuacagcaacaucugccagguggugcuggcuuuagagcuaugaaggagacaggaggaaagggggacuguacuaucuuccucaaagguuaagggaagugccugagaucagccaugaggccaggaugccuacauggaggcccugagggaccacugagggaagcuuugaaaaugaaguuuagauugccuuagagaugcccacaauggcugaggagucagagcuaugagaucuuugccaaggacagcugcagacaggguguggaaucggcuugccacaggaguaguggguuacagagcacaaaaaugcaaaaaccuaaacuucauuaaauuuuaagccuaagcaugcuaucuauggucagggucauccaaggggguguauacuauuacaucugucuagaagcacuucugaucugcuucucaauuuggugugcaaauacacaaucuacaaaggggacagagaucuuaauuauacaguaucccaagcauauuagguuugguagcagucaaaauuguacauaucagucgugucuauuaauuauagggguggggaaccccacauagcaauuaauacaucuuugaaggaaauucugaaguagcagucuuaagcuaaauacacuaauucacaaagcaauauaaacccauacauacucuuuagcuaaacuccucaguuuaacacuaguugucuucacaguacacuaggcuuucaguuugauagacuccucugcucacagaaacaaccucugccaugugaccccccacucuuuuccccuucccugaacccagggcucacuuugcuguauaacuugggugccaggacacaucaaccaaaucugcucagaggguggagagaccacagggaggcugguuccaacuccuagaugacucuaguaaagucaccacagcuggaugugagacccacagagccccaguccucuucccagagcucuugagucaguacuuuuaaacaauauccccaagagacucacagacuuagggaauuugagaagcuuugauuaccgaucuuuucaccuuggcagcccugguuaauuuuucuaugaagcagagaaacaaugucuuccgcauggggcuucugugaagaccucgugaacacagcacggccaccaccuccaguggagccggcacacagggcuucgcagauguggugaagaccucgugaacacagcacggccaccaccuccaguggagccggcacacagggcuucgcagaugugcugcggcucuuagcgcccacacucugugcuucuagcucuuauuugccuguacuuuguuuacaaaaccugcagcuacucccaagugugauaugacuccacaugcucuacaguguggcuaaacgugcaaguaaaacccaagguguuucucccuccuauuagcaugcccgcuacaagcugagguuucugguucuucuaggucaaguggccacugcccaaguccucuguagugucccaaacauuccuggaagccauccauaaggcugcagguggacuccaguuucuuuccccacaugcucugcucuccacaagucucuccacgcccacagucaucuugcacuggaucuccuuccuuucugggcaugacuuucacuacuacuaugucccaccucaggcacuugcagcaaccgcagaacccuuuccaucugaagcccaggggaggagcgagcacugagccacuuugagggauaugcaucuuuccaauuguuuuuccaauuagugugugugugugugugugugugugugugugugugcacgagugcucaagugccagugcacacauguagaugucagagagcagccugugggagccaguucucuuacucaucaugugggucccgaugucaaaccacugagccaucucuccagccugcuauacacccauugauaaacugacacuugucuucugaggcacagcugagcacccaugggaaacuggcuuuuacugauucaagauagcaacugguauaguuacuuaauuuaacaacguuaaaaaaugagcuacauuuuauucgugagagcaaauaaaaccuuaacauuaaaaagacuuccuuucccagugcuaagagucaggugcuauuagucccuacaucagucaacaccuuaccuuuauuuuuauuaauuuucaaucauauacauacuguggaugcuucaugugcuggcugccaguuuguuuuucuccuuaaauacuuuauaauucuucacaggaaauuucaacuugagauucaacaguaagcagguuguuuuuuuuuuucuagagauugaugaugcgcauccucaguccaguggcugucagacgucccgccccuuugaccuuacacauuuuauuacaaugaguuuugcaguuuugcacauuuuuuuuaaaugucauuaacuguuagggaauuuuacuugaauacugaaugcauauaauguguauauuuaaaaagucauuguuuguguuaaaaaagaaauuagaguugcaggaaauuuacagcacugcacaaauaauaagguauuuaaguuuuucaguagaaauuguccuacagaugcuuuauugacuugcuauuggaagaauagaucuucuuaaaugugcaguguugagucacuucacuauagugguagaguugggauuagggcuucaauuuuacuucuuaaauaucauuauauguuugauaugcccagacugcauacaauuuaaagcaagaguacaacuacuaucguaauguuaaugugaagaugcuauuacaaaggaucuccucccaaccccucgggaauuuggugucuuucaaauuauaucuugaccuugacauuugaauauccagccauuauuagauuucuuaauggugugaagucccauuuucaauaacuuauuggugcugaaguuguucacuagcuguggucugaccuagacuggaguccccguaacuuagggacucgagcuguuagugcagcucuggggcuugagguccucuccuguccaaagggaaucuaacugcuacacugugacagucuuguaacuuuucuuaucuucuggccuggguucuucacgcuuuccucaaguguggccucaccauuauuuuuccucagggaugaaaagccgucagaguugaaccagaaaugucaaaggaaaaccuggacacaggcgccacucucuuccaugcacgucacgcccauguuuuccagauuccuccccagacauuuccaacagccuucccacccaacgucacuuucccaccauuagggacacagacacaagaucugugggcaugaggaagcagcagacacuaggaaucccaccugacucagcccacuuuuugcggaguuccuccacacaagguccagagaaacccaagagaacacaaaaaucgccuucuaugcugagagcuaggugcuuaaacacaugaacaaaauggaaauuacacaucuaaggacagcagcuagccagcuucaaaguggcugauccgucauaccuaggcuuccuguucauacaaaguucuaguugcucaauuucugaaaaauaacuauugugaauuauauguaugugugcauucaugugcgcacgagugcagguaccagcacguguccagggcacuagauucccuggaacuggaguuacagguagucaugggccaccugauguggacgcugggaacacacauccucuacaagagcaguacacguccucgugagccaucucuccagccccaacugcuugcuuuuuaaugaugacccugagcuauucaugggcuuuaaggaaaagcuugcgcugagcaccacugccucugccggagacugcugcacaugcucaguaaguaggaaguuuaaauacuccacggccuuuucccagcuccuccccucagucccagcuggcugcaguagcaccacaaucagcugugcuccaaaacaugagggagaagagaagacaccaagccugaugguaauggaagccugcugccuccgugcgcuggggagcugaugagugggcuuuuaaagaaaaaacuuuacaagcuucguauacuguuuaccaagauaguuuucuuguaguuacagcauucugaagauagggcuuuauucuagacuugggguuugggguguguagggaccuugggcuaagaagcagaaaggaacuucugccuaccuucacuccauccaucuuaauacuuuguugugcgguugcgggggggggggcuuuauuuucuuuuucuuuuucuuucucucucuuuuguaaggcuuugcagaaaagucuguagcuguggcaauuuauacaguaacauuuugcuguaacacuauaaaaugugcauuccuucaaccagauuuugaagaccugagaagccacgaauagguggaccuagaaccugaaccuuuucaauaucaaaugugugcccaucuuccccaagcaaggugauugucuccagauuccuggaugggggaggggggauggacaaagaaagagugcacccucacauucagugacaggcugagagcagggugccaaagcagggagacugggaagggaacaaagagcucgccaaucaggcaaaaggccucugaaagccaaguaaagcuucguccaccagaagggagcaggagaguugcucuagcuaacaugcucaucuuugcccuacaucaggaccucucaucuaucuccuucaucaggcgaaaucacuaauugucugucccguagucaccuguaaaucuuucauucacucauucauucacacaucucauauggcagcuugugucagaggcuaagacagcacgcaguguggaagacaaacgcauccugcaaacugcugcacuccacagugcaaggcugaagacucgugacucuuuaaguuuaaccugaguuucaugauugaaacccaggaagagaaaauuggaaagguugccaguucaaacgccuccaaaccagcagcagucagugugcaggguagggagggaauaagcuuguacucucugacuguguugaugucuaacaaaggugaaaauuacacagcuuacacuaagauaaaggacuacuuaauauuaucuuaauacuaucauaaugucuucuggagguggggcaggaggggggcugggaagauggcucaguugcuaaagcacuugcugugcaggcaugaagaccauucacccaugcaaaaaucuggguccagcagacacacgaggaacucuggggcuugcuggccaaucagccuaacaaaaccaaugugcuugaaauucagugaaauccugucucaaguaaauaagguaaggacuagugggauagaccacuggguaaaggugcuugccaccaaccagcuaugaaggccugauuucaauccacugaagccgcauggugcacaggaagacugacuccugcaagcuguccucuaacuuucauucauacacacacacacaaaauaauaaaucuuuaauuuaaauuaaaaaagaaggugacgagcaagcaaggaauaaagauacccaucuccacacaacaugcacacuuacacacacacacacaauaagaagaaacuggauaacugaauuucaaaaccagagucuguaacuaaaccaguagccaaaaccacuguuugaagcucuccugucauggcggaacagguggccgcaggcugaugagaugcuuuuaaaggcaaugauauucuauguuguuauucuaacuuauaugucuuaauuaccguuuccauugcugugacgagacaccaugaccaaggcaacucuuguaagggagaacucuuaaacgggagcuggcuuacagguucagagguucaguccauuaucagcaaggcaggaagcauggcagcguccaggcagacacuggaggagcugagaguuguacaucuuguuucaaagacaaacaggagaagacuggcuucuuggaggaaggucucaaagcccaucccuacagugacacacucccuccaacaaggccacaccuccuaauagugccacucccugggccaagcauauucaaaccacuacacuuuaucuugucuuuuguuccccucaggaugcaaaggagacauacaacugagagaguuccuaggcuaacaacuagcucaagaagaauagaccaaguuggucucuccccuuuccucuaauccagaauaaggcaagaaucuugcuuuuuuuuuaaaagcaaaucaaugcuuaugcaacuuuuauuaaaaaugaaacccuuuuccauugucccuaaggagaugucugcccauacccugcugagccacaccucugaagcacccaguggacaggcucacuuacaggcacccgccgaccuccaguccacuuuaccugugggaugguaccauguggcucuuuaccacagagcaggucccuaucacacggcaaacuguauggacggaguauagguguaaauaggaaaagggcauuucugaagugccauucuagcuuuaccaggacagagaagagccccuccccucaggggaaagcugggcaucuagagaagcauuuuauuagagauaaagaauuuacucuaaacucaagguugaauagaaucuguuaucaaguuuuccugaagcaccacagugcuuaauaaaaaaaauucaacuuuaggggggaaauauauuauccaaaauggcuuaguagagcuuaaaucuugcacuuuuucaaaccuucuggggaaagaaacacauaagaauagacuaaagcuuguagcuuauaucagugauacccaaaacccagauaugguaccauauugggcaguuucagcuaauauaaugcaaaacuaagaucaaauuaaaaacaugauaaauccacuuacagaauuucagaugagauuauaucacuagauaaauacaugagagagagagagagagcgcgugcgcgauugauucucugcuuuaguuaaaauagaucugcugcaaagaacugaauuuaaggaaauauuuaucucgaggcuggagagaugacaugugguuaagcacacuuguugcucuugcagacuagaguucagcuccuggcccucauguggagggucuauucccauucauaacuucaguucuggggggugcagugccgccccccuccccacuucugaccuuaccaggcccuaggcaugccucugguacacaugcauacaugaagagagaacacauaaauuuugcuuuagaaaauauuuuuuaaguacuauaucauaaugcuaccacagcuaaaaucaauggucucucccugacaaacugcaucagcaucagcuggcucuuccuuucuggauaggccuggaugcuuucuucuucucucuucucgucccauucgacaaccaagaacaauuucgauaauguaauaguuuuuaaugcugcagcucccugguggccauucauuucaaucaaaucuuccaacgugaaagagagaaaaugccacacuuuucucucaguaaaaggaaggccccuuccuagaguuaugaggugucaacacuucagagagcucaaacucccugcgucugccuuagacacccaaagguaaaacacagauuucaucugggugaagacugcaaaucguccuaccucccuccaaaaacaaaccguugggcaauuccuuacuuggcaguagcguuuccuaacaaagcaagcugcuucuccuaaaggcugggaacgggguuugugggaggggggucuacuuaagucaaaaaucaaugccugccuuuuaguccugcaccuuuuaguccugcagucacaaacacagcuagcucuccgugcugcagcuggccgcauccuuuacagccugaaaaaguaaggcucccuccaucuaagaguuccuuuacaaugcuuuguacauuccacucagaccuuuuauuaauaauguagccuuaaucuuuaggagucuccucuuuccaaaucucccauucccuuccuccucgccaccucucccccaggaagcacucuccuacccuagggaccacaggcccuuucccgccuagaaugugcguuccucccuccgggccugcagcagguccaucggcguggcgugcggacaguauucuccacuucuccuuggucgcggugacaaccaggccaccacuaccucggcccccgaggcuuacauagcucaaggcagggcaggauggauccgugaggccgcgguggcccggcucgccaagagcacuggacgccccuccaaguggcccagauucucgagucucucguccggagccucgagacccagccccgagaccaggcgcggaggccagagcccagggcguggcagcucgcggcgccccgcuccacggaggagcgagcggcgcccggggccucgaagccccgacccacgaaccuagaaggcugcgccgcgagagagaggggcgcucggcagccgcccaaccgucuccccgccucggccucccgcccgcccgccccgcacucaccucccgugcgcccgugguacccgcaacggugcggcccgcgcucgcucucugcgcgcgaacacggacuccccgcagccgcacgcacgccgagcgggcgggcgcgcgccuccuucacgcacgcgcgcgcgcgcggggucccugcguccgcagcccagcgccg

SEQ ID NO: 1455 - RNA, 25044 nt, Mus musculus
cggcgcugggcugcggacgcagggaccccgcgcgcgcgcgcgugcgugaaggaggcgcgcgcccgcccgcucggcgugcgugcggcugcggggaguccguguucgcgcgcagagagcgagcgcgggccgcaccguugcggguaccacgggcgcacgggaggugagugcggggcgggcgggcgggaggccgaggcggggagacgguugggcggcugccgagcgccccucucucucgcggcgcagccuucuagguucgugggucggggcuucgaggccccgggcgccgcucgcuccuccguggagcggggcgccgcgagcugccacgcccugggcucuggccuccgcgccuggucucggggcugggucucgaggcuccggacgagagacucgagaaucugggccacuuggaggggcguccagugcucuuggcgagccgggccaccgcggccucacggauccauccugcccugccuugagcuauguaagccucgggggccgagguagugguggccugguugucaccgcgaccaaggagaaguggagaauacuguccgcacgccacgccgauggaccugcugcaggcccggagggaggaacgcacauucuaggcgggaaagggccuguggucccuaggguaggagagugcuuccugggggagagguggcgaggaggaagggaaugggagauuuggaaagaggagacuccuaaagauuaaggcuacauuauuaauaaaaggucugaguggaauguacaaagcauuguaaaggaacucuuagauggagggagccuuacuuuuucaggcuguaaaggaugcggccagcugcagcacggagagcuagcuguguuugugacugcaggacuaaaaggugcaggacuaaaaggcaggcauugauuuuugacuuaaguagaccccccucccacaaaccccguucccagccuuuaggagaagcagcuugcuuuguuaggaaacgcuacugccaaguaaggaauugcccaacgguuuguuuuuggagggagguaggacgauuugcagucuucacccagaugaaaucuguguuuuaccuuugggugucuaaggcagacgcagggaguuugagcucucugaaguguugacaccucauaacucuaggaaggggccuuccuuuuacugagagaaaaguguggcauuuucucucuuucacguuggaagauuugauugaaaugaauggccaccagggagcugcagcauuaaaaacuauuacauuaucgaaauuguucuugguugucgaaugggacgagaagagagaagaagaaagcauccaggccuauccagaaaggaagagccagcugaugcugaugcaguuugucagggagagaccauugauuuuagcugugguagcauuaugauauaguacuuaaaaaauauuuucuaaagcaaaauuuauguguucucucuucauguaugcauguguaccagaggcaugccuagggccugguaaggucagaaguggggaggggggcggcacugcaccccccagaacugaaguuaugaaugggaauagacccuccacaugagggccaggagcugaacucuagucugcaagagcaacaagugugcuuaaccacaugucaucucuccagccucgagauaaauauuuccuuaaauucaguucuuugcagcagaucuauuuuaacuaaagcagagaaucaaucgcgcacgcgcucucucucucucucucauguauuuaucuagugauauaaucucaucugaaauucuguaaguggauuuaucauguuuuuaauuugaucuuaguuuugcauuauauuagcugaaacugcccaauaugguaccauaucuggguuuuggguaucacugauauaagcuacaagcuuuagucuauucuuauguguuucuuuccccagaagguuugaaaaagugcaagauuuaagcucuacuaagccauuuuggauaauauauuuccccccuaaaguugaauuuuuuuuauuaagcacuguggugcuucaggaaaacuugauaacagauucuauucaaccuugaguuuagaguaaauucuuuaucucuaauaaaaugcuucucuagaugcccagcuuuccccugaggggaggggcucuucucuguccugguaaagcuagaauggcacuucagaaaugcccuuuuccuauuuacaccuauacuccguccauacaguuugccgugugauagggaccugcucugugguaaagagccacaugguaccaucccacagguaaaguggacuggaggucggcgggugccuguaagugagccuguccacugggugcuucagagguguggcucagcaggguaugggcagacaucuccuuagggacaauggaaaaggguuucauuuuuaauaaaaguugcauaagcauugauuugcuuuuaaaaaaaaagcaagauucuugccuuauucuggauuagaggaaaggggagagaccaacuuggucuauucuucuugagcuaguuguuagccuaggaacucucucaguuguaugucuccuuugcauccugaggggaacaaaagacaagauaaaguguagugguuugaauaugcuuggcccagggaguggcacuauuaggagguguggccuuguuggagggagugugucacuguagggaugggcuuugagaccuuccuccaagaagccagucuucuccuguuugucuuugaaacaagauguacaacucucagcuccuccagugucugccuggacgcugccaugcuuccugccuugcugauaauggacugaaccucugaaccuguaagccagcucccguuuaagaguucucccuuacaagaguugccuuggucauggugucucgucacagcaauggaaacgguaauuaagacauauaaguuagaauaacaacauagaauaucauugccuuuaaaagcaucucaucagccugcggccaccuguuccgccaugacaggagagcuucaaacagugguuuuggcuacugguuuaguuacagacucugguuuugaaauucaguuauccaguuucuucuuauuguguguguguguguaagugugcauguuguguggagauggguaucuuuauuccuugcuugcucgucaccuucuuuuuuaauuuaaauuaaagauuuauuauuuuguguguguguguaugaaugaaaguuagaggacagcuugcaggagucagucuuccugugcaccaugcggcuucaguggauugaaaucaggccuucauagcugguugguggcaagcaccuuuacccaguggucuaucccacuaguccuuaccuuauuuacuugagacaggauuucacugaauuucaagcacauugguuuuguuaggcugauuggccagcaagccccagaguuccucgugugucugcuggacccagauuuuugcaugggugaauggucuucaugccugcacagcaagugcuuuagcaacugagccaucuucccagccccccuccugccccaccuccagaagacauuaugauaguauuaagauaauauuaaguaguccuuuaucuuaguguaagcuguguaauuuucaccuuuguuagacaucaacacagucagagaguacaagcuuauucccucccuacccugcacacugacugcugcugguuuggaggcguuugaacuggcaaccuuuccaauuuucucuuccuggguuucaaucaugaaacucagguuaaacuuaaagagucacgagucuucagccuugcacuguggagugcagcaguuugcaggaugcguuugucuuccacacugcgugcugucuuagccucugacacaagcugccauaugagaugugugaaugaaugagugaaugaaagauuuacaggugacuacgggacagacaauuagugauuucgccugaugaaggagauagaugagagguccugauguagggcaaagaugagcauguuagcuagagcaacucuccugcucccuucugguggacgaagcuuuacuuggcuuucagaggccuuuugccugauuggcgagcucuuuguucccuucccagucucccugcuuuggcacccugcucucagccugucacugaaugugagggugcacucuuucuuuguccauccccccucccccauccaggaaucuggagacaaucaccuugcuuggggaagaugggcacacauuugauauugaaaagguucagguucuagguccaccuauucguggcuucucaggucuucaaaaucugguugaaggaaugcacauuuuauaguguuacagcaaaauguuacuguauaaauugccacagcuacagacuuuucugcaaagccuuacaaaagagagagaaagaaaaagaaaaagaaaauaaagcccccccccccgcaaccgcacaacaaaguauuaagauggauggagugaagguaggcagaaguuccuuucugcuucuuagcccaaggucccuacacaccccaaaccccaagucuagaauaaagcccuaucuucagaaugcuguaacuacaagaaaacuaucuugguaaacaguauacgaagcuuguaaaguuuuuucuuuaaaagcccacucaucagcuccccagcgcacggaggcagcaggcuuccauuaccaucaggcuuggugucuucucuucucccucauguuuuggagcacagcugauuguggugcuacugcagccagcugggacugaggggaggagcugggaaaaggccguggaguauuuaaacuuccuacuuacugagcaugugcagcagucuccggcagaggcaguggugcucagcgcaagcuuuuccuuaaagcccaugaauagcucagggucaucauuaaaaagcaagcaguuggggcuggagagauggcucacgaggacguguacugcucuuguagaggauguguguucccagcguccacaucagguggcccaugacuaccuguaacuccaguuccagggaaucuagugcccuggacacgugcugguaccugcacucgugcgcacaugaaugcacacauacauauaauucacaauaguuauuuuucagaaauugagcaacuagaacuuuguaugaacaggaagccuagguaugacggaucagccacuuugaagcuggcuagcugcuguccuuagauguguaauuuccauuuuguucauguguuuaagcaccuagcucucagcauagaaggcgauuuuuguguucucuuggguuucucuggaccuuguguggaggaacuccgcaaaaagugggcugagucaggugggauuccuagugucugcugcuuccucaugcccacagaucuugugucugugucccuaauggugggaaagugacguugggugggaaggcuguuggaaaugucuggggaggaaucuggaaaacaugggcgugacgugcauggaagagaguggcgccuguguccagguuuuccuuugacauuucugguucaacucugacggcuuuucaucccugaggaaaaauaauggugaggccacacuugaggaaagcgugaagaacccaggccagaagauaagaaaaguuacaagacugucacaguguagcaguuagauucccuuuggacaggagaggaccucaagccccagagcugcacuaacagcucgagucccuaaguuacggggacuccagucuaggucagaccacagcuagugaacaacuucagcaccaauaaguuauugaaaaugggacuucacaccauuaagaaaucuaauaauggcuggauauucaaaugucaaggucaagauauaauuugaaagacaccaaauucccgagggguugggaggagauccuuuguaauagcaucuucacauuaacauuacgauaguaguuguacucuugcuuuaaauuguaugcagucugggcauaucaaacauauaaugauauuuaagaaguaaaauugaagcccuaaucccaacucuaccacuauagugaagugacucaacacugcacauuuaagaagaucuauucuuccaauagcaagucaauaaagcaucuguaggacaauuucuacugaaaaacuuaaauaccuuauuauuugugcagugcuguaaauuuccugcaacucuaauuucuuuuuuaacacaaacaaugacuuuuuaaauauacacauuauaugcauucaguauucaaguaaaauucccuaacaguuaaugacauuuaaaaaaaaugugcaaaacugcaaaacucauuguaauaaaauguguaaggucaaaggggcgggacgucugacagccacuggacugaggaugcgcaucaucaaucucuagaaaaaaaaaaacaaccugcuuacuguugaaucucaaguugaaauuuccugugaagaauuauaaaguauuuaaggagaaaaacaaacuggcagccagcacaugaagcauccacaguauguauaugauugaaaauuaauaaaaauaaagguaagguguugacugauguagggacuaauagcaccugacucuuagcacugggaaaggaagucuuuuuaauguuaagguuuuauuugcucucacgaauaaaauguagcucauuuuuuaacguuguuaaauuaaguaacuauaccaguugcuaucuugaaucaguaaaagccaguuucccaugggugcucagcugugccucagaagacaagugucaguuuaucaauggguguauagcaggcuggagagauggcucagugguuugacaucgggacccacaugaugaguaagagaacuggcucccacaggcugcucucugacaucuacaugugugcacuggcacuugagcacucgugcacacacacacacacacacacacacacacacacacuaauuggaaaaacaauuggaaagaugcauaucccucaaaguggcucagugcucgcuccuccccugggcuucagauggaaaggguucugcgguugcugcaagugccugaggugggacauaguaguagugaaagucaugcccagaaaggaaggagauccagugcaagaugacugugggcguggagagacuuguggagagcagagcauguggggaaagaaacuggaguccaccugcagccuuauggauggcuuccaggaauguuugggacacuacagaggacuugggcaguggccacuugaccuagaagaaccagaaaccucagcuuguagcgggcaugcuaauaggagggagaaacaccuuggguuuuacuugcacguuuagccacacuguagagcauguggagucauaucacacuugggaguagcugcagguuuuguaaacaaaguacaggcaaauaagagcuagaagcacagagugugggcgcuaagagccgcagcacaucugcgaagcccugugugccggcuccacuggaggugguggccgugcuguguucacgaggucuucaccacaucugcgaagcccugugugccggcuccacuggaggugguggccgugcuguguucacgaggucuucacagaagccccaugcggaagacauuguuucucugcuucauagaaaaauuaaccagggcugccaaggugaaaagaucgguaaucaaagcuucucaaauucccuaagucugugagucucuuggggauauuguuuaaaaguacugacucaagagcucugggaagaggacuggggcucugugggucucacauccagcuguggugacuuuacuagagucaucuaggaguuggaaccagccucccuguggucucuccacccucugagcagauuugguugauguguccuggcacccaaguuauacagcaaagugagcccuggguucagggaaggggaaaagaguggggggucacauggcagagguuguuucugugagcagaggagucuaucaaacugaaagccuaguguacugugaagacaacuaguguuaaacugaggaguuuagcuaaagaguauguauggguuuauauugcuuugugaauuaguguauuuagcuuaagacugcuacuucagaauuuccuucaaagauguauuaauugcuaugugggguuccccaccccuauaauuaauagacacgacugauauguacaauuuugacugcuaccaaaccuaauaugcuugggauacuguauaauuaagaucucuguccccuuuguagauuguguauuugcacaccaaauugagaagcagaucagaagugcuucuagacagauguaauaguauacacccccuuggaugacccugaccauagauagcaugcuuaggcuuaaaauuuaaugaaguuuagguuuuugcauuuuugugcucuguaacccacuacuccuguggcaagccgauuccacacccugucugcagcuguccuuggcaaagaucucauagcucugacuccucagccauugugggcaucucuaaggcaaucuaaacuucauuuucaaagcuucccucaguggucccucagggccuccauguaggcauccuggccucauggcugaucucaggcacuucccuuaaccuuugaggaagauaguacagucccccuuuccuccugucuccuucauagcucuaaagccagcaccaccuggcagauguugcuguagcuucugcugcuuguuuggggccccgcuggaguuaugguguuuaauuugucuuugcucuuuaagaacagauaauuccuuaggccuuuuuacaagcuguaggauuggcugaguggggucugccuuaggggcaccauucacacacacaaauacacacacacacacacacacacacacacacacacacuccauuaucaucuuuucaacacaaccauggcuccagcauuauguuucuuagugucguuuucuccucaaaguguacauuuugcauugcuuuuugcccccucguuccuuuucauuguaguucagcauaacagugauuauuaauaacaguaugacagaauuaguacuaaggcugucuugaaaucuccuuugccaaugaaauuauuucaaaacucuucccaguuuaacucuagucagauucuuaggacaggagcagaaagcagucacauucuuugccaaaauaucacaagaauggucuuuaacaacauugcugauaaaguucccuucggaaacuucuugagcuaggccuccagaguucacguuguucucaguacugcuaucuuccaaacuccuacuagaauguuccauuaaaggccuucuaaagcauuuaaccacuuuucuaguccuacgucauaaaaucuuccacuuuccuccaaaagccauggucagaccugucagaauaguagcccacucccugccaugagcuccugucuuaguuacuuuccuacuucugugaagacacacugugaccuagguaauuuguagaaacaaugguuuacuguagguuuucuuaccucaaagcucacucauaguuacagaccucaucuaauaaggccacaccucuuaauccuuuccaaacaguuccgccaacuagggaccauucucauuaacacagcccaguaaugaaccccuccugaaagcagauugcaagcucuguuucuaacacaaagaaccaaaggguuucccugaauaaaagcugguacugaggaguugcuccuuccugucuucuuguugaucugauggcgaguugaguugugggcuccccaaaggaguucccucugcucuucucacuagcugcuuuccggcuccugcuuuagggacuccggccgagaccagauggucucugucauugccuuauuccacacugggggaguagcucuuccuccaaaauuccaucuaugggcagagaguuuuccuuggacaguacuucaaacuccuucaaagaccagugcagaugucugcaccucaugauaagugcccuuacaaaguagccacugaguugggggaugcccuuuuuuggcgugcuuuauauaucuauaucuauaucuauaucuauaucuauaucuauaucuauaucuauaucuaucuaucuaucuaucuaucuaucuauauauaucuuuucauauauauauaugggaaagaucucagugggccaauaauccucuuuaaacagacaaacaacaaacugaggcuccguugagucaaaaugccccaugcucuacugaauaugcucaggccaaaguaccaccucuaguauggccaacauuggccagaggguggauuguuuggcuuccaaauucuaagagaccuuggcuucuuucuuccuguggcacagggagagugcugugaggcucccugguucaagccuucgugugccuucucucugcugcuccuguucuacuucucuaccuucucugcagcccacucgacacucgccuuucuaaauccuuagacugaaaacucuccagaaaguuguugcucuggcuggcugaagagcacccguuccuugccugucaucacuuccuaccccccacuucaucccuugcuaaucagcuguagcucuccagccagccagccagccagccucagcccaggccagauaagggagguugguccagaaugcuuacauucagguucccuuccuguggcuccacuuugaaucaccugacaugacagcucauggcugcugcccucuucccuuugaaaagcuuucugucuagacguccuucccucaguauuccgcugguuuccuccuugaggcuggcuguaccguuguuuccccagcaggguuugccuccaggcugccagagguaacagggagguaacagguaaccgcagcugaucccacaugcuuguggcuucuuucuaacacagccucuccccucccccacugcuggagcguggcuacggaaaaccacgguuuacccuggauaauagucuaggacacaaaguccuuccuugcuuacaguccacuuuuaccugauucagcucuuaaguuacauuuuaaaagagcuaguuuguguccaguacucacuucuaaaucccccuuuuagccuacaaauacccucagccacaccuccuucucauucucuuccuaccacagggacucauccaccagagacccagagcaguaauccccucuucugaacucuauccccaccucggggcucccagaccggccacagcaccacucucacaaagccacaaaagacaagacgguauuucaaagggguugggagaguaaaacuguacagagggcagaaucuuucucucccacccaaggaagcucucuacagacuuaccuuuuggguuuccacugggggacagccacuguuggggacgucaggucuacaguguaaaccggguuaauacauccugcgcgugcgcauucugucagguguguuuuucuggagaacacugacuaaucaauccagugugugcgcauguuugauagcacugcucuucuacaguguauuugggguuagaacuaacuucuuuugagacagugugacuccccaaguuuucccuuacuuauuaaaugugaguuauaaaauauaucuuugguaaaaaaauuaauauuacuucagauaaagauucauauaaaggucucuaaaagauuuauuaugcuaacagaauuauaauuccucaaugcaaaauucuguaacaucaagauaaaauggacggcagauuucuauuugcaacaguaagauuuucuuaaguauagaucgguucuuagaaaugcuuacaaaaacugaccuuaggaaaaaggcagaagaguuuguuuuauuuuuuucacuaaauggaauauuuaaaccugugauuugacuucuccagauguguuggguacgcuuuccuacuggguaaagcuaucacuugcugggaggauacuacuguaacauuucccaccccccacuccgcccccaccccccaaaaaaguugcaaaaugauuucucaugggacauacuugauaaauuacauaauaacuguaaaacuuacuuuacugcucaaaaacuuaaaucuguuuauaaauuuggccuguuauauaaacuuaggugggccuguugugcuggauagcuuugggugcaguugacacaggguagggucauggggggggggcagaaccucaauugagaaaaugccuccauaagauugggcugaaggcaguguagcauuuucuuaauuaauaguuuauguggaagggcccaacugacugugggugguuuuaccccugggcugguugguagucuuggguucuauaagaaagcagacugcaagcaagccagaaagcaacacuccuccauggccucugcacuagcuucuguuuccaggguccugcccugucucauuccuguccugauguccucuugcccuggacuaggauguggaaguguaagccacgcaaacccuuuccuccccagcuugcuuuuuggucaugguguuucaucacagcaguaguaacccaaaccaagauacaugccaaacucaguccucuagauuguaagugaacaacucucauucaugauuuggaaguucuucacaguaaagucccugggaaguaaguacaacaguaccauauuuuauauuucucaaauccuacuauuuuugagggauguuuacaaaguuucuugcuauauuucucaaagauagaaugaugcugaucuugauucuguuaagagugcaggugaagacaguaucagguuccccauaucugguuacuuagacuugcuguacucgaaucgucuggagggagcugcauuuaaacuuggcuagucucgauuauggguccugucuucuucaucugcuauuaugugcugcuuucaagcacagugugucuauuauuacaucaaauacugcuguguugugcuguguuagaacuaaagugagucuauaacucuguugucagaauuucaaugguaagugugcuaguuugaauaagaguggccccuggaggcuuauauguauggaugcuuaguuaccaggaagugugaccugguuggaggagguaugccacuagggguggaccaguaucucuccaucucagucuuccucccuccuucccucccucucacucccucucccucuuuuucucugccucccugccugccuacagaucagaauuuagcucucagcuacuucuucaucaccacaccugcuugcugccauccucucuaccaugauguaaugaaacuguaaacaaacccccaauuaaaagcuuccuguuauaagaguugccuuggucauggugucucuugacugcaauagaacaguaacuaagacaacaaguauacagagcaaaaacuguugcagauucagagcccaaacaaucucuucugucugagguucuugauauguuuuguucuuccauuuauuaucuucuucaauaugugacuuaucacuucugugacccaaacucaaaacuauauaaugggauuaacuuuaggaaagucuguagauagcagcccuguuaaaaccugucuuugcuuucugaugccuucccugcaucuuccucaucagugaaaaguuggcgucucaugaauacuccuugcucuggugucuauucuguuauuuguuuucuauuuagaauaucuguccuuucagaggaucucaggccauggccauuuguagcugggucuccccacacuuguguucucuacauucuauuagguucugauagaaccuaguggggaaauccccacucaauuccccauuuggcgugcacccaaaaaaaaaaucacaaaggaccaucuugauauaauuacaugaggccguuuaauuacggagcuccggacugacaugcaucccacacaggagauaacggaugucaaccacgaggcucgaaagcuaggggcuuuuaugggguaaggggcuuagggguguggaauucagcauagcgacacacuauuggcuuauucaaacaucagcagaaaaauuacauguacgugcagggugucagaguucugugaguuguugacucaguucagauagcccuguuauauccucacauuccucuuuaucuuuaagguuaagcuguucccaggaauguuugaacuacggggcauacccagguuuguuuuucucuuuucucagccccaggcagccucuaggcucacaaacaaccagcaauuucugaguacuuuauaugacuuacaggucuugaaauuucaucuuucuuucaguucuugagggugaccccucaggagcucuaaagguccugaugguggucccucaggcuuugcccuacugugagaguggccacuccaggccuuuuccuguuucugggauuuuuggugaccacucuugguuuugccauacuguuggaguccuaauggcucccuccuccuuacuagguucuuuggcuuucuccuugagugcugcucucuccuaucuggacagccacagugaucugauguccaucuccuaaguuauuuuagagucucaaguuuugaaggaaaaacauuagguagcuggcuaggcggccauugaaaaggacacccccccucccccacugcaucuuccuucaaaacuucugauuccaaaggcugccacaggcuuccugcaucggacacugcccuuguccagcaaaagguaaugaaagaaaugacaacucuaauugcuaauagaaaccuaccuuauaaaaaugagaggagggagugucauaccauucuaaaccuccauuuggguugaaauaugccaauuaccaaacuaaaguaauuugauuuucagaaccaaagucacuuauuucacuagauucuaccucucuacccuguugaccacaagagauguuuaucacuuaacguuguuuagcuggcaucagccagcagugggccaaaaugggaaaccuuugaaucugccuauaauuacuuaagcuguaagcagaugguugguggacucugauucuuacagcaaagaaccccucugcaggcuuuucuuugcauaacccccuauacuguuguuuaguugcuuauaugccuuccuuuccuauaaugugaaagaaaauguaaucaacacaaaugauuagcuauuauucuuguuaauaauucacuucagguuuugagaguaggaaccuuuagucuucauguguaauaagcaguaagucugcuuacuguguguguccugguucauugacuuucaaagcuauaaacccauaucucacgguugcucuuucacaagggccucuguaguguaggagcagugggcaggcaguagacuccucaggauuugcuagccucaaaugggauaugcagaauucuauuggaguuuuccccugugaugguuuguauauguuuggcccagggaguggcacuauuuggagguguggccuuguuggaguaggugugucauugugggcaugagcuuuaagacccuaccuacuccuagcugccuggaagucaguauucuacuaguagccuucaaaugaagauguagaacucucagcuccuccuucaccaugccugccuggauccugccuugcuccugccuugaugauucuggacugaaccccugaaccuguaagucagccccaguuaaacguugucuguaucgacuauuagcuggagcuaagaaaucaguggugauuaaaaagagaccagcaucacugaagugaaaucuuuugggaagucuuuucuuagagcacaaagaagcuguuuaccaaagguagccaagguuguaccucaugcugcagcuggucuugguaauguguaagagucacccaggugguacugguucugaaggcaugaaggggucaugaagagcagcugaggcuuggcacugugagaggccauggaaggccauaggugaaggugcagccucaguuguaguugauggcccaggacugaaggugucauguaaaggauuugaggcuuggcaccaugaagagagccugaaaggauauuggugaagccuaguugcaguggaagaccccaguguauuggagaugccaguaccaugggcuuaucaccaagaacagcagcagcaguggaguggaucaaccucagcuuagagugcuacagagggcagagcuggagaagugacacccuuuggaggagcccagaagaucaugcguggauccuagacauugaaagcuauaacacugaagcugucuuggagacccaaagauuuuaaagaugccagagccaugagauacaugcugaggaaagcugcuaacggaguggaaccugcccaggagaaagaaguuuguugcaguuaacaaagaugaaaaaggaguuggagauuugaagaucacuuugacaugagacauggagauguuuagaguaaggccagcuguuuuccucucuugucuuggggauuacaguuaagugauugggcaaauaucagaagugucuuugaacuuuggacuuauaacauuaagacugcuauagacuuugggaacuuuggaaguuggacuaaaugaacucuuuuguuauguuaugucuaggucuggcccccauagacucaugugucagggaguggaaugugaugguuuguauauguuuuggccuaggcacuauuuggaagugugaccuggcuggaguaggugugucacugugggcaugagcuuuaagacccuacuccuagcugccuggaagucaguauucuacuaguagccuucagaugaagauguagaacucucagcuccuccuucaccaugccugccuggauccugucauguuccugccuugaugauuauggacugaaccucugaacuuguaugccagccccaguuaaauguuguccuuguaaagaguugccuugggggcuggagagauggcucaguaguuaagagugccgacugcucuucaagagguccugaguucaauucccagcaaccacaugguggcucacaaccaucuguaaugggaucuggugugucugaagagagcaauggugaauucauauacauaaaauaaauaaauaaaucuuaaaaaaaaguaagaguugccuugaauaugguguuuguucauagcaguaaaaccuuaacuaagacauuccuccaccaugcaucaaccugaggcucucauggagaugauaugagcugaugccuuugaacaacuugguguuccugucacacagcugggucugaguccgauggcuuauauagacaccugccuacacucauuguaaccaugacaaauggacagaauaaucuacuagguucccaagugugacucacaaagaaguauacagguucuaagaugaaauuacacacacgacacuccuguggcuccacacaugaaaagucagagcuugcccgggagggaugcuagagcaucgucuuagccccucucacaugugcuucuuccccugggguuccagcaguggguuccaccaccacagucugucugcucuucagccuagggagggugucagcucucuuugacccaugugacauugugccagguagcaguugguuccuugugaauaacauacuguugcuguuucucucuucaccugcaagagaguuuuaggugguucacuuuagaguugaccuaaauagaguacuauuaugagccuaauaauaauccuaaaauaauccauagaagccauuucagugggaugucuguaaaggucucccacgaccagauuucuuugaaugguuuucucauugcuagagucacugaaagcuaauuuuucuaagagguuuucucccugcuagagacacugaaagcuaauuucucugagugguuuucucucagcuagagacacugaaaacuaaaguagauucuuuguuucaauaacuugauaaacauugcauauucuuagagaauacaucagaaaucucucagaagccuuacacugaaaaaaguagauugggggcggggguggcuggagagauggcucagugcuuaagagcacugacugcucuucugaagguccugaguucaaaucccaguaaccacaugguggcucaccaccauccguaaugagaucugaugcccucuucuggagugucugaagacagcuacaguguacuuagauauaauaauaaguaaaucuuuaagccggagcaagcggggcugaccgcagugagcagaggucuugaguucaaauucccagcaaccacaugauauauauaaauauauauguuuuguuuuuaaguagauuagguuuguugggauuacuuccagauguuuuaguccuaggcacuucugagacuguuacaucucugaauuagagggagcugcaacugggagcgagcagaaagggggagaagggagaagggagaagguagacuuguuuugcucaguaacugagaugccaguuccuucugugaggacacugacaugcgugcuggaagaggucagaaagguuguaaggguuguagcaaacuacuucauuguggaguagucacauggcuguuaguacauugucuguaucgacuaucagcuauuaucuguugcuagaacaaaaaaaauuguggccaggguacgcuuaagaaacagauacauuuagcccauguauuagaaaccagaaagcauggugucauguguuagugucucaaaugcgucuauaugcuguuccacauaaagugggaagagauaagauggcacaggugcccaccuacaagaggggcucaggagagaugccaggcccacuggguaacagcuaacccaagaugcccgauucauuucauugggaacuguaguaauuucucugugaggguagagcccccuuccccuuacuaccauauaaacuccauuacauugggggccaaacuguucagaucagaguacuuaagagauacagggaaagucuugaagaccagaguggcaauaccuacuugccacccagcacgugggaggugggguagugugggguuggauuuauaagcagauguuucaggguuugcuucauauacaacaguguccugaaccagcaggaguaagagucccacauggugagguguugaacagaugagaggggaugaaaaauagagaaaacagaacgaaagcaacagcugggaucagcaggucuggcagaagcccaugacugaugccaggcgagguuuuguuuuuuuucuuuuuccuuuucaggacagauuucucucuauaucucuggaugugcugaacccacuguguugaucaggcuagccugaaacucagauccacaugugucugccucaagggugcugggauuaaaggugugcaucaucacaccuggcccaagcaaguuuauuaagaagcagagcuucuuguaucauauacacugcuugcaggagggaauauggccaaggucagcagagagcucaguuagacaguguugguaaacagaaguggaaugccucagacagcucaggggaagacugggugcccaggagcugcaaccuugacuccuuccaggcacugacugcuccagcccuaggccagcuuugccgagccugcuccuggacaaggacacaggaauaaaguucccuuuguccuuucaucaggaccccugagaaagucccaggugggucaggcccugauuuaugauguaucucuaugauuguuacauuuuccaguguuuuuguugaacucugaccuucacacggguacaugcaugcagucauauccacacaugcaggcaaacacaaaacacagugguaugaagagaucuuucaaauagaaauuuugcuggcaacaaaauuuucuuuguuucuuuuaaaugcuccucacuuaaaagacaugauaugagugguuagcgauggacuauaguccuagguggcugauuggcauuuucaugguacguacuuuucugguuuuuaacuuguaaacacuuuguguuuuguuuuaggugugagccuucuaaguagcauauggcaaaacguuaggccaagcugugacagccccugugguuaagguaagcucucgccuugaugaugugcguuuacagcagcugucuuugcguucccuaucugccacacuucucugcuuuccuucucucuuuccaucuucccaugaauacgugguuuuuucugucauuugacucagaagguagagguccguaucuguucuucugguuaugcugaagguuuacuuauuuuuuauucuucuuacugaaggugugugugugugugugugugugugugugugugugugugugugugagaguguguauucuuuaguauuuuuaccuuagguuugcuugcaaguaugaaaguguagcucaugugugcagucaccacagagaccagaagagggcaucagguccucuggaccuguaaaaugguugugagccauguagagguggugggacaaaacccagguccccugaaaaaacagagggugcuauuaaccccugugccaucucucucaccucucucucucucucucucuguguauacauauauaauauauauuuuacacauuuuuaaaagcagaauacuauguuuauccuuauuccuauggaacaaaguuuuucauuuauaaugucuuuugcaggcaggucucuguguguguguguguguguauggagacuagagaucaacaucagacuuucaguucucuccauaguuuuugagacaugcucucucacugaaccuagagcucaccaauuugguuagacuggaggcuagcaagcgccagggauccauuugucuuuaccuagcuaucccgugccccagugggguugcaggcauguggcaccaugccuggcaucuaugugagugcugaaaaucugaacaugggucucugugcuugcauggcacacauuuuaucaaccgagucaucuccucagccuaccaccuugucauuuucuuuaacaaagauuuuauuuauuuuauggaugugaguacacuguagcuauauucagacacaacagaagagggcaucaggucccauuacagaugcuugugagcuaccaugugguugcugggaauugaacucaggaccucuggaagaguaaucagugcuuuuaaccacugagccaucuccagcccccaccuugucauuuuuaccugguauguuaaguguaaauuucacuuuguguguguguacuuguucaugugaguguuuguggggaggcagguauguguauguguaugaaagccgagggugacgucaggugucuuccucagucauuuucuacuucauuuuucccccagaaauuuuguuuuugauuuuguaggacuggggagugguugcuccccagcgaccuugggcgcucagcaagccaucugccgcugaauuacagcauugccuucuacauuacuuuuuugagacucugucucucacugagucuagugcucacugaugaccagccaacaaaugccagagauccuccugucucugccuccucagggacaggauggugggaaugugcagcuugaggacccugcucgcaugugugcggcuccuguguuugaccagcugagccgucaucugacuaccaccucuaccauagccuucaacaccucaugcugggcugguccccaaccaugaaaugauuaguuuugcuacuucauaucugaaaucuugcugccauuagcauuugugauguaagcaucaauguuuuccaauagucucaggugacccaugugacucccccggggucauggcccacagguugagaaccacgacucuggcuccaugggaaaacuauuuuuguucuugccuuuuucuuuucuuguagcugugauuagaguccucgguaugauuucauagucuccuacuuuaccuuugcgucuugcauuccacuccuccuuaguuuccaucauauuaaaauagauccucaauagccaggcacaguggcacaugccuuugaucccagcacucuggagcugaaggcagaggagaggcaggcacagguggaucccgaguccuaguauuuuugaaaauauucuuuauauuucaugugaauacucuaaaauucacuuauaaaauagguacaguaaaacccaccucucugagcaaggugugcuggugcuuguggguaagauacugugugauaucugccgauccaaaugagcuuuuccaagcauccccuggcuugaaaggauauguaugaaaauaauugagaacauuaacugagagcaaugucugacuuguagauggucacaccucugguggaaagccaggacaggcuaacucuugggcucccaaccucuagcauaaggucaccuccacuuagugggacuuggcacugcacaggcacaaaauccagcguuuuugcuuuguuuuuauuacaaaacaagacaggaaauccaaaccaucacauuuguaaucuagugauccagaagguaagaggaagcucuucuggcggccccaaacacauaagcgcugacucagucagcacauccuuguggaugccuugcucugcauaugugcauagagaauucacuggcauuuaucacucugucuuuucagaggaggcucaugugcaucauguuuauugccccauauuuuagucagugacaugaagaaauuaugggaaacaaaauuucaaguaaugagugaacaaauccuguugaaugacagcuguaauuucaccucagagguuuccuaaugauaggcuuuuuaaaucauggguuuuuuuccuguauuauaaaggauacccauuuucugauuaaauuuuuuuuugauuaaaaccaaaaacauuuauuagguauaauguauuuucugauuaauuuuuauaggaugaguugguacgagugguguugcuaaugugggcacauagagugcauucagaagacaagugcuuacuuaguacagcacaguggccaggauacgggaucagcuggagacucggugaugaaggagaggauaaaagcaagaugcuuuucuacaagagggguauuaucagcuaucagaggguagaauccuggcauuugaugcaacuuaaauggaauaaaaugaggccagcacaaagacagagauuucauguucuuacuuguuuguggaauauuuuuagcuuccaucuuucuucccuuuuuuuuccuucccaucuuucuuuuuacuuuuugucuuugaaacaaggucuaucuuagucacuuaggcuggucuugaauugugaucuucuugccaaauccucccaaguagcuaggauuacaguuauucauauagaaugagagguguuguuugaaaaugauuccuggucauuuuaaccugggucuugaugugcacgucugcaugauggucuauuuaugugcauuaaaugacuguaugacauugacugaugaguugagguucaggugguggacacucacccagccuuugcucuuccuguagaaccugugccuucugaacuucucugcugcuguggauggccccggcugucuugacugcccuucccaauaggaugucacugagaucccucaaguggagccugcugcugcugucccugcugagcuuccuggugauaugguaccucagccucccccacuacaaugugaucgagcgcgucaacuggauguacuucuaugaguaugagccaauuuacagacaagacuuucgcuucacgcuccgcgaacacucgaacuguucucaucagaacccauuccuggucauccuggugaccucacgccccucagaugugaaagccagacaagccauuagaguuacuuggggugagaaaaaguccugguggggauaugaggugcucacguuuuucuuacuaggccagcaggcugaaagggaagacaaaacguuagcccuguccuuggaggaugagcacguucucuauggugauauuauacggcaagacuuucuagacacauauaauaacuugaccuugaaaaccauuauggcuuucagguggguaauggaguuuugccccaaugccaaguauaucaugaaaacagacacugauguuuucaucaacacuggcaauuuagucaaguaucuuuuaaaccuaaaccacucagagaaguuuuucacgggcuauccucuaauugauaacuauuccuauagaggauuuuuccauaaaaaccacauuucauaccaagaguaccccuucaagguguucccucccuacugcagcgggcugggcuacauuauguccggcgaccuggugcccagggucuacgagaugaugagucacgugaagcccaucaaguuugaagacguuuauguuggcaucuguuugaauuuguuaaaaguggacauucauauuccagaagacacaaaccuuuucuuucuguacagaauccacuuggauguaugucagcucagacgcgugauugcagcccauggcuuuucuuccaaggagaucaucacauucuggcaggugaugcugaggaacaccacaugccauuacuaagcccauccaucacccaucuaggcaagggaggaaggacacuguagacagggucagaguuagcacugugggaaacucgggaaguugagcaugcugguuugccugggcugaaacucauggagcucccuagacaggagucaaggccugaacuuagugauugcuuucacagaauuuaacuugggucguuuaaaggugacagaggagucaaacauaaugcaaacgaagaguuuugcuaaccaaaucaaagggucagacagucuggauggcucaggcuguagauuagaauuucuuaagauuucccuaaaagaaaaacuaacuaguccacagccagaauacaguguggaguuguauuuauuagacaguauaguuacauaaugguucaguguguaucuuaagugguuauuauguaaagauauauauauauauuucuuguaaaaagcuuuacagaguuauauugaaaacauucauuuguauuguuuucauuugcaagguacucaaugauaugguacguaagaguuaucaaaucaaguauuauuuaaugucauuucaauuuucuaaauguuuaaagguuauguauggucucaguauuauaugaugaauugccuuucacauuugagcuuuguuuuauucaccacugaucaguuuaauuaauguggcguuaaugugacaucaaagguuauuacugacuguccguaaucuguugaacucuguugcacuguaaacauagagaauuaaagcaagaaaauucaagcuuuguauaguuuuuuaaaaauguagucaguguuucucgaugucacuucaucugucucauuauccuccaaagaauuugggaauaauaagaacuucaggcagaucauuuccuaaaggcacagaaggcugagacggucuuaguguuuacuaucacaguguguaagcuagaaaggggaaguggaagacccagguuguauuguuaacccucccaguguguguuuucuacugaguaaucaauuugucaauaaaggauuuuuaaaaagcag

SEQ ID NO: 1456 - RNA, 28130 nt, Mus musculus
cuucucccgcacccuucagcacgcgggauuuccgguucuccuaucgcgagaucuucguagguguguagcgcggcugagguagccgguagugcguccuggccggcggguugcccgcuguggguguauuucgcccugucacggagcugcugguagguucugggugggagacccggcuccugcgccaacagcggccagacgagggagcgagccgggcccuguacccgggcugcgagcggcccgcacgggcgccggggcguggguguggggccgaggccggccgcaugcggagccgcggcgcggaggagggcggaagggccgugcugggcggcggcucgcgacccccgggcuugugugccgcacgcauggcuguccccgaacucaggagacucgaccugauggauccaagucucaccgguccuucccuccccuugauaggucgcgcgcgaaccauggaguacauggcagaguccauugagcacagcccgggacacaugugaguugcgagcccgcccugaucgaucccuuggcgucugcagaucguaaaauaccgagaaaacgguuaacgcuagcaggagagguccuuuucucggugggagaaaacgguugggucuugaucgcauaggaagucuaccccauuuuaaguccgguguagaaaaaaaugagugcuuugagaagacguccuccuagaggggcacgaguggacguguacgguugucacccggcuccucugucgugcuagccacaugguaugcggugcucacgugcagcuaguggccaccacuggaagauuaucuuaguuuucuuugggcagccgugggccacgguggcggagguucacagacuuuuucugcuguuucguugaaaucuuacuuucgauggagccaguccuguuagauuggcccuggaauucacucuguagccacggcugaccuugagagccuugucccuucagccuuagccucccaagugcugcgauuaugucaggccugcuucacaaaauuuuucugccuccaguacacuauagaguuauacuccuguagcuuagagcaucgguaggcauaggugcucuucuuguccuguauuuuugucuauuucuccuuuuaaaaauuacuuuguaacauaaaauacaggguuucauuauauuuucauguauauaggaggguccgcauauuuaacauuguacagcguucauauuuacccuaccauugaucuuccuuaacccuccuacccccucacaggucccuuuccuuuccuuaauaaucuccuuucuguuuucauggaauacguacauuuuccuuuacuguucauugugggucccuguaaagggggccuguucgcaucuacgcauuguagaugcucagaacaaagggggcacccacuagccgagucagaugcaagagaaacgagaaacggaucuuacauauauuguuuguuucucuuuguuguuuauuuuugcuuuugagacagucuuaccauguuaaguccugcuuaccaggaacucauagagagaucugucugccucugccucugccucgcaagugcuggguaaaggucugcaccaucacacuuggcugucuuuuguuuauauuguugaauuuaugugcacauuaguguuugcuauuguuguuagacuauuugcauugcuaauuucuuuuuuucuuaguuuuccaauuuuaaagaagagaugagggacuaggacauuucuaucauugcaugaaguucauuagcaugacaaagucgcacagugcccucuuuaagcauuuucagaauuauggcccuuugauuuuugccgauguuucaggauucuucuucacucugucuuuaagauugccuuuuuccccucuucgagacagacucucaugaagcucuggcuggcgugagacucacagaucugugugcccugcuuccugguuguuaagacgaaaaagauuuccccccacaccccacuugucuuuuaaaaacaaaucaacuuauuuuauucgugaguguaugugugugugcuaagugcauguaagaggccauggacaucagaagagugguagacucuccuggaacuagaguuacagaugguugugagcugccucuugugugcugaaaauugaccccaguuugcuauaagagcuggaagcacuuugacccauuaagugucuccucccccacuuuaaacaguagaaucuugaaggcuuuggcuugguagggguuuuuuguuuguuuguuuuguuuuguuuuugacuaguaaauguauaaaaucuaauuggaaaaaaucugcuuuauuuucucaagcuugugcugugaauguggugucccaauuaguccaaauccugccaauauuuguguggccuguuuacgaaguaaaguugacaucagccaagguguuccaaagcaggucuccauuucuuucugcaaacagugucagagguacaguacauuacuacuuguuuagcuuccuuaaguuggucuucauacagagagccacuguguuaugcugagauuacucugaaguauacggaaugaaacgugcuguugaguguuaauuuuuaccuaguugauguuaccaaggauauaauaauuugcaguuuuaugcugugcuuucuacuguccuacuaaucugguaaggauagaaaaaauauuuguauaaaagugagauacugaaucugacaguagaagacgccuucugagagcugaugcauucuuucuucaguuucguuccuuuaguuguuggcuacaucuguuuacaucuauccauaugucuagugagagacuuaaaccuugucagugaauauaaaaauuauaugccugugacuucccagauagguuuagcauuugcuuuguguauguggaaauugucuguggaccucuguaagaauucaaaauguauuuccccaaaucucugcacauauauaaauaagcccaugaauuuaguguacuauuuuagggaguuuacagugugugagccugguaaguaugaggcuuuuggucuguuaugaauauuuauuauuaaauacauggugaaguuuuaaaaguauuagacaaagaagcaggacccccaaaauauuagaaguuucuaucaaacuaguuuucugucaugcuuagauacagucugagucucaauuuucucaugagaaugaaggguuuuuauuagaugauaaauaguauuugaaacauccuuugaaaauacuuauaaacaaaugguuuuuauugaaccuugaaacaggaaaauuaaaguguuuaaccauuuaauaccauggcaagaaagcauuacauaacucaggugaaaguauuuagcagacauuguuaauaaccucuguguacuggaccuuggaagacuggguuaaaaaaauucauaauuuacagaaaggauuuguauuuuacuauaaugagguuuaauuaauuuuguuuuuucaagauaaaauuucucuguagcccugacuauccuggcccuuaucuugcucuauagaccagguugaccuggaacucaguuugucuuugcuucccgagugcugggauuaaaggcgugcaccaccgugcuugacuuacugaggcuuauuuugaaaacuugucuuuuucagcuuaaaaauugaaaugaaacuugaugacugaacuuuugauauacauuucuauguguacuaauuuuccuguuuuuguaugagaaaaauguuucgcaaacauuuuagaagaauaaaauaaauaauuuuagagucauuuaagauaauucuuaccuguuggucaguguuccuucaaagaaauuuuggaaauauugccguguuuacuggaauuuaaaaagaaagucauuuauguguagcugugugcacguuuggugucccuaaaggccagaggcauugaaucccccuggagcuagaguuccaggcauuugugagcugcccaacagugagugcuaggaaccccaccucagucccccuuaacuaccgagccaucucuccagcccuccuuacugggauauuuuauuuauuuauuuuuaacacguaugcauuuauuugguaugugugcgcacuaggccacacuaugcauauggcggucacaggacgauucauaggguugguucucuccuuuuaccaugugaucucagguugucaguccugguagcaagcccuuuuacucucugagccaucuucagagcucucuuaacucagugcucucuuaacuucuauuuuuaauaauugaaacgacaaaauacauaacauaucucagauuggcuuucuccaaauauuagaauauuaguuuugaacuaaagacacuggucucaugggguaaagcuuuagaguagaguauuacuccugauuaauaaucaguaucacuucuuucuacuaauggaaauuccuguuuuuuccugaaaagcggcaaacuuuagaauguuaucuucuuucagauauuuucagccaccagcaucauggguacagugugcuuuagaguccagggaacuucuugcuuuguguuugaaaaaaauuaaagcuccucugaguaagguaggucaguaguuaauauugcuguacuuuuucacugaaacacucauuuucagaaaauccuuugcuguggguuuugcuuuauuaugguggcuguuguuuguuuuuuuucucuuauguucuuuuccuuuuguuuuuugaggcuggaaauugaaccaagugucuuugccauaaauuaucagggauucuaccacugaaccauuuugcuagucccacacaauauuuuaauacacaaacacacacacucucuuacuuuuuauauugaccuuuguugaaagguaguauuuuuauuuuauuagaaaaauuuguugagauuuaaaauuuuuauuuguauggaugcuuugcauguguaugugucuguauauuauguaugugcaguaccuuuggaagucagaagaggguguuggguccucuggaacuggaguuacagaugguugugaucugauuugugggugcccuagaagaacagcaagugcucucacccacugagugagccuucaauauuauuuuuuaguucugaaaucuuucaaguuauugauucaucuugcccuuggacuuuuuaauugccuggagugaagcaguacagucaggaugacuagaaagggaaaagaaugcuccauugauuguuguuguuguuauaaguagagagcauaguaaaaggauuuuaggauuucaaaauguuaaguggguacagaagagacugaagaaccauaugggaauuggauuguaggaaaugagagggagacucagguaucuggaauuacguuaaaggacaaaggacuuaauaaaguugacaauggcuucucuaagaacaagugugcugagccuguuaagggaaugcugaagugaaugucaaggucucuacauuccugcagauggagguuagaggcuuuaggagagaaggcagacuuauuuagugcucuguacauuuguacauuuccaccuaacuccugcagauacuuacuaacuggaggcagggagggguacacuggggggguaggggaaaaagggugguuaggaacugcuugcuauucugauuuaauuucuugacuacuggacuuugcuguagcucacucagucauacuaguuggguuuuauucuugaguacugcauuugccuuggcuagucuugcuaucacuagauaguaucugguacaguuauaaucugccuguucacacuuuucaguguauuacuuaacagauuuuucuguguaccuucagaccaguaucaaacugucuacuuaauguaugucauagaugccaggaagggcucuuuguccauuaaaucuguuguuuauuuaugucaaaaaaauuguaauaucuagcuguuuaagcuugcuacuuggguauuguacuaguguguguucucguccucuuucuaauauauaaguauuaaauuaauccuauagaauuaucuuuuaaguagcucuugcuuugcuuauuucugguuccucuuaguucggguuccuacuuugauuauuauaaagccuccauucuuuuucucucuguuucuuuguuuuaaaguuuucauucuagccuuacugcauuauguucaguguaucaagaauagcaagcuguuuuuagcuccugaucuagaaguauuaaaauuauguagucaguauaugaacauuucccaaaauaauguccaucccccuacacacagacacccugaaacucauucuguaaauuuuuuuuaauggucauugauguuuuaucugcguguaugucugugugaaaguuucagauccucuggaacuagaguuacagacagaugugagcugccauguagguguugggaauugaacccagguccucugaaagaacagccagggcuuguaaccacugagccaucccuccccuaaauguccauucuuuaaaggaaaaaauaaagaagccacagaguaauguagaaagauauuaacuugaguggaagcuuauguuugugagguugcuuuuggguaauaaaggcaccaauucauuuucuuacgaaaaaguaaauuucugucugaagaggaauacuuuuuuuuuuucuuuaaauaaauuuccccccucugaaagcuacuuuuaauucuugcucaauauaauagcacagucauuggguugcccuuucauuugcugccauuguugccaugguuuuauagugauggauugcaaugauguuaaucacauguuccuucaaagaucuuaugagucuauuuaauuuuuuuccuuuuuuuaaaaaauucuuucauaaaauacauccugacagaaauuuccccacuuuccacgccucccaauuuucucugccaccucccccuuuccccagaugcacuccuccauuuccuuucagaaaagaucaggcuucccauggaugucagccgaacauggaauagaguaacaagauacaguaauacuaggcacauaucucccucaaggcugggcagaguaacccaguaggaggaaaagggccccaagaacagacaaaacacuucacacuccuacuguuagaagucccacagaaacaccaagcuauauaagauauguauaggaccuagugcagccccagguagccccaugcagccuucaugauugcugcuucagucugugugagccccugugagcuugcucaguugauucugugggccauguucuccuggugucuuaccucuggcuccuacagucccccaccccuuuccagggguucccugagcuucaugggaaggaccugguagagcuccaauuuuagugugcucucugccuaauguuuggcugugggucucuacaucuauuccuauuagcugcugguuuaagcaucucuguugagagucugcuuauuaaugagauagucagucaucuuuccaccucucugguggggacuuauauuucuuuuuuuccccuauugaagguucggcuugucgaugcaggcuuuguuuggacugagccccauuccaagagacuuaaaguuaaauugacaauucagaaagagguaagcugcucacuuuuucuaaacaugguuaaaguacacguagugagaaugagggacuaggguuaaauuauuuuauggacuaaauggcuuaaaaggaagaauacaaucuaagucuuagucuuuuguuaucuuuuggucuucugacaugauuaggugacuagcuacaauugcucagaauugguguguucaauagucucuuuaaauaaagguuuuguuuuuguuuaagauagguucucacuagguaguuaguacuugguggccuagagcuuaguagacuaggcugguuuggaauucagagaucuccugcuuuuacuucugagugcuggaaaaaagguguauguaccaccaugcuuacccauauguucuucugaaagugaauucuuugugugccacauaggcauauauguauacacauauaucauauacaugucuauacaacugaaaaauguuuuuagauuuaguucucaacucaguaaauagucaagagugauuuggaauuuuugaucauccugcuucuacuucccaaguguuggaauuauaggugugugccagcaugccuggcuuugugugguggugagaaucaaacucaaggcuucaagcacuagggacaagcacuguacaaucaaaccacauuccuaccuccacauuauuaagagaauauguucacaaccacauuuucaugagguaaacuuaaaaagauaaucuaaucuuuggauuucaugugucccuuucuuaaaacaguguaaccacugaaggacauggcucagggguagagagcuugaucagcaugcauaaggucccauauuuaauccuugguugugcacccucuuccccaaauguaguauacuuaguuuuauaauuuuaacuuugacuuauugauguccuuaaugcauucauagaaaacauuuaaguuacuaauuuuuaaaauuagaauauucacuauugaacaacuaggagugaaggagugcaauugccuucuuuuccaggugaugaauggugcuauccugcagcaaguguuugugguggauuauguuguucagucccaaauguguggagacugccauagaguggaagcuaaggauuucuggaaggcugugauccaagucaggcaaaagguauugaaaaaagaugaugagugaauccugagucuugaauuucaucacuguccauuuucuuuucuuuuuuucuuuuuuuaaaauacauuuuauucauugauugauugauuuuuuuuuuucuuuuuggguuauuuucuuuauuuacauuucaaauguuauccccuuucucaguuuccacugaagaacccccccccauuucauucccccuuccccugcuucaaugagggugccccucccacccuggcuggggcaugcagccuucacaggaccucaaccccauugaugcccaacaacaccauccucugcuacauauguggcuggagccauggguuccuccauguguacuuuuugguugguggguuagucccugggggcucugggggcucugguuggcugauauuguuguucuuccuaugggcuuggaaaccccuucagcuccuucaguccauuuucuaacuccuccauuggggaccccauguucaguccaauaguuggcugcaagcaucugccucugcauuuguuagacucuggcagaaccucucaggugauaguuauaucaggcuccugucagcaagcacuuauuggcauccacaauagccucuggguuuagugacuguauaugggauggaugggggagggggacaggggagggcagucucuggauggccuuuccuucagucucugcuccacacuuugucuccauguuugcuccugugauuauuuuguucccccuuguaagaaggacugagguauccacucuuuggucauccucccugagcuucauguggucacuguccauuuucaguagcugauaacauguucucauuucccuauguccuguaugcauaacuggagucuagguuccuggaacauucaacuuuagaaauacauuauuauuuuauguuuuaguuaauuuuuaaaguuuuuuuuuuguuugaaaaaucagagcucuauaucuguagaugguguauguauuuauacuuuauuucuaaaugcauuuuuuggcauuuauugauucuauaaugcuuuagacucuacacaagaaaacauucuacuaucuggaacaguugauuuuaaaauauggaaugcaucagaauacacugcguaucaaggagauucauggugaguucaaauuuaaaagaauuugaaacaguaucaaaauuuucuuucaauuauucaaaguuaucuuucucagaaguugagaugauuaaaaaauucauacaaauguauguauaagaagaaagcaacguaugccgggcgugguggugcacgccuuuaaucucagcacucgggaggcagaggcaggcggauuucuacacuugaucuuagccaaaaggcugagaagcgauggcaggcggauuucugaguucaaggccagccugaucuacagagugaguuccaggacagccagggcuacacagagaaacccugucuugaaaaaccaaaaaaaaagaaaaaagaaaaaagaaagcaacauuaauuuucugacugaaguauagcuagcuacucuaacucaggaauugaauuuucuucugcuagccgauauugaacucacaugacauuaguggcuauucuggauagugcacaucuagaacuguccugugucuucuauacaccuuuccugccucccuccccugagguuauucuaucccacuucacuuauuaaauauuuaguuuauaauagacaucauucuuugugcuuggaauauaaugauuauauuaauauuaauucuugcucucuguugcuuaucuugcuacuuaaagaauaagccaaguaacuccauuaauguguuguaaaauacuacaaaaaaauccaucaaaaccuuguuuuguaugggaaaaauuucucuaauuagaaguacuguuucuuuggccuuucuaaauuuuggacaagauaaaagcgaauuguaccucuugaucaguaaugagagcuaacaguuuucuuaucaucuuaauuuuguuucuaaugugagucaucugcuguuaguuauccuuagcucucauaucuaauuugcuuaguuuuauauguguuuuuaggauguugguuuccuuucagccauaaauacaguauuucuugaaguuucguuuucuuuuccuuuucucuuguuuuuaaacuuuuaaaauaauuuuuguucaauauauuuuauucaucuucuuccccucucccaacucuucccagauacuacugccuuccagcuucauguucuuucucucagaaaaacaacaaaagcucaccagcacugcauuccauacucucucaaagcacauaaaaacauggagacccauauguguugagggacagggucucugccgcccaaggcuauccuuggacucucagugcuccugccucauucuuccuauuauucuugcucauuugugagguuuuugaaguuguugagguuucuaauugauauaugcugauguguauacauaaauguguuuauguucucuguucaguuuuguuaucaguuaauuggagaaaguuacaaaggucgccuuuuuuuuucccuucaguguuuauuuacugugguuuugaagaaccuguccauuaaacuauuuccuuaguucuccucuugaauaauuuuucauuacauuuauuuaugcauuuaauauuuuuuugggccauaugucacacuggaauuuagguaacaucugucaucuucaggcauuuauuuauuuauuuauugcuuucgcauuuauuuauuuauuuauuuauuuauuuauuuauuuauuuauuuauuuauuuauuuguuaucgcaucuaucuaucuauguaucuaucuaucuaucuaucuaucuaucuaucuaucuaucuaucuaucuaucuaucuauuuauuguuuuuccgagacaggguuuuucuguaugccccuggcuauccuagaacucacucuguaagaccaggcuggccuugaacucagaaauccgccugccucugccucgagugcugggauuaaaggugagcgccaccacugccuggcuucaggcaucuuuucaccucugucuuugaggugaaaaggcagagugcugccuuauaggcagagugcugaguuauaugggaaauuuauguugaugauaauguuugagaaacugccauaguauauuuucaaauggcuguggucuuuacauuccggacagaaguguugaaagguccuagauucuguacuuuaguugcuuaccauccuuguuuauagacguugugagggaagucuguagugguaucuaucuuccuguggcuuuuucauuucacuaaggacuaaugauaugaggcauauucugcauauaaauguauuguuuguaugguuugcauuguuuucuccuagacugucuccucauuuucuaaauguuagucucuauugcaaauguuuguuuucuuuuaaauguauuuucuauauguaugaaugucuuaccugcauguauguaaauguacugugugugcagugcccacagaggccagaaaaagacauuagaugcccccuggaauuagagucacagauguacaccaccaaaguccaacuugaugaaccaguauguuuuauuggggcuacuuagaggaguagaaaugacucacgguaucuauaucaccaaagcucaccucagcaugugugauagcucacacagcugggaagcaggaguaugcugcacacacagcucacaggcaggcgucucagcagguucaagaguguucuuucuaagugaagucuaaaccucuucugggcaguuaagguuacaaaaauaacuauuuuuuaugugcuuuacaaucucaacucauaggucuuaacucuugaauugguggaaagugccuaaauucaucuuuuuggagggauugaagaacuaguuuucucuauuaaaaaaugccauuaauuguuaagaucuguuaaugaaauguaauagccuauuucugcaaucucaaauuugcaugaacuuauacuuuuaugcuaguuuuauacugucuuaauuuuaagucuagaaaucuaaguccugugacuuuguuuaguuuccuugguauuguuauuauaucuuaaauguuauuauaccuuaaauggaguucuuucuuagguaucucguaaguacuucuuagcaguagauuugcauuugccuguuccuuuguugauaguguuaaaugauacuguacugagauauuguuguccagugacuauuuuguucagucucaguauguaauuuuuuuucaugcaugucaacuaggugaauuuuugucauuuucuuggcaucuuguuucauuuuaauauaaaauguucuuuuccuuuucucucuuggccuugaauuuuguuccugugaauuaguaugaauuuuguuuuuaucuguuaacauuuauuuuaucugauuuucaucugccuuuuugccaaacaagucuuaauugauaucccuaaacuauuuugacuauaauauuuucuaauaauauguuuugcuuauggauuuaagugauuuuugucauauggucauguagaggaaaaccuuguuuugcagaacuguuuuuauuauuuuuuuuuuagauggucuggauuuuuauuauucuucaaaacagcaugcucagaagaugguggaguuucuucaggguauaguucccuguagguauguugaaaccuaaauuuguaaauuaaacaauaagagauauauaggucacaucuguucuucaggcuaagauaacuuacuuuguuacaauuaaaauucuaguauguauauuuaagcaaucaugaaauacggaguuauccauuuuuaccagccaaagagugcugaugacucucuugguaguuaaaccuaacuccauaguaauaggcacuacugcugugccauagagaugguagaagagcuaggcauucaagauggaagagacacucauaagcugaguugauauuaaaagguaagguuagcaggaacaaaaacuugggagguucauuaguguggcuuagccuguagucauucugaagaagguuugaaguaugcauaaaauuacuuucgccuaugcucuaguuucaugucuguugcugugauaaaaacagccugacagaaagcagcuuauuaggcuuacaguuguuauagucuaacaucauggauuaauuaaaucagugaguuucgucauauccaagggcagagagaaguuacuguguacaugccugcucgccggcuuguuuaugcucagcuagauuucucugcuuuaaacaguccaggauacucugccuagagaaggagccacuguggggcugguucuucacaucaguuuacuuaagauguuuuuccacagguauguucauagaccaacucagcccuuuucuggacuguaagguccuucucaggugauucuagguuauaucaacuugacaguuaaagcuaagcacaccaccagggagcuguuugaaggcauuggacuuugauuggauaaaaccaaguuaugugagugcggaccucucccuuucuauugauaauguuuuuuucuuaacagauacaaagcaucacaaagauugaucucucaggauauucauaguaacacauacaauuacaagaguacuuuuucuguggaaauuguuccaauaugcaagguacuucuuuucauauaauuaauccuuaucuguaagagaauaaguaauuugcugguuauaauuuauuguucuugguuuucuguuggcuggcuaaacacuaagaauaacuucuuugaaugacuucugacaugcucaauuuuguuaaaaagauuuaaaauauguguuuauaacuguggauuggaaugcccuuuauuauuguguauuaugaugaaaagauugggcuggugagacuuuaucaagugcuuauuuagcaugcuagccugacaacuucaguuggcuuccuggaacccacauaaaaggagggcgaggaccagcuccauaauguucucugauaccaacaugaacaugcauuaugcacaugagcgcgcgcgcacacacacacacacacacacacacacacacugucaaaggccagcuuugacaccacaagguaaacugagucuggcagcaaguuguggcaucagugauuggggucagcacugaaagcugacagguuaguccugauagcaacuggacaggggagaagggggcuguugccuauggcagccagugauuagagaaacagaaaagggggaaaauuauacacacagagugguugaagcaaaggcaggcuccagcauuuuauuuuuucuuuuaaccccuuucauaccccuuaagauaaagauuuuguauguaagaaaauuaccucauaguuacaaauuaccucaucaccacaaaaacauauucuuaaaaaacagguuuaaaauugucacacgacaggaaauuacaacaggauuguugaguauguauuguguuggaaacuaaacaauucucaucuaucuuucuacaaccucaucguaauccccaaagcaguaauucuuuuguuauagaguaacaaaguuuaagaaggccaaaguuugucucuaugcuaaggaauaggccaccuauuuuugacaucuugaucagcuagacuggcuaauaaucaucuguucucugucuugguuaggguuuuacugcuguaaacagacaacaugacuaaggcaacucuuacaaggacaacauuuaguuggggcuggcuuauagguucagagguucaguccaguaucaucaaagcgggaauaugggagcauccaggcaggcauggugcaggaggagcugagaguucuacaucuucaucugaaggcugcuagcagaauacuuccaggcagcuaggaguagggucugauagcccauacccuuagugacacaccuacuccaacaagaccacaucuacccaaacagggccacaccuucuaauagugccccucccugggcugagcacauacaaaccauaacacacucaacaauagaauuguuuauucuuauuuauaaccuuucuauuucaugguguacucuuaaaaccacaucccuagaucacaagaccaaggaacucagaggccuaaccuagagugaaugccuuuuuugagcguuaacuucucccaauccuauuuuucucgcuacuacaacuaugugcuuucggugcaugagcgcuuacuguaucccuuccuaacucaugcagcucuugucauccuaugaggaaggggcacauuuuguucuugauucagacuuuauaaacuuucuaucagcuuauccuaucaugucaugauuauuuauauuaaguuuaacuuccuaaaauugcuuaaaucaggaauucuaugaaaucauuaauucaucuaaguagaauuaucucaagaacuuucauucucauguugaucucagcucgacuggauacccgcuugcaauuccccacagugggcuaucacccaggaaguaauauuauaccaggcuacaggcaguuagggucuccuggugucuacucagagacaaagccaaauaaaugaggcguguggcaguggcaaacaugagaagcaugucaguagcaagcagcagugcugggaugaagucuccagagccauacuuuucccgagugcauccauuguagccuagcaaguguuuccagagagcucacuugcccacuguagcacuucuuacauggugcccaucaacacacacacacacacacacacacacacacacacacacacacacacacauuaaaacuagcaaaaacaaguguaaaauuuuacaauccacuuuuauuaaacauuagaaugauagugaacauauaauaauuccaugacuucacauuauaaaaaaugauaguuaaaagauagugagccacuuuggaauauguguggguaagaguuuuguauauguaccugauguaugcauagauguggaugauaauaugaaaacaaguuguacuagcuguguucuagccaaaaguaguuaucugaguucuacuuuuuccagucuucauuuaaaagcaauaaaagccuggauaauacaaauuuaggugugacagcauauuuagaccuguguauuaaguacaaugaaaggagauacaguauuguggcauguauagguaauuaaagagucccuguagaugcuaaacuccaggguuguacagauucuucauaaaauuguguaguauauguuacuuacagacuacuuauaccuaauauauagcauagcauauaguacauaugcuauguaaaugguuacuaguuaaucuguauuuuuaaggaaagcaaagaaaaagauucuaccuguuuaguacaggugcaguguuugggugaacucguuaauauggagcacauggauguggaaggcugauuacauauuugucuuugggagcuucugaauucaaaaccaaaaguuggaguagguguuaauguauaguccacuucagugggaaagccuugaauguacacagauacagcuuuaugaccaagauuuuuucuuuuaauuuauuuucuuuuguuaaggucucauucuuagaucuuugaugcauuggaacucagagauucucugacuuugccucccaaguaugggauuagaaguguauauaccaccaugcccagccacuugucuuuuaauacaguuaaacauacaaguaaccuuguuggauuauguaauauucuuucauugaaaauuguaauguagaugugaccuuuucagccauuaaaucuuugaucuuuaauuacagacucaaacauucagcuauuuuaagagaaacauauuuucuuuuuuuuaaacuuuuuuuuaaagauaauuuauuaauauauguaaguacacuguagcugucuucagacacuccagaagaggaagucagaucuuguuguggaugguugugagccaccaugugguugcugggauuugaacucuggaccuuuggaagagcagucgggugcucuuacccacugagccaucucaccagccccgagaaacauauuuucuauugaaauuugguuuugugaaaaucaagagaaaucaguuacaaggagauuuagacagugacucuauuauuaauguuauacuuuuguuagacuauaugcuauauuaacauucagaaugaaaagcagguauuuauguuacaauuaaauugaaaugaauuuaacaaacacauggauguggaaggcugauuauaaaaaagaaucuuaaaagcauuucaggaaagacaaacgggcccaucuuaagaauguguaguguauaaagaaaccauaaaguucgaaguugugacucuuagucugcaggucauuuguuggcccaugaauaaaggauaaugcuguggagccaagcaagauaguagcauccuguaggcugaaucaugagacgugguuauucugcauacauucagacagacaguuugguugggcaagaacaauuuuaucagguuuauuaaugaguguuuaucagagguuguuaauuuagaauuagucuuauuuuagauguuauuucuuuuugcuuaggauaauguugucugucuaucaccaaaacuggcacagagccuuggaaauaugagucagauauguauuuguauacgaguaacuagugccauccaccucauagacccaaauacccuacaagguaagguuuggaacuaaauuuaguuuuggaacaagaucuuaacaauuuggccuuaugguaaacaguaaucgcucaaggcauuuauguuguuuagugcaccuuuuuuuuuuuuuuuuuuuuuuuuuuugagacaggguauuauguagccuaggcugcccuugaacuaucuauauauucaaggaugaccuucaguuccugacucuuccuucuaccuccccaguagaagugugugcugugauaccagguuacauaguaacuggaacuuuaggccugguggaugcuaguuaggccugguggauacuagcuaggcaugcaauuuuuuaaauaagcugcaucuccagucccaaaugucauucuugauaauacuauuuuggaagacuuaguuaaaguuuaguacuuuaaaaauggaauuauacaguauuauauucuuucucuuuuaaagaaacaguuuuaugaacuuuuagauauuucauacuuuuauuucuuucauuuuuauaaaaaauugcagcuuuaugcaauuuuugucacuaagucuuuugccaaauauaugugugccugugcacaagcauugaacccagagcccugugccuguuaggcagggacucugcuauuaaaucuuaugccuagccugcaauuuuagcuuuuuuuuuuuaaagauuuauuuauuuauuauaugugaguacacuguagcugucuucagacacaccagaagagggcaucagaucucauuacagaugguugugagccaccaugugguugcugggaauugaauucaggaccucuggaagagucagugcucuuagccgcugagccaucucuccagcccgcaauuuuaguuuuuaaacagcagcuauuauaaacuuggggacguuugagcugugauucauugggauaugcaguuuaaauuagaauuuuaacuuuuuaucauuauuagggucauuuaggauaucuuuauguaaaucauuuuuuaaaaaaggaagacugcauagugauagaaguuuugguauaugucuccaucuuuuucuuguuuuuuaucaaccuuuuauuuugcuauuuuuucagaaacugacuguaccaucagcuaaggucuauuugcaguuauaguaacuaucugcagaaugcagaaaagggcauucuuaccaguuagacaaaaauaggcuuugugucuuauaaccuaagcagcuagggugaccaauaauuuucugccauaaaauucuagcaaaugaaaugaccaucaaccugauugaauuuggucuguggcauucauauuauaguaacagaauaagauguaauauuuuugacacuugacauuucucuugugcaugggggcuuuggaccucauucauguauggaaaucaaugaugacuuagagugacuucaguucuuguuguacaguuaguuacuucauauuuacacauuagaugacugaaauuugucaguuaucuuguuuugaguguugugcuuauuuuaguugcagauauugauggaaacacuuucuggagucauccuuucaauaguuuaugccauccuaaacagcucgaagaguuuauugugauagaaugcagcacaguccgagaucugaagcgaagugcgggggcuggagugauaucaaaaaagguaagcagcaucuaccugcuuuuauucauuugugacaauacugcuucaguucuuuuaaaaauucuuguuuuuuaauuguugguaauuauaaaauguagagaccagcuacaguaaaacccccaugaaguaauuuaguuagugagggccagagagcucacucagcagguaaaagugaugucuggugaccuggguugaaucccugggauccacgguacagugcuuuccucugaccuacagauguggugugugcuauggcaugugccaacguccugucauaaacacacuaaacacacacacacacacacacacacacacacacacacacacacacacaaguaagaaauacaauuuuuuuuuaaauggagucauuaaagcaggaugugguagugcaucucauuaaucccaguccucaggaggcagaggcguuuggagcucuugaguuugaggccagccuggucuacaugucuacuaucagacugauacccugucucacaaaaaauaaaauaaaauuuaaaaauggacuuacugugguaagguugcuggacuacagucugauaaguaaauuuuuuucuuuuuguauugagaaaaggccuuuuuguuucuuuuuuuauuaaaaauaaaagucacguuuucccuuuauuuuguuggaggagaaccaaguggacaaucucuugacuucaaaucauuacuacauaugaaaucauccauagauauuuguacaucauagagauccuuuugaguuaaucagauuauaacuaugagaacuacauuuggucuauggauaggcugcugcuuccuauuuuuuuugucucagaaguguuuugagguuuguucagacuaguaucuagguggggaacacacauuaaauuauaugaauauuguaauucuuaaucuuuucuucagagauaaugccuuucugucuuguuaugacaccaacuuuuuuuuuuuuuuuuuuuuuuuugguuucucgagacaggguuucuuugugcagcccuggcuguccuggaauucacucuuugaccuugaccaggcuggccucaaacucagaaauccaccugucucugccucccgagugcugggauuacaggcgugcgccaccacugcccagccugacaccaacuucuuaaccugaaaguucacauauuuuguagaguaugcuaucuucuagaucucuacuacuguuaguuuauaaagccauuugacuucauuuacaguauuuucucuaaauuaaaaagggcaucugcauuuugguaaacuaaaauauuuuaugagagcguuuaagagaugaguauuuuuaauuuuauuuggggagaggggagcugugcaugugcaccaguucaugaaaacgucagagggcaacuugaggaucaagcucagaucaucagacuuuguaguaaucuuuauccacugagcugucucuccagcccacuucagugugugccugugucagaguuuuggugaaauucauagguuuuucugaacucuagguuuuuguuuuuguuuuuuaaguuuugggucuguuuucuugcuuuaggauucuuuugccuucuaguuaauuuuuugcucagucugaguuagccagucucugugaagacauuuuucugugaaaaugcuauguguguauguuacauguguguggguuaguaguucagggggcaauguuaaugucuuuuucaaguuuuggauuguuuuuaugguuuccuuuggaguaauuuucugcauuccugauuuguuaauuuguuaguuuugauuguuuuagaauucuggaaaguugaaagcuguuuuaaaugaauauuaaaugagaaaaagucaauauuauauuuaauuuuuccaugauaugauuucuuucuuuucuguuaagcacacccuuggggaagucuggauccagaagacaucugaaaugaauacagauaaacaguauuuuugccgaacucacuugggacaucuuuuaaauccuggagaccuggugcugggguuuguuuuauuuuguuguauuuuaacuuggcagauagcauuguagguuuucuucaggagccaaugaauauuuaaaauacuaaauuuguuaauuucaaaaaauuuaagagugcuuaagauccuuucaguuuuuuuuuuaaagauuuauuuauuuuauguauaugaguacauuguaguauaugaguacagaugguugugagccaucaugugguugcugggaauugaauuucaggacuuacugcuugauccaugcuugauccaguccuguucucuccagccuugcuuguuccgguccaaagauuuacuuauuauauguaaguacacuguagcuguuuucagacacaccagaagagggcgucagauaucauuaugcaugguugugagccaccauguggccucuggaauuugaacucaggaccuucagaagagcaauguuuuacccacugagccaucugucuagcccucagcuuauuuuuauuauugauaacuauaaacucauagauugcauagaagcccauaguuguuccauuugggccaucaucugagagucauuuauucaaagauuuuuggcaauuaaacaauauaguuagauaaauaguuacagcuuuugaagagagugcguagcuuuuauggcugugaaaauacuucacucuuuggaaacagcuagggcugaagagauggcucagagguuaagagucuacuguucuugcagaggacccagauuuugaucucaguccucauaucaggcaggucacaacccucaauagcuccaguucuaagggaucuaacacuucugacuucuagguacuuacacacacacacacacacacacacacacacacacacaaguauauauaaacgcaugcaggcacacacgcuugcgcacgcacgcacucacgcacgcacauaauaaaaaaguuaaaaggaagaaaccaaaaagccaacaaccacagccuguaugccggacagaacccauaaaaguaaauaacagucuuuaugcauuugaggucaucaguguguuguagacaucugguguguuuuguucacagaguuugaguugcauuuacaagagaaugaaagguuguugcuuguuguauuaacuaugcagacucauucaguugaauuugaaguuaaggcugcugugucugucuuauuucuuuaaugaguguaugggaaagagaagccacaguggacaguggaaaaacuuacagugcaaugugaugcuuucauuaaaaaucuaaguucucuguguaugauuugccugcaugcacguuugagccugguguccacaggcuggaagaggaucuuuuugacuuuucaagacagggauucucuguguagcccuggcuguccugggacuagcucuguagaccagccuggccucgaacucacagagaucugacuccuuuugccucuguagugcuggguuugaaggcaugagcuacuaccucuuagcuucaaaacuuuuaaaguggagagcauacaaaaucuuccacuuugaaagauaguuguguguauauaauacuaucuagcgaguacagugauacacaaaggauacuccuuaacucauuguuuauauuucagauuugauuuggccaacuguaacuuaaaugaugaguaugucaacaaaaugaacucagacagaguuccagaugugguaaggcuuuagauuuuuguuauuguuguuccuauguuaauucuuagaauuuacucagcacccccuugcccagucaacuuuucuuuuucauggcaaaacacuugauaccgccagacgugguggcguaggccuauagucucagguacucaggaggcugaguugggaggaucacaaguucaagaccuaccuggauuagacagugacuuuaauucuaguuuguaaaaaaggccgucucaaaaaaaaucccaaaauggacaagaggacuuauaaaaugaggugcuugccuagcauaaggcccuagcuucugucaccaaacaaaguacugccaaacaaaacuccagugcuggugauagagugcaaauacguuuguacuuagaaaugguaauuuacaaaauuuauucagauagucuuaaauuagcguauuuuauacacuuucucuacuuuacaggacauuuagaauugagaccauuauucaguauuagcacaaauuagaauuuaaaauaaccuuuauaaagucaacucuuggaauaaaaauuuuaccagggaaaaaguauagaguuguaauguggugaguuuaaaguucauaaacaucagugaaugaaaugaaggauaauaauccuacuccuacuugcuuaauccuuuuagacuaaucaugauuuucuuuagcuaugagcaaaaaugaagaucugguaauaggagguuccuguuucaucaguugauaaaauacaaaaaaaaaucggguaugaaucagaaugggcauuucuuuuuuagauuuauuuguuucacuuaauguguaugauugccuuuccugcauguauuagugugcaccagcugugugcagugcugguggcggucagaagagggugucggguguccuggaacuggagcugugagccccauggugauguggguggugggaauggaauccagcucuucugcaagagcaacaaguguucuuaacccccgaguccuuucuccagccuccggauugauauuuauuaaaggucacaugaggaggucgcuaguuuucuuaaaaaauguuauauuuuaacuaguacauauuauuaaauguuauaaaggacuuguacauuuucuaagugcuuauuacugugaaaaacaaagugucuaucuguaauguuucaaaaugggcuguaagaaugguggcugaaaauugaaauuugaugagaaaacaauucagguuuuagguauuaaaauuuuaauguuuagucauuugaaauuuucacaguuacauaaauaaugcucauauguaucuucauacauggugaaaguuuuaaaaguccucuugauacugccucuugaccuccacaccuuucuccugaauugugacugcugccauggauuuccugacaugcucaaguuuugaguuuuuucccccuacuguguguuucaguguuucauaacugcaaauguuuguguuugcagguguuaauuaagaagagcuaugaccgcaccaaacgccagcgccguagaaacuggaaacugaaagagcuugcaagagacagagaaaacauggacacagaugaugaaagguucugcuuuccuggacccuuacaagcaguuucaggggcaagccuuagacauuaguuuuagauuguaaagaaauugauauuacccaauagaucuuugcacuaaaaauuaacucuggauucuuagaaacuauaaauggaaucuauauaagagaacucauaaaaagauauaauaugauauuauacaagcucaguaauuauuuucuggguuauugucuuuguaauuauaguguuaauguaaauaauuuaguuaaaaaguucaaguauaauguggcuaucacaaauagaugauuugcuuauauugugagcauaaaaaacuaguucauuuccauuagauauuacuuuucagauagugagcagaauugaaaauguuuuuuaaaaaggguuuacugaaugauuuaaagguggccuuaauucuguauaugugugguugugugcaugugggugugugcacaggugucuguguggccuaauuuguuuuuguuuugggauuuuuauuuauuuuuauguguaugaguguuuggcugaguuucuaucuggggaccauaugcauauaguuagugcccauugagaccagcagaaggcgucugguuuucuaggacuacaguauaguagugaacuguggugugggugcuggguacuuauugaaccuggguccucuggaagaacagcuggugcucauuaccacugagccaucucuucagccuguggccucaauucuugauauuaguaaaaagagcaaauuaaaacaaaaaaaauuauuauuauucuauuaaaggaugaguuuuacauuauugggaagcaacagaauuucacaauguaauacacacacacacacacacacacacacacacacacacacacacgaguauauuaaauuguuuagaagugcauacuuaacugugucagcuauagucuuagccugcugauaugguguacugguugcuguacacgccauguaaccagaauuccagcccuuagaaccaacauuaaaaacugaaggagagaacugacugaaaauauugacucugggcuguuucuugggcuggaaagauagcucccauagcuaagagugcguccuguucuuccagaggaccaaagucaguucucagcacccaccuuguaccucuaguuucagaccauccaaugcccucuguaggccucuauggguaccucacacaucugguguacgugugcgugcacgcgcacacacacacacacacacacacacaagcauguauuguuaaaacagaaaacaacuuguccauaagaauugguuugguuggguugaauagagaugggagguaauuuuucauugucuuagauuuaauaucaccuuaauauucagcaguuauauugcaaggaaauuuguuuucuagucuaccuacuuaauuaacauucauauuugaccuuugugaauaguauaauauuuaguacagugcuuaaaguuuucuuuuucuuauaggcaauaucaagauuuucuugaagaucuugaagaagaugaggcaauuagaaaacaugucaacauuuacagagguugguguucuaggaggauuguagucauggagauaguaucagggaggguauuugguguuuuaaaacuuuggggaggguauuugguguuuuaaaacuuugguuuucauaagugacuuuauuugucuuguagacuauuauaauuaggcuuuuacauaacggauaauaaggagcaguaaaauuuauuaaauguucucauauacauaugaugcaguuguuucugaacgauucuuuagugguugcucuacuucuaauuugcucauuuauucaguauuugaaaacuuacuguagauaagagcugcgagcuucuacuacagccugauugcucaguagugauggugguaggaguuguuguuugugcauuuccauauuuguauaugggacugauuaaugccugcuuccuuagaugcaaccaucccuguggaaagugacacagaugaugaaggagcaccucgaauuagucuggcugagaugcuugaagaccuucauauuucucaagaugccacuggugaagaaggugcaucaaugaugucaugaugagucauauuauauguugcuugcauaucuguggccucaggaaguuggcaaaaaccuuuauuguacaguacauauauucccuuauauuuuaaaagaaauuugaccuuaaacuuuaauaaauuacuauuuuaauuguucccuuaaaguguugugaagguuucauaauuugauugauagauaaugagagauuagaugggauguaauuguaacugauauuuuggccaccucacaugugcaguuuuauuggcuugaguuuuaauacaggaggcacuguaguauuuuuacuacuauaguacuggauugagaugacuaaaaguugggauuuuuaaaaguauuaaccaaauauuggagcauaaauuaaccucuuacauugguuuuauauugauugaucuaugaacauauaaaaauauguaugaaucacuuuugauauaaacuauuguauuuugguacacuuuagaucacuuuuauauccugggguaggaaaaugaagguucaguuucagacaaugaaucagacaauugggaagcucaucuuuuuauuucuacacagaauuuguaucuuuaucuuucuuccccccuuucugagauuuaacugaaggccugugccauauuugguguucuaugauugagcuauagcuuuauuuagcuuugcaaaaaaaaaaaaaaaauuaacugaggguuauuuuuuauuucguuagaaugaaauauauuuaaaauguauagauauuuagggaauacuuacuaauuuuauagguuaaguaacuauuuuuuuauucuaccuugggcagcagcuuagggugauagcuuccuuauuaauuauaaaaugucuggcacuuguaucagaaauacagcuuuuaaauuuuggauuucaaguugggaaggaagacuuuucaguaaguuuuugccauugaacauaacucaucuucaucagcaagaaugugauuguagaugauggaauaggaaaaucuuuuaugagacuuaguguagagccuuccauggucugaaagaagaguguuggccuggauguaaacaauuugaaagugaaguuuuaucuuguuucuauaagcaacaucagauuuguuaaacacaccauagugaaugucuuuacuuagucucuacauaccacuggagauggaaacuagugcucaggucuuaagauucaacuaccaaaguuuugcaauuaagaauaaaggcccagacau

SEQ ID NO: 1457 - RNA, 630 nt, Mus musculus
cucauuugccuuucugggcuuugaucuuccgcagauagaacuccagcuccuugccuucgagcacauagcggucugcucugccacacuggccuggucuugaggcaacgcaggcgagaagcucgcccugcuggaacugcuucuccaggaggcugcugauuuuggcauucuuuuuccuuucguuguauuucuuuugaauuuucuuugaucgcuuuuguuuaaaaucucuuccucuucaggagucagcuuggcccccuucuuguggcccaggggcagugcauagugggaaucaaaccauugucaguauggcgugcugucaauaagcaagaugaaguucuucaccaaggucuuggugcagacaagcucguuguuggaugcauuguagacaacaucauugauccuuguuuuaugaguacaacacucagagccccaggaaaauuuccccacauccaaucucagggcacgguacuucuuauugccuccucgaacucagacuguguguguauucggugagggccaaucuucguguuggcagcaggccaucccagcucauacuucugugucuuaugguaggguuuucgcuuacccccggucuuguggcgcuugugccagcugucccgagacaugcccauu

SEQ ID NO: 1458 - RNA, 40369 nt, Mus musculus
ugcgcgacuccugcugggcaggauuccggacaacgccugguuccuuucggguccuuccggcgucgccggagugaauugauccgggaguugaagagggcuccaaaggugggaagugaaguccgugccucaguugccgguaaggcgagguuucucgguucggguccgcacggcuccgugggcagccagagcggccuggggucaggcggggaccgaggcggaggugcugaggcuaggcucuggccggcggggcggacggguggggagccgggccuugugggcgucagcgaggucucuacgcgagcugcggaaagcuggguuuguaaaugccuccugcccagcccggcccggcgccuccaggaaguccgcuguggguuuggguggaggggaagggugaggucggccucccgggucuccacugaccgagggggcggaugugguggggugaggucccgggcaggugaggcuaaagcuuggcuaggccuggagggagcgugggugcccgggagucgccucccgguguggcugggguuaugcccuuugagggaagaagagagacaguguugacaguuccgacucaguuccaauuuccucucugaggaggugauucuuaacucggaagguuugugccucuugacuccaauacgucagauggauguauacuucucaagugcccucgaagcgcuuucacuuugggaugcuaaugagacuacuguagaagcaaaugacgugcccaaggucacacagaucuucagagucuaguccuccgaaaguccaguuucugaccagaguugucggcuuaggaagaaagaguggggaggugggugguaguacuggaagcagauagaagaaguugcaaaguagugugccuguuugucagaaacgguugugaggugcagagaguugguuuguugacguggaguggaagcuuugccaaagcauccucucuaauguucuguaaaacaggaaggaucgcuuuagcuuagaucuuuaccccuuuuucuggggucuacugaaugauaacacucacuuuccacacgccauuuuuaaaggauagauaauauuuaggaauagcucaguguugccauuaagagaauaguccuuuucauuucuauuuucuuaccauuuucaaaaacuaugggugaaacuuucacagaacuuacuuuacagauauucaugcuuucauuaagugaaaauuaagugcagaaucuuggagaaauuguaccauguucauuacaagaagugacccuuugggggggggggucagguuuuuacuuuucucucauuuucuucacuccauguguagacaguaaaacauacacuuguauauuuucuuuucuuggcaucaucagugaguuuuaauucauucuuauuuaauguuaaugaaugauaaaaaugaugcuucuauauugaauggaaagaacugcaggcuuacuauguaaauuaaaauauaaauacauaguauguacuguaaguauauaugcuauauauugaaugugcuuugcuugccaugauuaauauuaauuuuuuuuuaaugcaaagcuguuucugggaucagaagaaccagucaaaauggucuuguuugaaggggacuuuuaaagaaaauggagaguugugguaccauaaaaugaagcaaaaucaggaauaauguaacaccacacgucacaguaagggaaaagucacuaacaaaagggaaauuaucugggauuaauugguuuugaaguggaguuugaagugcauuaauuugagugggccauauguaagucagugcugguaaagcaagaaugcuaauauauuuucuagaugacaguguggacauuuguuguuugcugggaaagguaugaaauaaguuuuaaguggcacacagcuguguugguuauggaaggacuuuuuuaacaacaaaaaaaguuuugucuuugauuuaguccuacuccaacucugucuguaucucugaggcccaucauacuguccuguuucaucgucacuacaguguaagugcugagaugaacagugagaugaacagagaagaugauuuugaacauccuucaggcucuagcuagagcucacagaucggauguuugccuguagugugcagcucucuuugcccacauuuguucccuuaaagagcuuugcaucaacucucagacacuauccauugcaggacuuuggagguuuuccuuaaagagccaucucucucuuaaagaguagucuguaagaacagggucuauauauuauuuaucuuuuuagucuugguagaauaauugaguggcuaaggggaauggaaaaggaauggcuaggugacuuucccaaggucauaugaccuggaaaagaucagcuuauaauuaauccauguauuuucacuauagguuuuaauauuguguucaaacuucgauuauuuuauguaagaaaaagacugaccauuacagaugucacuaucuccuuauucuguuuaaugcuacuaauuuguccucaauuuccugaaugucuccaaacuuauucucagcugucaccuuuuuuucucauauaaguuucuuccugauuuggggacaauuuuacaaauuccaacuuuccaccugucuaguauaagggaguuuuauuuucuuuuacagcaaaacuucuguguaacuuagcauuuuagaaaaccuugcuacugccuuuuuaaaaagcaaauaagauucauuauaacaaaauauagauauggaagaagguuuuuauggacucuauucuucccuuagauuuuaacuucaaaacaauuauuucacuuaccuuguagcuaaggacaccaaaacuagaaguaaauuuacuccuugggacucagaagaauacaaugcauugcuaaagucuuggaaggacuagagccaagauuugaguauaaaccucuccuauguuuguuuguuuuaguugguugguugugguuauacccaggauuuaauacaaccuugagagaagaugauuuugggaaacuaacuuucuaauuucagaggaacuuauauuuugcacuucuuguaaguuauauuugaagcagggcagugguaggguaugccuucaauucuggcacuucagaggcauaagcaaguauaucucugaguucgagaccagccugguguauauagagugaguuccaggacagccagggcuacacagagaaacacugucuugaaaaacguuauaauugagggauuuaagguaauauuuuacuuuuuugaacauaugacacuucuaagauuaaaaauguuuuuaaguuugcaaacaaaauuuuaaggauauaaaaggcuagauuuucucuagaagacaaaauucuguaauuuuucucaguagcauacuaauauaauaaaccagaguagauucccacucuuccccauauaauugacacuuacauacuauugacacuuuucacaguaggagcuuauuauuucuauacugauuuaacaauguuuuaacaucucacuaaacauuaucggagcaaggccuucucacuucuucuaucuuagcucugagcuauguauguagccuuuacucaucuguuuucuuaccaguacacuucccaguagaggauuguguuugcuuucaguuuugaugaugugguaagguuuauuauuaaccaugguuuuugcuaaauucuaagcuuacuugguacuuuuuggaugauagucugaauauuauuugaaucuucaauaacaacuuaauauuuaccuuacauaaugcaguuugcaggagauuaagcaauuauuuauguguugauagaguauuaggguuauuacaauaggugguauuacuaagaauuuuaagcuaguauauaaauuuucuucugaaauauauagaagaugguauaauuuuauacuucauugcauuuaaaauacuguguguuucagacuuagggcaguagaauauuuauacacauucauaaaaauaaaauuuaaaguacuucuauuaaggcaauuagaauuaauuuauuugcugcaauugaaaugaauuucauaauuaaauuuuauauaaacauaggcauuuuauuuaagcuacaaaacacaccuuggcuggcaucacaauauuagccuuauuuuucaaggccaccuuuacauuuggaguaugggaagccauuuuuucgaaacuacccaaaagugauuugaacuuauuuaaucuccuauuacaguugcuuggaaucugguguuacuguaggaaugaaagagagcacaaggauuguuauaaucauuaguuuauacugaauuauugggcaugcacuggaaauuaaccucccuuuccucagucagaauggucccuugaaaacccauaggaaugauccuuugauucauccaccuaugaauuaguugaguguguuuuacgugugagauuguguacuuuggaaugaucuagaauggccauugcauagaccaagcauuucacaugugcaccuacaauccuugcaaccaccauaggagguucuauuaucccuaauuugugaacaaggaagauaagauguagagagauuaaguuacuugcucaagaucacaaaacucauacuugcuuggaauuagcaguuuaguucaggcuggcucccuggagauugcaggcuuuuagucauuucaauaaaaugguguucauggucaaagacuggcuuguagcauuagaguugcaguuacagacaauuugucccccaaaugucaaggucauuggggcacaauuauuguuauuuaauaagaggcuuaaacuuaaaaucuauugggaaguucacacagcagaaaugacagaccacuucuauguuacgugcaaauuuucuggaucagugaaauagauuauuuucaauuggugguuuaaguguucgauuuccucuucagauacuguuggaaauuaucuauaaccugguauuauaugucauaauuccucacucaaaauuaguacugggagcuguucaaauugaggaucuaugacugaguuugacaggggaauagcaggccauuuucuuaugacagucugguacagacuuguauacuaggaaacuugugaccacuggucuucuuaaaguagguguggcucacuggaagcaggagugcuccugucuggucuucggugacuguuccugcaguuccacucacuuucaaaggcuuggauugacugacuucacuggauugucagcuacacuauugcugauuagacuaugcagaguucagugacagguacuagaaaucgaaaaauggauaaaucuuuuagggaauuuaaacuucaggagguagagggaaagggggauaugaagaucauuucuuugguacuuagacauuuuauauccagcacuuuguacaaauuuuuguuggauaauuagaacccauagaugauauagagguagaaaacaugguuucucuaacuugccaucuggcucuuggcacuuaaauggcucuuucugucuuauucagccauucugucuuaauuuggaugaccuggaauccagcugucauuggacugaaggaaugacaaaacccuaaaauguucuacccuugcugcucucucauacuuauguaagguuauacaacaaaagguucuugaaaauguuaaaugagucagaccuggccucuaggcagcaauggcucucuuuggcacuuuaaauuguugcaagauuuucuuaauuuaauuccaaaagauuuugaguaauacugugccuuuuauauuaaaaaauacacauggucugaaggaugccuuuauucaugcuaaaauugauacuuugauaguauugagauuuuguagguguucuuagaaaugaauuaacaguuuuacaaagugaagguuacagaagggacucuaaauacuauauagauagccuuacaacuaagaccauuuguauuugugaucaguuaggaguaaaagguaaaguuuaaugacaucauugagugagaacuuuaggaucauuuggcaccuuguguuuaauaagagagccaggggcaauuuguuauuugcugcuauagauucuaucaacauuuagaguacacauaacauugcugugauguaaaacaucaaguaaggaacaauguuuuuguuuugaaccuuaccuauucuggagguuuuaaaugaaaggguauaggaugagggauuugggacacaccaaguagauaugguccagaguggucuuguaaguuuagagaacagaagcguguucugaagagcuuauuuacuugaacuucuaagauaauuaaaaagaaaaaagucuuacuuuuauauugaugaaauuaaaaggagagugcacagaugcuaaucaaaaagaaaacugccauggucuucaauuaaacacuaagugaauauugaguuaggcacuuaauuuaugugaacuuuauagccagaagagcauguucaagaggucaaguuauuuauuuuuguuuauauuugaguucuguuuagucaguaggguaagaaauaaaaagaauugccauaagaaauuugcauuauucccuaaaccagugauuuuuuucaaauacuguagaagcuauuugcuguuuuaccuuauucccauuucccgucacccagcugauaacgaguucugugugucagcuuuggaucacucuagauuuuuaccuuuucuauauuguuacucagucuuugauuaugucuugauuuucuagugcuacccaaccugcuuauaggacacagcuuccuuuauuaagcugaccaguguuuauuaagaaaguaaauguagguuguguaaauuuuauuuauuuucguuuauguacauggauauuuucccuguguauaucugugcccuauguuuucagugcccagagaggccagaagucauuguuuguuagccaccauguaggugcuguugaauugaacccauguucuucagaagagcagccggugcucuuaaacagugagguaucuguucagccccgaaaauaauacuuuuagugauuugcuuuaaauagucuuaaaguucauuugaugaccaaacucuuuguaucuccaaacugagaguaauuaauuaccugugaauaacaugaauuuugauggccaaaguaacuuuggccuuccuuuuggcaagugagagagaaaguuuugaaaauggucugugugacuacuaugacauugugauaaucagcauucgauccuugcugugcuauguauaggcagaaugaagaugaggcaagaaaggccucugcagguggcagaauugaaggagacacuaauucaccauguccugcaagucagaguuuguauucuccucugauuugacucacccuccuuucaaccucaagccacgccaggcccacagagcucugcugaaauagcucuaaccgugugaauuagaugcuuauugaaggucagcuacuucauuaaguauuuuaaauauacuuaguacuccuaacaacccuguaaggugaaaauuucaaucagcauucauucauucucaaaugaguuuagaaaguuaucaaauaauuuaaaccauauaacccagugugcaaaaaaaaaaaaaaaucaaacuauaucuuucuaccaaauauaaggguuuaucgccuauauauuguagaaaaaauacuuccagucacuucauagauuugcaauuuccccaaaacauguauacauuugacauaguaauugacuuuaaggugagucagauguaccaaauuaaaaacccacaaagucaaaucuaccuacauuccugccuucuugggucuccuaacaguuuuauaggaggucacagcagcucuugccuguguucacguugaggcggcacaaaggcugaggcggguuaacauagcauuucaguuuguaaacacuaaauacaauaagccuuggaagcacuauauuuggcucacacaucagcuaccauucuguuucugaauugugaaaguuaaugacuggacuugauaucuauaaugacaaguuuucaauuucaaguuucagcauuuuagcaguuaacuuucuuuuuuuuuuucauacaaacuuuuuuuauuagauauuuucuuuauuuacauuucaaauguuauucccuuuccugguuucaacucugaaagccuccauuuucuccccccuuccccuucucaccagcccacccacuccugcuuccuggcccuggcccuacauuggggcauagaaccuucacaggaccaaaggccucuccucccauugaugaucaacaaggucauccucugcuacauaugcaacuggagccaugucccaccauguguacucuuugguuggugguuuagucccugggagcucugcggguacugguugguucauauuuuguuccuccuaugggguugcaaaccccuucagccccuuggguccuagcaguuaacuuucuuaagugcauuaacaucuauagcaaggagagauacuagcuagagauugaaaucugguauugaguuauagaaaaguuugugucugaauauccuauguuuucuuaaccuauuaggcugcucauuuauguuuuguuuauaaagcuauguuagugacuguucaagaagagaucuaguugugucagggcuuuugugagagagaaggacuacagguuuuaaaugcuuaauuuauuaaaggaaagaauaguuuaauauuuuauuucucacacacucuugucucugucccucucucucucaaacacacacacacacacagacagacacacacacacacagggagagagagguagggagguuuuauuuggaaaaggaaguuuugcucuccuaaauagguuucaaaccauuauuuuuaccagcauuccuguucucaggguccuugauacccuggagaguuggcugugaaggcugcccaauuucagcccaaauuggaugcacauuucuccacuugaucauaauaguuaauauuaauuacuaugccccauauguuguccuaucaguaauaauaaacuguauuuucacagcaaaccuagaaguugguugcuguuagcauuuauagagauaacuauuguucuugagugucgaugcucagaauguccccaagaauaucugcggaacuccuggcacuguuguccugcagacaauauuaauuuggauaucucauaacuuuccuuuucuauagcaaaauaccugagauaaacaacuuggcuguaguccauggucgcuugaccccagugcuuuggaaguagaacccaucaggguaggaauaaaaucacucaccacaaaaggaaaaggcuuaagauuuuaaaauauugaaggcuauaauaccuuucaucaaagguuuuuggaccaguuccacuuauuaaaguuucuaccuacuccuaauauaacuucuuuggaaacaaaaccuucaacuuauaagggucuggaacacagaguaagcccugagguggcauuggcauucuauucuccugguacaaacggucacuuuuuuuuucuuuuucuuuccuuuuuuuuuuuuuuuuucuuuuuugaguaaauuacugcuauccuagcuaacacccucuggcaucuuuacacaugcuccuuuugggggacuaggcuagaaaauuuucaaauuuucauucuguuccuuuugcuuaugauugucauucuaaaguuuucccacugguaauaucuauuauauuauuacaucaccuuugaacuugcacugcugcccugagauuuuuucuuuccagauaagcuugcccauucauacuuaaaacuugguucuccucaaaguaccagagaguagacaaaugaauugccugcaauccccgaauucugugacaauugccaguauagucuucauuuccauugugacccucagccugacuuccuuuaugcguccuuguuuucgggggugacauaaucauccuuuacauuacuuacauucuuccacuuuauauaacacucgcgcccaccugcuucugaauuuucucaagcucuuuuugcaaaacccauccccaaaucccaaagacuccuccacauuguuucauaaauaguuauugucaacaacuccaugucuggguacuaauucuccaugguagcuuuguuuuacuauaacacaauacucaauuugcaaagagaaaacggguuauuuggcacacaagugucaguaaaugugguucaacccagaaugcucuucagauuuugauuaaauagacuggacuuuucagugaaaugagaugccacuaugacaugccuggcuuucuggaaaagauauuuaaaguucaaugcuuaauacagaacuguuagaguuuuguuuauaaaauaacuuauuuuuagcucaguuucuuuauagugccuacuuaucuaacuuaaagaaucuaauugguagaggugagaugacuuguucacacacaacauaauuuaacauauaacagauuugaggcccauguugcagacuuuacuucacuuucucccauagcuuucaauacaaacuauuugaucuuacuaaggauauauguaugcauauacauaaacacacauuauaguguaguaccaagggacuauauauuccuugcuacuagcaagguacuugcuuguuucuaaaugcagcauuccauaagcuugguaauauaaguauauuuugaagaauugaagcuuguuuuuuuaucuaagaagaauuuccugcuuacaauauuccuccagucuuccuuuuuucacaccuuuuaggaaauuuuagcucuucaguggcuguaucauuuugauauacccuaaaaggugugaggaucuuggaacaaauuagagcauucuccuuuaugaaauggcuguauuguagucuggacaguuuuggguaugaggcuagcaagcuaguuuuucuauagguguaaccagugagauccuugauaauuaugaagagaaaacaaaauggccauucagaacuuccagacaaacagcucuuggggaaaaccucuaugcuagaguuguaaauaauuuucaugaucuguugaggguauuuauuuucuguaguagauaccauacuggaaauguuagaaugguagcauacugaguacugagaaaggauguaguaucaccuccugucuguuucuggugggaaacugugauaacuagaacuccauaaagcaugcuacacacucuuuccaacacuucaucugacaucauuuugccuguauccugcccauaagcggcuggaucuucucuucucuugucuuccuccuccuccucuuccuccuccuccuccuccuccuccuccuccuuuuccuccccccacaccuccucccccuccuccucuuccuccuucuucaucuucaucuucucuucucccccucuucccccuccuccuccuccucccccuccuuuuucuucuucuucuucuuuucuuccuccuccuccuccuccucccccccuuucuucuucucucuccccccccucuccucucucucucucuccucucucucucuccucucucucucucucaucauagcagugauucauaggcucccguccucaugagacucaucuggguuaucuguugagaauagguaccuggauuuugaaugaguagucuuaggaaucaauguugcuaauaagcucugaaauaguuagugaugguucagaucucccaccucaaagagaaagauuuacugccugcuaaaaguauauuggcccccuuuuucuuugaauguaaagcaaaauuaguguuggaaauucuuguacuuggagaaucuuguuaagcaugaaauguuucuggacauagaggugcauaccuuacccucaaaaggcauaggcaggcaacucuaugaguuagugauaagacugguguacauaaugagucucaggacagccaaggguacuuaaugagaccugucuuaaggaaaucaaauaaaauuuacacagaguuuaucuucagaaucucagcaaacauucuagggguuuaccauuuaguauuuaauuuuucuguuguguaaauaaauauugaaauuuugguuuugcuugcaauuuuuuuguuuuuugcuuuuauuuuauuucaggaugagaaauaagcagaaggauuuauaggguuacugucuuaauguaauaggaagaacuugggauaacuaaaaugaaaguuaaaaacugguaaauaggacuaagaauagaauauaauuggauuaacuuauuauguuuuauuuuacuaagcuugguacuuaaaaauuauuagcaaggcugaacuuaaaaaaaugucuacuuacauuuuuuauuauggggaaaagaaaugcauaugaauuggaauauaacacauggacucuguaccaugcuauuguaaagugcauuuuguuguauguuuguuuguuuggucuggcuugguuuggauuuuacuaaauaaugaaaauguagaaguuacuuaggaaucccuuuucaccaaagaaccacauuuaguccaguuccaagaauuugugcugucuuuucccuuuguucauuguuaauacuaguggcucuaguuaucucucaggucccagauggaguaaagugagccuguuucaggaaacccugagauacuguagcuuuuuacaugaaaaggcuggaguuggucauguagggcaggaacccuaaacacugaacuugguaguagaaguggcccacaaucaauuuuaugccuauucauuaugaacaagugguaauuauuuuaaacucguauuucauauuucaagcuaguuuuucuuacaucagaaucaaugguacuauuuugauuauucuggaaaauaaggggaacauuuaugagaagguucaauuuguauuggaaucuuacuucauaacauuugcuuauuucuuaacaaaaaguuaagacuaucauuugaaaaauaacuuaacauuuacaguccucggcaguuuuuguuguucuuguuauuuauuuauucuguggauguauagcaauacaccuacaaagcucaccuugaacugaagaguuuccucugaagcagcacaauaaacagaaaaacauaaaccauuccugauagguucauacuguaucaacauuacugguguguguguguguguguguguguguguguguccgucuguccguccguccugaggucagguuuggauguuuuucuucuggagcauccauccacugugcuuuuuaaacagugucucucgguaggugguggagcuugguuacuaacugggcuaggcuagacugggcuggccaaugaaccaaaggaaacuggcugucugcauuuuccccucucuagaaucacacauguacuuucacccucaugucuaucuuuuauauugguggugggaauugaagucaaguacaugguggaaguacuuugcugacuaagcuaacuugcauuuaacaaugauccucucuguuacuaaauccaauuggucuucaaguucugucucugguccuauuuugcuguuggaucauggauucuuacuauuuugucuaaucuuuucccaaauucuguaguuugcauuuucacuauuauugcuuaucagccuucuugauuucaaguuugcuuuguauaguuguuguuggguuuuuuguuugucuuuuuuuuuuuuuguuuugggggggacgggguuguaacuaaguaauacuagcuuuguagcacagauggcccucuaacuggcaaacuugccuuucuucccuuagugcugggauuagaagugugugccagcauaaaaguagaucaccuagaagcauauuaaauacuuauauuggaacaggaaaacuguagugcuuuuauugacaaagcaauauucguaaaucuaccauagacuguuauguuagugguuuucucuugcuuuguauuauaaaguuuaaggauugguuuuggugguccucuguaaagguggggagcaaaguuuagcucagcaaaaggaaggauuuuucuuucuuuucuauuuuuaaaagucacccaaaccaggacucagcuguuggcagauacugagccgcugucaaucagaagggugcaguagaacacugagcagucagccuugacagggaggcggagcuuuugaagcagcccucuagcucugugugguucucacaauauaguucuucaagugaaguuuacuucuucaaaacaaucuuguauagauaccgcuaaaugacugauggacaucuuguuucuauagcuacugaauguucauuuguccagggaacacugagcuccugggcuccuugaguagguggggauagaaaggguguuccuuaguuuuccauucaagagguauuugugcuguguaaaauacuggaguuugcaucugaaaucaaaucuugggccucugcacggacucuuucagaccuuacuucuguauuuguaaaauugaaaugguagcuacuauaugaaaaauguuuuauaaugcagaaauccuuucuucaguaagaauuguucagaguuaaaagcuuuuucuuaaauacauuuguaauuacuagcaguuuaugauuuaauuuauuguucagccuucuuuaaguauacauaccuuuuuaaaacuuuuuauuguuuuccacaggccuuauuauacuuagcauccccuuaacucacuuucaagaacuggaguguauuguugaauucuugauuuuuaauuccuaacuacguucaaagaaggaguacaauguaugcuauuuccauacaaauugcauuuccuauuauuuuaucaauguuaagacuugccucagaucucuggugcugcuguuuuuguuguuauuuucaggugcuaaaaaccaguggacaaguagccaaaaaaguuuuaaaaaacaacgcaacacuuuuuaaaaauuuuuuuauuauauauuuucuucauuuacauuucaaaugcuauccugaaaguccccuauacccuccccccacccugcuccccaacccacccacuccggcuuccuggcccuggcauucuccuguacuggggcauaucaucuucacaagaccaagggccuuuccucccaaugauggccgacuagggcaucuucugcuacauaugcagcuagagacacgagcucggggguacuaguuaguucauauuguuguaccuccuauaggauugcagaucccuucagcuccuuggguacuuucucuagcuccucuauugggggcccuauguuccauccaauagaugacugugagccacuucuguauuugccaggcacuggcauagccucacaagagacagcuauaucagggaccugucagcaaaaucuugcuggcauacgcaauaguacaacgcaacacuuaauucuuuguuuuacccuuuuaauuuagcucuccauauuucauuauuauuauuuuacauaugagucauucaugaauauaagcauggcuguuguugguagauuucaugauuauacaucaugcaagugaguacauaauuuuucaugguguuuuauggaaaacucacugcauccacgugaaguagguuuuggauacacugccuuggaaauaggacuuauuagcuggguuaaaaugagguuuuucuuucgucuaaaagaagaggaaaauaaucucccugacuaggguuguuuucaaacggaaagugugguaucaaauuagcuucuggguauaauagcuagcaauucucuaauuuugauaagacaguuucuagaauuugugguuucccuuuacuguaaguuacuuuuucuccuuucagauugcuguucuucuuuguguaccagucuuuaucacauacacauaaaaaagggaagaaauucggcagugaaugaagauuccucugcauuuuagcauugcuuuuucuacuguaguuggcuuuugaaugaggaugacaauggaagagaugaagaaugaagcugagaccacuuccaugguuucuaugccucucuaugcagucauguauccuguguuuaaugaggugaguguacauuuaagauugcugcaauuccuuaaugucugccacucuucuuccacaugacagacauauauaugaacugaaaccccuguguuggcuauugggucuaauccauccaugcaguugaagaaauaaaaguaaauagauguguuagucuuaguggaagagauagaugguaccuauaaguuucuaaauccaacauuucuaguaaguacuaucaagcaagaaaaaaagagagagaaauagguagauggucucuauuuuaggguucagaaaaggccucacuaaaggagauauguagaaguccaaaaggacaaaugagaggagaaacaaguacaugauagguagaauggcaggcacaaaggucauagugacaaagucauguuuaaaaauggauuucugggaugcuguugcauugugucuaaagaagucauggaagcuuuuuuauuuaaggaauugucuugaacgccgcacaguuacauuucugguuuaaauuaauauacuaauaucugaagaaaauuuuagaucugcaagucccuuaguuaauuaauuccuucccuguagucaugaauggcgaccuugaauagugaaaguauuuuacuaacagaaagaagacuaacauuuacaguuuguguccugucucuaaagacauuggcuuuagcuaaaaaaaaagaaaaagaaauguaauuuuuuuuuuuuuuuuuuuuugcuacaugacaaaauuuuuuuuaaaugaccaaucuuauuguuucuaagauagcuggaagccguaacaaaaaugccagugcaguuuuagaguguuauuuuuagacucaaauccauuuucccucacauuauugggguugaugcacuugauauuuuaugagccuaaacuuggagugaguagagaaugauuucuuuauccuuuuugauauaccaugcauauauuagaguuauaaaugcuacaaaauacugucagauugagaguccuugugggagaauucaaaaggauaguauaaguaaaaguuuuugucuccauuccauaaaagauucuggaggcagaggauuuaaggcuaguaauauuaugaguuaguaucaucagaaauucaucuuuuguuuuaacaugcacaacuacaaccaaauuccaucauguacuaaaggaugaaaaaugcaauaaggugugaaaucuuguuucaucauguccagaagggaaaaaaaaugaaguaaguuguggagucuuguuuucaacggagucuaauuacuuaauguaaccuuuaccccuuuaccaaaaagaagcccuacacaggacauccaugcacacuauuuuuaagaacuuacccuuaugaccaaaccuaacugcacaagagguuagaaaauccaggaauguuugcuuaccgaggagaaagccucucuugucaaacuugucccuguggucgucuccucuggggcagcucucaacaagcugauaauuagauccaccuuuuuuguugugauacuucauuucaaguagcuauuauuagaaggcaguacuuccuugugguaaauaccaaguguuuauuugcuuaguacucagcugggccaugaguuuaagagaaaacaagcaauggaccuguucucaagaauccacuaggaacagagcuauuuaaagauauguaauuaacuuugugccaggagugagaagagaagacaucccuuaaauuagauaagcaacuugaguuugcaguaguuaggauuugaacuucuuacguaguccauaaaucguuuucauaauuucgcccacggguacucugucuuuuagguccgugcauccagcuuagugucacuacacagaguguuggauuggggagaaauuucaguuuagucggcuagguugagucuugauuugagaagaggcaaauucauuuauacagcauuaguuuuaucuuccaguuaguaaagagaaaugaacgaaggcuagcaacacaggccaacuuauuucuguguaugaaggaucgcuauuugcaucuagacuuugaugugaaaauaagggguuuguauuaaaugaacuauugggauuaauuuugaugaaaauuuacucauugaggaaaauuacuuauuuuacucauacguaagagaaauuuacuuccaagaaaaagaaggggcugugaauaggcugaugaaucucuucuacauaaguaaagauggugcuguuuucccaguuagaucugaacacacauguggcuucgugggcauagacaugugauucagcauuaucuaggagcuaauuuuuaagaguaagguuugaaaaugaaggggcugacuggcaaaugggacauugcuacagcacauuagugaggucugucuaggggucaguuugcuggccuaacuuuguaguguacuuuuuaaaaacguacuuuugaauacaagauaguauucaaaaacaugcucuaaacucuuauuuuaggaauggcaaugauacuuaaauucccucuuaacagaugacaucuagaauuggauggaggaauacaauagaaguguuggcccuucauguauaaaguuuuagguuaaagaugauauauugacugcuauuuuuagcaauaugcuuguuaaaaaauauucacauuaucuuuuagcauuuugguauuuuaauauaauuaaauuaaaauuaacuauaauuaaauagugaauuaaauucauaguuaacuauaguucaacuaugaauuuuccuuauggguacuagugagaaaauuauaauuuaucuuuacuaaucuauacuguacagauuuggauaaaaauagucaaucagggacaaggcaagacuacccacuuucauucuauuuauugaauauaguacucgaaguucuagccagagcaguuacacaacaaaaggucaaagggauacaaaucggaaaguaggaagggaaggguaucacucuuugcucaugauaacauaguauauuuaagcgaccccaaaaauuccaccagggaacuccuacagcugauaaacaacuucagcaaagugacuggauauaaaauuaacucaaauccgccacccaaaaaaauaaacugagaaagaaauuagggaagcgaaaccuucacaauacucauaaauaauauaaaauaucuugguguggcuguaaccaagcaagucaaauaucuauaugacaagaacuucaauucucugaagaaagaaauuaaagaacaccucagaagauugaaaaaucuccuaugcucaucgauuggcaggauuaacauaguaaaaauggccaucuuaccaaaagcaaucuacagauucauuccaguccccauuaaaauuccaacugaauuauugacagagauagaaaaagcaauucucaaauugaucuggaauaacaaaacauccaggauaccuaaacuaaucucaauaauaaaagaacuucugggggaaucaccauuccugauaaaaauuacaugauauuaguauagagacagacagguagaucaguggaauagaacugaagacccagagauaauuccacacaccuauggccaccuuuucauugacacagaagccaaaaccauccaguggaaaaaugacagcauauucaacaaauggugcugguucaagugguagucagcauguagaagaaugcaaauugauccauucuuaucucuuuguacaaagcucaaguccaaguggaucaagaaccuccacagaaaaccacauacauugagucuaauagaagagaaagugggaaagcgccuagaacacaucagccuggggggaaaguuuccugaacagaauaccaauggcuuaggcucuaagaucaacaauugauaaaucgggccucauaaaauugcuaagcuucuuccugaagauccagccaaaccacuacuggucauauacccaaaagacgauccaacauauaacaaggacacaugcuccacuaugcuuauagcagccuuauuuauaauaaauagccagaagcuggaaacaacccagauguccuucgaaggaagaauggauacagaaaauguggugcauuuacacaauggaguacuacucagcuauuaaaaacaaugacuucaugaaauucuuaggcaaauggauggaacuagaaaauauccugagugagguaacccagacacaaaagaacucauuacugaugaguggaccuugaagaauucagacaaacuaaacacaaguccucaacaauuaguagauggaauuuuaccugaaguuucuuuauucugacaugaucaguuuggaguaugauuuaguuaaugcuaugcugcaaaauaggcauacuuuuuccucgguuuucauugcuaaaauuggaauaaauaauauuuaauucaacaaccaaugagaauaauuaaugcaauguauuuagaauaauccuagguauauguugcuauaauuauggaaaucuuacccaauauuuuugagaaaaauguagucagcauaagaauauuugcguacuugccaacaguguuuuagcagaugauuuuacagugcuuagguggcccuucuuaccugcuuugucauaguguuuaaaaaacacaggaacuuuccugaaacgagcacagauuuuucuguauagagcauagguuauggcauuguccuuucuguggcugcuaaugugccaacuuuuaaaucugauucaccauauucuuagacaauacaccuugagauuuuaguguugugauauggcccaguuuaguaggaucaauaguaggaucaauaaguuuggaggagguguaaggauggugucacuaugggaaaaccuaaucuugucuuauguugaggaggccaguagauuuguaugcaauuuagaacuaauuaacuuaauucuuuggaccuuaagaaaaaaaccuuucacaagaauauaugcaaaacuguugaaaacgugaacaaaggcugaacugauaucuuuuuucuuuuuuucaacuaaucaugaguuugacagcucaugugauauugaaaaauaugggaaugaacugaugcuucuaaagggauugaugcaauaagugagcuacugagaacuggaagugcauuuaaacuuuaaauguauuuuauuagugaaccugaauuauaaauuuggcauuacaguugauaauaguaaguauucaagaucuguccucaaaguuguagcacaaggagcuauagauccuauugguagacugugcgacugaauugagagacugaugcugccuuccuuagggauccuucagcuggcaauguugcuucgccucguagugaagauaucuuaagcacucuuuucucucauuuggaguuaccccuuccuuucaguagugacaugaaauguggcuacgacaaagcaaugccaaguuuugcuuuguuaucuagugaugcaaaauguagcucuaaucuucccucuuuaaaacgaaccaugugguguauaugcuaucaauugcuaguaaucuaauaauuuugaaacagaccaggguucuagccaacaacuauaaccccaacaguucacaugauuuuacucaguaauaaguauuggaaacaaaaaugcaguuuuuucuucuguuuuagacugacaugcaauugugugucacguguuaccaacucugaagaaauuaagugguagaacuuguaaagauaguuuuaagaagccaggccacuucaagaucaguuuagauacuaucuccuaaaaguaaacugaugauagucccacuuuucaccuuuucaaagucuuaauaaggacugaauaauuuuucaacauugacuucuuacacaugauagaacucaggggucuguuaauucuuauagauauucaacuccaguguggaaagugauaaaggcugcuuguguauaggccacacagccaagaugauggcaugaacucugucucaggacaaaguuggaaauuuguaucagccaguuuucuguauguaaaauuaugaaagguauauuaugaagauuagagacuauucuguagaaaaacacucgacaagcacuuaguugaugauuaaugaaauggcugcuguuguuagaauguucucagaacuucugucaggagagagaugauguagugaauacaguuuuguuauaucuucgucacaacugagaggcauaaaagaaguacuuuugucggcuagguaaaagucuuugcugccuaagugcagcagagugccucuagauauuugagacaaguuuugaugaguucauugagaugauaacuuacuucucugcaaacaagaggucugggcuugugugugccuggcuacuuuuggguauuggaaaccagaugaauaaggaaauauguuaaguucauugcagauaauaugguguacaguauacuccaaaauuacucccaacagagcucugcugaaguuuacagucuucugaucuacugagacuugucuaacugaccuuccuguggcuacuuucuuaguaagauagaaauacucaacuauagucuagaacuuggagacuucuguaccagcucuucccuugcuguucuggucucucuccuuuuacuugcauuucagugagggugcuacuuagucauuuauuaaugccagagcuagaagggacauaucugacucagaccuuuagcugaugaaaagcaggcaguaggguguaaacccaaguaucaugggcagucaguauggcaauauucauccuaucggucuagcccaacuuucauacauaccugagguuagaugaguugugcuauuacuuuaaccagcauucacuguaauuacaugaacuguguuguucacuauuacuguaaguuggcuuuacuagccucacauauaaaauaaaaaucauuauauuuaaccuuuuaaaauauuguacuuuuacauauaugaguguuuugggugcugcauguauguaaguguacuauguaugugugcaguuucugcagaggucagaaugaaguauuaaauccucuguuagagauagguaugagucaucauauggguccucuacaagaggagggugggugcgguuaucugcccugcuaucucugcagcaccuacgguuaauguuugcuuacuuagaggaguagaugacagacagaggcagcacugaaguucagaugacccaggcuuuaguuuaagggggcuuugcuuuguuuuguuuuguuuuguuuugucagcacuguuugcugaguggcaagaaaauuuugccaaagcuuaauccuugacugagaaauuagaguaauuaaacguaaguaaauaugagcagaauccaaauacauguuucccuucacccuuucagcauuacuuauauucacacagagaaccauaacuagggaaucagagcuguaaguuuauucuuaauccucauuauuuuuaugaauucaaguugauguguuuauuguuucuuagcacuuagaauuccaugucacauauuuauaucauguauucuguaucguaaaucuuacuuucggguaaaguacaucuuauuuuaaaaaaaauuuuuuuuacaggguugaguaagaauuuuaauuuuuugaagaguucugacuuauaacuauugacauuuuugcuuauuguuugauggauuuaucauuaauagagaacaaaacaucagaaauguuuuuccccaaaaaacgcuuauacuaaucauaacuuuaaacuucucauuguagcuagaacgaguaaauuugucugcagcucagacucugagagccgcuuucauuaaggugagguacauucacuucuuacacuuauuaaacuguuauacguaaaucuaaauaccaggugauuguuguuaguuuuagauuacuuagauauuacuuaugcuuuggucuauuauauaaagcuuugaauacuuauaaaaggcaaacaacagcaaaugguguuucagauggucucucuuagaugugcauuuuuuacauucuuuuuuaauuacuucuuaaaaacuuguuuuaaaguguaaauuaguuauacuucaaauaguuuaauauugagauauaaaaucuaccucauauaugacagacuaagguuaccuugagaauauaguuaagacuuuucaggugcauuccuuccuuguccuuagacagagcuguugagcuguuguucauuacuggugacuuguugagcucuaggaaguaggacuguucaaacaguccuguccugacgauacagguuuggugacauugcuuuaaaauuagcagaagcuagcuuaguauuauuucuuauacacuauaaaaacaauuucucuguacacaaccacuagagaagaauuuguucucaggguauauuucuguuguuuagcucuacucuagagacucaauguacauuuugagcauauuguuuuaaaauguuaccugcuuucucaacuaacauauauguuuguguggccccaaauuaauuuuuauuuacuuggaaauucucaucauuaauuaaaauaugucuuuuuuaagucaaaauauguuaauguuuaaauuaagaauacgcuuaaauuuuuuguagcuguuccuuuuagugauauucaaaaaacugguaaaacaauguauccuugaggaauuuucuuaugacauugacaaaaauagaguugugugacuaagacagaccugcguaucuggguuugcccgcggguacauuuaauauucacagcacuggaguuuuagugcuguuuugcuuuauuuguuuaucuacuacugagucuuaaaguuacacaagucugaccuugaacuucuaccuucaaaugacacuuuggucucagccuuccucguacuggaaacuguaggcauauacuauucugcuucauguucacaauauuucuuaauucaaaaaauggugaaaauuauuuaagaggagcaugaaucucauauuaaguagugauuuauuguuaacuaucaaagcuagguagaucucaaguaaaacuaaugaaagcuaugcaggaaaggugauucuguguuuuuaaauuuauuuuugagaaccuggagagagagcucaaagguuaaaagaacuuaauacucuucuagagaaccuaaauucaguuccuggcaccaccccaggaggcuuccaagcuucccuaacugcagcucuaggggacucuauaccucuagccuacucgaguaccuucacucacaugcacauaccuaccuguaaccacagaauuaaagaaaaugaaaaggaauuuuuaaaacuuucuuuuugaaaaugacaaagaacuuuugccaaacuacuuuuuuauacccauauuuccaguucuuuucuuauacaguggguuuuuuuuagucacaucguauauuauuugcagaaaaagaggauuaauaauuuucccaaaauaaauauaugucacaauuuuuuauuaagauauacauucugcuugauuagaaguacauuguccuucuuguccgcugcagacagguugugcuaucuccuacauugauaaucauuggcuaugaaacagcuuuuaugcugugggauguuuuucucuugcauuagagucuucacaaaaguugaguacccaucaaguuccugguugaaaucuuucaagugcagaaagcaucucugaucuaagagcagaauuucagacauauugauugaauuugagcuuuugaagauuuagccaggacuuuagcuagaagacacuaagacagugguuuucaaccuguagguugugacccuuuugaaugcccuucacagggucaccuaagaguauauugauacuacgauucauaacaguagcaaaauuccaguugugaaguagcaacgaaaaugauuucacgauuggggucaccacaacaugaggaacuguauuaaagggucgcagcauuaggaaggcugagaacaacugcacuaagacauaauaaccaaauauugugcccagccgcccugcaaaccuaguggacagugugaaguguuuuagaaaagugaguauugugauauuuaacaucuguuuacacuaugaacuucuuuugaaguaguuugugauuucaacauacuagauugaucugcauuccuuuaaaugaugucauaucuuuguggaacuacuaaaagcaauuaccacaaagagaaaaaaaucaaugugcagaaagaaaugagaauugugccaaucuacguccaguguuugagaaacuacagugcucaggaaaugcagacaucccauuaauacauuaauacauacauauauuaauacuagcagugagauaaaaugcuguccuuacuuguguacaaaguuuuggagguaacugaguuaguaggguguaccacuuugcuaagauauuuguacuaccuaaacuacuuaauaagcuucauuuggcucucugagcucugagaacuggcagaguucagggccucguugagacuucucauuuuccagugcugaccuuuugcugugccaaaucaaacuaguauuaaaaacuuugugugcagacuuugauuuaauucuuucagcacuuuaacuuaauuagcaagcuguuucuuugcaguuauuuccuguaaacaucaugcccccaagauaauucauuauguagguggauuuaaugcuucuuggacaaggaagauaaacaaguguuaugaaauaagcaucaaguaaaauuguuggcaguucaggaaacuaagacuauaauagagcauuuaaccauauuugaaucauuuuucuuuugagaguugccuuggcaaaacagaauuuaaaugcuucauuaaucauuuaucaaagugauaagcguagcauuacaaguacagugaucccaccauucacugagguacauguguuuauuuugugccuuuccccacuucaauucacaaccuccaagguauucuuacuugauaccucauacaaacaagaguauuuuaagaaagugaugaaacagaaaagagaaaaaaaaaacaaaaaacaaaaaaccggaucucagugacauuagaauggaacugcaaagucagagagauuaauuguguuugaaacuaaggaagcagagugucacugaaucaugauuggaaauuacaugauuauugggauaaaagaaaaagcauuauauagauuuaauuggcaggcauccuaaaagagacacacuuucaaugugauuuaaauucuuuuuuuucuaaugaaauaggcuaaauuacuaugaaaauguaaaauuugccuuuuuuaauuaaucuugguauggcuagguuuuaaugccuuaacauucaagaacccuaagaaauguacauuuauuuaccaugcuccauauuauuuaucaugcucuguauauagcuuuccaggguacuauauagagggccugugagaagguuccaugcaucagugcaauuaucaaauaaacccgaugugcaaaauccccugagcccaugcuaagauggagggagagaacugacuccccagagcugccuacucacuuacacuugcacaugugugcuugccuauggccaagcaacccauuuuacauacacacacacacacacacacacacacacacacacacaaacacauacacacacacacacagacacacacacaccaauaacaauaaaugaaaaucaguuuucaaugagugauacuuuaaaaacuauugaacaaaauauuuugcuauaaaccuaaaauaggcaaugggaauuauucuauagaaaaguagguaagggaauaaaucaauuuuauuuaaaaaugcaaaagcuacccuaguguuuuauuuugcauuuccuggcacuuaauucuaauacagcacaucuuccaaaaauacuugauaggaauuauuacugcccuuccuuaagaugaaauguuguauaugcuaaaaguucucaguguagucaugaaaagaguaauauauauaauaaagagauuuugucauaguuguuagguugauugaaagaggacauacuggagaggcaaaggaugcugggugcuucugugaguuugcacauaauaaaaacuucugaugcauaagcuaaacaaagcugauggcgccuuucuuagcaccugggucaacagugcuuucuuguccuuauaagugauuaaauucagaacaauuaaauuuuagcuuuaaaauguugaucacauuucuauguaucaaaacuagcgauuuuuuuucucaacagaaaaagauuagaaauguaaggguuuuuuuuuuuaaccuuuuauugauucuuuguggguuuugcaucaugugugccagucucacucaucuaugucauaucugccuuuguccuuaaaaccucaccccaaaauaaaaaacagacaaaaagcaaagcauagaaaauaugucauuguggaagcuguaguaugucacaaugcuuuccacgguauaucccucugucagaagccagagauccugaaccagacuauacucaucgcauguucuucuuccaggcugaaaaggaaaauccaggccucacacaagacaucauuaugaaaauauuagagaaaaaaaguguagaaguuaacuucaccgagucccuccuucguauggcagcugaugacguagaagguaucagaaagaagccuugugugcaguucuccguucuugagaagcccuuccuccagaccauucccauuggaccagacaguccuccccauuccuucaugcuucuagugccggcggugguuguuaccuguacgaaguagacaaggagacccuuuaacuuuucuguauuugccagacuuagugaugugauguauuugauacucuaugcuuuuaucuuuuuacccauuaauauaauguuuaacacauuucaauuucacuggaaguucugagaaauauucucuguugcauuugaaagaagugagccguuuguaaguugaugagcuuccuauuagucagccuggugguaagccuucuuaucuaccaggucugacugaaacuucuuuuuaaaaagccauucugugaucccaaccuauauguugggcucauauuggucuuuguuuuaaaaugaaauguuaagaauauacugaaaauuguaguaaguuugugguuauaauauagugaaccacaguauauuucacauuguagacauuuuaauauaaugagccauauuauauucaacacuauacaaguuuuaguaugaugaaccauaaaauacucuacacuauagggguuuaauauaaugaacuauagugcauucaguacuguaggaguuuaauauaaugauccauuguauagucaauacuaaaguuaaugaaauagacuuaauauauuccacauuauagggguuuuaacuuucugaacucaaaucucccuuuuacagauauauaaaugaccuccuucaugaauuuuguuauuuaagguuucaugggacaugaauauagaauguuaggacugaugaguuaguuaagccuccucuuuuuuugaucaauggauggguggaucuuauuaggcuuaaccauauaucucaaagauguguagucuuauucuguuuuacuucagagauaauuuuugcacuggaccaaguugaacuucguuucucuuuuugggcucaaugacuuuuuucccacucucuccuuccuuuggucagcauugagaguucuuagauuugaauuugucagagucacaugauauuuuuuuauuguguuucuguuuuaucagaguacaugauugagcggccagagccagaauuccaggaccuaaaugaaaaggcacgggcacuuaaacagauucucaguaagauuccugaugagaucaaugacagagugagguuucugcagacaaucaaguaagugaaguuuuuugauuuguuuaaaaacaagaaucauuaauuaauucaauuaaaauauuaguuuggaauaaaaucugaaaauuggaaaugucauggacuuugaauauaauggccucagaguacccugucuuuaggauguuuaaguggcaccaaugacguaguggacuaaacauaguaauguaaacaauaaauuaaacuuuauguggugguuugaaaagcucuggcccccaucgacucauucuuugaaugguuggcccauguguaguguagggaguagcacuuuuaggagauguggcccuguuagagucgguaagaccuuggaggaagaauucuuggguccuccaauaccaagucugccugcauaaugccauaccucccgccaugaugauaauaaacugaaccucugaaacuguaagccagccccaacuaaagguuugccuuuaugaccuugguauuguguccuuucacagcaacaaaacccccaagacacuauauaaacagauucuguaaauaaccuguauauuucagauaaaaauaaguguaggcacuauguugguagcaagaaaguuccaauguuguuuuuauuucaaaaauggcauaagucacuuuuauauagaugugaauggcauguuuugauauuuaccgaacugaacucuaaauuccugcuuuuggguuauagauuacauaauaagggcuaagaagcugauugguagccaaacagcaaaaguaguaguucuagagaacuaggucgcagacuuguggcccaucugucuuguuagguuuccaaugccaugauaaagacccugaccaaaaaugcagcuugagggggaggcuuauguauccuacgucacagucuauugaggaaagccaaggcaggagccugcacucaggcucugaagcagaggccauggaaaaaugcugcuuacugacuggcucaagcuuacuuuagauacuucaugacuaccuuuccaggaguacucccuccagcaucaaucauccaagaagaaaaugccccacagguucaccacagccaauccuauggcucauuugccauuuucucaauugagagacccuagcuugugucagguugacaaaaucaccagccuuugacguuuguacuagugguggagaaaauauuuucucgcuaagugucuaugguaauucucuucagccuccauagauagaaagcagcacaagcuggaauaauaauaucucuaauuaaugcaauguuuuggggaaaccauagguaaagauuucugggaagcauaguuuuauuagcauguuucuguggcauaggcuaaaauaaauuguguguuaccuugaaaccauaaaaaggaaccacauagaguaagugccagguuuguguucaggaauaaccuguuuaacuuugguuucaaaaugcuauguuaaauauuuggagcauauguuuugagugauaaggaaagaaacgauauuaugucacaguguaagcccuuuucuguauuaauauguuaaugaaauagcauuaauaauuauuccuuuaagagaugaggagaaugagccacaaaauguaaguuauauccuaaggguauagaauaguuugaaccauaguagacugauaccagcauucucugugcuauuuucuguccuaacaccuuuucuagcuaagugucuaugguaauucucuucaaccuccauagauagaaagcagcacaagcuggaauaauaauaucucuaauuaaugcaguguuucggugaagccauaaguaaagaugacccccccccccaugggaagcauaguuuuauuagcauguuucuguggcauaggcuaaauugugcuaccuugaaaccauaccuugaauucuugaaaccuugaaacagguuucugcuauuugaaugaaaugugauaauggauaucaucuauugaaugugaguagauuagacaggaauauuacagugaacaccaaggcaaaaacggauagaagcagagcuggaauccucaugacaguuucuguccuccuacagcagugguucucacucugugggugaugaccucuuugggucacauaucagguauucuguaucucacauauuuauauuaggguucauuacaguaguaaaauuauaguuaugaaguaguaacaauauaauuuuaugguugggauucauucaacaugaggguugcaguguuagaaagauuaagaaccuuagggagucucuuuaaccugcuguggcugaagggaaauagugugcaagcuacauaugggagaguuugcccauaguuuuuaacgaaggcuuagacauugcaguuuuacuuccacuuucugaauguauguacuaauaagcacaauugaauuaaaaaguaauggcaguggaaauguaguuuguauacauuucaggauucacuugucuuaagguuugguguauucaaauuauuuggaaaggagaagucagucuugugugaacagugcagauggcuacaguugagcuuuuuuuaaaacauacuguacuuuucauauuuaaauuaguaaucauacuuuuccauauuuuaccaacauuaagcgaguaugaccuacuguaccaaauuuuaugagaauauaaaucuugcugucaguuaugacagauuucaucugcuguaaauuauucauaacuaugagaguuacauuaccucaauucuuuaucuggcucacuggcucaguauuccuuuguguuguaauguucuuuuguaauuugcuaauucucaggugauuacuaauauaauucaaugucccuaguacaaaccuuggugcuauaaguaagaauguuuuacuaucuauggauaauguauucaauguaaguuauuucaggauuuuuucaagaacauuuuucaacaacuggguaagucacugugguuugccagaucuccuaguaguccaggcuuagggcuaauguuggucaaaacaguuuauaagagugcucuauaccacuaaguuagaagaucuugaccacauauucccaaauacuuaaaauguggcucauccacagaguaccuggggaggacucuuucuacuccaaccccauccaaacuuauacaggcucuuaauuguauuauaacagauauacaagaauacagagguuuguauguaacaguggggugccaugugcuguccaaugcauguuucccuuaggucaacuuuaaaaauccuaggugguuuuugaaaaauugguauguaauuuuuauguauagucccccuacuuacuaugcaguagcaggccauaauaugcuccugucugacuuaguacucagugaucguacuuaaccuggacuccucccuccuccgcagcaucuccuaacaaccacucacucucaccuuuuaucaaaucaacuuuuuuagacucuacuuacaagugaaauuauauguuuuuuuuucuguauguguuauuucaccuaauaauagagucuaauuccacucauauuaucauaaguuacaggaucccacuguuucucacuguuaacuaguauccaaugcaucucuacuguguugauccauugagccagcaauugauaaacaucagacuuguuuacuauuuugacuauuuugugaacagcucuuuauugaacaugggaguauagaacaucuguuugauacacuuauuucaucuguguuagcuauguacccaagcagugaaauuacuaguacuguucucuacaauaacaugcuaauaaugaacaccccacccucagggcuuguggcucugcuuuucucuaucuacagccuugccagcauucguuacuuuguguugauaucacugucacucauccuaggguaaaaugauggcuuauuaugcuuucaauuuguguuucuuuguuacuuagcgguguugucuuuucaccuacuuuuaguaucauuaguuggacccugguguuuuaaaaaaugucuauucaaguuucuuguccauuucuuaguuuuauuauuuugcuacaguguuguauguuuuuuuuucugguguugggauaauauugucucuuagaauuucuugggacguuggaaugaaggagaauuugguauauuguuaagaugcauuauucagaaauugacgaguaaagauuuucuuaugcuuaagccuucuucugugccccacauaagguaaaggccuuuuucacagucccuauccuaaggucugacauuacaaaguugucuuugccuucagagagagucacuggauggagcaguccuagaguacugucauguagcuguggccauuauccaccaaucucugccaugcuccaagcccaugggcaaugaagaccagcacauuggaggauuaggaccaaggccacuucuugcaaaggcuccugguuuucaguauauauacaaucauggaaaaauacuacauaccagugaugcuacuagauuagaaguuuauguucccagguuaucuagagcuguucaggaagcucugcuaacagcacagccuggggaaucucccaguaucaugcauccuaucaaauguggucugucacuaugcugugcugcuuuagauugagagcuucugccaggguuuguugugcauuagucucagguauaccucaccccuugugguagccagcaguguuggaagccagacuaguuagaugccgagacagugcuagaaucccauuaugagcacaggccuaauuauagcugugcuacuuggguggugaagggagccacaagguuaauaaugcaaaauugaguuguaccuuagagaucugcauaagucuuaggaggacauacuccucagguaacauaaauaugaguuguagauauacagacuucugccuaaggucagagcuggugcuaggcuguuugagcacuuucucucauacaaagccucagugucucuuaucucuuaggugcuuugccucauuguggacuuagaccugaauaaugagacagagcugugcgaacuuuccuguucuguucuuccucccagcuuauucuauagggcagagcuuauugaggcuaucagccuccuggccugaugcucuucuagaagcuaaguuccuggcccuacaaucaaguuaaguuacugggacuuugucuagcccuggguuccacugugacuuugcuaaagcugcugcauccuuggggcaugaacaauuuucuuuuccucuaacugcaagguaccuugcucuguacugggcuucuugaagcugaaagacaaggaugauggcaauucuuuccuuccgaccucuuuaaguguagcuaaaagcagacucucuagucacucaccugauugcccuagcuuugugcagauauuuuguuauuugugauagcucuuuaauuugcuguaucugaggaaagccucacuagagacugauucagcagccugucaucaugcucacuuuucagauucccaguucuuaaaagcagauacagauagacucuagcaaagccuuuucucuucuuccugucuugcuguucuuugcaguuaagcagucuguuucugggcugcucgcuugaccugcccuguccaaaaauuucuguugcauucacaucuuucgcauuagccaugacaacaaguuaaaaauuacuuuuuuauagaauacuaacauaugugaucuauguguucacuguuaccuucuuuauauuuauuuuaauuagcucaauaugauuuuauugaaacuuucauauguagagauuuaacauuuuauauugguuacaacuauaguuuuucucaaaaacacagcaaauucugcugacacuauuuugcugaauaugauugacuaugcccuucacagcaguguaaaauauugaaauugcuugaagauagagagguccuuacaugauuuaggcugcuacucuuaaauaggagcugcgaugcuagcaaguggccaggugacauuucugugugaaaauaauucuacuucaguagggaacguuuuuuguucuagccuaaugucaaugguuuacauauaagaggugguauauauucaucauaaugcuuagggaaaaaaggcauuacuauggcaggaugagcugaaguaccucaugaucggagagaauuaaguaugcaaaugagcacuuugagggucuggcaaggcaugccucaguugguagagagcagugugccuugcaugcauaaaaagcaagauccaauccccaacagugcacuacacuugggaugauugcacucuggauauggagccaagaggaucagaaaagcucaaagcuuuugguuacauguagaguucaaagcuagccugguuacuugagaacauaucucagaaacaaaacaaaaagauacauggauauagauauaugaauagccaaccauguggugcauaccuuuaaucccagcacugaggcagaggcaggauagguaauccauggcaguuucugagcuacaggccacucuggcagguaucagugggggaaguggaguggcauaucaugauucauaauuauaaauauauauuucuuaauguagaugauuuuaaagauuuuuguuguugcuguuccuuuccaaacagggauauagcuagugcaauaaaagaacuacuugauacagugaauaaugucuucaaaaaauaucaguaccagaaccgcaggguaaguugcuuguugccauuguacauaugggcaguuguuuuaugaccuuugcacuaaaggguuuggcuuguggaaauugucucauugcauuuguccucagauguaaauguugugugguuaugugaguaaacacuccucagaccuacggacuauaaaucaugccauauucauuguugccauugcccuuugacuuggccuugugugcucuucuucugucuuagccuguuuuucuuuuuauaaacauaggcacuugaacaccaaaagaaagaauuuguaaaauacuccaaaaguuucagugacacucugaagacuuauuuuaaagauggcaaguaaguauugucauuuauacuucucugcucuaauuaaaugaauguuuuucugggauauuggaaccagguuauuugggccagugagaggucuccauggguaaaggcuuucacagccuggccucacagccugaauuuaauuccacacccacuuggugaaaggggccgggagauggagaaaauugaauguaaaaauuaaaacggaaaagcucugucagcuaagcucugucuuccauuguuaagagucgagucaucugauuaacaaaggcagaggauuggagaguggcuacuguucuuaccacaacuuaaaaccuacaguaaggauuuuugacacuuucugaaaaggaccugauaaugaaauguaaauuguacagucuucaccugaaugugguugguugguuuguuuuuuuugggaggggagaggggggcauuugguguuuuccuuuuuugauauuaaaagauaaaaaguaaaucuuaacuuacuggcuuguaccagcccuaauuuuuuuuucuuaaacuuuaguagcaucugaugguaugggucuacuauugggguucaauaauugaacauuuuuuuaagauuguucaguugcugucaaagguaccagccccuugaaaaacuaguacacagaggauaggauuuaauaacaauaauucgcaauccucucuccauauuaaaaccauccugggucaguuuuuaaaaagcucauugccacaguuccacuuugagagauuucuaccuugacuugaauaggaacauggucuagauguuuuguaaauguguccagguggcuuucgagugaucccaggcuagagauccauauugcuaaagggaagauaaaauagcuaaauaagagaacacuaaaaagauuggaaagaagacaaaagcaaaugacuauuuaagaaaaugauauggaaauuguaaguggaacauuagggguuuuuuuguuguuguuguuguuuuuuaaauuagguauuuucuuauuuuacauuucaaaugcuaucccaaaagucccccauacccuccuccgccccccacgcacuccccuacccacccacucccacuucuuggcccugguguuccccuguacugaggcauauaaaguuugcaagagcuagagaaaguacccaaggagcugaaggguauucauccuauuggagaaacaacaauaugaacuaaccaguacccccagagcucgugucucuagcugcauauguagcagaagauggccuagucagccaucauugggaacauuaguuuuaaguuuauacaaaacuuccuauagagcccuguguagaucuagggauuguguuuuguauauguacucaguauuuaaacagauagucuggguuaugacaucugcaaugugcuuucauacagguuguugacuggacuuuaguuaagaugcuagaaauuauauugaaaaagacauauacuuauguauauauauaaagcuagaaaauacuccaaacaggcaccgcaaaccuugaaguuuuaagaucccauauaaaaccacacauuugugauauuaguauaaaauauuuuaaaaguacauggauauaaaacuuuuacaaucaguuuuaauguucaggcaaauauaaauauuuucauuuauauuacaaauuaaagauaguuacauuaauaguuuuauguuccauaugcaaauucaaauuguuuagggaaaauguuuugugacauaguuuaauaaacuaagcccaaauagccgaagguaugauuuagauaaggguauaauaauuucuaacuuuaauuaaucauguacaaugaauguugaaaggcaggaguuuauaguucacuaaucuaaaauuuguauauauugauauuaagcuugcuacuauuuuuccaaucucuacagcucuaaauucauuuuuuuuuuuuuuuguuuaaauguugugaauuuuguacuugcuuacuccaaauggaaaauuguuaguggagcaaaaucuuugaagacaucuuguacuagggagacaaauucucauugacucaacuggugaagauccaaccuucaucccugguacaaugagggacugauaaggcuguauaaugagggaaccaugagccucugagagaacauccuggcucuuaaaguagcuuuguccccuucucucauacauuacaucuucucacaguuuucucuccuuccacuccuccuggucccucccccaaccucuccccucccccagaucaaguacuccucugcuucccuuccaaagggggaagagagagaggcagagaaagaacacaagagugcaggacuuaucuggccucucaagggauaucuaccaaacuaacaagauagagaagacugggauggacccucauaucauaucuggacaugacaacucaguaggaggaaaaggaucccaugugcaggcaaaagaaucagagacaacccccuuccauuguugggagccccacaagaacaagcuauaccaccauaaaguauaugcacaugaccuagcucaaacccuuacaggcuccauguuuguaauuaaagcaucgguuaaaaccauacuuuuguauuuguuggaccccagguacuaaaucacauguuuuuaggcaaggauuagauuaggguagguuagaagucguuaacauuucuuuaucaugcucauugaugccagauguuacugugccauuagaucucgaggcuuagugccuugcaugcuuccgcagaucaggcuaaccgggaaccucaacucuaaucaucacuuaagcacaucagguuuuauuuuguuaacaaaauucuuuuuaaauuguauuuauuuuguacagcugaaaacaaucugaauccuccuguuugaccagugaucuguuuagccuguaaaugguuaagggguagcaacccuacaaccccuuacugccagucagaaccaccagggggcagugguuccuagacgcuauaguuuauaacccacauuaaauucucaacuggaaugaaaguuuacaguacucagaacuuacuugccucccccuuucauuuuauugcuaccguuaauauaacauuaacuauaaauauuuuaguuuaaauagugaauuugaaaaaugaaauuaaugauuguucuuuuucuuuuuaaacagggcaauaaauguguucauaagugccaaccggcuaauucaucaaaccaacuugauacuucagaccuucaaaacuguggccugaaaguuguauauguuaagagauguacuucucaguggcaguauuaaacugcauuuaucuguaaauuuuaaaguuugacuguauaaauuaucagucccuccggagggaccuaauccaggauguugaaugggauuauugccaucuuacaccauauuuuuguaaaauguagcuuaaucauaaucucacaaugaagauuuugcaucacuuuugcuauuaucauucuuuuaagaauuauaagccaaaagaauuuacgccuuaaugugucauuauauaacauuccuuacaagaacuguaaauauugguguuuguuucugacauuuuaacuugaaagcgauaugcugcaagauaauguauuuaacaauauuugguggcaaauauucaauaaauaguuuacaucuguuaaacauuucuuuacuugaaaaaagaugcauauauauauguguguguguauauaugaucagaagaccaagacaacuugguauaauguuaaagaucuucuaaugggagcuuacuagcaguuuaucaaauaauaaaggaacaagaauuccuauuuuuuguccuuaaucacuuugagcaaaauguagucaguuaaaauacuuuuguuaguuguuacauaucaagaacuggauauuuuuucacuauuuccaaucuuuauagaccugagaagagagaugaagcuacggggucuucguacuguaguaacacuucagguucaugacgcuuucugagugguagaugcggcuccacgaaauuacuucugcuauacuaggcccuaauaagcuuugcacauuguccccagaguaaucacaauuuaaaaaaaaaaaauucuaauaguuguauugagauuuuuaucaguguuaauauaauauauacucuuuaaauauguauaguuuguuucacacuagagaaguuauaagaaaacuauguaucgguauucauguugagugauuugaguuuuuaauuauaaaauaaagggaaaaucagguuuuguucauguuuuauaaagaaaugaaauauuaaaauuuguugacaga

SEQ ID NO: 1459 - RNA, 8293 nt, Mus musculus
gaacaguuaaaaaggaaaacauuuuauuugggcuggcuucacauuucagagguuuaguccauucuuaccaugguaggaagcauggcagcaugaaggcagacaugaugcuggagagguagcuaagacuucuacauuuggauugacaggcagcaggaagaaagagggacacuuggcuuggcuuggcuugagcauuugaaaccucaaagcccaccccccaguagugacacacuuccuccagcuuggccacaccaaaugagccuacaaaggcuauuuucauacaaaccaccaaagccaaccacaaugcacuuaaacauucagucugcaugacagggcagcugccuggcucaacagauacacagaaaugcucuaagagccacagcaggcuguuuggcaacaauucuccauaaauaauuuuuucuuugagcugucagaacaugcaugucuaucuuccacaagaggcagcuacauacuucuaaaagaacaucauagaauccaggagcuaaaaaaaaaaaaaaaaaaaaaagaauggagaccaccugggguagagaaaugaggcuuuauuaucuauaugagaauggugcuuuucuuagaagacuuucaguaaaugaguugacagacucaacuguaacucaacucuuuguuuuaguuuuaaaggaucuacuuaguuacuucuuuacauguaugugaauaugucugugaguggguacgugcugcugcaugugcccggggcauguguaguagccagaggaagaugccaaguguccucuauuaacauauauccucuaccucuauaaaucaccauucuuuugaagcuguucccugaacaaagaguuccuguuuucuugacuagagcaccugcucuuuggauuuacauaacccagagcuccagguggccuuuagaugauauaagaaugucuaauagcccccgccuuuuaauuaauugguuacuuuauuuauuuacauuucaaauguugucccuaguccccagucuucccucugcaaacuaccucaucccacccccugccucuaugaguguguuccccaaccuacccacccacucccaccucaccccucuagcauuccccuaugcuagggcaacaagccuucauaagaccaagagucuccccucccauugaagcuagauaagacaacuuucugcugcauaugcagauggagccaugggucccuccauguguacucuuugauugugguuuugucccgugagcucuggagguuccguuuaguuuaguugauauuguuguucuuccuauaggauuguaagccccuucggcuccuucaguccuucccuaacucauccauuggggucgcuggguucaguccaaugguuagcugugaguaccugcaucuaucuuagucagaugcuggcagagccucuccgaggacagccauacuaggcuccugucugggaguacgucuugguaucagcaauagugucaggguuuggugucugcagaugggaagaaucacaaggugggacagucucuggauggccuuuccuucagucugcuccauuuuuugucucuguguuuccuguagacaggaacaauucaggguuaaaaauucugggcuaaaaauuuugagauggguggguggccccauccuucagcugggguccaugucuauauauuggaggugguuuuucagguucuaucuacccucuguuaaguauuuuggcugaugucacgcacauuugguccuggaaaccucucacuucucuggcaucugggacuuucugcugguuccccuuccucacugcuacuuacuucuauucauucuccugacccucuggacuucugucucuuuccauacuugguccuacuucccuuuuuccuucccucuuauuucuuccucucaggucccucccucuacugcccaugauuauuuuguucaccauucuaagcaggauugaagcauccacauuuuggucuuccuucuugauaaucuucauauagucugugaauuuuauugugguuauucugagcuuuugggcuaauauccacuuaucagugaguacaugccauguguguuccuuugggucugaguuaccucacccaggaugauauuucuaguucuauccauuugccugcaaaaucauuaagucuuuauuuuuaauagcugaauaguacuccauuguguaaauguaccacaauuucuguauccacuguuccauugagggacauauggguuuuuuccagcuucuggcuauuauagauaaggauugacuuuuaaaauguguaaagcuacauaauuugaugaagaaaauacuaccccuuucaugaucaugaggcaggugagcauaggagauaguuuugcuuggaaaugugggcuauacauacacauacacacacacacacacacacacacacacacacacacaccuuauaauauucauuuuacagccuaguuucuuuaccugcacuugcucugccuccaggaaagaaggaaccuaguaacuuuaaaacuuccagaacccauaucuggauccaggcuaugcauauucucauauaugaacaaguuuccucacugcugauaaugaucaacuuuaaacuguuucuguuccaagucuuuucaacuauauuuccuuauucauuuugaggaauagaagcuccaaucuggccagaacugguuuugggugcccuguguaguaaaucaaaacucugcccucuaauaauauaguaaucacgcuuucuggagaaucuuauuuaccaccugauuccuaugcauaauuagacacauauaugauaaaaaucauaugcauuuuagaauauuaacaauugugaaauuguuggggcuggccugaggcucucauguccggguucaagccugggaggcaccuuggaacuggaagagaagagggaaucuaggcagguagagaaauaaugggaccaagacaagcuagucugcucaagguucaaauuuuuaauggcagacacacuuuauaaaggagaggggaagcccauccagaaauaaugggaccaagacaagcuagucugcucaagguucaaauuuuuaauggcagacacacuuuauaaaggagaggggaagcccauccccaccaaaucauccuuggaacccagcugcaggugaccacguguaggcuccagaauagcuaggcagacucccagcagguaggagcaguggcaguggcagaacaauagagugaucuagggaggcaagcuccacccuuggugaucuccauagugguaagcaaagucaaggucuggcucagccugcuucaggcuuguggggggagguuacaucuccucccuguuauuaauauaaaaaagaaaggcuggacugaggcauaaaauuuauuuaugcucuauaguucagccugauuuccuugggccuagugaagaaaccugucucagugggauucccuaacuuuauuuauaguaaauccuuauuugguuuagacuguacuuacuguccuaguaaacauucugcagaccaucccugagcugcaggcuccgucuuuuguaaugcuaauuaguuacugaauagguaacuuccuuacugaauuccuacugaauuccaaguucuuucuaggaaguuggaacacuggggaaggcuuaacuauaucagaauucaaucuuaaaaggcacuuuuaauaagauaauacuaaaggagagcacgugcauccauacaccagacuaacguggggauaggguaagaauguacugguuaugagaaugccaaaguuccaggaggugagcauccaugaaacucuuugccucaugagugcucccaggccucucgaccugccaagcaaacuucacuggagugugcauagcauucucccauucuuauauuuuugcugaaguuccagaaugucccaccucaucauagcuauagaucuuaggagugcucuaaagaugaguggaaacacaacgauuuacuaauaaaauagugccaauaauaauagcaaguaugauaauauauugaacccaauccaggggauucaaugcacuuagguuaucuuuaaaucauuggccaauucaucaauguuccaaguguccaagugacuauugcuaauaucuggaauuucugccuuucuagccuuaauauaugcuaugcccugccguauuguuaagacuacuacuucuaaggccuuaaccuuugccuccaauucuuuauguggcucugugguauacuaucaauaaaccacaaccucuuggcagguaccucugucuagauuaauaugauuccaagaucugggugucugucuagacugucuggcccucguagcuaaccuuaauuccaaaucagaccaaaagccacaauauguacuagaauguuacuugagugaagauuaguaacugccaccugcuuggaggcggggaugcaugccuuuugcagucaggcuaaagggcauugacugaccugcuugaaaaacaaaguccagacagugaaaggcaaugguacaaaagcuuauuuuggggaaguccagguacuccauucaauugcaaauuagcaaugaucaagcuagacuuagagcuccaggugugggggaggugaccuugagaauugcagaaaggcugcaaucuuucugggagaggaggcuguguucuaauuuguuaaguaauuaagaauauuuugauauuuucccugggauacucuaauacuggaauuauuacuagaccagucuaagacugaguuagaauaaccagucacaugagagaaagagaagaaucacuaaucuuucugagucagacuacacagucucugauguucuuuuuaccauaagguuaaaagcuugaagcaaggcagcuucacuuguccaaacuggaaaaauggcauacaaggauggcucgaaaacguguacccaauucagcuuccuacucacuauagucacuacagucagggcacugagcgaacucaccuguuuugucacacgaauuagccaucaugcuucugcagcauucugugaagaaaaccuaugcuuuucccuuuucuaauaaaguagcuguucaggaucaagccauaugccaauaaguagauccuuuuaagauacuauaaagcauuuauuaaauuuuuugacauccaaauuucaaaauucuaaaauaaaaguaugauuuaaauaauguucauggggaugcacuaaauaauagacauggggauauaauuucccccuucuuugucuuuuaagaagcuaguuucaaaguuucacaguaccuuguccuugagaauuaauaauuuguugacaaaacaucucaaauacuugacaguuauagucaguauuaauguaacauggguugugacuaauugcaauuguuucucuuaaagagcgguuguaacuagaaagcuugaaaaguuauuaauagucacauguguauauuuauuuauuaacucaaaaacaacagcauuuauuugcagcaauuuauuaaguauaaguccucaaaaauuaacacuauuauguggaaacaaguaguaacugaggacacucagaggaaagaauuuuacaugcacaauuuccaagaauacuaaaauauuaucuuaaaccauaacuguuuugaauauauaaagaaugagauuauaucuccaaucuaucuuauauguaggaucaauacauugcuugagauauaaauccaccauggcauugcuuuaagauguccaggcaaucuagaacaauuuauuaaauguccaaaaacagccuucuuaaaaggacagcauuuuuucuuaugaguuguauauguauaagcaauugcaaauuugagaauuaauagcaucugagggaugaacaaucuuaagcaauugugagcucugagauauaauauugacuauuaauauacaaauuaagguuugauuguucagcauuuuaaaacaccauccacagcacacaacuaaauuaucugugcugaagcagggggaagcucaaaacaguaagugugugauccaauucacaucuacuuaucucucauagagggguuguuuguaaacacaguaauugggauguaugcaugcaugaauuuauagaagauacaaaagcaugcaugaaaacaguuuuuuagcuuaucuuugggauaaugauugucaauuuuauuuaaaaugaugauaugcaauagaucaaauauuaauauucuguaauaacuaaauuguuguuuggaacaaggaacagacacuuagucagguucuuaagacacaauuuuuguuauagguuuucccaaacuauaugaauuuaucuuauaauucuuuguuagcaccacaguggcuuaauaggaugcugaaaaugugcuuuaaggugaaugccacuucagccucgcccuugagaggcauuagcuaacaaaauacuuuccacuuaggaaacaauauacacugaaagauucaaacucuuaguuucuugauuacagcucacuagaagcaaaacucuuuacaauuaucagaaugcaaaggaaaaaacaauccuuuaaaucuauaauaacuuuauauaaaguaggcaagucacaucgcaauguccugaugaauucuacagccugauugaccuuuuuuuaauaaacuuagaauuuaaacuuuauuuagaacaacaucugcaaaggugcucuuacagcuaaaaggaauucucuccugaaggcagggagaggggagguucucagaacuuuccuagucacaguauucgaaacaaaggagauuucucaccaacuuccccgaggcugcucugaacuugcauuaacucgaacauaagaaaaaauuuccuaacucaagcauuuuggcccuccuguaaugaggacagauuuuagaacuacuaaguuucuuuugcaauauuaaauuauaacuacaaccuuggguaaacaaaacccaauuucaaaacaauuuaucaccuuaagaaucaacauuaaaacuucacuauuacauugcgagauuuggcugccaauuuauaccuaugaauuuaugacagugcaagcuuuaaugcuucauuaaagagaccuugcuuuaaaucuuaucuuaaucuuacuuucuaggauaagaaucacauuaaauauuaucucagcuagaaguaucuuaggaggcccuguuuuguuguuguuuguuuguuuaguuuuuuuuuuuuuugccugcguaugccacguguuugaaaaacuccugaguugucaauuuaaggcuaacccucuguuaccaauguaacaauuauuuaaucccaaccaauaacucaugagcugauugugaagacaugcagagcacauuaccaguaaaaaaccaaaugaaucagcuacacuuagaucaaucagagaauauuaguuuuuucuagcuauaauuauaaaauaaaaagcacuuugucauuagccaaaugcaauaaucacgaaugcagagaauuuucuuaggaaaaaaacaucuaucagcuuuuuuugccccaauaccaugaggcugcagacucucuuuaaaaaaaaaaacaaaaaacaaaaaacaaacaaacaaaaaaaaaaacaauuuuuccagcaggggcucuccugcugugccugauccugugguccucucagcuuugcuauaccagcagagaaaguuuuagucaccuuuuaucuuccaauaugaaaacacagaaauucauucauucagacuagccaugaacauacaugaauugaacacguggacagaccggugcaccagacuuuagacaagaccuuagacaaaaacacaaagagggcagaggacuucuacuguagggcucagagagaacaaagcagaguaccccuaaaauuucucucugcuucugggacauuuucccccccgccuaaugcaguuucugacugcgaccaauccgccuaauuauuaaaucccuuuuauuaaacccuuuuauuucucucaccuaaaaaaguagcuucuggaagcugcggcuaacugccugucacauuccuagauccuguaucucacugcugaacuuaagugaacccagcgugcugguuuaacgcuguuccagcuuagcccauaccacaccuucuccgguaugaauuuucuuuaauucuuuucuucuuccauggagcuccaaaccagcaguguuucuuccaaauguccucugccauuccuaagucccaaguugguucgccaaaugguuggggccggccugcggcucucauguccggguucgagccugggaggcaucucggaacuggaagagaagagggaaucuaggcagguagagaaauaauggaaccaagacaagcuagucugcucaagguucaaauuuuuaauggcagacacacuuuauaaaggagaggggaagcccauucccaccaaaucauccuuggagccagcuucaggugaccacguguaggcucca

SEQ ID NO: 1460 - RNA, 80769 nt, Mus musculus
gggacuuccucccggaaucccguuggccaugauagcggggccgugggugacacguaaguugggugggagguggcgggcggcuggagcuuccagaucagugacaccagcccaccaccccccuuaaccugaccagaccaaccaguccccaucucuucaucaauaccgagggaccguucaaggggacgccgccuggagccaggucccuuuguugggcgcgcguccccuaccagugguagcgacaaaguccagcagcgggagccggcgcgaggggcggggacugacgguggggacagcgaggccaaaaaguggggaguagggaaaaccaagccggcugcgcgcggggaccaguagcaagggcagcgggcucugaaguaugcaaagagacuccacgcgggcccagccacucgcggaaauccgacaucgcagaaguuugguggcugcuggccggguggcgucgaugaccuggcgcccagccggccgcgggggcugagcggccgccucuuccucucugguccggcuuuugugucucgcgucuucugcucaugccguguccagcuacuucucgcgguggccguugcugagcuguccgacgcagccgaggaccgaggacacgacggcucccgccgccgcagcgcggggcacaggagggacuaugggaaacgggaugugcucccgaaagcagaagcggaucuuccagacgcugcugcuucucacgguggucuucggcuuccucuauggcgcgaugcucuacuuggaacugcagacgcagcugcgcaaagcugaggcaguggcgcucaaguaccagcagcaccaggacucucucucugcccaguugcaagguacaguuaaggggaagcgcaccgccaacuucucucugagcuggugcuggugcuggaaaaguagcuugguggauaguuaguuggcuuugcagguaccacucauugaccuucuggcgcaucugagggagcggccgcggggauguuggcuucugagcguaugugugggagauaauauccugauuuuccagcuuccucccaggaguuaucuuugaaauccacagcaccagcgcacgguccugccuggcguuugguggguacauacaacaccaagucuuuuacccgaagcacuugucaaaggcccagcugcaaucuaggcaaacagcccuucugcuacaucugccaauccuuucccaagaggcaagccuugguuuguagacauaaagaauuaugcagacauuuucuaacccguguucuuuuucaaggggggaaaaaagagacuauauacacuagugacucaugaacggaaccugcaagcuuguguugugauuagugcucuuguuauuacguuuguucauuuaguaguuaacuugagaaauguugggagugaugguaaaguccacaccaccacuugacuguagguuauccuacagauauuugcuuuuaaaaggcuugucucccuggagaaaccuuuauuuagcugaucuguagaacccugugugugcaucuucaggaaggcacacgcguguuuuagaguuagcugugagaagucuaaaagaagaaacauaaaauuucccuuugccagccacagacgacucagcuugggcaagguguucgcagcucguagccuuucauuuuaagaaucacacugaguuuccacggucuagaugauucccgagugagugcauggaaacacuuugugguuccauuaaggucauacucguuguaugcauuuuuaugaaugauuuggccugucuugcugguuuguuuucaccacucaugaagcucucucucucuccaauacaaagcaagugagaaauaaaguccuaccuaaaugcugaccauccuugcugugaaugcaaauauagcuuauugaaucauccugggcaaaaauaagcugaaggggguauuucugacaguggguguguguacaaauauaaaacagauccuuugcuuugaccgagcuaugcagagcauuuucuaguaagagacuuaagaugggagaaaugauaugcaauuauuugcuuggucugauuuguuugucccaacuuaaaagaaaagaaaguauuuuuagcaucuuggugcugcauggcuccagccaaugaaaauauguggcugggcuuccuucagagggaaagcuuguuuuugauaguuuuuauauuuaaaagaaaaaguuuaaaguauggaaauuuaccuaugaguuguugguaugagaacgguggauacuugcuuauuuauuuagaaaaucaugccuuccacaugaguuuuaguguguguguguguguguguguuuguguguguguguguguguguggugagauggccaauguuuguuuuucacucuccaccuuauuucuugagacagggucacuugauucaagcuuugaucucacugauucagcuagacugucuggccagugagcuccaaggauauucgguuuucacccccuacggcccagcacccagauuccaggcacacaccacuacaccuggguucuuacacugguccuggggauccaaacugagguagucaaacuugcauagcaagcaagcacuugccuggcugagcuguugagccauaguguacugugccccugaaauguuacuuaacuguugccuuggccuugcaacaguugcaaugauuguguaggaagaauuaguucacaagcuggcuaaaguuucugcuuauuuaaacacacacacacacacauacacacacacacacacacauucaggcuugcuuuuagcaacauuaauguccacgucugugucucugugcuguuuaauaaggaacaguuucugaaagcaugcagcucuuguuuuuccuucccuaggacagaugguauuuuacccugugaugccacacacaccaccaucauagaugagcuuucagagugucugauuucauucuuuuuuuuccccccauuauuuauuuacuuguuuguuuuugauguguaugucuacaugugaguguucaugagugcagaacucguagacuaaugucaucugucucuucccauuuguucuuucuccaccuuuacauuuugagauggcaucuuccacugaaccugagccgguuauugauuuagcuaggcuggcuggcuuuggguaucugcgggucucuccgccacagccauaggguuagagagaaaaguguaggucugcaggccgcacuuuacugccugcaccaucuccugaaacucucccucccucccuccugucucucugucccucucaccuuuguuuaagccuugcuuagguaaaugagauagaucucuuaacaugacuuggauaaaggucagcguuaauuuugaguggccuucuuuuaaaacaugacucuuggaaaaguugaaguaacagugucugugucaagugguacgcagguguuaagagagcauaguuaagcuaucuucauuacuccaggguccuuugaauggagguuacucuuuuuguaaaguagucucauaauuggaguuggagaaugacauggaaaggaucagagaccaaaugaccuucuccacaaaaauuccaugacaauaucuucugcaucuauuugucuaucuauauagcuauauaccuuaucuaucuaucaaauagcuagcuagcuaucaacuaucuauuaucuaucuaucaaucaucuaucaucuaucuucuauuaauaaucuaugugucaucuauguaucuaucaauaaucuauauaucuagcucccagcccagaaccuuaaauauaccaaagacuagcguggagaucgcauacggcuggcagaagguguaccaaccuuuguccagagcaguguuuauuuaacauuugaacguuuucucuugcugcuuucaagggagccacaugccuccuguucugcaagcagucugccucuggcuagacuccccauuuggagcaccuugcaacucccauaucaauuaaaucccaucuguggggguggaacccaggcuucaaccaacaaucuuuacugcucccuaggugauuccaggagcagccaugguuaagaacccuggcucucuaaucuuaaugcuaagccacuucaaacauccucuuuacaugcuuggccccgaggguguuucccucucuuauccugggcaugugauuagaaacagacugguuucuggaccggguuucaaacucuaguucugcuacuuuuugugugaagucagaccuaauuuuucuucuuuaucaaauggagauuagagugacucauuucgucagggcuguucuaaguaugagccaaaauaauaugcacaguacccuuaacacaaacauagagacucuuaucuuuucucuucccagcuuggucuuaggcccaguguugagauuggcuaacuucuuuguacagguauauacccgucuuuguuucuaagcaagcaucaggaaaauaaauaaacuggcauaagcuggugcacuuuacccuggacaaggaaaggcucuuccuugacaacuuaaacacauaauuagucuuugguuacugguuaaccccucugaaucacaguacauuagcagaggugugcagcuucugagcuaaugauaguacgaaggucuggaauaagauggagcuagcacacauugaagacuauucagugugcucucuggaaacccuguccccuguuaugagagugaugaccacauaccacugaagaagagcuauauaauauuuuauaugcucuaaauucaaacaaguacguuguaauuauuuagaagaaaggaguuguauguaaaaaccccauuuguuacuuaaauuugcuggcacgagggaggacaaaaucccauccugaccagggagguauugugcuauggccuccaaagcuccuaauuugcuuuaaaacaaaaagcccuucaauucaagcccaggcucuuuagugcccuuccucuuuccuccuggugccugacauauaaaugguacuuggcaacagcagguguauaaagagacacgcuuauugagagacugcagugcuauuccuugauacuggcuugugaggcagagggcaucaauuuguugugcuuucuccuagcugggugaucgucgacauaaaguuagcuacccucucacagcacuguugcauauagauuucaggauaauugucuuauagguuuccauguggcccaauaucuagugugcuaugucagaugaauggugcuugcauuuagauuaacuuuagaggcuucugugcugcagaguucuucacagauuucuucugucauucauucuucaggugugccaaaaauggacaguguuuuuuguaggcacaguaguuucccugugccaaguuaagacguguaacaucaauuaaacauuaccuugaguagccaucuguauucauauguaucuuacacuuaaaaagaggugauucuuuaaaaauacugaugugguuuagaugugaaauuugccccuugggcuaugugcuugaccaguugacugucagguggcggugcuguuguuaaaaaguugugaaaguuuuaacuggaaguggcucacuguguggaaugggggaaggaauagcucccucugauuucaggugagcccuaugguuaguggaguaugaagaguuccagucucacuacccaucaccaugccuaccugaacacaguggacugugcuuucccuaacugugagacuaauaaaucccuccuccuuaauguugugccugugaagccuuucauuacgacaacaaggaaggcaauuaauagauguuuaucucuuaaccuauaaaauucauucccuaauuaaaugauaaaagcuuauaaauacgucaugcaacaccaaguaaagaauucuguccccuguaaaugacaggaacaagaaucuacagccaucugugaauguggcuucagccaucgauagucugugauaagggaaauaacgguugaguaugucaaaauuguucacagcauagaggccucucgugugaacuccagagagauaggcaaccucuuccuugaccuugcuuaguuuuccugucuuugcaaagaacauuguucccuagacacuggcugaaagaauccaagaguuaaagaaaugaggacugacaauuaacugaacgugaaguggaccaagaaugagaguguugaggggacuauaguaggggggagacugggaaagggaucaguaguggcuggugaguguucagcacuauaauucuugcuuagaauuucauguucuuuuuguuuguuugguugguuuguuucuguuuuuccgagacuggguuucucuguauagcucuggcuguccuggacucacucuguaguccaggcuggucucgaacucagaaaucugccucccaagugcugggauuaacggcgugcaccuccacuguccagcuagaauuucauguucuuaaaaaagaaaaaagauggcgugagagccacaagagagggagaagggagacugggcuuugagguuaaagaugacacgaaggcuacucuugaaacacucacauaaguccagaacauuaggcaagcagcucauuaugacacugggcagcagcugcuggaugcauugggcuuugucucacugggaugccucuuauucuauguauuuggugugacuacuccaaguuuaaauggaacaaauucagaacgugguguccaguuuugcugaaacuuuaugacccucuugcuaucuuacuuuuucuuucuuucuuucuuucuuucuuucuuucuuucuuucuuucuuucuuucuccucuccucucucucucucucucucucucucucucucucucucucucucucucucucucucucucucucucuuccauuuuuugauccuguuuuagggaagaaaaauacauaacaucuuacacaacagaaacuuagaguuauugcuuuucauguagaccaaaaaguacuuauguucuaucauggaggagaaaacauauuugucacuuuugcugcuaggugguaugugggauucauagacuuguuuaaaguggaaguucugugugucugucauauggucaaagacgaaugguaaaccucuuuucuucugagaguaaauuuguucugguggaauuuugaacucuauuucuaccacuaaugguauuucauaacauuuauuuagggcccacgaugccaagguauccuguugagcgccacuucagacauaaggaacagucugggauuugcagguguaagcacuuggccaugucaagaugaggucuauugaaaugaagugucaaaccccaguguaaccuccugucuagguugcuucuuucaugagcuuagugcuucucauaaucacauaaauguguucugagaaagucagaaucaaaggaggauuucaauaaaagucgaagaaguaauuaaaauaugaagauucaaauaaaaauuagacuaagaaggaagaggugucacugucugcagcagucugucaggguuucaggcaugggcugccacacgacgaguugauguuuagauaaagcagaugcuuccugaaguaacacugaaucacaauguacaauacuuacagucccuacucgaggcuguucgacucuuuccacaaguguuucauaaaaagacaacuucaggcaaaugacaauguagauuuguuuuauaaucuauaaucucauuaaacaauccauugucauucauuaauguaguacacaucacccuucccauuuccaaggcaguggguagaauuuucuuaucagaagucugucuuaggugaagagagacacuuggcagccccucuuuugauagguguugacuggccuggggagacuucaggugaggaugucugaaggcuugagguuuaggaaugcacuaacuggucagauaugacugaauuucucaguucccuacauuuugagauggauaauucacucaccauguuauucaagcugagcccagagccacauaccauuugaauugagaaagcagcauugcccauuggccugugcucccugaaggcgagaagcagcccccuuuugguuucaauuauaaugguauugcuauuuuuaaccaaugcuguaugcuuccaaaugaaauguuuaugcucuuuguuuucauugccccaugaaugguuagacugaaaacauggcugcccaucauugcucaucacuaauaagccuuugcuaaauggccucacagccuggagggacaagccuaggagauaaaucgcuuugugacugacugucugacauuuagaaaauauugcuuuaacuauuuuucacacaugacucagugugguagugagugggacccugaaaguugcagugucauugugaagcauagguacuguaaagcauuugaaugauguaauuugcuuucacuggaggauaagugaaucaaaaauuagaaucacuuuaguggagucaaauacuccaucuccuagcuuucauuucacuuaauguguguguguuauuaauugagguuuuguuacaaaccacaaaaccuuuuguaaauaguggucuucaagagagcuuuggcauuucuuauaagaucucuuaaguauaggugcaaugcuaaaauaaauauaaacagauuacaguugggcagaugauaauuauuugguuauuuaacucugaauguagcaauucaucauguuuacauuacagagauuuuauguuauaaacauaguuucagugauacugauucaacuauucagcgguuuugguuuuguuuauauuguguugggaggguaauuguacacaugucugugccuguauacagaggucagaugucagcacuguacuugacuuuuaaaaauuuguguguguguauacaugugugugauguagggguaugaugugggucaauguguauguucaugugugagugcagggacacacaugccagagugugcaaggacaggucauaggacaacccugggaaucagucuguaacuuccaucuuguuuagacaguuucacuuguuucuaucucucauuacacuaagcuugcuggucaccagacuucuagggauucuccuguuucugacuccuaucucacaugauaugaacacugggauuacagaugugagcuacagcaucuggcuucaaguggauucuggagaauccaacucaguaccuuaggcuugugggcccagcauuuucacccucugaggcaucucacccuugccugguuugcuugcauggguuuggggggauuaaacccuggccuuuaugaaugccauaaacugagucauagauccagcuccauuuguucaagcuuuucgucagcccugagagagaauguuaaauagacuugaaguucuauuuagagguccugaugaugguguaaaacaaaggaaguaauauugaugucaagaaucacuuuuauucaugcaagugcauuaccucgucaacuucugcaaagcaguccuucuuauugcauaagugaguuagggcucaaaauucagaaauccaaguuuagucucaguguggaugaggcucccaggguguucuuugauaguuucuucagucuaacuuuaccuuuccuccuccuccuuggaacuucaaaccuaaaggaaaaaugaugaucaguucuuaacaccgucaaccuucucaagacggaaaggauacacgaagauguuugcauucugagaugucaauggaaggaaggaaugaggaagucaccgaugcacagcaacucugaaauccgaggagagauauuucuuugggucgucaggccuucaucgucacucuccaggucuuuuguacccuggggcucuugguuauauccuuggagucgugcacccuguaugugcuugcugcucugccauuuuuccagcauucucugccagugaaaugugggugggucuauaggcucuuuuaauuuuauccucuuucucccuguugguccaagcuggccguauucugauaagaaucuucucaaagaauuugugaguuuucugcaacacuuuguagauuuugucuauuugugccugucccauucaugcagcuucuagaaagcaguccucugcuguguguccacgcuguguguccacgcuguguguccacgcuguguguccacgcuguguguccacgcuguguguccacgcuguguguccacgcugcuguguguccacgcugcuguguguccacgcugcuguguguccacgcuguguguccacgcuguguguccacgcuguguguccacgcuguguguccacgcugcuguguguccacgcuguguguccacgcugcuguguguccacgcugcuguguguccacgcugcuguguguccacgcuguguguccacgcuguguguccacgcugcuguguguccacgcugggacagaugagcaacagaucucuuaaaugucuaccuuuuuuaagcucaucaauagaccaugaaaccuccuaagauccaaacuuuguccuuacacuucagugaggagggucugugucagucuuuggaggcccuuuguugugguauuccuccuccuccuccuccuccuccuucuucuucuucuuuuuuuaaauuuuuacauggcuuuaacugaaagauuucauagcuacaagcugggcuucuaucuaaugaugucaugcuuuuccuguagugucaucauaugaccuuguuuucuggccuugucuuucaaaaaaaauauuuauucauuucagugugucuguggggaguuacagagugugugugaauacaugacaugugcacaggagcccuaggagucaggagagugugucauauccagauccaguggaacgggagacaaagauagcugugagcugccauaugggagcuaggaacugaacaugagucuucugaaagaacagcaagggcuuuugaccacggagacaugucuccagccaugaugcuaucguuuuuauuuuauaauuauguggcugucuagagagacugaaagccuucaacccaucaagucauggguuucuuuuauugccuauccauuuuuuuccuacuauauacuacauguaauccuacaauaaaggaaaccuggugaaauugucaguguuuuuuuuuuuuuuucuaggaaaucucuuuaaucggaucacucaauucauuuggcaauuuuuacucucaguauaucugcaggagacaguggaucaaauagcuacguggaaaugugggcagugaugaaaguucugugcuccaucauuucuaaauuccagugaaauuuuucuuucuuauguuuuaaaggagucuguccauccauccaaccacauccauccauccauccauccauccauccauccauccauccauagauuguuauaaauuucaaauuucucuaaaccauguguucuaguacucuuuuuaacauguacagcucuaagcacauucucacauuuguauuuacuuuauuuuugaggaagggucucacaauauagccuccacuagccuggaccucucuaugaagacuggauugaacucggacucaggcuucugcuucccagaugcugggcucaaaugcguacaacaccaaccaugucuaaaggucucccaccuuuagauuuuuaugguggcacccuccucuaaaaccugaauuaacuguuuuucuguaaagcaucacauccccaaacuaaauuggcuccaaaagauagucauuguugccacagggguucuguagcaagugagugagugagugagccacaguggcauuguuaagcaggacuugagucaucucagaacuucacuggaacuaagggcugcuucaggguuuacuuggguugucuggaaggucucggaagauucucuuccagucuugugcucauccuggacccuucaucagacuaucucaaaacauaauaguggggaagaaaucugagggacucaggacaugugugguaugguaaaaagacaggcaaaauuaaggguauacagaagaaagcaaaacccuuuacuuggauucuagcuuuuguuuccugcuggccgagggucagaaauuucuacacagccaacaaagucaagcuugcuugcagaaacaacauucccugucccaaaagauuccuccaacuaggauguuguaaacagcagaagaacuaugcuuguuuagcgcucgaaugccugugaccugccaguguaaccauacccacacaccuccuccauccaucguucuaaacaaugugccucaugaagccacaguuacacaaaggaaacacacuacaagaaauaagaaaacuucauacugcuauacuuaauuucugaacuucacuuacuauuuaaaccacagugcagauuucauccuuugggcaauguuaacuuaagccacagagucgcagagcuggcuauuguaaagcugucuguaugugacacucuuaagaagccuggaacuacacuggagugcacacuguccuguccucugugcaccagucacucagugcuaguccuuaaguugaaaccauguacgaucccuuauuucugcuugaaaagcuugguaacaucauucauccuucucugugaguuguccugaaauucuuuccuguggcacagucaaaacuuuguaccugagugaguguucccuguagacagaacaccucgggcuaccugcaggagugcuggcuguguccuccaaauaucaaagaugagagaggagguguuuuaauuacagggagcaucuuggaagccauuucucauuuuuccauauucuguuaguuuggaauagaccauugaguucuguuuccacccaggggagcauggcuuugggauguagggccauugggaacuggcauaaugugagauuuauuugauuauugcuauguuguuauuugacaguaucauuaagaccuaagccaucaugaaauggcauauauggaguucugcauugguaccaugcacucuucaaaauuauuuucuuggguuaucugacauagucauuuuauaaaauuauuuuaauaugcacuacagugugauuuuaauuaaauuucaagcauauuagcuauaaguggacacugaaaucucacuuuugaggacaaguauuuaauauuuagaccauucaaccuuggaaaauuaaaaccuugugauugcuugaaauucaaauacaggauauaggcuuuugcaggaaacacuaaggggaagacgucacacaccuggaaaguuucaaaguuccucgugaauagucaccacaacugaaugugacugaucacuuagacaguagagaaggaagcagucguuguguggucauugaacaggguuuucacaugcuucugucuuaugaauuacaguccacauugaagaucucauuugguggaagcucuuuauucuauagaguuuacuucuuguaggaagccaucuuugaaagcagcagugauugccugacuggucauuucugguuguucauucagcccuacuuugaaagucaaguuuaacauuuugcuauaaacagucucacauaauauuaacaaaaccaaaaguucagccuaaaagcauauuggggaaaagucauuugauguuuucuggauaauuauaauucuaaguucaaaguuuucucugucucugaaacauaucuccauaacuuagaauagagauaaguguuucuacuuuccauuugaccuccauuggacuuucuaaauauauucuuucuuugucuuccuucggcucugcugaaguguauuaucuguucuuaucacguuuguaucugauauauccucuaccuaaaagcacuuuacgguuuaagucaucgcauaugauaauggauuucaguauagcauuuuaauaaacaguaaggcguaugugcuugcuguguaagucuaaugaccuguaguucagaucuccaguccucacuuaaaaagucagaugcagggauugaggacugcauccccauaacagaacgggcaggcacaagagaggcccuggggcuugcuggaccgccagucagccaacuccaggaucagugagagacucaaaacguaagguggagagcagcaaauaucucuggcuucuaccuguguacucacacaggaaccugugcacacccacacccacacccacacaccuacacaaacaccucugugauauuugagacaugcguagaggguauuuuguuaaaagcuguguggggccauauuugagucaagacuugagaguuguacucuaugcagugagaagcugcuguucaauuucuguaguaucuccuagucgacucccaccaaauagcacuguguguaucagauugcugcucugauaccagcugacacugcccugugacuugcugugguauuagcguggaucacccagguuucucuggauauguaaucuucauucccuucuguguuccaaaagucaacauuaggaaaaauucucuugauguucgguaauguuguauugagauuauguagagaggcuuucagggaaccugacauaugguauuuuucuucuuagcucugcguuuggcucggguccaucuggcuuaagcuccgggaugcucuguuuuguugaaaguguccaaggaaaaaguagcaguuagcucguugagaugaugguauuuaggaaugcaugugagaucuuguguguaaauuccaggaagucaagucacccggagguuccacaauaaguauacuaugaaugagccuuugggggcgggcugaaccuguauaaagaaagucuguuuuguucuuacccuuggccucuagaucgucccaaaacaccuccuauuucaaaacagcuauugccuaagaccauggugagcgccugaccuguaaccuucccucuguugagguaggaucugugagaguccaugaacuuucuggaaacuuaugucaguucucuauaggucccuuuguuucagacagaaaccagcguuucagucaaacacuaaaagcaucaaugaccuaaagaagguuaaauccuaccacuuuagggcaaauuccuccuucucagguuuuucaaguauaucuuagaauuuuaccuccuuuguauccagccuaggaacacauuaggaacagauggcuuccuggagccuaagucuauaaugagugguuagugauaacuguuacucauauacccagagccuuaaucaccuaacugccauucccaauuaaaugagaauccugauuagaaauuuacauggcaucuaaggaauuggcuggcuagaauugauuaauaacaguuuaguaauuuaauacaaauauguaauaaauaauaauaaugaaaaccaaugaacugcuuaguaauuuaauaacaagugauaauaaaaaauggaacuuucacaaaaaacuuauuauuucaagugauguuauuugacuugaaaauaagccuaugucauuauuauuaugauuuuaaauguaggaaaauugcaaacacacagcaagaauacugacaaauuuaaaacuggcaugcaggcuaccuaauuuauaacacagguuucuuacuaauauaaucaauucuguuuccaauauucccucauccuggaacuaaaagugaacucuuaauuucacaaaguggguuggacuccuagcuuguccccucagaaagcauguaacuucucagauucuaccaggguugagaauauucacaaagugaagccugaccgagcacaccuauacuuagugccaauauuuacauggcuaaggcaggagaguuaugaguuacagguuagccaggacuucacagugucucuaagagcuggucuucuuggagaccccuuuccauuucuauuagcuguguuugcaggcagugcugauggcuguuucagcuaccaagaagaacucacugccaugccuuuugcuuuccucauggaucauccuuucauugcuuugcugggggucacacaucugcucuaucacucagccuuguucuuuugagauggagguccuuccuucacugaacccagagcuaggcagcuuaccaagaagcucuagcaauucuccugccucugcucuccacagagcuguggugacucucagguacugggccauguguggcuuuucuuucuuucuuuuuauugguuauuucauuuguuuacauuuaaaauguuaucccccuucccaguuucuccucugcaaacaccuaucucacucccccuccccgcccgcccccccacgcuucuauaagggagcuccccacccacguacccacaccucccucaccacccuagcauuccccuaugcuggggcauugauucucuaaaggaccaagggccucccuucccguugaugccagauaaggcaauccugcacuacacaagcagcugaagcuuagaguggagcagagacugaacaaaaggccauucaaagacugccccaccuagggacagucuucgaaucccaucuauaggcaccaaacccagauacuguugcugaugccaagaaguacuugcuaacaagagccugguauggcuguccccugagaggcucugucagagccugaccaauacagauguggauguucauaagcaaccaucagaccgagcacaggaauccugaaagaggaguuagaggaaggacugaaggagcugaagggguuuguaaucccauaggaagaacaacaauaugaaccaaccagagccgccagagcucccaggggcuaaaccaccaaccaaagaguacacauggagggacccauggcuccagcugcauauguggcuuuuaaagugggugcaggaaucugaucucaguuccucaugcuggcaucgaaagcacucugaccauuggggccaccacuccugccccuaaauauaaucaucuguaauuuuaaugucaugauuuuugcuaacguaaggcacaucucagguccucggccuguaaguuacuuacugcugugaggguuuggaaagaaagagcuaaauacuagagagguucugagaggaugccagauguuuccagaagugucaccuucaguucauuuggaggacucuuugguaagucauugaaauaaccgagguuacaaaaucaggauuuggaagguugguugguugguugguugguugguugguugguugguuuguuuguuuguugguugguugguuuuuaguuaccuuuucuaaucaaauaauggcacacaguaauaaaauaacaaagcuaaguuugucacagucaguuuggcugugauuuucaucauuaugcaacuccuacuaccuggaccacagacugaugguggacacaguuuuagguguacucuccaagucuguagugucuaacuggggcugcauggauugugaccuagggacuauuuucuuugggaagaugacagcgacacuggacagccaguguuagcaccucuaaucucuccggcccaguaugucacauagacuagucuagaaauuauggggugguggagacugcuaagcgugauggaauugcacuaauguaacuauggcagggagugccugagugaucacacaccuuuuaccacaaucacuuucaaaaugccugugguuugaaaucaaaggaaaaagugacuguauuugaaaaaucccuuuacaguuaugugacaggaauuuaaugaagcauaaugcccaguaacauaauuuaaucauaucugugcauauuuugguaggagaagcaaacuuugaaugaacaagccccuggaauaauuucuaagcaaaaggaaauauagcaagcuuuuuucccaaaacacuguagauuacuugggcaaauaaacuugcuuacugaaaagcugccagcaagaauuguguagggaaccagagaacagcuucagacuugcuggggaccugaguuuggucuuuagcaugcacgucaugugcaucacaacuacucuuauaacuccauauucaggggaucugaugcuaucaucuggcuucagaggguggacacauacccacacauaugcaccccacacacugaaaaaaaauuaagaaagcaaguagaguauaaacgagaucuggugguauaugacuguaguacuuacuacucgggaagcucagacaggaagacugauuucagugauagcuugagcuguagugaguucaaggauaggcuggucaauucagugagacucugugucaaaauaacauaguauccagauuccccggcuuaccacucagugguagagugcucaucaaguauaucugagacccuggacucaauccuuauugauggaaaaaaguagcucgcuacauguuuucccaauggacuuugauuacaauucuuuuagugacguagcauacauggaaugucuuuuccagauagguagccugauuuugccagcauaagauuugcuaaggcuuuggguuuauuuuauauagugauauagucaagauguaaagaagaagguuagagcaugucucuacagacagguuuggacaucugaaaguuacgcaaacuucuguuguguaaaugugcugcuuuccuuuaaaaacagauacccacuuaaauuccguuguaagcaaaauuaaaugaaguaaugaagccauugccguuuagucacggcuucaacaucuaccauggcagcuaucucugcuuauaagcaaagccuugggaaaggcuuguggggaaagccagggagagagaagccuugccuuugucugucuuguaaagaacucgucuguuuugagcauuucugcuuuucagguuguauauuuguucuuaccauguucugagagaguucuuuguggauagguaaaaugugugugugaaugccauuuguguguguuuauagcaguuuuucaauuauucuauuaguuagauaacucuaauagcaauuucuuugccuuuuuuuuggugguggugguggggggggggcuucaguucuuuaugucucagccuaagaaugucagaagcucagcguugguccagagguagacaaauacagacuugaucugggaugaguguuucccauucgucaucuucccgugauuuuuauaugucuuucuaauguauccauugugucuucuaaggaagguuucagagcgggaacaugccucuucuuguuaagcccuacugaauggaacucuaagucucucaacccagcagugacucccagcaggauucaaggcacugaauguacucggaagacuccuuccugucuuuaguuugguuccuuagcugacacgaacagggaaaucuggccuuaccuuuaguauccuucaucuugauuuuauuaucuuuuguuuucuuuucucccguuguaaguuuuugcuuaaaugucuauucaacacucugguuggcaccacuuagaacagaaaccaaagaaccaguucuccuuuauccuuuuauauacagagacuuuucuuucuauggcuugaaccauuuuaaucucaagugauaauuuuccauuaccacgucuacaacauuuuuugcuuguuugugugucucacugagugacauguaauaccaauuauugccucaguuugucuugcugacugagccacugcaaaaccagaaccuauugccuggauaaaggcuucugaauaacauuuucauauaacuauauuugcacuucuuuuaaaauacugauauuuaucauaugcaugcacagaaauguuugguuaaaaccucauuaucuuauguaauuaauauaugcuaauaaaaauagauauguugcaucuuaucaaacaaauauucucauugauaagguuuuauguauuggucagugagaagcuggcauguggaggacaaagaaugaucucagggguccuuccucaggcacuauugaccuuguguuacaagagugucuuuuucuagccuggaauaugcuaaguaggccagacuagccgcuuacugaaccucaggguuguccauguucugccuccccagcacugaaauaaaaggcaagcaccaccaccgcuggcuuuccccuccuaauaauauguguauugaauaauaauauguguauugaaguguaauuacagcauuuccccuucucuuccuccuuccaacccaucccauuguacccaucuugaucucucucagauucauggacuuuuugcuuuaauuagcuauaauguuccuaaguguguaaauacagucgguucauuuuguauaagauuacuuguguguauaugagauuguaaggacucaguguggacaacugauaugucauccccaguauuccagggaucaaauuuagaagaaugucaaaaauauaguaggcaauuaguacuuuugauaaacauauguauauagguuaauauuuuagaccaguuuuuuuuuuuaguucuaaaguuuucuuuuuuauuuuauugaguagauuuguauaaauauauucuaaauauuuucucugccaauaacuucucacauuuccuucauaccucccguccuaucacaauccaccuuuuuuccugucuuucaggaaacaaauaaauaauaauaaaacaaacaggauaauaauaaaacaaaauaucauaagauaaaauuaaugcaaaccaauuggaauaggacaaaacaaacaaacagaaccaaaaaggggcaaaaaacaccuggaagcuauaauauacacacaaaggacaugucagggggaaaaaaaaaaagccugauacaacauugcuuuaguuagaguuuuacugcugucaacagacaccgugcccaaggcaacucuuacaaaggacaacauuuaauugggccugcauuacagguucagagguuuaguccauuaucauaaaggcaggagcauggcagcauccagacauacaggggacuguuggagcugugagcuccacgucuuguucugaaggcaacuagaagacuagcuucuaggcagcuagcaugaggguauuaaagcccauaccuacagugacacaccuacuccaauaaguagcuacaccuccuaauagugccacacccuggccaaguauauacaaaccaguacaaacaugaaaaaaagaccuuccaaauaugccacugaguuuguuuuuuguucuuugucuacugcucggcauggagccuacucuuaagcaugguuuguuccacagugaaacucccuuauagaaaaguucuccuuugugaauugagguaacuucugggucagaaguaguagcacauguccauuucugcucucagcccuaaguacagacccucucuggcccugugcaugcuaccaucaucucuaugaauucacaugggcuuuggucccacuguguuuagguguuggugucuucuaucuccucuagcucuugcauucuucccaccacuuugucaguaggguagccuaagugaagaggggaggguuugauggagacauuacauucagggcuaagugcuccacggucucucagucucugcauauugucugauuguagaugccugcauuuguucccaccuacugcagcaagaagcuucucagaugauggcugggcaaggcguucaucuauuaauguaacagaaugacauuagaagauuuuauuacuacauuccuuuaguagaagagcagugcuugguuuuucucuaaguuccuggacugucuagucucaggguuguggcuacccagcagcaacagguauggguucaaucucgugggguuggccuuaaaucaaaucagguauugauugguuaaucccacaagcuuuguucuaccauuguguuauggaaucuagcaggugaaacacuauuguauagugaacgguuuguaacuagguucauguuuauguuucuccuuugguccuaauacuaguccauacugggggugucucuaaguaggcacaagcucuacuucucuguguugaaugaguuguguagguguugucuuuaaccauagggccauacuaucaguuuguggagagcaaccuauaggcuugguaacagcuuggauuuugggcuaguucccauguagccccuuuggccacaaacuuaauuagauauaacauauucucaguacuggaagcuccauuuggugacaagguauauagaguugggcuaucccugaauuuugugugugugugugugugugugugugugugugugugugugugauuucauuucagauuacuuuccuauauguauauguuuuaggaagcuuaacuuuuuuagguuuccaagccuaacagguuuucccuacguggcccuuaauuauaguuguucaucuuaguacuucuacccuuguaccccucucccuuuacucuaccaauuugauccuccauuccagucucuccuaccuucucuauucauaaauaucuauucuauuccuccuucugaggagaacugucccuuccaccuagcccuuuacuuucuucuacagacuguacagcccuuaguuuggcucuagagauuguagcuugcuuauugacuuaacagauaacauacauaucauauuugucuuccuagguuauccaacucugguauuccuauccauuuacuugugaauuuuuuuaauuuuauuuuucaucagcagaguaauauuccauuguguaaauguaacacauuucuuuauccauucaucaguugaaggucaugaagguuguuuccaguuuugccuauuaugaauggagcagcaacaaacagaucaagguugagcaagugucuuugugauaggauggaacauccuuuugguaugugaccaagagugguguagcuggcuauugagguaaaucgauuccuuaggaaccgccacagugauuuccacaauggccuuccuuccaagugugcauucccaccaccaauggaugaguguuccucuuacuccauauccuugucagcaugaacugucacuuguguuguuaaucuuagccauucugacagggauaagauggaauuucaaaguaguauugauuugcauuucucagauaacuaaaaauguugaacauuucuuuauguguuucucagccauuuuaacucccucuuucaaaaaugguuuagaucacuuucccauucuuaauuggguuagguauacuccugaugucuaguuuuuauaguucuuuauauauuuuggguacuaaugucuguccauauguaguuggccaguuuuuugguuuuuuuguuuuuuuuucauuaugaugcugucacuuugucugaaugauggucucuguugacaugccgaagcuucucuguuuuaccuucugcaggucauuuauuauucaagauuguuuuauauaugaaagcaugucccauuaugauagauuuccgugaagcagaaagcacuuuguucauauuuagguauuccuaaauccauguaccuuuagaauuaaaucacuguguggugauuuuaacacuauucugugaauucaucaacuucucauuguagugaucuuucuuuaaugugauucaucuauuguagcuguggacuugaaagucaaauaaccuaucuugauccaguuauauagaagaaaacacaaaaccuacuccucaaaguuauuuucaagaaauaaacuuaagauauagccacauuuuaauccagcaacauugcugcucugucaaaagaucacauccaaagacauucuaggucuauaugaucuggcuggaauauagauacuccacacaccauuaaucccucuggcuggaauaaagacaugccuuuuagugcacaccuuuaauuccaaccaauggcauaauugagggucagacaaaaagaugaaucagagaaagauuugauagaaugagcuagagaaaggauacauccgacucucaggagaacagauauaaaagagaggcaacuuaagagcagcucagagugggucaagaauggaaggcaguuccaugagugcaguucaguugaguucaguucacugcaauucagagucguucauuugaaugcaguuaaguuuaucuagugaguggaguucaguucagucaaguucagaggcaguuuuuccaaguagagcaauucagggagaagccaagagaagcuaguuugaaucagucagcuuggagagaaguuugagucagaacagcugauuugauccagccaaccagaguucagaaagaacuagaaugugugagagaauucagcaguaagccccugagacaacaauuacaucuggcagauaaguuacuuuuacauuaagggacauguaaaacccauuuauauuuuaauaaaauuuuuuuaacuuaagaauauuauaauucauacaauguaucuuggucauaucuauucuacuccuuccacuuccaacagcuuccaggccaaaacuacuccuuccaccuuugugucuuauucuuccuuuuuuaaauaacccagugccuguauguauuaggguuuagugucuacuuuuuucuauuuuuaaaacuucauuuagcaaccagguguaggaggcauaggguuccuugaguucauaaagaaaaaaacagggaaaccaggaaugcuagacacacaggcuugucucgucaaagugaaagaugauauauaaccuauuuucuauccagaagccugggaguagagucugugauauuuacacuaucugucuggcugagaccacagcagagccucccacagaccccuaucaugagcuugucuuucucagucaaucuuuggaaccuuucuuuauauuauauguacuuuacaaagaauuuugauaugguuuugucuuaagcuuuauuguaaacaaaaaauugacuuaauuaucuccaggaaauauuuuucaaaauugugaugcacuuaaguauaucuaaaauaaacgaaccaugcucauaccagcugaugaguuguguugaaucaaauuuccuuuuugccuucccugggucaacacugcugguggugcugugugcaaaggccccuacagacaggauauaaauuuauuaaaguuuguuuuaccauuugccucugauuaauaucagcuuuggaguaagacaacguuagagcuccaccauguucagugguuuauucuaagcaacuguugauucuuucugacuuucauguaaaaauguguucauccuagaguugguauaaauaguagaugaguuaguuauggacagcaggcuucuuggcaauucauuuccuucucccuucaggguggauggaaucuuauuuuuuaauuugauaucuagugccuuaggaagcagcauccauaaaauuugcuucccuguuccacagggaagcucugcuuuguauccugcaauguagggcugaaccagaacucuggucuuuaaaguaguuuucuuuccaaagauuguaaagggccagggugauggucaauauugccucauuugguccugugugugaaaggguaucuagguuggcuuaguugaagugugacaacagugccauccuaugggcuggugccuugggcugaauaaaaaggcgaaaacaagugcaguaaguaccagcauucaucccccucuucuuucuucuggacuacacacacaaugugaccagcugcuguugucucgcacuccugggccaugaccaucucuucccucaaacacugugccacauugaacccuuccauucuuuuuuuuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagugaacccuuccauucuuaaguugaacuugucugguaucuuguuacagcaaggagaaaagugacaacacagggaccacaguugaauuucacugcaguaguaacagggggucuuauccuauauaaaauuccaacuucauggcugaccaugacauuggccuuauucuuacucucuucuuccaacuuuagagagcagaaacuugcuguguuccacuuuagccucccccuguugauuauaaguguggcauuguacaggcaucccaggcucugaaaauaaagccauaaguguucuguaggaggaccuacuggucacagcagguccacaaagucaacaaaacauucagaggaaggaauuuuuuaauuaaacuuccacaccauccaaugaugaccucuuccuacuccuccccaugguuucccgggguucccaccuucuugacucauuugggagcaaaaucaaaugaagucagcauuuucuuuuggccaucaaguucaacugggucacuggccuggcucacuagacagugccugcccagucucaucucagggcagccccugccugcugugauguugucuuaguuuccuuuugauccaguuuucaccucccaucagaauguaucacagugacuaccucucuugagaauguggcaguccuuauucuuuagucucucgugcccccugaggauaacaguguuuagacccugcucuuaucuuacucuaauucaguugaaauucacugaaugucuacuaugaguugcacaaugaauuacuccugacauuauaggucaaaagaaaaaaauaagacucauaaaaucuaugacuaaaauuacaaaaguagguacugccaaggaggaguacagcuacuuucuuggcacaggaaucuucuuguggcaggagacugugauugggaguccaauuuaagcuacauaagaagauccauccucaaaaaccucaaaacucuaacaaaaccaacuguagcaugagacauuuccuggggagacagguuacacgcauguccuucacaccccagauaggaaaccacaacagaccaauucuaaguaacaaacaauucuaagucaaacuugugaaccaaugagcuuauuagaguaacuuacaggagucugugugaggaucugcuuacaagcucaugcauggagagcuacuuaugggaguaugcaugaagaacuacuuacugcaguauguccgaggagcuacuuacagcaguaugugugaggagcugcauacaggaguauacacgaggagcugcuacaagaauaggagcaacuaaaaaaaaacaacuacaucagugaaaacccugccgcaaggcuagcgaugagucacaaaaguuucagccuugagguucucugugccauuugcaggcaggcagcuagauagagaggguccuuuagacagcuaggcuuucccuagcggcugccuccgcuccaggugacuacuagcuccaucaucuuagggagggacccuggacaucuuagaagcuucugucacccuaagguaguuuccaugaguggaaaagcugacaaguugguuaacugaauuauuggaagagaauaguaauaauaguaauucauuuugagugucuguguguacuuuuuuuuuaguacaucuuugaguuuguguuuggcaagacauauugcugcagagauuuuacucagccauggugugaaugcaaagcucaagaaggcaaaggaauacaugcuuuccgaguacauauauauaugugugugugugugugugucuauacauauauauauauauauauauauauauauauauauacacauguguguauuauacaauauauaucaauaacauauauaauuauaauguauauauuaacauauccauaauauaaucuucagccuaucuaaugcuuccuauccacauagccuauaccacugucuauuuuucuagaguucuaaauacuaaaauagcaccagcccuguacauaucacaucauagacagagacaucagucaccuucaccuaccacuuaucguucauaaacuucaacugaggaaaaacaaagcaaucggcuucuaccuuaggaaugcccagugaguuaggaagcucaucuuuacuuuccagagcuuuauaguugcccuugagugcuugaacaccgaccauuagauggaaugauuuuaagugagaauggcuugugaaguaaaauagagaugccauaaaucucuaaaaacccucuuaagaucucccuaaggaaagucagcuuagcauaucauaauacaugcugucuccugcugcauauuuuggagcaaucuuugaaugccugcuguuccugucauuaauucauuuuacuuagagauuuuugaacaucaaagcaacaaaacucaauucaguagaccacugaggaaauggaauauucuggucaauuuaaguaucuggguuaaaaaaauaaaccuucuguuucuggaugauuucuggucucugugucuaaauaauucuguugcauuugacuuuauguugaaagcuguaugauaucuuguuuuuucaaggcuuagugaagauuccucgcagcuguauuaauuacuuuacaucauuggaaauaagaaaggcgguuaccagaaacauugguucucaugcuguguaaauguaggucagaugugauguucuuuccccuggcugugacacuuaacuguccuuguuagaaaacuuuggucuuucucuuucuucuaaaaacuugaugcaaaaacaaacaaaaaaggcaaucagugauagcaauguuagaaucguaaacgauacaguaugaaaucgaggcacuaguucaugacuacauauacauuuagaaggcauagagaguuuaaagaaguaaggucuugauaguuuaucuucaaagaacuagaacuucugguagaucuuaaaguuuguucuacauuuuauuuacagaacaaauagugagucaauaggccuucuuaucccucauugcugauuugacuuauggaucugauucccauuuuaauuucagcaaaaugauggcaaaagcuagaugaagacagaaauaaagcaucucucaaugguuugaaugucuguacugacucagcauugcagugcaauguucagugugggagaaaagaacaaaggacagaucaguuguaaacacuuuuauccugcacaaaguugauguauuuaauaauaauaugucuuuucagaacuccaaaaauggucacucggaaaguggaaccauuacaaaagccacauuuuucuuacuggguguguuaacugagcaguuuuaaucauaaccuuguguugguucucucuugugcucaacauggcaaagaacauaaaccuuuuaggaaauuauucgugcauuauuaauauuugggaaaagcugcuugaauuucuuuggugcaggauuagucauaagcauuuuuaccugauuaauauuuuuguaaacauauuuaaauuaaggaggaaaacuuaaauuuguggcauccucuauuuuuuuuaguuccaaagcuaaaaauauuuuguguauuuuccuaagaaaacacaaggcuacacaauguuaauauauuuuguuagguuucauuucugcuguuuauugaguuaugaagcucuggauaguaaauagaaguguuacccucugccccguacauaaaucucucucucucucucucucucucucucucucucuauauauauauauauauauauauauauauauauauauauauuccacauugugacaauguagcugccuuuucugccuuagaggaauucuuaaugagugcuagccucauuuuuucauuucucgaaugucugucacacccucugauauguuuauguuuaguaucaguaucuauaucagucugagguacugaguucugucaguauuuugacaacuaccuuuagaucagaagguguccuuuuucuuuguguguguguguguguguguguguguguguguguguguggugugugugugugguguguguguauguguuuggcaauaaugacauacccaagacuggauaacucauaagguacgcaaaauuauuucuuacaguuuuggaggcugagaaguuucgagggggcucacguuuggcguagaacuucaugguauagcacgcaacagugggaggcagaggagggcagagguggggaauggagagaaaggggaggagaagggggagggaagaaaaagggucagggagagguaguuaagggaggaggagacagagagacauaaacaaagaaacaaaaacuuggacugaaucugcugccugggagccauuuuauauucaccaaaacuauaugcgugagagugagacacccaugaccuaagcucuuuagaguguucuacuucuuauuguuauagaauucaggauuaauuauccaguacauguuuuggggggaaauuaaacuaauauaauucuucccucuauacgccagacucauguccucucacagacaaaaugcauucaucccauugugagagucuccaauaccuucagguacuucuugaaucaauucaaaagcucaaaguucacgcucucaucuaaaucaggaacagacaggacucuuggugcacaguuuauucuggggaauguuucuguccagcugugagccucuggcauuaaacuaguuagcugcuuacagaauacaauggcagauaggcauuccuaugccugaagggaaaaucagacaagaauagucagccccauguaauuucaaaacccaacagaggaaacaacaugaaauuaaaguugcugcuuaaucuuugaugucauaaccaucuuccugggcacgugggcaagaggauuggacccacaaggcauccuguggccucacccagaugacuuugcagggcguacaguucauugaccaucucauguauuuggagucuugugccacagugcuccuaggcuccauuaguguguugaaauucuauagaucuguagacucacgugcuguuccacucuucaacuccacugggcauuucuucuagccucaauucugauugugugcuuggaguaagauuuucacagcccuuuuuauguggcccuugaagucuaagagucacugcgugguuccaugaucuccuauucugcacacguguaaaauaaauccuuuguagauguugccaaguuuauggcuugugccugcuagagcuaaaccugggccuauuugagccucagcucuaggucugaagaguauaagagaaguucugggcagugaaugcggauguccuagaaauguugcuuuaaagucucauaauguuuaugcuuauuuuauuaguaauugacuuuucaacacauguccugaagaaacagucaaaccauuacaaaaagggcuuauuuauacuuucuagcauuuuauauuggaugaaugaauuaauuucugugguaaugcuaaauuuccagaauuuuuguuuaccuacacauaaugcuaauugcaucuccauuuagguaacuacucaguauauauuccuuggcucguugcugugauucaggguggauggaggcggggagauucuugauucaaaaauguauguuacugaaggauuggacucugagcugcuugcaagcacaguauuuuuuuuucaugucaucacagaguaaguuauaggagccacaaucuuaucuuuacuaaaauuagcacucaaaaguggguccuuuacaaggucaaacagaaagugaggugagugaguauguucucgaaggauguaagaggcaaccaugaauauuaacugcauauuguccugccuuucucacuugcauuaaugcagcuuuaucaucugggugacauggcguauaaaugauuuaaggguaaauuugaggacaauagccaccuuucuuccucacacucuugaugauccaaaauugccauaagaaguauuuuaagcagaagcaauaaaagaagaccuaaaccauacugacucacugcucccaaauguaaugauuuucaaguaauugcauuuuuaaguacuauaaauauaagaugagcuaauagcucaagauugguucaagauccucuaaugagcagauagccguaauuucuaauuagcaucuuacauaccccccccuuaauuagugugaauuggacauaaaaguucuuuguauacacacugaaauggaccaugaaaguauaauuuauugugauuaccacugaagugcauuuuaaaggacaguuuucuucugaauacauggacacucaucugcaaauacauuuaaccucuucgugagaguuuaucuacaagaugauaaagaauugaacagaccauuaguggauuaugguuuacugucccugagaaauucuaauuuaccuuuuguccaugaaaaaaaacuguguaaaacaaagguggacucucuaaugugcuaaugagacuuugcuuaaaggcuuuggcuauaauuaguuuuacuauggauuucuuggaaaugaaaauguaacauaacaaugugaggcagcuccuccaaaugaauguugaccugcagagccuggaaccagugagauuauuuugugccuggcagagcuuuccuguuuucaacuucuuagaaaauuuuaguagcuauuaaaacaauguugugcagaggaaaggggaccagaaguccuucaaguccuucagcucucaucaaaggccuuaaaccaucagcuaaagagauuuggcuucuccuaggcuugacuuuccugucacuugcugagccuuugguucuucucaggccaucauuguuucugagauuuacuguuagauugaagauagaauuauuuacccaaggccuuucauaauucuggugcccauaucuuugccugcuaagccauuucaaagaaaaagagagugacagagcaggaagaagccccagaaguugcuugauaggauguuccauuuugucagugaugaaauuugaggauauauauauauauauauauauauauauacacacauauauauguguguguguaauucauauguauuauguauguucauauauauaugaaaagcauaucgaguguauacuagaauaggcacucaaauggcacuuuaacaaugauagucuuagauuauguuaauauguaguaguuucaaguuauugaaaaucaucggugacaaauaaaauagaaugacuuccuuugccaccagccguuuucuaacaaucagagccuucaguguucuucuaaacuggguauuucugcucuuguucaaacuuaagucccaaagaauauucaagucaguuugaauuaagucauuuuauugguuuggcuggugccauuguaguuacaccucagcacacaaaaggaucaccugauagacucaucacaaggugagaauaucacaagucaauaaugcauucaacacaccuaucccagaugacaacugagcaaaauaggaccuugauaaguaucugucauuugcccuugagacagugcaccucacugggaguuugaauaggaauagacccauagauucacauauuugaauaauugguuuccagcuguugaaacucagaacaauuagcagaugugaucuuuuuggaggaugugugucacuaagggugagcuuugggguuucauaaguccacaccauuggcaaucaugucuuauucuuucucugucucaugguuguugugucaacauguaagcucucaucgacugcugcagcaccaugccuaccauggugaucauggacuaacccucugaaacuuugugcaaaccuucauuugaaaccuuuauuuuauguugucuuagucacagugucucuucacagcaauagaacaguagcuaagauagggaauguaaucucucagcuuccagaaaccaucaccaggguauugcuugccuaggaaaugaucaaaauuugacaggcucuucccagugaaugugcauagcucuuucagacaguugugaaguggaaaaaucuuuugugaguugagugcuacugucuacauucacacaagcuuuuuuuuuuuuuuaaauuaauacaaauaaguguccuucaaacuuuacaauugggaagauguuguugacgcagcuuucuaccuacuuaauuuuaucccauagaaaacagacauguaaaaguaagauuucuuagcucugugcucagaacugaucagcaucagguagcucuuggcucuggccaucgucauugucuuugacuauuugaaaaucaucauuuaaugaccucuuaacucuaugugcuucccuuucauuuuccuuuuguuuuucacucuuagauuaauccauuugauucucuguagauuuuuaucuacauuccagugauggaauaaagaugaaaagaaaaguaggaagucucacuagaaugcugauguaaucaaaaaaguaguuugucauucuuuuaucaucuagucauaugcucucaauagauauuauuuauugauuuuauuguacuucuuuccaaaaaccccaaauguacuuugcuagauuuucugucuuucauauagaaacauugaaguugcagacuauaauagugucuguguuaguguaaauuagcuguaucaaauuuagagcugauuuaaauugaacucauagaaucuguucugauguguagccaucuauauucuuaauauguaaauuuuagagguaaaaauugacaggaaggcuauaaugcucauggguucugcuuuggaguuggcauucuuuaguguguauuagucuagucaauuaacaaggauguuuuuuacucugaaacuuauuuaguaugagugugugugugugugugugugugugugugugugugugcauaugugcuuuuguguguguucauacagacaucagggcacauguggaagucagaagauaauuugcagaaauugcuucucuguuugcaucacauggauucuagguuauacagcuauguucaccaagcucugugaucaagaacccuuacccaagcuaagccauuuuucugcccacacuuaaaaaauacuuugcaggaaauuacauugauuuccacucaaggcuacaugcugaauucagccuggcaacgagagugacagggugacaugguuccugccccuggaacagagccagcagagagguggccuccuguaguauugaugguuuuugugggcauaaugcuuguuuguauaauaauguacauauuuucauguucuucauuugaggacaugacucuccucucucacaaggugaaugacucgcugauaaucagagacagcaugagucuggggggggggagggugugucuaaggucucagcaaaauaguaaaaugcugugaccuucuggacagcccuuaagacuguggggaaaauggugaaaccaugaguucaaauauauauaauuucuuaacuaugcaaaauguacggaugcaauaugaauuauaugaggggcuucuuggaccauauuaaaacagaggccguugcacuaugagccagcucgucagagagauacaaaggcagacagauucccgaguuuacagucagccugggaugaguuuagguccaggcccaagugugguaggaaugguaauuucagggcagaguccuacccaaauaucuuacuaucuaugcuuuacaaaggcuggcagauaucugaauuauuuugcaauguuaaaaaaaaaugugcuugcugucucuuccuaagaaucaaggggcaggggucaugggaugcugauucaugggacaaucaaaagagagcaugggguaaagacugaauugauagguaaauaaaaggcugggguuuuugaucugcaagaggugaacuaucuagagagguuuuuagaauagcaagacaaagcugucuugaacagaacguaggccaucagcuugucacccacaguuugacuuugaguccuuuguuucacuauucucaaacagcucuuccucagaacccgucuccaaucccaggcugguccuuggcagcgacacagcagauaguacagauuucuagagacugacauuuucuuaaguaaucccaccauauaguggaaauggccaguauacauacaugaaauauaguaaaauguuucugcauagagacaauguggggcaaaaagggauccgggagagggaucccugcugccucucaaagccccggugagcacucauaaagcuaacccagagagagggcugcucacuugaugcaugccacugcgaaggaaguacucaaggcugcucgggaaacgcuuuccccaaauccuucaaauccucagaucauugcugagaaucuccucuaagccucucuaaaacccacaccuccuacgaauacugugcccuuucuuaaaggaagaaaaaagaaaccaagucuuguauuugaccuugacagaucacacccagcaaccucggccuucuacacuucagggcuuuuacuagagguguagauuagugauugacgcguuccccuucccuuaaccaggcucugccugugaucucagugcaaacgucagucuuacucauaggccuagguguccauagagacccaaccaaaaaauaaaauaaaauaagauacccaucuucuguaaauauaaggaaaaaaagaauacugcagagagaugcagaagaacucggucccuuuuauuaaacuuuguuauaugaacauaaacauucucuuucaaaacucguagaacguuuguacuuaaucagcuugucaucccacaagugagcggagaguaaaggauauuuauugccaggaguuuuaaucaagcggcugaaaugaguguuagauaccuacugccaauuuuggagucccuguguuuguauuugcccucagcuuucuucugacuaaccgggguuuaagauucuucacucguaaaguaagcauucguagcuaagcaguuuggcaggagugggacauaaacuaccaggaagaauaagcugagcaguggccuuggguggggacagacggggcuugaacucugagacuucuaugcaaagccuuagggaugcaaugugacaaggaaaugcagccugaggcuuucuuagauaacucucugugcuucuguaugcuuauacuugcagcagacaggaagugugacuaaaacugaguguaugguggacccucuccuccaccauccuuauaaaauucugucuaguagcaagaccauaaauauuggccccaucauuccguccauuuucauucuuuguuuccuaaagguuuugugcaugucuguauuguacaucaaagaucuucccucuccuacccugaugcuuccccuuuucaaaucccucccuccuguaccucuaggcaacuuuaccuacuuucaugucauuuagauaaauauguagguagacagacagauagacagauagaugauagauaaacagacuagacagacagacaacagacagauagacagauagauagauaauagacagacauauuuacagagguuuguuuuaauguaugaggcaaggcauuauguaucuaagaccuggaccucaauguguauauggccaagaauaaccuugaucucuugauucuccugccuccagugucucuaccuccagagaguuguggauugggaguugaacccagugccccauacaugcuaagcaauuccuuugucaaaugaagugaaccccuauccuccuagauauaugcuaugcacuucuagcuauucacucagcuaucuggauuuauguaccuacagauccuuuacuuuuguguauuccucugucuuugucagugauugucaaccauacucacauacuagagaggguucucuucuugcaaaauuagccuucugauuuuauaacuuauuaaguuaugugagcucuugaaucucgagacuccuucuuuccuccaagauggaaugcuucaauuuggagcuacacaacacccugauuguaucuuguaccccaugaagucucauuaguacaaagaucccaucucacuucuguucagaauaaaccagugguuccccauguuuaugugaguaaaaauccaaguuagaggccuauggaaaguuucccuuuucucucuccaagccuuuugcccugaaggcuggccauaaucaggugcucugaccucugaaauaaagucguuucacacuagaaucagggcagagccucugcaaucccuggguaccuucuccacugcuucauuucaaguaacagaucuguaugaggaagacaccugagcucaaagugaccucauuugaugcaguuagauauuuauggaaggcaccugacagauuuuuuuuuuaagccuacaggaacauuuaaaaacaguggguauuuauucccaggaauguguccucaaaauugcaaauacaaaauaucuugggaaacagggcuuuccacaaaaauaaaacaaaaucaaucaaucuaggaguuggccaaacagaaagcaugacugugcucucaccgaacaaauaaagucaacgguccauccucaucaccgugagacaggacaacguuuccagaaaagucauaugacauaaaucucccgauggcuauaucaagauacaaacuguguccccuggaaacugugugagaauuaaaaaaaaccucaguuuauguugauauugaugucacucugcauacaaguuuaaaucgaauuaugucaggagauagagacaaaaugacucuuuagauguguuuuauguucuuaguuucuuuuguguuguuguugcuuuaguuugagauaaggucccucagcuucacacacacacacacacacacacacacacacacacacacacacacguuaagcgcuaguccacagcacucguuugcuugcucuugaacuuuguauaaauagaauuauucaguaaguaacaacuugcugucuggcuuauuuuuaaaaauauuuuauuaauuuuugauaacuaugaauguauuuugaucauaucaacccacacuuuuccccuuaucaccucagauccauucccagcucaaaauuuuauuuuaaaauaaauugcccaccaacucuaauuugugcuacuuauauauauuccugggaguaggacuguccuccugaauguaguugacacaccaagagccacaaacuuaaaaaaaaaaaaaacaaaacaaacaugauugucccucuccuagaagcuaucagcuauggacagcuccucgggagugaggccccccccgugcucccucccacucugugcuaaaauguugacaggcuuggucugucucugugcuccagugagauaaggggcgcuacuuacaggaacauggacgagggguaacauuaaugagcaugcgugacugaagggcagggauaucagcaaacagccuacucuuagcaugcauuaaccccccaaaguugcauccguagaccacccuguaugauuuacacguaguucagugacgucuccucucugcaguaguuguucguguucuucccuggggagcagcuguguggauuuuguaacugacugagcuccugagccgcacacacuuuuuguuagcucuaggaucuugagacuccuccuuuccgcuaagauugcuucaguuuggaggaaagagcuacacaauaccacuccccgauuguaucuuguacuccaugaagccucauuaauacaaaguucccaucacguuucugcucagaacaaaccaaugauuccccauauccgcgugaguaaagaucaaaguuagaggccuacgcaauguuuccccuucuccaaacccuuguccccgaggcugaccauaaucagacgcucagaccucuggacaugucuucuagcacaagcauguuucugaucugccuucucugucugcagcacucacauucucucucugcaucucuauaauucuuuuaaguuuagcuuccaaugaauccuucuucuucgcccccccuccccccccgcaacauuugguuuuucgagacaggguuucucuguguagcccuggcuguccuggaacucacucuguagaccaggcuuggccucgaacccagaaacccaccugccucugccucccgagugcugggauuaaaggcuuaagcccccacgcccccaaugaauccuucuuaaggagaaaccugccuccccaucccucuucacacuuccaauaucuuucaguauuuuuucuuuaucuugcuguuucaauuaccauauaauauaguauuuauuuuguucacuauucaccaugucuaugucucagucagacaagaauacuguuuucuagaaggcagacuuacaaaaauauaucuguuuguggccauagucccaggugucagaacaaugccuggaacauagugugcaaucaauaaauaucguuuguuauauagaaaccacauaagaacugguauuugaauacugaacuuuaguauuuuugguagaaguaugcaaagugucuguggaggcaaauacgcguaaaauaguuagaugauuaugaaaguugacuuuuaugcuugcuucaaucacauagauccauuguuucuuuauaaaaacccuugugccuuuacuuccaaauuagauacuuaucuuguugauggagccaaauaucugaagacaaacaacguaaagaauuaaguguuuauuuuggccgauagcucagagagauaccgcccagcauguuagagaagccuugggaacaggcacuuaaggcaguuaggcacauuguacauccuguauggaagcugagagcagacagcauguggggaugcucucugaaguuuucucugcucccuaacaccccacaaucuuucaaaacaucaccaccagcuggagaucaauuguucaaacaccaugagccuguugggggcauuuuacacucaaaccauaacauaugcuuaccccaacuuaaggggguuuguguguaucucuguaucauuuugaaggucuagaaacaacuccucuggccccaccuucacuuaccuacuucuuucuuauuuuucuugucuucauuauuuucuugaaauacuuuaaaguagucgggcugaaauccuacuacugcugagauaagaagguaccugcauaaagucuauauacaauauguuuuucuuuggaguaacuuuuguuucgauugucagagcuuguacacuucuaaccccugugccuguacaaccaugcaugcguuuuaaaauggagcuuugcccuguacagugcaagacuccugugcagcuggaccuucucuuucagcuuugaagacuuuccacaaacagucugccagcacagccucuguuucuuucagugguuugcagaugggugcgcaucauaggccaauaagaacuccugugcacugagccacuuccccagcccugagaaccugaagggaacucagaacccauuuaugcagauaugugaagaaaaaagaguguucugcuggguuaaugugguucucccacauucagggagaagcaagaaggcuaggggcugggagaggaauaauaaaugaaucacugagaauaugaauggaagacaugagaaggccuuaccccaaagacugggucuuaaacacgcaggagaguuagauaacaaccaaauuaaaguauaaguuauaccccagggagggaagguuguaauagaagauauguauguuaccuucaugccagcacagcaaauacccgagacaauuagcuuuucuagagaaaauguuugcuugggcucagucuugaaagucccagacuacaaugcuuggcccuacuuuuuguuugcuuuuuuuuuucuuuguucuuguuuguuuugacguuuuuuguuuauuuguauguuguugguuuuuucuuucuuuuuuuuuuuucucuuuuuuuggcaugugguggggggaaaauaacuucuuacugguagccaagaacaaguagaaaucgccuucacagaacauuccagugacugagggacccucacuaggucacaccugcuaaaguuccacugccucccguuggugucacucuaggacugagcuuugagccuauggaucuuggaauccauucaaaauccaaacuuuagcagcaugcucgagggauggagugagaugacauccuugaccuagaagggagaccaggcagaagcaccuuaucucugcuucacuggugcccucucccuguccugggagccgaagggaagauccaguguguggaucaaaccugucaggcgucucugcuguuccuuuagguacucauuugcuguggauuuucuaagauuuucuguauucaugcucagacuuuguauggaguauaauuacaaaagcaagaaugaaagauacuagaaaauucaucuguaauguuaucuuccuguugacucaccaucuucuguacuauagugcacugguccuacaggucaagguaguucuuaaacuaucguaaugggccuggggagagaacucgguuggcgaaguaccuccugcacagacaugaaggcucgcguucacuuccucagaacccagaaaaagagccaggagccauggaucaugucugauauacccacagugccagugucacagggggauccccuagauuucauuagucagacagccucacucaauagacagacuucguguucagagaaagguccugucucaaaagaacaagacagagaacuaucagagaagauuccuguugucugccuugucucucaaugcacacucacacacauccauaggauggauaggaaugugaauuucacacacucacauacaaauuauccuaaguaaaugauuuuagaacugaaguuacucaaaagccuuuuaaaccacucuguucugagagauauguauugcuuugaauuaaauuuccauuuuuaauguuuuuuuuaacagcccagucucauguacauugcgcguaccaacacaguaagggaaggaaggaauaucaucaugugcuaauggggggaauaguucugccaucacggaagaggggcaauuaacacuucccagaaccuuccugcucacagaguuguaaaucucaauuugauuucaagcuacuagacucuuuuauaucucucugacuagauugagacagaagcuggucuaacaugaaaguagacaucuaauaacugcuccuugcucucucggcauacugagaacugguaaucaaaacuuuuuugaccugcugcugcugcugcugcuacagauuuguucguuuaaaaugugauuaaugauaaaccuaccaggugaauaugugacucucauccaagcuuuagccccuguuuuauaaagguaaaaugguagauuauuggagucagaucuggagaggagaaaaaaaaaucacagacuguuguggguacugccaaagcacuguugcccccauccccggagcuuaaggagugaagacauuuggugaugcuuucugcaggauuuuuaaauguuauuuuuaaaauaaauaaauaaguaaguaaguaaauaaauaaauaaauaaauauuuaucuauuuuaugcauaugagugguuuucugugcugguguguagauggaccacaaccaugcuuggugcuugugaagagcagaaaagggugugcugaucuccuggaacuggaguuacuaauggcugugaagcauccuguggguucuggugaccaaaccuggguggguccccugccgaagcaacacaagcuuggagcaacacaagcucguaccacugaacucucucucuccagcugagaagauuugcuucucuguucugaguuggaguguuuugcucugaacuucugaaaauagucuuucacccagauaugaaugcacacagcauuucuuuuguaacuuuuagaugaaagcugguguuaaaaugccaaaugguugaaggaagcucuugaauguuguuuuaaaucccugugagcuuuuccuuucuguuuuuguuuuguuuuguuuuaaauggaaaugagccccuuuuccauucuuuacugccuggaaaauaguauauccucuuucaacaaacuugggagaugaguccccuacuagacuugcuuguggcugugagaauauccauucuuugccauuguguagccuuagcucaucuugacuaaugcccuucaaaguauaaauaggaaaauagagaugagugacagggauugauuagcagucuauuuuccaacagaaacaauaaacccacuggauaguuugccagcucaaaagccugagaaaugcauggugaaauaauugugugugugugucugugugcgucuaugugucucuaugugugugugucuauguguguguguugugaucacguuuucuagaaagacaaaaagacccuaccuggucuuucuuaucuguaauacuuaugaacgauuauggauauaugggcuuccagauucuaaugaaauggaggaaaaugcuuccuuguggucuuuucaaggggauuuuucgaguaaaaagaaauaggguaauauuaccgccaguggauaaacaguauucauaucauaaauacuaguauuaccuuucccuuuccuugcccagguccagcaaucauucagggugggguuuuuaguaccagucuaggugacaaaggaaggagagcuccggucacuuguaacaggaaacugugacagagagcggaggggaaacaggcaaucccugcagcagcugcaaucauugcaggagagaggaaggagauccugggcuccugacaacuuuggcagcagccauuuaugugaagacaguucuuguguuguacacagacagcuauugaccaaagaugauggaauuauauauagccaaggggugcuugggucugaucaaagaauggaguaagggaauuggcuuagcuugcuggagaaugagaucauaguugacauaaugcugagggaacaggacuuggaggguacaucugaaauugaauuuaucccuuucucagcccuuacugccugcucacucugcaaccgaggcuuccguucccagauacaguccgagagacauuuguugguuucucaguguccucugggaauuaaaacaaaaugaaaugccccugacuauuuuucaauagcuuauacuaacugguacauaugucacugguuugccgauuauuguaucugaucuagucugguugaauaaaucauauuucauucacuccaaggugaaguuucucucacuugcagcuucugcuugcugcagauguccauccaucagugcauuaagagcuguggugagcacuguucccuugcucaguccacaguaucucuuccucccuucucuccgcccaccugacuucuuuagaguguaucuauaagcagaacgcagagauggcaggaaaucccuccagaauagacaucaguuugcuaucgugguuagugaacuugacucuuugugagcauuuucuuucagagguucuuuggggugucucucccucuucuuucuuugugucucuuuuaugugugggcuccaauacucuacuggugugcugcuucgguuuugauggcaauuggucuagcucacacuggugaagaugcagaacacaguaaccuugcagaucagggauacugagugggaaauucucuccgguaacuuaccagggauguuagagcagggcguguggaugagagagcaacugcuuuguggccagcaauugaagucaugcaaauggacacaguugccugggaagagauacaguggaccucgcagagacacagagggagcagagggaaaaguuucuagcuaacugacauguaaguguuacuagggaguccacccagaaucaugccuaauuacauguguauuguuugccccaaaucuggaucuuuaaauagaucuaccugcuuucuuuacccuaaaugugaaccuuuaugacuuuauuuuaauaggaugugugcccuauacuguuuuaaguuuuaaaaauugcugcuaauuuuacucuggacccuuuaguucccugacaaauguaacucuuucucuuccaguuguauaugaacacagaucaagauuagagaaaucuuugcaaaaagaaaggcuugaacacaagaaagcaaaggaagguaagacaauaugagcuugugcccugauauuuccuccuacccuucuuugauguagcaugaauuugaacuaugaugcauuugguuuuguauuuuguuguuguuguuguuguuguuguuguuaagcugucucucaaaucugccugaagccagugcuauaagugggccgagaaagagcugucaauaaauguguuauacacagugcagacauuuuauauagucuuugucauggggaaguagcccuuucuucuccuuugggaacucaagacagauagcaaguggaagaugugugagcuucaucaccaggucaugacucaaagggcuucauuuccuucauuccuguagagaaccggcuguauuagaggcucaggacuguguuuagaagcuuucccuucuguuucugcagccuucauggacuguguacauugccauacaaauuauaucaaaauuaacacaugacuucccuucuaaauauuuuuauuguauauuuucuuuauuuaccuuucaaauguuauucccuuuccaggccuccccucuggaaacccucuguuccaugcccccucccccugccucuaugagggugcccccccuacccccacccacuccuuccuucccacccugacauucccucacugcaccaaaccucuguugaugguugggguuuggaaaacauacauuguuuagaacaugacacuguuuauguaaguuuguaacucagugaguugaccuucuaccuggaaucuucugaaugaagcagguguuacuauaaguucaugaaacauuugccuagcccagcuguucagauaggaauuaccacuuaacacauugcuuuuugucagagcuuuugaagcaagcauacacucuagcauccaaguacuggaaguuaucugcacucuuaggucugaugcauucauguuuugugaugaaucuuggaauguaaacccuuggcuccuuuggugaguguggggugggugcuggguacuauguaacccucuccugacucauaggaugcacagacuuaaucauucugagaaaugcuuucagacuugucuuugccaggucuuccauugcagaguguuuuuauagagccaucuaguggauaauaaaguuucagagcauuaaagacggcuugauugccguuucaguuccugaaggaauuuagugugcccucuaguggguagcuauaaaucacccuugucucaaaugcacccucuccgcuuucaaaggcagauuucacagagauauuguaagugugcuauuagucacuugccaucgauucuggugaugcagggcuugaagacagcagggagaguggaaaacuauaagcuuugucaucuguuuuccaaagcuuccagagguaacaugauguacauaaaucacuagguauguugauuugaaaaaaacugguuaucuuuuuguaaaucugaguaaaguauauagcauuuuuuucucagagaugcuuaaagguuuuuaaauagacuaacuuauacuuuacuuucucuauuuuuaucuuuccuagauuuccuuguuuauaaguuagaagcacaagaaacacuuaacaaaggaaggguaaggcuuuguucuguuuuggcuuuuauuuuguucucaugaacuuuaagggagauaaaaauaccacugcaaaaaauuuuacuccauuuauuaccagcauaaauggauuaaggguggacauacauuuuuguuaccaaaaaaaaaaaaaaaaaacaaaaaaaaaacaaaaaaacaacaaaaaaaaaaaccaagaaggaaaccaagagagaaacuuguacacauuguuuauuuaaaacuuaucuuuucuuacuucuugucgcauuacugaugacuagugauaaacuggggcagcuucucuguggcacaugagguuuguuugguuguguuuggaucuagauuucgauuugagacagguucucauguaugcaagaagacgucuaaaucauugaguagcagaggauaacuuugaguuucugaucuuccuaccuuaaccucccuagugcugggauuauaggugugugcuacugugcgugccaacagggaagcucauguuuauucccucuuugauuugcucauggcgucucuuuucucugacaugaaagacuucuguuugcuuacagaguacuaucaaggaggagaacuaacugccuuaguguucacauugcaggaaucugaaggaugaauuauggacagaaugagugguauuggcauuuaaaaauauuuuaaaguuaaaauucgcuggagaaaagccagucuuugucuuacccuacagaaaugugugaguguuaguugaauaaaacauuuguguuuagugauuucaaagcugaggaaagucuguucuuugaauugccuagaggauguuuucaacuuucaacucuaaguugcuuuuaaaagccugaaccagaccucggugcacccaauuguauauuuuguaguguaguuuccuuaucaacuaaaaaaauaaaaaaagaauaaggcaggggaugaaugaugaaccagaaguguaguuuauuuuaggagcuaugagaagaaaacccgggagugccccuguguggugauagcacagccggagagugcugugcuagaccuucacccuagaguagcgaguggcagccucggauguugguaccagaagggcugucuguacagcugcuccauuagaucacagggauguucuagaauguggcaucagaagggagacuucagcccucaucagcugggguucaggcugcaucucucccuuuaguacuguguaaaaguacugguguugguucugguuucucacuguggagguacaauaaagauuaugggaauacccacugaaguugagggaagagcccuuucgauuccucuauuaagacagccugaacuggugaaguuugcucuuaacugauggaucucccaccccucccaccuguccugaccacuacacccuauauuaguuaugcacaguaacuuucagaaguucauugaguagcugggcaucuuggcuucuuuggauuaugagaaauaagcccaaacuauuucuaagcauccugucaaccuaucauuuuaugauugugugucuaaucuuuuuauuacucagaguuuaggaauccagaagaaaauugaaaccucauuucuguuacggaguggcucagugguagagugauugccuaguauaugcaagguccugaguucaaucuccaguagugcgaaauaaauaaauaaauaaauaaauaaauaaauaaauaagaaaugucccuaaagacaugcucuuucuaacagaguuuauguuagcuuacaaaagcaaaaaugaaaaaucuuuuauuagggaaggaagcuguucacaacaaaagaacaagaugagcuaucuuuuauuaauuugguuuucuuuuauuuacagcaagauuccaauagcagauauagugcauugaauguccaacaucagaugcugaaaguaaguaaccuaaacugucccguaugaaugaagaagggagcagacgacauuugaaaugguuaacaaugucuaauauaaacaagaaggguucgagaaaguugacuuggugaauauugucauaguugucuaaaaauugugauuguuuauuaccucccaugauuauuacuuuuuuuucuuuuuacaaaaaugugguuaauguacuaccuacuuuuuaauauaauaauugggcucucagguuaccuacuuuuaaauauuuguucucuuugaugucuuuagaguuugugcuuuauuuagucucucacagugguuuuuccuuuauuguacacagaauggaguguguggaaccccaaagcuuugucuguguuacuaaugacugucuaagagaugcacuuuuagcuacuugaagaacacagcuuauauuuuuaauauuuccuuuccuugggacuuaggaaaaacucccucuuaagugccaaaggaagaucuaaagcacaaaagggaaaguaagcaauucauugauuccaucagccugguagcacucagcaccaugugcaaauccucccauggucucugccccacauuaguccugggugcuaguuuucugcuuucuauccauucacaucaguaggacacacacccucuguucaaacuagaaccuuucccaucuucaggagugcaguacuuaaagcaagccuuucugccacauaagcauuuggagacuguggaauuuaaauaacuuguaaugauguuguagaauuccgauaugaaaucauaugaaugaaaaugaauucuagaaacacuucauuacuuuccccaauggcaagauggucuccucugccucuucacuacugcagucacugucaaaaugggucacuacuaaacugaaaaucaaagaaauguugaauaaagcggcccuucgugguaaaugcuccugccuuugaguauuucuaaaaaaucuagaagagaauugagugcauauugaaaguaaacagaauuuucuugccauuauuucuuugauauuguagucaauauaacaucagugguucgcguagcauuuaucuugaauuaggaagaagaaguaaucuaaaaggauugaaagcauggugguagauacaugcaaauaccauacgaugaagagucuugagcaguuucauauuuagguaacuuaguuuaaaguuauccuuggagccucccaugaauacucugaagccuugaucuugcuuguucacuagagaaaauacacaaaguagccaagguuaaacguauuaucuccuuucuaugauaauuugacuacagggaaauagccucagauuccccgccccccuuuuucauagcuugggcuagcuucucacucauauugauguuuaaaaccaagaggagguuuguguuugaacuugaucucagacuacucaaguauuugaagaguacaggaaaugaaagggacaaacagacagaacccaaccuuaagaacugagcuuauucuaccaugcacucucacauuucugacacgagaaagaccucucggugaagaaauaaacgcugcaugauuuagagacccugucugucaaguguucaucuugcagagucagcaugaggagcugaggaagcagcacagugaccuggaagaggaacaccggaagcaaggggaagacuucaguagaacguucaaugaccacaagcagagauaccugcagcuucagcaagaaaaggaacaagaacuuucuaagcuaaaagguauuggcuagggccagagaugccuuuguacaccauuugaacaggaacgcacacuagcacugugguccugaccuucuuuaaggccuuuagauuauuuugugcuuuuaacuuuaauaaucacauggaauagcaaucucauuuauaaauaauccaguccguuuuuacucuuuuaauuuuugcuuuaugcaaaugguguuuugcaugcacauaugccugugcaccacaagcaugccucgauucucuagaggcuccaaaaggggcguuagaccccccagaacuggaguaagcgaugguugugagcugccuugugggugcugcgaauuaaaccaggauccucuggaagagcaguaagugcucuuaaauucuaaaccaguuccuuuuuccauuauuuuuaaagcaacauucauauauagcaaaauuuuaauuauauauaugaaaucaaaauuacagaaaauaggaggacacaaauauguaauuucugacuaccaagguauuucaaccucagaauuuugcacccaagacaaaaguguaaauacaggaugcuuuagggaacuagucauuaguaagaaaagaaauuagacacauacacauaaaacacaugugcaugcaugcacgcacaagacuuagaagagauagaaagcaaaaaaaucauauuuauagaaaacaacuuuuggaagaauuucuuuucuuuucuuuuuaauuuauuauauguaaguacgcuguagcugucuucagacaccccagaggagggcaucagaucucauuacagaugauugugagccaccaugugguugcugagauuugaacucggguccuuuggaagagcagucaguacucuuaaccgcugagccaucuugccaguccucggaagaauuucuugaagagaucugaaacaccuggguauagaaaguuccuugacaucaggaugagcacuuaacauguuuguacuuauguuugauuagaaugauugugcugcuacugucauaacugcugauaauugucaacuugaauccaucuaaacccaccuuaaaagauuuuaaugaaagauucucuggcuuaaguuggccucugaguauaccagugauguuuuuuucauauuuguguucauugugauggguuggccuaauuguggacagcaucauuucaucgauugaguccuggacugaauggaaaugguugggagagcugaguacaggcaucccucccucuccuagucuucacuaggauacagugugaccagaugucucacacacuugccacugugauuucccuaaaggggugugcuaugaccuggcaguguggacaaaaacaagacuucucucccccaaccugcuguugucaggguguuuuaucauagcaauggaaguggaaguagacaggacucuagauaaaagacuuaugcaguaaaguuaaagcauguugugaucgaugaaggggagguacuggcuaggggccauaagugcagguaauuuuuguuagcuucauaugguacaagagggguaucucgaucuuccccucuccuaaggcaggcugacagccuggaaaccuauauaauucucuucaucauugugaacauaauggcugaugaugcauuccuuuaauguauuaggacuaugugaaccccuuccgcuggaugaauuuacugaauucuuaucauaaaccuggaggcaggcaggccauuguuuugcuuuauauagcauaugaagaucaggaggcuggggagcaaaccuugcuggcugaggcccagagaacucacagaaacuacugucgauaaguuugcaaauaaaaaaucaggacuagcucaucaagguuagagauuucacacgguuuuguuaaaaagccccauguagcuggcaguacacaaaagguccuuguagguggcagugguguccuguuugcuguccuguuuugacuucugagauuaucagcuauggcaugaaggcuggaucuuauuuuguucuuaacuuccccccaccccccacuucaagugcaagggaaauccuaugugcagguguccagaagggacagugagaaaguaaaacugcacugacugugguaagagaaggaaauggauucucuucccuuucugcuuucugcuuaccuucccuggagagauggagccuugucugcagagguaucuccauacucugguaccaccaagauuuaguaaaugccugcugucccagcucauguauuaauugugccauuucuuuuggccaaucauagccucuuccaaaauaaauuauaaaaaucuccaagacaggucuuagcuucccuugugcugaguauugccaugcacucauuggccucauaaugacagacguuauuagauccauuuuuaaucagugaugaguaaguacucaaagauggaaaagacucuauaggcacauuugucaaaagcccaccaaguuuguaaguuugaauaguguuucaugugucaaacguauguaaugauagggcuucuaaaaauagagagaucuagaauucgcaagaggaagcugguaccugaacagggaggggagguuuugggacuucacucugacuccacacucucagguucuaacuggaaaaauaccuucucuaagucgaauuuagauuacccaagaacucaaaaaaacuagagguuaucaccagauaaguaggauuucuguuaucucuaguaccuucuuagaggauguaaaaauuauccaugcuaugagaaauaaagucuguucuguucguaaguacuuuuuguuugugaagaucuucaaaucugagaccaucuggccauuacauucaagcccaggggauuguuaauuaacagaaauguuuuauuuuaaacaucuaugugauuaaauuguugacuuaauaugaaaugcauagacucuuucuagaguccaauaagccaggucauccugcaagagccuuggaacccaugucauaugccucuaugauauagucuuuuguuuauucccaauacuuugcuguugaaguucaaaauacaccuugaaauaauuuuuaaaguuucaaauaacagcaugaaaacuagacaguucucaguauuuaugugugguuguucuuguaaaacagaaacuguauauaauuugagagaagagaauagacaacuaagaaaagcacaccaagacauucacacacagcuucaagacgucaagguaagaugaaucagacauuuggcucgggggcuucugucuccuuuacuaugcagaauggcuucagaagucauuccagggagcuggaaagaugccugagagacugagugcuugcugcuggugcagagaaaccacauuuggcuccuagugcgauagcucaccaccaccuguaacuccaacuccagggaaucuaauguccuuguugauccccugcggauacugcacccacaugcauaccccuugagcaacccacaaaaacacacauacucgaacacacaaguacacauacucgcacacacaaacacacacacacaaaauuaaaaacauugaaauaaagauuuuucuuuucaaaaauugauuccuuaauugaucugcuuugcgagcucaucaccaacuuggacuuugccuuccuggaguacacuugauacuuuuaccacuuugguaucauaaacgacagguuuccugggacauguaaauauuucuguugauaccgaacucauuauguuguuggaugauuacacugugagaugguuuuuacuuacagagguaacuacuaaugaaagguuuagcuggguagcgaggcagcaguuuugagagauuuuuuagaauccuccauaaauccugucuaccuccaguaauuuuuggauugaacaaaugcugcuuucacuuccaucaagugagcaaguaacauuuggguggccacaccaaagaggcuuauuucgugacguuaauuuagcucaccauguaaacuucucuuuuguguagcaacagcauaagaauuuacucuccgagcaugaacagcuuguagugacuuuggaagaccacaagagugcacuggcugcugcgcagguuaggagggagcagccuuuguuggguccuuugaagucugcugacuauuucugaaucccuucaugcaugucguuucugacaacucagucuucagggaguuauggcagcacuccuaaucccggggauaugcaugcuuuucaaaucaccaaagagacuacuaaauaaacucuucauugcuuauuauacaugacugcaucugccucugcuacgcccuacacgaacaauucugauacuuaacucacugugaaucuggccuucugcaucucucuggccuguaucaacucuugguacaguagguauaggguuugugaugcugacucccagacacugucuucucuccuccccuuauucccaguaucccagcccauaggcauacuccuuuugggauaauguuuauacagggcgguucauacuacagaaaagcagacgggucaggggagaagaaaaucgagagucacaaucuccauuuguucagagaauacaauagccccuggcauaagccacucucuugguauaugucuguuaaaugaauaaacagucaaauccaagcuguggagagcuuggcaaggugauauccagaugaguacauuacagcuggagacccagagaaauaggacugccugcuuacuugguucggguucaaaaaauuauucagagcuguaaugcauugggcucaugucuauuugcaucucucucagugacuucuguuugcauuuuggggacuagaguguuugucuguuuuuacauuauaaaaaauccacuugcuuuguaguuuucuaagugcauucucacaugauauuucucuuuaacauuuuaaguuauuccuugauacauuucauacauauauacaauauaugaugauagucauuucagcauuucccauacauaucgcuugagccaccaacccaucccacucccaacaucauguccccucuccaauuugcugccuauauggacucaggcauggguccauacacuggagcaccggaaaccuaacuguggccacaaucacagagaaacaugauuauccuccuucuggcugccaucaaccacccauagcuuccucagcuagggauagggccuugugaauugccccuccuuggggaccuuugccaauuggggucugucuauuucucaauugaccaugguuauuuuuaccuguaugugaacugauuauuucuaagcacuggugcauuccaaaucucaagguuugccaaguguuauuuuaugugagguucacacagugagauguggucagcugauuagaacacuguccugcaauagccauagauaauacaauaagcaaacaucugaaaaagcgcagaacuaggauuaaaaucauuucuuuaaugacccaaaccaaaucugaagucgcacauuugcagcacugcugagccagcuuuugaggcuucugucauuaaucuaugcaugguuguguguacauguguaucaguagaacccugaaggucaacugcaagggucaacuccucaggacauccuccacuuugagacagucccucacugggcuggaucucccugauuccagugauccccaggaauacaccucauuucccuucucuagcccugaaagaauuuauagaaagaaaaaaaaaaaacugacacaaagaaccuauguaucauguacuuauuaauuauuaauauauuuaacugcuguguaaucauauguauuuugauuaagagagugauaaaacaucugccuuuugagagugguggguuuuuuuuucuggucuuaauauuuauucuauaacuagugcaccccuuaauuaccuuaauuagagucauaugucucuauuaauuugggcuugauuuaacaaaaugccauugacugguggccuagucacuguuccagaaacugggaguccuagauuccugugaggaugcucaucuggcuugguggcuccuggcuucuuguauuguugugguguggaaagagaccaagaauggucccugcucuccuguuaucggggcccuagcuuuauucaugaggauuccacccuuaggacugagcaccuucuaacacaccauccuuugaucugugguugguaucaaaaaaauaaaaguuauucaauuucagauauacaaauuuugaagaguacacacauuaaguaaguaacaucauaucacaacuuuauccaaaucuccaagggagggaaaaugcuauuucuagcaaaauccucuuaagagauucuuuguuaacaaaucuugggcuuauugaugguuccuuggguaaaaugcuugccacacaagccauucaaccauacuuucauccccagaauccacuacaaguagaaggaaccuccucugaaacccacaguggugcugaggugugcaguuguacacauauuuuaauaugguccuuuucuguacagagaaccacaacuuggcugccuucauuaauugcauaccuuagagcagcaguucucagccuuacuaacgcugcgacaccuuaaugcauuuccuuguauuguggugaaccccaacuauaaaauuacuuuuguugcuacuucauaauuguaguuuugcuaccauuaugauuuguaauguaaacaucugguaugcacaugguccuggugaccccuagggucaucugacccccccccagagggucacaacacauggguggagaaccacugccuuagaagaagagaaaaagaaugaauugaauugggcuuuauagaucccuccacguaagagcauggcuauguggauuuuguugguuuuuuuguuuuguuuuguuuucauuugguuuuuguuuguuugcuuuuuuguuuuuuguuuuuuuuuuucauuuugagcuccaaaguagaaccccaaaugaucugauuaauuucugaaguacaggccaaugcuagcuacauguuccauuucuauacaaacuacaugcaagcacuccuuugauauauuuuuagccagcuaccaccuucauuuuuugaaaacuagaagagacaaaacagagcuggggagauagcucagucaguauaguaucugcuguggaaucaugagggccagaguuuggauccccagucuccauagcaaaggucagagaucaucucaacagugaguggguuggagacaagacagguagauccuugagcucauuggccagccauccuagcugaaucagugagcuucagacuaaugagaggccucgucugaaaaaaaaaaaaaaaaaaagaauaaugauagagaaaagcuacuugauguagaccuugggauuccacauacaugugcacacagguacaagcaacaugugugcacaugugcacauacccucuaugcauaucauauguggacacagcaccacacacauacacacauauacuacaaaagaagacuaagaagagguaaaagagugcuucucuccaggcauggaaguccagagguucuauuuaaguguuucuuuacacaguaauucugguuuuagaaugagagugguaguguacaugaaaaguguauacugauuuuguuaaaguuauugguguauuuucuaucuuucuagcuccuuauuaaaaaaagaaaaaagaaauguaucuuccacaucaaguacacacccuugugucugccuauauuagucuuaaacucauacauaugcugccuuugucgauuaugccaaaaggauauuuggaauugauaaacacccagcuucaugacagucuuguuuuugcuacucucugcuaccucggagcaccguauggaaagcaaucuagaaaguagcaaguaaaaaaccguauuugagcauaaaucaccuaaggagaagauggugagcguagaccaacagacagacagacagacagaccaauagacgaguccauugaaagcuguaacccaggacauacuuacuguuaaugggucucaauuugaauaauuauguaagucuucaaguagauuuuuaaugugagaaaacauugauuaacuaggugccuuucaaugaugaugcuuauacuagaaugguugacguucuuauuuugucucacauagccuggaacacuaacaugucuucgauaagguuuuagucucguaauccugauucuaauuugcaugugcugagaaauggucgagcauguccagagaggcagagcuagugcaugaggccaaucugcagcuuugcuaaccaaccuaaggucaaugcuuucccuaggcauccagugaacccaaaagcccaucuaauuaaccuaugaauauucucucucuuuuuuuccuuucuacaaauugugcaauuuucucccaacuguacaauuuacgugcagacucaaguugcagaauauaaacaacugaaagauacacugaacaggauuccaagcuuucgaaauccugacccagucgagcagcaaaaugucaccuuuccccaugggacucacccuccucaagguuacaacggaagagagaagcugacaggagagcuccaagaggugagauccuggggauccccgggaggugaaguucccaguggagcuguccugaggagaacuguccucuguauggcccacuuuuccuaccaagcagauuccuagaaguucuuaaacguuaguauccccaguaggguauguuaaagcgcgcaccucagccaaagcuccacuuucuaagucaguucauuugacuuuuggcuggggauuuguauuucuaaacaauucagcuagucuggagaacacguugauaauuaaaacugucacauuuacugggaaagaauguucuggcuuuguccguauccguguaaauuuacuuguauuaaaagagcucuggugucugcaucuuugaaggugagacgguuuuucucuccuuugaauaggugaacagguuuucaacuguaugacgauauuauguggcagcccauuuccguauuaaugcuaaucuaauagaacuugguacacuucuggucucauguagagcauaccaaaagucauacuaaaugccuuuguaaccuggucacaauuaacuuucuucuuccucuucaugaaaaugaaaacaugcuugcauauguuucaaaguacaacauuaccgguguggucuugcuuauuguuaauucuuacaaaguuccuuguaugggcuggagaaauggcucagcacgugaaaccccuggucacaagacuaauggccugaguucaagucacaggacucaaauggaggaagguagagaguuguccugugaccuccacaugcaugcuguugcaggcgugcaguaaauguuugagaagucuugucugcaaguggcuggccaucuugcggggauaaugaagucaacaugaacagaguuagcaaggugauuguuuucagcaugaacagaacauuccuucauaaacagacuugggguucuugcaauccaguucuuuuguggggauuuauauccagcaauuucaacagcaugauaggagagcaggccugucguuugauucuaugcucugcuagucugacauccaacucacuggguucacugucuaaugauucagagcuugcucugcuccaacugugagugggagauagaaguuaucugcccuaacguuccucacagagacagaguggggauaaauggcagguguuugaaaguccuuagagcccuugagugaaacauuuucuacgaggcaguuuuauggcaaacuugccaggggacuucgucaaauguacggcucucgaaggucucagauggucaaggaaggucuuuucuccccacuucuugcuuugcacucuugacuuuuacaagagugauaauuauaucccugcuagauucagaagagugauuccugucucaauguguugauggucugguccccuaggcaucucaauuauaagaaauuaaucugaccacagaaguaacuucuuucgaugaagaaaagggaaaagauagugccgauuuuccuaugugguuucucccuccaagcuaguggagaccgaaaggauggaaaccuacggaaaauauggccacgacucgacaaacuuacagaagauaguuucuaaaguaguuuuuauuucuuugauaaaucaaaaacuaaagcuuucuguuuugacauuguuuauaccaucaauuuauuauauauuauacuuauaauaucauauauaauuguauuauguuuauuauaauaaauagacagaccaucuuugguuuacaaaaggauguaacaagauacauuaauauuugacuggggcugggaggguaacucaguacaauuccuaccacaaacugaauucaaucccacauaaaaagccaaauuuuauguggcaugugccuauaauacuaguguuggagaaguagagaccagaggauuugggggggaggggguucacugaccagccaaucuagucuaauccaugauccugggaauccuaaugagggaccaggucucaauuuagaagauggagaccugagaaacaugaccugagguuaauguuaugcuuccacaugcucaugcaugcacccagaugcuuccacaugcacccagaugcuuccacaugcucaugcaugcuuccacaugcuccccacauguucccauaugcuuccauaugcucccccauguuccauaugcucccacaugcucacacacgcucccacacgcucccacacucuuccacaugcucccacaugcuuccauauguucuugcaacauauagcugugugucuauacacucacaggcacacugacuggcacaaacugaaagguuggaacaaagaauauuuugugucuugcguagcugaagcuauuuuaaaugaacauggauguccguuaguagcgcaagccccuucugcuuaaucguaaugaagccagugagaaaccacuccagccuuucuucagcugaaucugaaagcuucccccaguccuuccaaagaucugucgagaagaaagccgaccuugaagcagcuuucauaagcaccaggccugaggauuuccaguuuuuauuauuuuacuuguuuauuuccuuucuagucuaagcagagcuggagucagauugccucugagggaaguguuuuccuaauacaugguuaccaguaggcuucgguuuccuggucucugagcauuuucugagauaaaauuuugccuagauuauuccugucuuggggugagaugacacagugaggaugaaacaucucccucacaccucucuuccuguuuagucacggcuguauauauuucuagacuccgggauuuugcuucugcuguagcccuuuuagaugagguaauagaagcauaaugucaccacauuugaaauagaaaaguaucacuucuugugacuugcuuaucuugaaauaacuaggugcagccgaaucacgaagcagggccuagaagaauggaagagaaaccucugucuuccaugcagaaggaugcaggauuccaggcucuagaagagcagaaucaaguggaacccagagagccagaggagcgucaaguggaagaggaacacaggaaggcacuggaggaggaggagauggagcagguggggcaggcggagcaucuggaggaagaacacgacccaucaccagaggagcaggaucgagacuggcgggaucagcagggacagaaugcagcccaccuucuggauggccacccucaagcugaggugcaugggagcucaccagaccuucucucugauggggaacuugucucgguuuuaaauacacuacuacuacucuguuuuaaauacacuaauaauaauaauaauaauaauaauaauaauaacaauaacaauaauagggcugccgaggugcucagucagugaaggacaagcuugaggaucucagugugaugccaaauucuguguaagaaguuggguguagugaugucuuccugucguccugcaccgaggaaauagacagauaggucccuggaguuuaccagccagccagccuagccugacaagaaagacagcccagaucugagagagagagagagagagagagagagagagagagagagagagagagagagagagagagagagagagagagagaaacgggggaaggacacuugaaguacacacagagagagagagagagagagagagagagagaagaaaaaaacuuaugaaucaccgucucuguaaauguuucugaaagguuuucauugguuguccuuuccuuguauuuaaguuuucuguuguaagacaaauagcaugauauagcucauaaaggcauuugugaucagaacaaucacugcugguagaccuguaucguucccauugucaguggugcguaagaaaagaaccugguccauccucauaucccugacauuguagcaggugaacucccaacuggccaccuccccagaagaucccuaaguuccaccugaaguaucuugauguggagaaaugucuaauuuucugugacaaagaguccucagucugcucacugacugccagcuacagagcuagcuucugccuguugccgucaaagccgcaucagaagcuuacauugucuuacuaacccaugcgcccaugagugagugaguauccuguaccugcccagggacugccuuccucagcacguggcugacaucugagauccauucuuaccuucauaacaaccaaaguggccaguguccuuaaaggaacccagugucagccagcacugaguacaaccggggaccuuucuucagucuccaaacucauacucagcagcaaugccccugggugcugaggauuuuuuuuguaacucugagccauucucuguccucaaagucuuugcguaaacucagcaauccccgggccaaggggagacacugucuuaaacaaacaaacaaaaaacaaccaaaaccaauacccauaagguggcaucuaagaaaugacaacugagguuucacucaggacaaauaccugaacagcacacacacaggcacacagucuccuuuucccuuucccuuucccccccaccccgacuccuucuccgccacccccccccaucucuaucucucaucuccucugcuucaccaguagaagcugagauuugacauuuucuuuagccugaaacugacauauacauucuuguuaaauagcauccuugggucuuuaacuauuccuagacaaagccuuagccucagaaauugugcaguaugggguuacuagcuugauuuagaaccuagaugcauaaauuuaauucagguuagaacugauuucuuguguggugcucuguagcauuggaaugggaacacacggagaggcugccuuccagcucacagguccacaaguccacucagagaaagcugggaaguucacguucuugggcuuuaugugugguuggugcuuaccugaugcaaaagugucgagaagccuauccugccucccgaguuuacccugacaagcaaaugaagggcgugccgagggucuaccccuucuagcucagcaugaagcccuuuuauucuagguggagcauucgaccaaggcagcuacaaacuuccaauccccauaugaggaacaguuggaacagcagaggcuggcagcgaggagagaugaggaagcccagcggcugagagaacaucaggaagccuugcaccaacagaggcuccaugggcaguugcuaagacaacagcagcagcaacaguuccuggccagagagauggcucagcagaagcagguagcccaugaagauggccagcagcagcaccaggagcagcuaagguagccugccccuuccccugguggguguagacaguccuuccucugcugucaaaucagcauuguacguguauuauauagcaagaggacaaaccuauauagcucaugaaggcaagauagaaaaaauguauucgggaauuaaaugcuagagacuuuagacacuuaauuuuacguguaauuuuuuuuccugccuaaucaugagaguuauccauugagaagagggcuuggugauaaagggcauaucacacaaacauuaugaccuaugucuacauccccagaaucuauguaaaucucaggacaguuccauacagucuguaaugcugggcuaguucaucaggaagugagauggagacaaggagaaucucugcaaguucucagccagucagcauggaguaugugacagcaaaucacacaagucaggcucugggucaaacaagguugaaggcagggacaauaugcaagguugucuuccaaccccuuggcauguccugcugcaugcuggugcaccccucacaaaacuuacaggcauacacauugcacacuccugcaaaguaaaaacaagcauucccaaaauagccuaacauccucagcucuaacuuuauucuaugcgggaaugacaauguacuauuuaaagguggacuuuggaagcaucugcuaucacuauuacacuuuacuaugugucuacaucucagaaacgaguuauggcuuauucugaaaguugaaaucuuuauuuaucccugucuugaaagagaaaugaccuuggucaaacugugccaacugauuuuuuuuaucuccgaauuugggccccugacaggcagcaagcucauuacaaugcuguggagaaugacaucgcacagggagucgaggaccagggaauccccgaagaagagggaggugguaagacuccuuagaugaugacucuucagucaaaccacuuggucacaucacccaauagcaaggagcacauuucacagcuccaacaggcagacugugucccugauuaagugcagaggacagcucugacucaugcuaacacucuugccacacauggucugagugcuggcaaaaguauauaccacuacugaaaccuggccaagguggugaguccuuccuacaucauugucccuucuguugaagcucuuugugugccuuacaguuuuuuuuuuucugacaaccaaccuuaggauugguauucuuuaggaaauuuccauguuuucuacuuagcuuggagaucuuuuacccuucuuuauauaaaugguaaacaucuaggauaaaauuuguaaaauucagcuuccuguggagauagagcugaaguuaacucuccuugguaccaccgagucuuaugaauguuugauuuuucuagaaaguauccaaagaaaagcaaaggcacgcuccaucagcagccuguugugguguuuuauaacccuaggagucagaaaauuguugcauuuaugucccccaugggucacuuuaacuucuucuacuuguucauacgacuaagagcuauuugcucccaucuuguuuaauaagucccucagagcacuuggagcuugcccgcaggcccccuacuucuuuauugucugcaaacuaaauaagucuuuauguucuuaaccuuccaucuuauaucuuacuuuucgaaggauuuacaauucuugugagcucuuagaauucuguuaaucuaaauacuuuucuugcuaagcaauauaagcaagcaugggauguguuuucgggcagcagcagucugucugcuuccaaguucacagcuguccuugucccuuuugaaauguccuaaucuuagaaaacucuuuuuucuugacauucaaccacacaaaaaaauuaauuuugucaaaugucuuuuauuuuguaaguuuugauuauuguuuucauaucugguggggaaaagccagccuccgcuauaaauauucccuaagagggauagaauggcacauuuacccaucccuuugacaugcagaaaaaggacagaacuauucaggaaaaaaaaaaaacaacaacaauaacaacaaacaaaaaccaaaacagagaucugccaguaccgaagauggagaugagcuagacauacuguaggcgguuuuucgagaggaaaacuccugcucaacccacacagggcugauuauacuuccuuugcuuugauagccuaugacagagauaaccagcgccaagaugaagcugaaggagacccaggcaacagacaggaacuucgugaaccaggacaccaagaaggcgacccugaaguugaagcagauguaaguguccuccucagguuaugguaguucucauagucaagcuucagggauggcuacauugaaauucccuugccuaauacacugcuauagcaaaggaccggagaccuuuaucauaagaguucuguugacugggaaacagugcucgaggcucagaucuagagaggaaaaauguguaguaagcagaagggugaacucuguugacagaggacacaaagugcaugcugauaaguauccuccaccaguggaaugagccaauccaaaccaaauuaaagaauauaaaggcauguuuaucggggaaccacucucuggcagguucacuggucccaaccagccaggccagggaaguugccgugaggagggggaccaaggagagggcgaccagaaagagcaugugcacacagagagagagagagagagagagagagagagagagagagagagagagagagagagaggaagggagggagggagggagggaggaagagagagagagaggaagggagggaggaagagagagagagagagagagagagagagagagagagagagagagagagagagagagagagagagaauauagacagagggagaaagaaaagagaagccaaaauauauagacgauaaagggcagagccucuagggaaagggaagcccagcuccugggcugaaaguucaggguagaggcagggucugccauccaugcccuguaacaggucaggacugaaggauggcgggagauccuggagacuguguacacgucaguauauaaaauauacaccuagccuuuggccugaaucucaacacaggggucacugaaagacaaaguccagcauuagggccuaaauaauucuuaggauuuggggugaauucagguggaggcugauuccuacuagaauagcaaaggauuggcagguuaagcacagcacuccagcauuccagagcaggcaucccacucuuccuuccauggaagagagcaggccucugugcuuaacaguuaauucuggguucuccaaugauuauucugggauggcuuucuacagugggggugugugaagaaauggauuggagguuguucucaggauuaaaaagaacacuaacuuuggcaucuuuuagagugauuaagcuuuagcuuagaagaacaaaauugagaaacgucaaaaaaagaaaaaauacagugacucuuaaagaugaagaggagagggaaagccaaccaagaaguuggaaaguggaugggaaaagagacuuccuguuugcugagcauguugucugcucuguugggcugucaagugugcccugugacuuuguuccaugcuuugugaccaccuugauaaccaugaacaaggauguguggcugcagguuugaaaaagaggucaucagguggcaagaugguaugcacaauucagagugcacuuauguagaugcuuggauagucuuuguguugacugaaaacaagaccccugccuuucugguuggacagucuagguucuuagcccuauacaggagaaaugcaagacauuguggaguggauccaaucuuguguuuuguauacaugauguuuacaguuuauuuuagcucuucugucauagacugcuaauaaaucaauacacauuuugggaugacauccauuccccaaguucuguauaaauugauccggaaauucuucugauuauuggucccaccuuguuucggggauggcuuggagcauguugaugcugacgguuuucuacuuagcuuucaguaugccuucuuuuuucccuucugcaaugacuuuuaggaaaauaugcagcauauaaccuaccucugaacuauuuccaauaauggaaguagagacauaugggagaaugagaguaagagagccagagcagaaaaaccuacaaguguguaagaggagauuaaggcugccacugggaacagggugggucugauaggcacuuagguuuaggauaugcuaccuggcuugcaguauccuuuacuccccugacaucuuuuugcucauucuauucaaugcacuggaaaagacuggggccuuuuaccuguacucuuaacuagagauuguguuacuucugguucaauucuguauucacuauuuuauuugaugagacuuuuuuuuuccuguaaccuccccccccccauuguugcuugguuggaguugggagcuagcauuugcauuuuaugaacuuaaaaagugauauuuagcauuuuuuuucugcucagaguggguuacacuuuuuucucuauccuucgaacaaaugaugaauaauucauacaggaaagccuauaaaacaagagauuguagaguaauuggaauuggaugugaaggugaugacuuaucguuuauauugagagcagugucauuugcacuugaagcuucaggccagggcugugcaggaauaagccaucugacaccacaggaagcucuugaccauggucaaguggcugagugaaugguagaaagagccccuugucugcccaaugcugagagaauagauccuacucuauggccucagcauuucacggagugcaauucccacuucagucccugucccuaggcuuaccaaagaauuggggacacccauaagaagcagagguuuaucugcacauaucaagaucauuugagguuggguauuauuuaaccaguguccugggugcuuaaauggauaagugaaguaauugugaggccaacaccacuacugagaacuccuguggaaauaccuuggugauguauugucugauuuuuccuauccccuucuagagcacuauuacucuucuucacaguagcccuaguugaaaaagaaauuuuucugcauauguaugaaaagauggccuagucggccaucacuggaaagagaggcccauuggacacacaaacuuuauaugccccaguacaggggaacgccagggccaaaaaaugggaauggguggguaggggagggggcagaggguaugggggacuuuugggagagcauuggaaauguaauugaggaaaauacguaauaaaaaaauauuaaaaaaaaaaaaaaagaaauuuggccaugcuacaaaaggacccuuuacucuugcauaugggcuuucuuucccaccaacuacucucugccuauuuacauguuaagaauuauuuucaggggccaaaaaaguaucucaguuagaaaagagcuugcugcacaggcacgagcaugcccagucuccagcagccacauauaaagucagauguagugcugcgugcuuacaugcuggggagcugguaacugaauaccaaagggcuugauaccaagccagucucgcuuaauggauggaccucaugucucagcauaucagaaagaaagaaaaaaaaaaagaguuauuugcccaucuaacucucucaucuugauuauuacugauuauuuuuuccauuuggaccucugacuucucuuaccaccguuggcuaugugcugauguuuccaugcuagaauucugaggaauucacuugcacaaaugaaguacaauguguucccccucaaucgaucugaucccugaaacacugacaaagcaagaguuccauuuuugcaagucuugggaaagauugaucugaacagucccaugaagggcaauuucauuuucugccagcguaugaccuuuccagugaaauuaaacuugagccucaguuuugaagugguggaaugcuuuuuaugaacauuuugcagagggcagcuguggaggauauaaacccagcagaugaccccaacaaucaaggcgaagaugaauuugaggaagccgagcaagugagagaagaaaauuugccagaggaaagugaagagcaaaaacaaagcgaagcaaagcaagggaauguagaaauggaugagcacuuggugguaagauaaugccuggggugaacaguggguucagccuggucauuuuaggaaaugccuaguuuauggggaaggcaaaugcuuaugugaguuagagaagauuugccacaucagcaagucuuggacccuuugggauguuaugcuuauaaucccagagccagguaagggaugacucacgcuccacauuugagaaauggauauucagcauuuucuggcuacugaugcauuugcgagugcacuuuucaucaugguauucucauucuuucacucagcguccugugagacgacucuccuagguauaguaacgugagccucuccuuuuguuucaacagauggcagggaauccagaccagcaggaggauaauguugaugagcaguaucaggacgaaggagaggaagagguauaagauaggaugcaugggacaggacacacugcacaugcuacccuaaaacuaaucucaguucuguccacuuugacauucagacuuaaaugguauuagaaaggggugggaacuugaagacuauaugggucauggcaguugaaagacuuagaagauaaaccagaguaauuuuaaaugaccacagauuuggaaucgagaagaacuguagcagacugaaauucaugugaucuuucugagaguauccacacaucuauuuucucucaucaaagagagaacaaggcucugcaugucugggggaauauggucugacuccuagagcuuucucuauggaaucuucccucugccugucacagaaauuccccacugugaaaguaacuuuuauucgccugaugugguugucaucuuggaagcuuauuguuaaauaagcucacccuuucuaguucuuucugaaagcuggcuggcugguucaacucagcagaucuggcucgaacuccucuccaagcugacugguucaaauuggcuucuuucagcuugugacugaauucuucugcuugguuucaaacuaacuccggcaauuuguucuaauuuucuggcuccuucuucuucucgggcuucaacuucuucggcugaccuucaugaacucacagacaaacccaaccccacuguacugcagucacuguacggacucccaacugacucaacuccagaugcacuucaacuuucucucccugcacugcuccuaaauaacuuuucuccugacacuugggugcguccuguaucugacucauucugccagaucuuucucugauuugucucugauucucaauuaggcaucacuguccaacacgauugcuucuuucuauaaaguaauuuuacuuuaaaagugugugcuaacggugcgucuguaugccagccagaaggauuaaagguguguggugugucugcaguccagccgagucacacagaccuagggcuuuguaugggaucccuuaacagaguagcucuguugcuggacuaaaauuccucuacaccccacggaguguaacgucuaacucagaguaaauauuucuauagaugggccagucuuucauucucauaugaaugaauaccagucucuucccucaugggaaugcaacuucuuaauuaagcuuaauagugagguucaccuggcaagggagaagccuugaguucagucuccagcacaccucccccaccaaaaggaagagaaaagaggagguaaaauaugaaaaggacugggauucauuugaacaaaauacauuagaucuaauuuuuaauuuuuaauuuuaauuuuauuuccauuauaaacuuuuggcauauaaucacuagugaaucuuacaaaaaaacaaaaacaaaacaaaacaaaacaaaaaaaaccuaucacaguaucguauuccuguaauuagauagcuggugaguucagugugugagagccuguguucugcagcugucuccugagugaacuccuaugagugagcaugucucaguauuuuauuauggugaagagacuccaugaccacagcaacuuuuacagaggaaaacauuuaacuggggcuggcuuagaguucugaaguuuaauccauuauucagagcagaaagcauagcaguauacaguuagaccgagugcuagagaggcagcagagaguucuaucuacaucuggaucugaaggcagcacgaagagugagccacugggccugagcgucugaagccucaaagccucccuauggcuagugacagucuuccuccaauaaugucacacuuacuccaaaauggccacaugucuucuuccguucauauagugacacucccuauccaccuguggcugccauuuuuucuucaaacugccacagggaauauguuuuaugucaggucaaaagccccacaauuauucucuuugcagauaacucaguauuucccaagucaaagcccuaagagcaacuucauaaccaguaccuugcaaacacacagccuucucccugaaggaaagggcagauaggcagguagacauaggaccaccaaagacaggcugccccugagaagagagcaaguucagagggcuugugcucugcuccagcacucucggcugccuucccgagucucugccucauucucccugccccugucagcuuuguagagccagugcuaaaacucgugccguucccaggaaaagagaaaagcacacggcucuucauaaccccagccaugcucuguguaccaggcgugagcuuagcauucugucacauuccccuuccugcuguuugucuucaugaaaacgcagaaauugucuuuccgggaagagcgcugagaaaggagcagccuugacuaugaagacauuugcuggagagagcgauucaucaggacugcuccuguaacaggaugucuaguccuugguuuccuuauggcaaauguggcgggggcagccuugagggauuaagauaagaaagaaaggguucaccuuggcuuccuuugaaaaauucagaagggugaacauaaaaguuuaaucaguguuugcggguuccuucgcagcucuguagucucaucaguuaagaugaaggagagugauccugagaugggagcgggauagauagggaccgagggacaagaaauaccagcaagggcaugcaacaagccagaggcuuguucuguuccucugcaaccuucucucagagggcauccuuccccucccuugugcccaggauuccucuccuugaguucuucugggguuauaacacugccuuguugcacaaagccccaugcccuuccuugaagucuuauaaaaagucagugacuauacuuuuugacccccuguugcauuagcucuggauucucucucucucucucucucucucucucucucucucucucucuuucucugucugucugucugucucucucacucacacacacacacacacacgcacacacacacacacacaccccguaggacuacuuccugaaacucuccaaaaagcuuuucuuucccuuaacugccucccuguccacugagcaucccuggcugcuuugaauucugccagaucuuuccaguguucccagacuuucuauacaggaaggagaagaguagaugucacauuuuuuucaagcaccaguaacagagaugaggagcugagcagccuguagcaauaugagcagugaacuaaaaguguggauccguucguuguuuuagugugugugguugggcaguauccgugcacuauaaauacagugaaauuccaaaguggcuucacucccaucaucucuuagccuggguguuccagcugcucuagagcugcugagcuguagacuuauaacagcccucaguuucccucccuccaagacaucacucagauguauugguauuaguauuuaguccuugagaauuguauccuaucggccuuacaucugucagagcuauaaucaucagacuuccuggcucgagaaugggaagcaaaggaagggaagggagaaaaagagcuuuuggugugugcguacguguguguguguguguguguguguguguguguguguguguguguguacauguguauguucugaugagugggaacacaaaugugauucacauguauucucaugagugugguggccagagggcauuucgcucucuggggacauccaccuuuguuuucaggaguaagguuggccuggcauucauuauauagacaugcugucuauacagaaagccccaggaagcugccugucccugccucaccagagcugggauuaugugcaugccacuagugagaccuuugauguagacucugaggauugacuugugguccaacugcuuacccagcaaacacuucacugacugugcuacgccccccccccccagcuuuucacuaccuuuucuuuuauuccagccaugucaucuuucuaugaugcaaaccugaugguuccugaccagcccuccuuguuuauucauuuacaauuuuuacaguaaaaauauuuacugcaauauuucucucauaggagagcauucuagauguuuuauccacauuugagagaagagacauuauuacauaacuaaaaaguauuagguauuuuaaaguauuuaaauguugaaaacaguuuaaaugaguucaugaacaauuugaauacuuucaugacucuaguucaacaaaagaagcaaauuaauaagaauauucucagagagaaguaaaagguuaauggcacccauucuguagccagaggagcacacacccuacccccaauguaacccagaggagcacacacccuacccccaauguaacccagaggagcacacacccuacccccaauguaacccagaggagcacacacccuacccccaauguaacccagaggagcacacacccuacacccaauguaacccagaggagcacacacccuacacccaauguaacccagucacaugagcaacaugucaagaaacuuuuccagagcugagggcgugguguggcacagcugguagagcucuugaccagcaaguucuguugcaagcaacauauaaacugggugugguggugcacaguuauagucccagcaccuugggaauagagacaggagagucagaaguucaggcuuguucucagcugcauggugaauuuaaacccauccagggauaugaggcccugcuagggaggaaaaaggaaaggagggagggagggagagggaagaguaacucugaaaugggcacagcucuuagaccuugcagaucagccguuuguagcuaaugcugaaggccuuucacugucacaugccacaaucucuggauccuuccaggcuuaacgucugaaaaggauuccuccugguuccuagcuaggugcaccauuucgcucauaugaagaacagcuuuuuuuuuuuuuuuuuuuuuuuuuaccaaaugauggcacaagauagggaacgaacacuaaguucagauacaagguuugcccccaucugguagaauucuuuucuccaguuucaaaagcacagauuucagggcuccaaaugaaaaggagcagcacugggguguguucgaugagacuuggugccagcuuuagugggguaguaaggcaggcuguuguggaagauguaaaugaucaaaggggaacuuuugaccugggccuaguagcuuaagcauauuguuaagcucagaggcacaauaucaucuguucuuacuuaguaauggaauuaagaugagcuuguguuaauuuugucucaaacaugaugaaugcauuacuuuuauauuuguaagagucuauugucucaauggcgagaauauuauagaauaucauguuuugauuccccaaaugaaagccccauuuaaaucaucaguucucagcuauaauugaaaugacaacuggggcauaagcuaaaauaucuacaauacauccagcgaguagagaaagggaaaaacauuuuuacaaagguuguuaucuccccagccagacaugcuuaacuaacauccauuguacucccagaaguaguguucugucucaacugugaccaagagucaccuugagaaguuccuaaaacauacaaauaccuagaccaaagcugcccuggaggaaauuggaucuuaucuuucaggggcccuagaaaucggagcccuuccauagcucuaccuuccaccaaguguauagugauauucggggaaccccuguuuaaacaaauaguccuagggaaagcagcugaagaugacuugugugagugguucugcccauuugcuagacauuuucucacuagaugcuuaaaaagauccacagugcucagaccacgccucccccaacccacacaaaaacaccaggggccguggaccuuuuauucaacauuuuuauuuuaugcauaagaaguuugaguuucagagaagucacuuuaguuuuucagaaucacagaauuuauaauuuauucuuggacucuaacuacagcuuacccagaccugggauaagguugacauuguuaaguauuuuaagaauuggaaguauagaguuaauaugagagaauucuugguggaaauuaauauagaaaaaugacagaaggucaccaugcuauaaccuuuaaauauaacaacugacuuaugacccagucauaacugggagggggcagagugacaucuuuacucccagcucucagguggcagaggccaguagaucucugugaguuugaggccagacuugucuauugagcgaguuccaggacagccagggcuagagagagacucaguguugauaaaaacaaaacaacaacaacaacaacaacaaaaaacaaacaaacaaacaaaaaaaaaaaacaagacacagucauuaugaaugaugucacuacaagaacagaagucagggaccuuucuccugggguggcuggacuaaccaucugcagucacuggcuaagcacaggcuuacugugucuucaggguaaacacguccagggggcaugcugacaagauggcaacaggccacuggccugucuuugguuuugcucacuuugaauuucugcucaccuuuaccacucuuuccaugcccuccuguuucuucaguucuguaguuuccagcacgccucagcugcacaucugcuacaaauacauaaugagguuacauccagcccauccaggcccuuugguugaugguuuagucucuguuagccuccacgggcccaaguuaguuaguucuuccuaugcugucccugaccccucuuccacaagacugcucaaguuccucuggguuucuccugcucuuauagagguccuaaguucaguuccuagcaaccacuugguggcucacaaccaucuucaaugggaucuggugcccucuucuggcuagcaguaguacgugcaggcauaacacuguauaugguguauacagagcauaagacaggcuguuuugccuuugaaggacuucuauccugucugacauauagauuucuggaucucuccuauuuggaagaggaaauauaacagucuguaaacagagcugcaucucuguugacuuuguagaauuauuucauauccaaacaaacaagaaauuuggaucuaaguaucuuccuuugaaaaccauauagauuguaacaauuuucuuacuguuugacaguuucauauauuuguacagugaauuuuaaucucauuccuccccacuacccuucccuacccuccuuucucauccaacuuccuuuccuucuggacaguucuuuuuaacauaucuucuuccugcugucaugucuuccuuucaaguauggcccacugagucuaauuagaguuccuugcccaagcauguguaggagauaauuuaccagagcaaaggcaucuucucgguggcuacaucacugaagaaaaugacaccuguuccuucaacagccaggaacugccaauaauuucuacagaggcauaucacacauuucuucacaccuaguugacaagucaaaauuucgacuuacaucauuuuucaacuuuaauuuuaguuccuuuccguaaagauguucuguuuuggauuaauaucucagaaaucgaauaauuucgugacaaguauuuaaauggaaaagcagcacucagucuuuguguucugucuuagguucaggaagaucugacugaagagaaaaaacgggaaauggagcauaauguugaagagacauauggugaacauguauguuuauuucuuugaacaugugcauguguaugcaauugugccuagcugcauauauauauauauauacauauauauauauguauguacauauauauauauauauauauauauauauauauauguacauacauauauaugcaugugauagaauauauguguuugccuauucugaucuggaaugucacauuuacacauauaaaucacacacaugcacacagacagggaccagcaauauauucccugcaucucucaggaaaugccaaaguuaucuggcccagcuagaauuauaaaaagauaaugauaacuggaaaauuguugcuguagcagugcugcuuaugagaucauuuuucuucacaucuuuuauuuguccaaaaugaauuauguugcauccuuugguaaaaagagauuaucaaucacgagcucuacauccucucuuaguuaugguuuuuuucuuuugucuuuuagccugaugauaagaauaaugauggugaagaacaaggaguucacaacagggcgcauccuaaaggaagacaggagcauuaugaggaggaggaagaugaagaagacggggcugcuguugcugagaaaucacaucgcagagcugaaauguaacuggacucaguuucuagacugugcucagccaacgauuuuuuucucaagcugcucuaaaacaaaucccgccuacugaauucuagaguauuuaauuacauacagaaguaaggguuuagacuuuuuuaacuuuuuuauuagaaaugcuauacauuuauaugaauauauuuugauaccuuaggugagaacuucuuuuauagucgaguuauacauggacaagaagaaaagcaguaagacuugccuucaggucugaaucucauuucccagcgauggugggaagaugugcuuggcuuuggugcaugucucagcucaguaccauuuuguuuucuggcuuccggguagucuacuauuuaucucagauaaaaugcaagauauagaaaaaaaaagguguauggaaaaacaauaugcaaacaucaggggaauggcugguguccucguggcuguucuugcagguucuuguauacagcucugaaagaaugucacuacugcagaguguuggcaaaugagagccaucuguacaguugaaaaucaauuggaaagcccgugugucugugucggugugugugcgugcgugucaggacaaaguuuuuuuucaaacuuucaggucacuuugaauaauacguagcaauucuuaaaaucacagcuaucuugcuugagaggaaucacguaugaaaguuggauaauauuaauaccccuaugaaagucucaaggacucugucuugucagagaggccaaaggagcugacacacuuagaaauagaugcaguauguucagugaugcuuccugggugaacuccccgucuccccaucgguuaucugcuugcucgucagucuccacuugcuccagcauauuuuccucucuuaagcucugugccuugauguggaaccauuugguucacaguuauggauaggaaagcaugcgaagcuacaguuuaauaggauuauuuuucagacuauaugauaaaauaacuauagcacuaggauaggcaccccucccuuagcggcuuuacuauuuacccagaauugaccugccuuugccuauguaugaggcauucuaauggcuaucaagaauaaugcauccuuuaaaagaaaacucaaacugaaagguuuucccugaaaugagcacauauuuuaguuuacaucaucaauauuguuaaauacauugaacugggccaccguuaaucugugugugguacuuucaaaauaauaaagcaaauuucauuuucuguuauuaucauaugaguguaauuuuaguuucuaauaaccacaaucauguaugguuuugauuuucccagcugagcaauuguguauguaugcauaggaaauguuccgcucaaauuuaguuuggauuuccaguaacaauaaaucaaaucucaucuuuauguauaaaagccccauauguaauguaaaauguauuauauuguacauaaauacucagaauacaauuauuuugguaaauuaguuuguauuuuuaaugucccuuugcaguauuuaauuauuugaaacacauugaaacuuggguaauaaucaauaaacuuauaaaaaguuaaggauaagucuuuuaaagcauauaauuucuuagugcuuuguuaucuaugguuuuucuuuauaggacaauauaaauuaaugaauuauuaaaugccuuucccaaacugcuuuauuuuucuuucuuuuucugcuuuaauugacacuugaauucucaucaucaaacuucuuugaaagaagaagcuaauaauuuccauuaucuuuaagggcuagaaauaagaaauugaacuagaaagguauguaaaacaugagugucauauccacaauucauauguaaaucuggccauuaaagcaacaaucacaaacca

SEQ ID NO: 1461 - RNA, 1626 nt, Mus musculus
cagcgucuggaagauccgcuucugcuuucgggagcacaucccguuucccauagucccuccugugccccgcgcugcggcggcgggagccgucguguccucgguccucggcugcgucggacagcucagcaacggccaccgcgagaaguagcuggacacggcaugagcagaagacgcgagacacaaaagccggaccagagaggaagaggcggccgcucagcccccgcggccggcugggcgccaggucaucgacgccacccggccagcagccaccaaacuucugcgaugucggauuuccgcgaguggcugggcccgcguggagucucuuugcauacuucagagcccgcugcccuugcuacugguccccgcgcgcagccggcuugguuuucccuacuccccacuuuuuggccucgcuguccccaccgucaguccccgccccucgcgccggcucccgcugcuggacuuugucgcuaccacugguaggggacgcgcgcccaacaaagggaccuggcuccaggcggcguccccuugaacggucccucgguauugaugaagagauggggacugguuggucuggucagguuaagggggguggugggcuggugucacugaucuggaagcuccagccgcccgccaccucccacccaacuuacgugucacccacggccccgcuaucauggccaacgggauuccgggaggaagucccacucgggcuccccgcucauugggcccgcgcaagccaccgcucccuccuuucggggagcuaaugcugggcuccauuggacgccagcuuuguccgucccgccccgggccgcgccuacccucucagcucugggcaggcucugagcuccgugggccgcgcggccgccuggcgccugggugcgcccacguggagccuggaugggugcggagggguggaggagccugguugggagggcuagggacuuguccuggccugaggcuuggugaucauugcgcaugugugugcauguaugucccagcacuuggaaugcacguggagcaagaguacagugcuuauaugcacaccaacaaccgcaaagcaaccgugggugcacucugcuuagcccugcucauuucuuacccuacauaaugaguucagcuuaugaacacuuuguucuucucacauucucucaaggacugccuacugagucuugucccauuagaggcacuaggcuaugugcaaaaaugguagaaaguaagcugggacccugaagcucacuugacugucuacaugggguggggaaagcacuuuguuggcagaaggaaagaaaugaucucauguuuccucuggcugcaaauggaauaauuuuaaaaacaaaucuuacaggcugaaaugaguaugcauucaucuugcuguguguauuucucuuaaugguagcagaaaaaaaaaucaguuacauuuuuaaauuacauuuucaaggccagcaaaacccacuacguuuaacaaaaaguuagacaggcauaauaacgccaaaccacuucaaagaaauccacagugcauuucuuucuucaauauaaucaggguguguguggaauugagguuaugcauaaaugauaaauuuguuucuccucuugaccugaauucuaagagaaauaaauuauuucuga

SEQ ID NO: 1462 - RNA, 1626 nt, Mus musculus
ucagaaauaauuuauuucucuuagaauucaggucaagaggagaaacaaauuuaucauuuaugcauaaccucaauuccacacacacccugauuauauugaagaaagaaaugcacuguggauuucuuugaagugguuuggcguuauuaugccugucuaacuuuuuguuaaacguaguggguuuugcuggccuugaaaauguaauuuaaaaauguaacugauuuuuuuuucugcuaccauuaagagaaauacacacagcaagaugaaugcauacucauuucagccuguaagauuuguuuuuaaaauuauuccauuugcagccagaggaaacaugagaucauuucuuuccuucugccaacaaagugcuuuccccaccccauguagacagucaagugagcuucagggucccagcuuacuuucuaccauuuuugcacauagccuagugccucuaaugggacaagacucaguaggcaguccuugagagaaugugagaagaacaaaguguucauaagcugaacucauuauguaggguaagaaaugagcagggcuaagcagagugcacccacgguugcuuugcgguuguuggugugcauauaagcacuguacucuugcuccacgugcauuccaagugcugggacauacaugcacacacaugcgcaaugaucaccaagccucaggccaggacaagucccuagcccucccaaccaggcuccuccaccccuccgcacccauccaggcuccacgugggcgcacccaggcgccaggcggccgcgcggcccacggagcucagagccugcccagagcugagaggguaggcgcggcccggggcgggacggacaaagcuggcguccaauggagcccagcauuagcuccccgaaaggagggagcgguggcuugcgcgggcccaaugagcggggagcccgagugggacuuccucccggaaucccguuggccaugauagcggggccgugggugacacguaaguugggugggagguggcgggcggcuggagcuuccagaucagugacaccagcccaccaccccccuuaaccugaccagaccaaccaguccccaucucuucaucaauaccgagggaccguucaaggggacgccgccuggagccaggucccuuuguugggcgcgcguccccuaccagugguagcgacaaaguccagcagcgggagccggcgcgaggggcggggacugacgguggggacagcgaggccaaaaaguggggaguagggaaaaccaagccggcugcgcgcggggaccaguagcaagggcagcgggcucugaaguaugcaaagagacuccacgcgggcccagccacucgcggaaauccgacaucgcagaaguuugguggcugcuggccggguggcgucgaugaccuggcgcccagccggccgcgggggcugagcggccgccucuuccucucugguccggcuuuugugucucgcgucuucugcucaugccguguccagcuacuucucgcgguggccguugcugagcuguccgacgcagccgaggaccgaggacacgacggcucccgccgccgcagcgcggggcacaggagggacuaugggaaacgggaugugcucccgaaagcagaagcggaucuuccagacgcug

SEQ ID NO: 1463 - RNA, 111711 nt, Mus musculus
cgcggccgccgugggcugcgcgcugagccgucgggucccggagcguggccgcccgcccgggccgccgcgugcacgccauggccccgacccugcuccagaagcucuucaacaaaaggggcggcggcgcagcgucugcccaggcccggccgcccaaggaggagccggccuucaggugagcgcgugcgagcgggagggaggccucaggcgggcugcauggagaccggacccccgcgccacccuguccccuccuccugggcgggaccccgcgccacccugucccuucuucccagauccuccugggaaagaccccagucucucacucuccucugucccgguccucccgggugggaccccacgccucucucgccccucuuucugggugggacccagcagcauccucuucccucccucgccggguucucccagguugggcuccucuuuccacuucuuucagggucucagagccgcgaaccgcccugucccuuuucuacugcuccuucuggguggaaccucagcgccguccuccuuccuugcucuccaggucuccccaggugggagcccugcgccauccucugcccucuuuccucaggugccccacaaaauuucuccauaugcccccgugucugagcacgucugggaccgguguguaccuuccagggucucuggagggagagucaccugcgucuccccugccccagagccuguaagcugucauuuugcaggcagcuccaacccacugaguaugugacaguauuuugaaguuggaaagggugaagccacgaaaaaagcagcuucuuucuugcaguguaugacaagcucgccggcggaugaauaaaaguguguaauuuccucaucaguuagaaggcugaugccgcaugaugaguggaaagggagggaaaugcuuuuuaugaaacgucucggguucuaauuuaacaaagcagaggcagauauuuaauaguucaucuucggaacacauaccuuuggauuagcauguguuaagcuggcucaagacccacagcucuaaguggcggcuggucuugcauuuugagcuaagcaauuggcucucaguaacaucccuauacuauucugcuuuugagugguaaguuuccaaagaugcucuccuggguccuguacugucucucagcacuacuaguugagaaaacauuuuauuugccauuuaaguuuucaucacuauaaaacaaaacaaaacaaaacagaaaacugaacaccucacaccgauucagaccuucuagggauacuuuauguucagaauguaagacuuugaauuuuuuuuaaaaacaaacaaacaaacaaacaaaggucucauuaguccaggcuggcuuuaaacucuugacaaucuuccugccuuagcuucucaaguucugggaacaccaacaugaagcaucgcauuugaaaugaauuuugauuaaaucucaucuccuuuauugcauaaaaauucauucaaaacacauacaaacacauuccuauaguuauauaagauuuucuuuuaucuuguauuuccaguuuuauguagcccaggcuagcuucgaucaauugaugaccugaucguccuguuagugcuucucaaguguaagauuacaguaagcacgugcugccaucccuggcuccaacuuggagagaaugagacauuaaacagaauagcagcauuuguguguguguguguguguguguguguguguguggugggagguuggaagguaaauugugaggacugccuggaucauggucagugcauuuccguuaggcagacuggaccugauucugugccuucuauuugucugccuacccgugaugcugucgucuaacgucucugaguuguagaauuacuuuggagucaggacauguuaauucuucuuggaauccuagacuagaccaagauuccucaggugucuucuuugguggcccuuaccaaggacauuacagccauuugagugcccguggagaugcgugguacuugucacuguuucuuacguucccugccuacuuguccaccagcacucuucccuucccauggauaagguuaaauucaguguauuuugagcaacagcaacaacaacaaaaaaauguggcuauauuuagggcucggccauauuaggaaaauugauucccacuuugugaguacaauauuaguaccauguucugucuucucauuugguguuuaagggagaagaaagugcagucuuuaacuuuuuuuacugugcuauacauuuauuuguaugcgugugggaacacacacuccaguucuacagcaugcagguggaggucggggacaacuuucagaacccuguuugcuccuaccuuguguuuaccugggacgcuaacucaggugaucaggcaacagguacucucuccugcugagccaccaugauagcccccaugugccaucucuugucauuuguucaccucagauuuuuuguuucccgauaggcuuuuugagguagauguuccugaaggauguugaggcugccucucuucccuuuuugucuuauguaacccaggcugaccuagaaguccagcuuugccucaguccucaugugaucagaugcugggguuacagauucaccaacgugcugggcacuugugugaccucucuuguuauccgggcuuuccacuccuccuccuccuccugcagugcuucccuguuugugguucagagagcgagaguggcuccagucccacacuguuuccagaucuuaucugucagccgucaccuauauauagggcauugucacagucaagaguacaacuuacacauuucauugaugaucccaacgcuugucuuuucaguuugccuugguagaaacggaaaggaauaaaaagaggcugaauugucagucuuacccaagcaguuaggcgcaguauauaauuguaauacuucuagacuuugauccugcgucaaaucauaguguguuugacacuugagaaaguucuauuugccgaucuuccaaaugcuuuucacuuuuacuuaauugauaagaaccaauuugaauaacccucaggcuaaaaaugaaugcaauucagaaccagacugucuugaggucaacaugccuacguaggacuuaaacauauuguuuuauauguauguaugccugaguguauguauguaugugcaucugaugcaugggagagccccuggagcuggaggcaccaugaaccaucauguggaugcuagacaguaagugcucuuaaauacucagccaucucucagccccuacauagaacuucuuaauggucaagguauauccaaugucuucugugucucacauguaugugaaaccuuauccauauuaucuuuuuucucccuuuuacugagggccaaaccaaggaucucauguaugcuaguuaaaacauuaucuuuuuaaagauuuauuuauuuauuuauuauauguauauacaaguacacuguggcugucugcagacacaccagaaaagggcauuggaucccauuaccgaugguugugagccaccaugugguugcugggauuugaacucaggacuucuggaugagcagucagugcucuuaacugcugagccaucucuccagcccugcuaaaacacuauuuuaagauuguuuuuguuuguuuugaggcagagucucauguagccaagauuccuucugucucuaccucccaaaugcugacauuaccauugucugccacucugcauagcucuauuauuauuauuauuauuauuauuauuauuauuauuauuauuauuuaauguuuuguugggcuucagacugaaucuagaaccuugcacauguuaggaguuuucagguuuuuauucuuuuggauuucugaggcagggucucaagugacccaggcugguuuagaacugcugguucucaugccacacacucaaagguguuuucaguugcaggcgugcacuaucaugcuugguucuugucuuuaguuuuugagacaagguuucucuguguagcccugguugucuugaaacucccucugcaguccuggcuggcuucaaacgagauccaccugucucugccuucugagugcugggauuaaagacaugugccaccaccaccuagcuucuuguuuuguuuuuuuaaauaccucuaguaaauuguuagaccaguuuccacuuaaaagguggugggaaagaugggcugcuagguguuuucuuuuauuccggcuugguuagaugacacgugaacaucuugugggauauggagaauagaugaaagcauugcagccgccugguaguuagccgaguaaaugccaccaagagggagcuuugugguaauuagcuguguaaaugccaccaagagggagcccuucuucccuccaguccugaauaccuaaggccaaauggccuaguuaguaguaauccccauuuguucuguuagaacaguucaaauaaucuguuacagggcugggauaaauauaauuaaauccacuuauugccaaagagcggcuacugccaguuuacagcuuggccuuccaccuguacgaagccugcuaggacacacauguugugugcccuagaguugaaggugaguguguguguguguguguguguguguguaugagaaaacagguuauaaacugaguaaauagacacacucuagagaugaugaugaguauauacauaagcuggagacggaguagauacaguuuuauacuacccagguuagaauuguagcccuggcuguccuggaacucacucuguagaccaggcuggccuggaacucagaaaucugccugcuucugccuccugagugcuaggauuaaaggugugugccaccacgcccgaccucacucaccgaucuuacgguaggcgugauuuggacaagauucccuucuuucauacugccagccuaauuucuaaugggauuguucuaagguaggauagagaauauucuagaagacagggcaagauuucuguguguguguguguguguguguguguguacgagggagagagagagacagagagagacagacagagagagacagacagaaacagacagagagagguauguguaggugguguguguacauuuguaugggcaugaaggugccacugcaugcuugugcuuagaggacagccuuggguccauguccugacuuuucucuuggcuuuagacagggucuuuuuccugcugcacuuugcaccaguugaccugcaagcuuccagugauucuccugguucugcugccgggauuacagacguuugugcuauguggcuggcucuuauauggguuauagggauucgaagucuuguucuuguguuuccauggcaagcacuuuuacccacugcagcauuuccccagccccauacauucacaguuuuaauucccguuaaagucgacaagacugucgagauguccuuuccugccaaacuugcaucugcuggcuuacucuugacauagcuccccguucugacauagcaucacauacugagagcuuacauuagugauguuagcagaggcgaauagagaaauugugcuguccagugccccuagaagauccacacacaguggugcaugccuguguccuagcuuuugggagacugaugcagccagaucaggaauugaaggcuagcuucagcuuugucuagggagucagagggcaccccgggcuaagugagaccuggucacaacaaaaggaacaaaaauguaucuugaaagacaaaauggggaagcuaauuagucuugccucauguagcauguugacaugaagcccaguaguaaggcuguagacuucucugcuuguccaguguuaaaucaugugcaauacgauacagucccauguaaaagaauuuauuuagguaaagagguaaugacaugugcuuuuaaaaaaacuuacagaaagaagaaaaugcaauucaaaaggauuuuaaauaggagcaagucaucuuagguaaugauguuuaguaguauucuauugaagcuuuacuaaaaauuaaaauauuuucaaaguccaacuugaacuuuuguucaaagagcagacuugagacaauugaaguaaauguucucucucgcauuuuguuuccacauugcugauuuuuagccuugaugcagucagugguggaauacagacccugugauuucagagaggcaggcauuaaagacaaauagcaggcaacauuucagaccuacacacgugugccugcacauucagaaauacuuauagaaacgcagcacuguuuuucugaguuauuugcaaguuuuuuucccccauccaaaacacuuauuuaaugaaacagaugaaacccguucuuuuguagaacaguuuaguuccaucuugcggcccugcauuugauaugugagagacaaugcauuccgaagcuacaaugagaugaugcuguauucuuccauagaacaggggucugacauguuacauauuucaguggcuuuugaucauguuuaaaauuuuuuacugguuuauguuaauuauaugaagcaguggguuucauucuggcauuuucauacauguauguaacaugcuuuacuuaaaaccauggguuucuuuaugacauuuccauacauguauguaaugugcccuuucuuuuuuuuuuuuuaauuuuuuaaagauuuauuuauuuauuauauguaaguacauuuauuuauuuauuauauguaaguacauuguagcugucuucagacacuccagaagagggagucagaucuuguuacgggugguugugagccaccaugugguugcugggauuugaacucuggaccuucggaagagcagucgggugcucuuacccacugagccaucucaccagccagauaauauuccuuucuuaucucuguuuuuucuucauggucaccuucucuuaccucaaaguuuuuguuaucaagaaugacauuuuagcugagcuggagauacagccuggcugguaguacuuaccuggcaugcagggaacucuggguucaaaguccagcaccguguaccgaggaguggugaugcgcauaaaggcuagacuccuccaaggcacuugggagguggaggcaggaggaucugaagguuacgguaaaucuuggcuacaaaguaaauuagaggccagccugggguacacuagagccuacuuaagaaauuaacuuucuaccucuuuguuaagauaacugaaagcuccuguuacuaaaauggcaugcuugcugugaauuuuaauauauuaagugaaaccuaaauugaacacaagucuuaggagggccaguuuugcuguaucaccugucugugagccugggggugacuuuucucuagaauuggagcauaguuguuuguuuguuuuuuccaggcaggguuucucuguguagcccuagcuauccuggaacucacucuguagaccaggcuggccucaaacucagaaauccuccugucucugccucccaggugcugggauuaaaggugugcuccacccccugccuggcuuggagcauaguuuuauugcagaacguggguuuccagcuuuacuagagauggcuuuagagaacgguaacagaauuuuuuuauguuuuuccagaauuugugggauuagacuuguuuuuuuuuuuuuuccuuuuuguuguuuguauuuuuuuugagacaggaucuaugcagcccagccuugcaccccgugucuccugcccgaggcuccugagugcaggcagggauuauagguauggcuguuacacggggcuagcuagguuagaugcuuauaaagcaaaacugucuaguuauguuuuuguuauuguuuuucuuugagucagggugccacuguguaaccugggcuggacuggaauuugaugugugaaccaggcagacucuacgccgaaacuuccugcccugagcuguaccauggcuguaaaucaguucugaaaugggaguuugccacguuacuguuugaugaaguuugucggauugaaauuuggaccugggcaugugcacaucuuagaguuccaaggaggacacggggauuuguuguuguuguuguuguuguuagauuagguuguguuucugugguuugagaccaaagaucaaccuaaggaagccacuuuguuucuuggcaaaggaaguuguuuaaaaaaagaaaaaggaucuuucuugccuccuugcuuucucucacugcuuuggcugugagcccgagccacugguggugacuaggagguaggcaugggaaugaguuacuucucuagcuacuguuucucucugugugcacaaaggggacagaugauuuacagggaaaguguggaccuuugggcuugggcugugagguuauguucuucuuggcuaugaaaguaaguuggugaguuccucucucccaagcauucuuuaucucagguuuauagaaaugauuauuauauaaaagaggaaaaacaggaugaacugucccagcucacugggcacacacuagugauuucccccaccccaccccgucuguaaauggaacaugcaugacucaccacggccggccacacaaggcacuuuuguagcccugcuucagggggagggcgggaugaggauggagggagaugggcuggcaucccacuuuguacagcaggaucugcccagcugccauuguauggacuucugaggaggacagugugccuucucagacgucauacugcagagguucgaaacagugcuuucuguguguaccgaaagaaugcaauauaccaauguacuaaaaaugcagccaguaagaacauuguaauguugcgcguucauguucugcaguagagugcucuucugguacauaagaauuuaguaguaaaagccagggagaugguuugguggguuuggugcuugucaucaggcccgggaccugaguccaaucucugagaccuaucugguacaaggagagaccugguuguucauugaacuccacauguguuccauggcuggugugucuacauacaugugugaugucauagauauuucgggcagugguggcacacaccuuuaaucccagcacuugggaggcagaggcaggcagauuuucuagauuucuaguucuaggccagccuggucuacagagugaguuccaggacagccagggcuacacagagaaacccugucucgaaaaaccaaagagagcaagcgagagagaucguagauauuuaauaucucucucucucuaaaguauuuauuuuaugaaugugaauacagacgcucgcugucuucagaugcaccagaagaggacauuggaucccauuacagaugguugugagccgccaugugguugcugggaauugaauuuaggcccuccggaaguaaguacuuuuaauaguugagccaucuauccagccccuagguauuuaauuucaaccagggcuuucuacuccaccuuugaucauucaguuccuagguaaaaacaacuucuauauuuauaauaagccuuaaucggcacuagagcugggcagacaucuacccucguuuaccucccuacaaauaaccuugaguuaugacuugacauaugacacauggcugcucuaacuccaacuggccaggccacauggccaguucuuaggaucucuuauccuggacggucgucuuucuccuggucccucuccagacccaaacucggcccuccucucuucugcccacuaauaggcuguaggcaucuuuauucaccaaugagggauaaccugggggcaaggcuacauagcaucacuuguguaugugcagguucucucauuccuggggggcagccaggccuugggggccagcauuuagcauuacaauauauaacaaaaggcccaacuucaacaauuccccuuuuugucuaaaaauauucuuuuauaauaauaaacaacaugcaauaggaacacuuaucaagauuauuagguaagaguuacauuagaaaaaaauccaguuuguucauauuugguaacucaggagaaaguauuuuauugucucuccuaucuugcugaguucagaguucuguaucuaaaucacuuucuaucuuauauuaccauccuaaaagcaucuuuuuagaccuagaacaucuucuuaaauccuaaauaacuuaagcuuauaguaaggcugacuauguagucuucaaccccaucagaaaccugagaaggaauauuaccugagugugcaggaaguguagggaugcacacacacgcgcgcgcgcacacacacacacacacacauacacacacacacacacacacauacacacacagugguucuguccuuccaccaugcagguucuggggauagaacuuguugucuggcuugguggcacacaucuuuaccuucuuacuggccuuaugcuucaaacucccaauccuccuguuucagccucccuugcuggcuggaauuauagguggaugccuucauacuauacccaugauuugcuuaauuuauagauuaagcuccgaauuuauaccuagcauauaggcgugugugugugugugugugugugugugugugugugugugugugagcauauaggcguguguguguguguaucuuugaaaaaugauuuuucaucaucuuaccuagaauuaaaaaaauuuuuuuaaguacuauuuuacucuguuuuucuuauacuuacagguaauuugccuguauguauguguauguguguguauauguguguguguguguguguguguguguguguauaugaauguauguauacuaugcacaugccuggugccugcagaggccagaagagaguauccuauacucagaacuuggaauuacagacuauugugagucaucuuguggcuugguugaaccgaacccagguccucugcaagaacagugcucauaagaacugagcuaucucuccagcccugaauuuuuuaaagucacaaauaagagcuugucuguauuucauagauagaucuuuaaauuaauggucauugcugcuuuuuuuaaccuauugauaccuaauagaaaaugaaaccuaguuacuagacaucauagugucuacugcauguguagacacucauguucccagugcccagggggagcccugcacaccugcuggggacucccugugauuuccccuaaauuuacuugcauguuguuauagcaaguuacuuuuucaccagugggagacagguuagauguuaaccagcucauuccucaagagauggagcaguguugauucaggaugugugaagaaaaagcaacaaaucacuggccuagacacuuuagucuuucuuuaacaccuuagaugccaacccuggaaaguucuucucugacccucacauucauacaugcaagcacacaugcaagcacacaggcacacacagcuguacacaaauaaaauuuuuagauuggguuggggagauggcucagugguuaagagcacugagugcucuuccacagguccugaguucaaaucccagcaaccacaugguggcucacaaucaaucuauaauggaaucugaugcccuguucuggugugucugaaaacaguuacaguguacucauauacauaaaauuaauuuaaauuccuuaaaagaauuuuuuacguuauugaaaaacagaaaucuguguuaguauucaccugcauugagguggggugauggcaaggucuauuacauuacacgguccaggccaaccugguuugcauaagauaccuucaaaccaaaccaaaaacaaaaaggaagaaaaagaaaaaaacacucuuguuauaggcaacucaaacaaauguuuuucuuuucuuucuuucuuuuuuuuuuuuuuuuugguuuuucgagacaggguuucucuguauagcccuggcuguccuggaacucacuguguaggccaggcuggccucaaacucagaaauccgccugccucugccucccgagugcugggauuaaaggugugcgccaccaugcccggcaacuuuuuuuuuucauucauuaauacuaguauuuguuuuccuugcuacaagaaugauagagcaaguauucaaaaggauggauugauaaacccuaccccaaaaccagaauggaaaccuuguuuggauaauauaucagacacagucagaggaccucaccuauguuacacgugaccuacugaaaguguauuuaacuuagauaguauguacaaaacucccgcauuccugugugucaguaacacaacaaacaugcaguauacacacaugucacuugaaucaauuugugguaagacaaaucaggucucucacuuaagauacagcuucccuaguuuugacauuauauugguaugccggaagaugcaaacaggcauucauuugcauaucgaaugaaauaaggggcuuuagaaaaacgauggaaccaucaguacuuuccauguaagacuuuccaguugaaaaguuaauuuggaaauggguuaacaggcaguaucacuaaugguggcccagagugagcacggcauacacuacgaauaaacauuucccugagcauaucaggcaguggcuguuugcuuuggaacgguacauugaguaaguuaguugcuagggcagaaggagauggcaggaacaacuggcaccagcgcacauagauggauucuugguagucaauuguucuaaguguucagguucuguggaggaccuggaaacguugcuaucuggcucuuacuacagagugcuuuccaucugucugucuauccaucuguguguguguguugcucacugcauauguuccugaacaaauuguguauuugcuuucuuuuuuuuuuaagauuuauuuuuguuuaagguuauuauugcuuucuuuuugcagaguugggucaaaugcuagucaagugugauacagcuugcuuacauacugagccacagauuauuaauaucuucaaagcacuuuugugcucgauguguguauguauguuccccagcauguguguguauguauguuccccagcauguguguguauguggagacggguucucucuguccaccuggauauguguuccagggauugaauuuaaggcaucaggcucaagauuguuaauuuuuagaugcaccugguaaaaaaaaaaucaaacaaauucgauaagcuagacaugcaagucuuacuucauguuuauaguuucuuuucucaggggcuaguauuauucuaucuauuucuuuuguauccuucuagaaguauucugugcaaauacaaaaauaauauucauauuucauugcauacggugacauugcaguaugcuguucugcuaaccuguccuguguuuguguaugugugcgucaguaugugucccugcuuacacaugcacagcggagaauagccagugcucugccgaguugcuuuccagccuguucccuugagccaggacagcucauugaacccggaaccugccauuuuggcuagacugacagccagcucaccccagcuuccuccugucuccaaccccaccacacuggggucagaggcacaugcagcuaugccuugcucuuucauauguguucugggcaucgaguucaggccccgaugcgugagggacagguucucuuucccgugagccaccagcccggcccacuaacaaguaucuugauuuacuuugaauuaaugugugcauaccccuuaaguuaguuguucucugggcugcuggacauugaagucagaugacaagcccagauuauucucuuagagacccugacuuugucugggcggaggcuuucagugucuaugaaacccuccccaaguaauucagugcacagccaaccaauuugucuacagaugguuuauuuagauugaaauggugaaauucaugcuuaaaggguccuuaugcauaggucaaguagauuuucaggauaauuuccgccaaccugagaguuuccacuuguugauacucuuaccagugguacaugcuagaggcuguuuaguggagaugacuuaaaucacaguaaagaaauuguggggugagagugaaucuggauacuagcuaacucaguaguuguugaucacguguguaguccaguguuacuugcaucauuauaagacuuuugguguucauuuuuguagugcuaucuagaaauaaaaaugaacguuuaaaaagcauuacguuguacuugguacacacuuggugcaugugugugcuugcauacguaugcaugagguacagcacggagguaaacgcuggguguuuuccucaguugcccucgaauuccucaggacaaggucucacugaaucuggagcucaggcugguccuggagucacagacgcacacugcagcuccuggacuucgcauggguucugaggggcuggacgcagguccuccugcuuucuuugaccucgccgucucccacauuguucgcugaccugaguaacucaaaaggaagagcucuuguacgugaagacuaaaaagcgucuguagagaugggcguucucuaggcauuaucauuaugcugaucagugacaaacacuucccaguuguacagcaggaaaacuacagaguuagcguccuaggauaccaagugauggauaaacgauuaugaauauccuaauagaaucuguuuacuauaaauuaaaaauuccaaaaccguuagguaucuaaaucaugaacacaucagcaaauauacaaauaggugaccaaguacuagaaggcaaaaaggaaguuaaaaaaaguguugcgauggggugaugauugcggacaaacagcuugaaacaguuaaggggggagcaguuguaucugaugcaaugaagacauauuuccauacguguuauccuccagcaugcuaagcacugcuguuauugcauggcugguuuggagaauguguggagggaauggaaguaaccucugcuuacuccagcugacaguuaacgugcaccuuagcucuaguuggugcaggcagauucacaguccgugauuuguacaccauugucuuaccccgaagcccaguuugcccugggcuuugaucuuaaugcugcuggcuuggcuccuuguguuccugucccagacucuaugagugcugcgauuauagacaggcauggccacacuagagggucaagcuuuaugcuagauucauuucuuuacauuucacuauucauggguugggccuguguguguguugaugaaugcauacaggguguacguauggagaucaaaggaccaacuuuugggagaucuuccaucguauuaucaggcucaguggcaaguacuuuacucagugagauaccuuacacacacccacacacacacacacacacacacaccccaccccuguuauucuuuacuccuuucuuuuuuucuuuacuccuuucuaguagugaguuuuacagcuggggccauugaaguuaacauuguaucuaauauuuacuaucaauggcgagugagcuugacuugaccuuccuguaugcuaaaguagcuuguugugggccuuuccuaaggagcugugaguaauagcuuuucacuccagacaaggcccuaaggacagaccaaagaagugauuccacccaaguccagcuugcucaaccagugcguuuauuggggugacuuacagaagcguggaugacuaaagggcagcugcggcaccaggaagcccaucugcguaugaguggggacuccugaaagcugagucccagaccacaggcugcuccacaggaguccuuuccccagcgguugcuaacugcuuguaugagcguaggcagaggucuugugagucuuguaggauuucugaacuuccagaaccugguaagguuggagggauuccugagaugucagcuucccugguguguguccaggaggagauguuugagcucacaggaaguagcuggagcacaugagugucuggaggcuucgugccaaguccacucaucaggacuguuguguuccacucgccaggcuguaguagguaauuucauugugguugagguucugccaugauggaucuuuucaguuuuaauuuguguguguggggggguggggggcgggggugggugggaggggggcgggggugggugggagggaggcggggaucgaacccagggcccuacaugugucuuaccacuuauuuaguucugauuauuuuagaacauuuuagugcaagguacugagccuacagcuuaccauuuucuuucauuuuuuuucuuuuuagauuuucuuucuuuuuauuuuauguguauuaguguuuggcugaauguuugugcccauggaaggcagaagaaggcauuggauccccugggccugaagucacaguugguugugaacugccaugccugugccgggaaucaaaccuggguccucugggagagagagcauccaguguccuuaaccacagagccaccucuccagcccugugacuauuuauuugccuucagagcuuuaucccagagcugucauuaguuaggagaguacagcuacccaugaagauaaaacuuuguuuucugcccauauaaaaaauaccuagagcaagacacgggcuauacacuuguaaguuuagcauccgggaggccgaggcagaaggaaggagaggguaggguuagccugggccacauaaugaguucuaggacagccuagcuccagugaaucccugaaauaaacaaaacaaacucagaugugggagccuugguuaaguaugaugugaacauuugggaaaguccguuugcacauguccauaucuccccaucuuccucaggaaugggaggagcccauucacucacugguuggguuucuuuuggucucguguaguuucaaagauugguccaguuuaaggcugauuugcaucagaguuuagcacuauuuuccugcugcucugcuucuguugcuaucuugucaggacagauggauggauggauggacaggcaccucuucagggguaacugggcaggacguaggaaugaggaagggugaacuauaagcaugagaaauaauaaaaccagauagugauauuuaaagucacagcaggguuuugagaucaaguaaccugggagaaugguaacauaauuaauagaaaugggaacuuagaaagagaaaugauuuuuaaaagggaauaaaugcauuuguaagcugcauugagguacuuauacucccaaauaauaauguaugaaguuagagagauaauagcuaauauugccagaguaccagaguucaucuuuaacucuucggaaacuuucuuuuuugucccccucacacuaacuacaugguuaaaauugcuuuuccaagcucaggucaacugccaucugcgaucuucuuugcugauugcuucaaaggggacacuggucccuuuccgcuuguggacauaggauuuuauuucuuuuuauguggcaguuaauaaucucuaagccuguuuuucuuuuuuuuuuuaaaaauuuguauguaggucuauaauuugauuuugagacauuugugagggggugggggaggaguacagaaaaauggggggggcuaguuuucuucauagaagcuucuagaagugauaguguaguauacuuuauccuucuccagaagaaguggccucuuauuuauggacaggucucuuuaaaaguugcuucauauuuuuuuuaaauccaaagccaaaaauacuauauuuggguuugguguaguggcacaugcucauaaucgcagcaugcaagaggcagaugcagaaggaugcugcaugucugaggccagccugcucuacauaaucauuuuaagccuacccagggcuaaggaauaagaccuugucccuaaaaggcuuuuuaaaaaaaaaccucaaaacaaaacaaaacccaagaaaacaaaaaccaaaaacuacaacaaaaaacaggcuggaaagauagcgcaguuauuccaggcacuggcugcucgugcagaagacuuggguccaguuccaacacccucaugguagcacauaaccaucuguguaauuccaguuccagggaauccucuuccggccucugaagguaccaggcaggcgugcacccagcgcacauuuguauauacaggcaaagcgcucauacacauaaaauaaaaagaguuuuuaaaaagccggaaaaccaaagaaaugauugcaaacauuuccauuacaucauuuauuuauuuugguauaugcgcaugugugugggugcacauggagcucagaggacaguuuuugauagucgguucaaacucauccacacugaucuagggccccaggaucaaacuuagguccucacgcuugacggaagguggcuuugucgcugacacgcccuucuuccuauccccacaaaucguagucuuugucuucauucuugucuuuuuuuuuuuuuuuuuuuaaagaaguugccauguuagguacuuuuguaccacuguggcucguuucacuccagaaacaauuuaagguaggaaaggcuuuuucugaaggguucacuccauggcuguuuaguugcagguccuugguaaaacaugguggcaaugggagcaugagggggaacuuccucauggugggcaggaagcagagagaaaaagaccggucgcagcgcuccucaagcaaacauggucccgcuggccacaggcugcacucaggaaagcacuaagccagugccuguuauagccccccucuaaucuggguauugcccugcccugcccugcccccuccugcucucugcaccguacucucaggauuuccuggcauucaguuuuuguuaguaaucaggugugcugcugccgcuguugucguagugcaggggcccaagccucuuggccucuucgccuuuagacuaaacucaucuugagucgaggcuaaaaacaaugugccggggaaacucugccacaggugaauggcuuugacuggaagugggaaagucuguuuuuuccagcuucaagaauaguggagagcagcuuaaucguggcggggugggugggguagggagccugguagaggacagaugugaugagaguuuccuguggaccugcugcuuugguucaggcugaggcuauuaaagguacauccgaagaaugaagcagccgucuagggcugcagaaguaaucagacugucuacgcacaguaguuugacggcuaaucaugguugucaacucgacaaaccugggaagagggagucucaaucaacaaacugccuccaucagauuggccuguaggcaugccuguggggcauuuuuugguugcuaguugauggaggugggcucacaggucacuguggguggugcuugcugucccuaggcaagugaaucugggccagcuaacugaacaagccauggagagcaaaccaguaaggagcauuucucccuuggucucugcuucugauccuuucugggcaucucucgaugcugauagcguguaacccaaauaacccuuucuccccccaaguuguuuuuguucagugauuuaucgcagcaacagccaugaaaaguagaagacaaauugguaccagcauagugggguaugccugugacaaccugaccauguuuuggggaggacuguggggacuauggaacuucgggccagaagauccauucgguguuaaaagaacucugugggauguuguauaggagcuuggaagauaaugcugagaacagugcagaagauggaggccuggcuugugaaauuucaagggaagauuaaagacgcuuuucagggccauugcuguuuuggauugugaagauucugugguucugguuagcugaggcugaagaaucagcugugauuaacaagauaccagaaccacuagagugaagccuuugcauuacugggacuauugaugcugguuagcuggagcuaagaaauuagcagugauuaagaagagaccagcaucauugacaucuucugggaaguguuuuaugagagcacagaggccaagguuguaccuugggcuguggcuggacuuaguaauguauaagagucacccaggugguacugguuuugaaggcaugaaggggucacgcagagcagcugaggcucggcacugugagaggccauggaaggccauuggugaaggugcagccacaguugcaauugauggcccaggacugaaggggucaugcaguguuuuggagaugccaguaccaugagaugaccaccaagagcagcagcagugaguacaggcaucuggagccuagaggaaaagcugugugccacaaaggacagggcuggagaagugacccaagcccuuggaggagcccagaggauugugaguuggagcccagacaucggacgguuggaguuuaauuuuugcuguugauuaugacugugcccugauauuuuucccucuugaaggaagaaaauauuuuaguggagcccacaguuaagagacuuuuaauuguaaaaagacuuuggauuuuaaaagauacuggauauuuuaaaaggauugaacuuuuaauauguaaagacugugggacuuuuacaguuguuuagaucuuagggaugaauaagaaacugaggauugaggcuagcuacugauguguuugugugucaaguugacaaggggucaauuaauuguacuggcuaguuuugugucaacuugacacaugcuggaauuaucacggagaaaggagcuucaguuggggaaaugccuccaugagauccaacuguaaggcauuuucucaauuagugaucaagggaaaaaggcccuuuguggguggaaccaucucuaggcuggcagucuuggguucuauaagagagcaggcugagcaagccaggggaagcaagccaguaaagaacaucccuccauggccucugcaucagcuccugcuuccugaccugcuugaguuccagacuuccuuggugaugaacagcaguauggaaguguaagccgaauaaacccuuuccuccccaauuugcuucuuggucaugauguuugugcaggaauagaaacccugacuaagacaaauuaucgcagcaacagccgugaaaaguagaaauugacuggacuugacaccuucccuacccuccaucugugaguccacacucugaaaggagcuguguguguauguguguguguauguguuauguauguguguguauguauguuuguguguguguguaugucuguguauguguguguauguauguguguaugucuguguauguguguaugucuguguauguguguuugugaguaugucuguguauguguguguauguguuuguguguaugucuguguauguguguguauguauguauguuuguguauguguauguguguauguuuguguauguguguguguguaugugugugugugugucagcucuuacuuccugaggagcguuguuuccucacuuacuacgauaaugccuucuguuguauuugccaugaacuaucacaaccucuuaauaugaugcuucugacguaugucuugagcuagaaggauaagcauaaaaaugaauuuguccgaucucucuguugggaaaaacaauucauuuucaaacucacuuucuccuacaggcauuuuugaccugugagguucuuucccacuuaccaagcagguaaccaaucagcucuggaugccucuaagauguucagacccauuucaguuuuugccaucagcuagcaggauauccauggggagguagcaucaugucccacaggcugaggacuccccccugcagaugccagugccaggugguuucuuaugguguggccuaccagugguaaaucaggguucccacaacccucucugcaggcuugauuaaugggcuugagucauucacaaaacucaaggacacagguggaagcuguggcauccuuuuggaaggugcuauccuccacaggcucaucuuucuggaagcucuuccagacucauucuuugagguccugguggaaauugcauggacuugauggaagugcaggcacagcuuugaagugugauuggaaaggucugcucuaagacuaguagacugguggaacuaugaggccuucucuccagguacugcaccuucuuucuccugaguauggggcaagaucccccuugaagugagaguuuugucuccuagcagacaagguaggucagaaaagggggagggaacauggcuguggagaagacauuguggugccuauggccuguugcucuagcgucugcagucauucaagaucacagacugacgaguccuauuccaggucugggagcuggaaugcacugcccugcgggaguucaguuugagaagguucauuccuccuuauucuaucaaggggugugaugggagcugacugcacaccaagaugaagacacuggaggccuugcagaagcgcucagcaaagaauugcuaaacaguuuggucucucuguucaauagagaccuucauuuuacauuuuccuucacuuuucgcuuggauuuugagagucucuaguccaagcugcccuugucguccucacccuccugccucuuugaaugcugagaugguuggcaucugccaccaggccuggcucucuaugugauucucuauagcuaaaccauaauuagaauuuguuuuaaguauucugaaagagggaauggguuuggggucagggaagguggagaaagaagccaggagugaaugagguguggugguuguuguuuuaagcauugcuucaaguucccucugaaaucuuauuuuuauuuuuuaguguuuuucauuuuuguuauugucacuuaaauuuuauuuuguacgguguguguguaagucaaaggauagcuuguggaaauugguucucuauuucugccacauggguccuggggauggaacucagggugucagguucccccccccuuaccccccaacaguuuguauguuggcauacuuguaauacagagauuacuuacuuaaaaucaacugcuguugaaaauacuggaaaauuucuguuuucccccauaagcuuacgcagaguagugcccccuugcucagcaguucauuccccuacauucgcugcaguucaugccauacacagaagcuuugaacauagguaaaagguggugguguugggagccuggacagagcauuguccuuuucgaugagagccagagaggaguuauacauucuucuucuucgucuagaaacguccuuccccgagaggaggcagaguuaaguguggguauaguacuugcuaagaauauuuuuuuuuuuuuuuuuuuuuuuuuuuuuugguuuuucgagacaggguuucucuguauagcccuggcuguccuggaacucacucuguagaccaggcuggccucgaacucagaaauccgccugccucugccucccaagugcugggauuaaaggcgugcgccaccaugcccggcuugcuaagaauauuuacaacugccuucuauauuucaggaacugugcuagagucuagcacgagacugugaagugagacauggcguacuuucagggagcuagaguuaacaaaccaacagaaaacucacacuccuauuaaguacugacagugugauccuugucgguucaccuguucucugcaguguguuuguaacccucuggggugauagcccaucccuguacacacaauguucacuguauagguuuaucauccaucucacggcuaaauuuuucaguucccuugucaugugauuuucguuauuauggcauguaagucuggugaauaagaagauccagcaaauagggguaccgauuccucucaguucuguuugcguagggguuggagagacaggcagcuuccucccaagucacugguaacuuuggacccugcguuucagccaucaacauccgcuacucaccaggcauuggaccuccuuuucauuucucucuggucuuggugacggaagcuggaaguggaaagcggcaaaucacuugccaucauuguggcuuggaaucugugccucccagcucaguacaauggcaacacacagcuggggcuacuccaaaugugucuaaucugaguggagaugaccucuaaaccacugagguauggugacaugcuguagucccuggacuucagaggcugaagugggaggauuguugaggccagucugguuuaaagacuaaucagucgauuucagaugugguccauguucucgagaaaucuguuaccuagcuccggaauucagaaaggacaucaugacaucgccguggggugagaugggaagagagugaugcuuaacaguggcagcuggagcacuaaugcugguggaggaggugacauccaaggcuugcugucaguggacaccaccucacaccugccuuuaugacaguccugcacaguccaaauguccuugcaaaaguaagacccuggacaagagaagacugagacugacuucuaagguacacaugccacaugcuguggaggaagaguugaggcccaguuauagcuaggcaguucugagcucuaagaagcagaucuuuccaaguccauucugucuuccugaggaggauguuggagcauuuuuuucaggacagggccauugugggaaauucuaaccaagugaacgaucuugguuucuuccuagugagguuacaaggucuggcuuggaaaguuacuuggaagauguuuuagacagaagauuugguguaguuacagguguuaaaauuguggucuaaggggccuuugucaguggaagagacgauuuggaagcuaauuauuucauaguuauaauucucuaccuuguauuaauuuauucugcaguuuacuguucucuguggacuuugcagaaucuauuuuagauugugcaauuucuuggagauuccagagaaccggcugcauuuugugagguuggaauugaagugaggaggugacugauuuuaguaagaucaucugccagguguugucgccuucguguugugugaaucucaggccguccucucugagcugucagcacacaaacgguguguacucugggccuugugcagacagacagacagcacaucccauuagucugcagccccagaaguuuucagaggguuucucagcugcucacaugcaguauuucaaagcccuuagagcuggauagagucagagcugagcagacuaagacuagggauguuugaguagucuccugagucgcguggacagugaguaacuggggccagaacgaggugugccugucuucuugcccagccuucuguccccggugugaccagcagggccccaugagcuggccccuccccucugcaugcucagaugccuccuggguucccgguacucaggcaccaugaggcacuuacucagaugugucugcugagucacaguucaacauccuuuuccuugcuuucccuucucauaaauugauuucuacauauucguaagcagcagauguagcuuuuuuuuucuacuagaaccuaaagaauguugagucuuucuuaauuagucaugcauuuguuacauaggaagcuuuuaauuuaaauuuaauuuaauuuaguuuuuuguuuuuuucgagacagggucucucuguggagcccuugcuguccuggaacucacucuguagaccaggcuagccucaaacucagaaguccgccugccucugccucccgagugcugggauuaaaggugugcgccaccacugccuggcuuaguuuuaauuuuguuuugauauaaaucaugguuguuacccaucaaucuaaaauagaaagaagacaagagagagucaucuuuuaacagauacuuauuuuauuaauguguguguguguguuuaaauuuaguuacuuguucaguugguuuugagacagggucuuauguaaccuaccuggucuacauagugucuuagucaggguuucuauuccugcacaaacaucaugaccaagaagcaaguuggggaggaaaggguuuauucagcuuacacuuccauacugcuguucaucaccaaggaagucaggacugguacucaagcaggucaggaagcaggagcugaugcagaggccauggagggauguucuuuacuggcuugcuuccccuggcuugcucagccugcucucuuauagaaccaagacuaccagcccagagauggcacugcccacaaggggccuuucccuauugaucacuaauugagaaaaugccuuacaguuggaucucauggaggcauuuccucaacugaagcuccuuucucugugauaaccccaguugugucaaguugacacaaaacuagccaguaugauugaccccuugucaauuugacacacaaacacaucacuaguaagccucaacccuuacauucuuauucauccccaagaucuaaacaacuguaaaagccccacagucuuuacauauucuuaaaauccaaagucuuuuuaaaauuaaaagucucuuaacugugggcuccacuaaaauauuuucuuccuucaagagggaaaauaucagggcacagucauaaucaaaagcaaaaaucaaucuccaaccguccgaugucugggauccaacucacgaucuucugggcuccuccaagggcuugggucacuucuccagccaugcccuuuguagcacgcacauuguuuucuaggcuucagcugccuguacugcacugcugcugcuguuauuggugaucaucucaugauacuggcaucuccaaaaugcuacugucuuccacuguaacuuggcuucaacaauagccucucauaggcucucuucauggugccaagccucaacuccuuugcaugaccccuucaguccugggccaucaauugcaacugaggcugcaccuucaccaauggccuucccugaccucucacggugccgagccucagcugcuuugcgugaccccuucaugccuucaaaaccaguaccaccuggguaacucuuacacauuacuaaguccagccacagcccaagguacaaccuuggccucugugcucuccuaaaacacuucucagaagaugucaccucagugaugcuggucucuucuuaaucacggcuaauuucuuagcuccagcuaaccagcaucaauagucccaguaaugcaaaggcuucacucuagugguucugguaucuuguuaaucacagcugauucuucagccucagcuaaccagaaccacagaaucuucacaaucaaaacagcaauggcccugaaaagcgucuuuaaucuucccuugaaauuucacaagccaggccuccaucuucugcacuguucucagcauuaucuuccaagcuccuauacaacaucccacagagcccuuuuaacaccaaauggauccucuagcccaaaguuccaaaguccuuccacaguccuccccaaaacauggucagguugucacaggaauaccccacucugcugguaccaauuugucuuagucaggguuucuauuccugcacaaacaucaugaccaagaagcaaguuggggaggaaaggguuuauucagcuuacaauuccauacugcuguucaucaccaaggaagucaggacuggagcuuaagcaggucaggaagcaggagcugaugcagaggccauggagggauguucuuuacuggcuugcucagccuguucucuuauagaaccaagacuaucagcccagagauggucccauccacaaggggccuuucccucuugaucacuaauugagaaaaugccuuacaguuggaucucauggaggcauuuccucaacugaagcuccuuucucucugauaacuccagcugugucaaguugacacgaaacuagccaguauaacauagugagccccuauaccaaaacuuagugcauauuuuuggcacauagcugcuuagcacuugagagguggauggugcgggaucaugcauucaggucauccuugcucgaggcuggucugggauauaugagaucuugccuccaaaagccagaagaaaaacaagcacuaaauaaaacacccaaacacccucagaguucagcgcuggagcucuagcuccggcaacacccugagugcuaucccugcccccaaguuaaaaauguaagagaggccuuuccacaaaaagucucuuuuucagggagacucaggaacagaucuaaugugggccagguguguggagcacaagacauaugaggaaguacagaggauugugaaaaauaaggcuuaccacagagguccucccugcugauccaacauggcuaaaacuuagcugugguuagagcaugugaaaugaggcuucugggugcugcaugucuuaugacccuggccauauauagcucucugcagugcaugcucuguaaggagcuacagggugcaaaggauuuguggagaaguuaauuguuauagcuuuacauccaaauaaaagagaagcagggguucugaaaaauucuuguguaaguccauuuccaaaccuauuuucuccagaugauaagauucugguaagaauaauuuaguguugaccauggcagcacauggcaguacauaccuguauugaggagagggaggcauaaggaucagaaaauucagagucauccuuggcuacauagaacauuugaggacagccugggguauauaaggugcuggucguuccccccugccccccaagaaaagaaugucuacaaaugcucuucagaguuccagauaccucugcuugcaacugugugcucugcucauaugauuuuuaggaaaugagagaccugugaaugauuucagacgugauggccucaauccaacaauagcuuagcuuccaaaguucuaaauaggacuggacuauugaugccuuuacuaagguccaaaucuggugacaaccugcagacaucagaguuaaauuuuaaaaguuauguaaugcuuguugcuaauguuuuccgaugguugauaaccuuuuuuuuaauauauauuuaauguguaugaguguuuugcucaaauguauguaugugcaucaugugugugccuggugccuucggaaggcagaggaggacauugaauccccugaaguuggaauugugaaugguugugagccaccgugugggucuuuuaugagagcaagugcuuauaaccacagagcugucucuuuagucauguaacuguugauaaucuuaaauuaaguauggcugucauuaauuuuacccaaacagaggaaucagcuacaacauuauacauaagaaagaaagacuguauuugaggucucugauacuggaccucauaggaaaaaaagcaaaaacuaaaaaaacaaacaaaacauugaaagacuaucuuuuuuaaaaauuuauuuuauuuauauaaguacgcuguagcugucuucagacacaccagaagagggcaucagaucccauuacagaugguuguaagcuaccaugugguugcugggaauugaccucaggaucuuggaagagcagucagugcucuuaacgguugagccaacucuccagcccgaaagucuuaucuuaaugcuugcagagagagcuaguuauuuuucucagacagugccccuuaggacagugagacuacaggcaugggacaaccuccuauugcuuucucuuguuacaacuacauuuuaucacagcucuuaucagggcuacuguuugacucauaggcuggggaaccccugcaaccuucucgccuccccucuuucugugcugucagcaggcagccacuuccucagauaaccuuugaauagcauuuuuuaaaagguaaugugaauaguuuaaaauuuucccaagagagugagaugcuucagaggguaaagacacuugccacugagccugaggacccagguucgaucccauaugguagaaguauagaaccaguucugaccuccaggcacaguacuccaccacaccugcaggcacacacacaacauguuuauaauuaagcaguguuuuccccguguggauuguuuugcuccuuagcauuaaagaagagcagugagagccugcacccuacccaccuagcugagugccaggcugggcagucaaguggcagcaggauggacauccaucccaugguguacuuggcuccugcacaggggauguuuacaggugagcagggcaggguucauggcaaggugucugauaagagacucagucacccacagagcauaugacuggggccuuguccucagagcuaacuuagaauccaaacauucuaaguggcaaaggauucaagguaauagaaaacauuuggcucaaugcaguaaucucuggugguuuguacagauggucacacccagguggguaccucuugacagaacagugugaggaugcucaugagugagccuaacgcucacccagggcaaguuauggccuggccacugaugaaucacaagcuuuggcuucuuuccuuccuucucucacucguucauuuucuucucucucccuuccucuccuaccacaccuuucucugcucuccuuugucugcucugaguuucugacucccucuugcccuccauccucucuccuccccucucuuuucuucaugaugcuggaaacugcacuaccaggcaagugggcuagcucuagcucuacgcuacauacucuacacucagugugucuuuaauuuuugaaacaagaucucaguaaguugccucacuauauagaacauggaggccuuacacucaucaucccccugccucagucucuugggcagcugugauuacaggugcacggccaugcacagcuguuuuuucccuucccuguguuugguucucucugucuguuaaaaggccguaucacuacugcccacuuccugugauugagagaaacccagggaacaaugccuggcaugcaaaauaagcacuccaugaaucuagcuaacuauuaucugugcuggacaaccgaguuuguaaauguugccaaauuuccugacugucaugcuugucugacgagugcagcuaauaucggguguguuuuggcacagauaggcagggguauuauuuuauuacacacugagugggccuugugaggaugagcugcuguugagucgcuaccgacuacuucugaccacauuucugaccaaccugguuccagucuucaaucuggcucugaagcccuucgccuaaagcacacuacagcaaaaaggucuuccacucccuaaccuuaguccgcuugcuguaggccggcaugagaucuuccuuucuuucuccuuuucucguuucuuuucuuucuugagucucuuguagcccauguuggccucaaacuauauaacugaggauggccuugaacucuuuuuuuuuuuguuuuuuuuuguuuuuugagacaggguuucucuguguagcccuggcuauccuggaacucacucuguagaccaggcuggccucgaacucagaaaucugccugccucugccuccugagugcugggauuaaaggcgggccuugaacucuugaucuucuugcuucuacuaccucuggggugcugggauuacaggucugugccaugaguguuagguuuuguuuuuucuugagacagggucuuauguaacucaagauacuugcugacaucacacguauuugcuuuguagcccgggaugaccuugaacugguuuggugugugugcacguauucaguugucuuugucagcuacuuucuaccuuguuuuggguaggccagcgaggccugggcgucuccccguguauguguccgcagugcugagauuucaggcgugcauugcugugccuggcuuuauaaggaugcugagacuggagcuuaggcacucauccuugcccagcaagcacuucacuggcugaaccaucucuacagccauagccuuggcugucugaccucucaagugcugagauaauagaugugugcuaccacaccugguguucccuuuuaaaauuucaauacacugcauucugcauuauaauaugcagaaaacuacauauuuuacuuaguuaaugcuuagaucuccaauauugagaucaagaaacgcgcuuuuaauacucucaagucugcucauagacaccacauuuugaaaaaucacagcuauggcaucaguugucuggagaugaacgagagaaagacacagcaaaggguugcaugugauacuguggccugagguuuuguuuguuucucgugaugauagggugaauugguagagaaggauuguuuaaguggguuauuagauguggguacacugcaggagcugggccagguuuuagguuuuucuucucuucucuaacccauuccucaguuguggcuuuugaguuggguuuucauucuguauaauguauugugaacacugcuuccccuuuugcagugugagguuagagagauacggaaaugcaccaguacuuagcccgaagcuuuccugccuugaauucuccuuacucuucaucagguguggaaacucacaguccccugguguccagucuuagaguucaggugguccugcagcaguggacugaaugguuguggagaagacuccauguaugacaggaaacagugcuguggacggucagagauucuuauuaaaggcagcaggcacauugaguaccauugcuaucugagugaugugccguucauugguagaaacuugcuguucuguagggccgcuucagugccugggauuugugaauggaaacagugcaacagcaguuuaaacuccugagaggccgggccuguguucggaguagcacauauauagcauuugugagguccuggugucaaccccaucaccaaaaacuauaaccuguauccauuccucucagauauugcagggcuucauuguaccucaguacucucuggcccugccuccuaacauugggaguuugcugugcuaugacccagccagugaggcagcagagguugcaggcagugugcugagcuguggggucuagucagugacugcggaugauuuuagguacucuuucuuuucuguaaugugugggugagcuuugugaggaagauagggaagggccaugaguagggcuacaaauaaaacuggugguggcgcacgccuuuaaucccagcacucaggaggcagaggcaggcggauuucugaguucaaggccagccuggucuacagagugaguuccaggacagccagggguacacagagaaacccugucucgaaaaaaccaaaaaaaaaaaaaaaaaaaaaaccuggugauaauugugguaugugugguuuuagcauuugaguagaguacccagugcgauuacacgccacggggugaggaccuguguaagcggguuguuccauuucaggaggaagaugacuuaaacagagcagugcugggcucaggagacucaguauaccuuuucuuaccucugucugcccugggagccuucucaucucucagaaggacgguuguggugauacaguugucuuucauuuacugcagaaauuugaagacguauugaaauaugagacaauuugggguagaaaagagacuucaaagucaaguaugauaguguguuuuuuguauucuauuuauuucaucagauuuugaauuacagaauuaaagauuaaggaacauagagaggaaauacugcuuucacauuuuuuuguaaguuuugaugucuuuucucauaagauaugaugugaguuauauugauuggaacgaccacaagaucucgaagccucugugggaccuuugggguagggggagguugcaguaucccagacaucagccugccacagagacauacugcuuguugcagguagauuugaaucaaagcuuuaaugcaacuguggaacgcuugcuaagccacucagaagugucuauaccagagguagaaaucucucugugguucaaagaagagucccaaggcccacuuuucauaugccaagaguuuauaaucuccuaaacauccuacaggauacuauagaaaaauaagcauguaguagguauuaaagugugcuuaaaguuauuauagaagaacucagaggacagaggccugggucauauggcagagucccaguggggacagacaguuacuguguaagggacuggcucucaggagcgcgguuccuuuaguuucuguuugagagaaucccauccagguacagucagauccuuauccagaugucaucugggagcaugccucuuuuuguccguuauucuuguuuuaauuuauauguguguggaucuuggauaagggauaaaauagguauauuuaugacauuauuuggaauuacuuuggaaauagcaguuuuguggcuaaacuacuaaguauguguauaauguugaaaaagaaugucaugacagcuggcgguauaguacaaugguuagaauacuugccuagcauguauaaagcccuggguucuaucuuaguauaccuccccucuuuaaaaaaaaaaguguuuuaugauccuuccuuacauacuaguuaaguccagauugaaguuuuaagccaaaauaucauuuauuuuauuauuacuauuuuuuaaaggcagucucgugcaccucaggcugcucucagacggucucugcaucccuagugcugagaccggugugcuuuaccacucaguuugugaggugcuggggacuaaaugucaggccucaggcaugcuagccaaaccaaaucagcccccaaauucauuuuuuauacaaaaagugagaugcauuucucuaacacaucuguauagaauucaggauuugagcccuuuuuguuguuugcuuguuugaggcagaguuucucuguguaacagacccuggcuguccuguacucgauuuguagccuaggcuggccuugaacucacagagaucuaucugcccaucucccagugcuaggauuaaaggugugugccauccucccaccugcacuucccaccuaccccugcaguuuaugccauauuuaaagcauuguccugucagucuugcgccugcccucucauuucuucugcaaguuuggucugagcaucagaugacugggagaugcuguaggccauuuguguccuccagcuguccugucccuuaaacuggaacuaauuuucauaauauuuggauguucccuguuuguuuguuuuuuuuuuguuuuuguuuuuuuugaguuauuuuagacaguugaaagguaaaaaagaacccauggccaguuugugcccgggggucaaaacuucgugcaaaaaggaauucguucucuccuacucuaggucugucuucacaccaucaguuuagcaguugccacagagaagaaaauucauugucauagguguguugcaaucugaaacuugggaagucuuuuuuuuuuuuuuuuuuuuuuuuuuuuuuuuaaguucauggaggguggcggguuccgguccaauguacggcauguaaaaugucuuaaaucaacugaggucugggccuggcaucccuaguuuuccuuaccuuaaauuaguggguaauuuauaaagauacuuuuaggacuaagaccauagagccagccaaugguucaccucaccuuagggauggacccaguaguacuuucuucaaccuaauuccaggcaaaaggaauugguaucaucacucugcuguugguuucuagccuugaccuguguuuaggggaucaccagcucaaauuuaucuccuaacacucccauauccaggugagcuauguugaugucagaagcuagcacuguucuagggcucugguaauucagggcuuucucagcuugaauaagcccaggaauucaaaugcaagaguuagaaggcuuuuuaccaucaguugccucucaucaucauuacuuucccccauccccacucauaccauggccagagugugccccagcucugcuucucaucccacacgucuccuucuacauauuaagaucuccauucgacucuuguggguagccauccuucacucacuguggacagaguuuugcaagguuguggaguagaagcugucagcugauacuuacucacaugagaaccauuaagaggguggugcggccaaugucagagcaaccuugcagcugaagguuuacccagagccacaugagcugggcucgugacuagugaaggcagggcugcuuguaaacucagcucgagaugcagauggugugagucagugcaagcugcuggaccuguugagugcacuugagugcaggcggagaaaaagcagggagagauuuguacuugucuacuuuauuauggguuuacugagagcacauccgcuucuagaagucauccugggcuucauuugcaugaugaaugaacaucccuuuuuuuaagcucccaaaagaggaaguuaguaguagcugggcucacgugcugugcuuggagggaaauggucuuuagucuggagcugcugcucgucaccguggcauauccuucagauaaugaaggaacuuuacagagugggcuaguccacacugcuggucaggaucaacugaagagcaucuaugcccucaggagauguguggugguacagcagacagcacaaacuggccaguaggccaacaggagucagccagaugucugaccgauaccacuuguggugcugggaggauuuucaagacacuuguaugugcaaagauuccaaaaugugccagaggaggacgcgacacaaauuccacagugcucaaccacagguaugaauguuuaguucuguuucagucuggaaaauacuaaccacacgggacucuaagaagcuuuauugauuugaauuauguuuucaagaaugcuuuacguaggagaaauguaguuauuggugacuuguagaaacaaguccuuuccucuguagaaaagauguagguaggcacagguaucuguaguggcucuuaggagucugucacuaucuuaacuucuuaaguguucauuaccucugcuggggccaacuuguguggaaucgauuguguccucuuuuggaacgcugagcuuuauaaggcaaaagguaaagcucugagcuuuaacuuagcacacagaggaccagaggacaggcaaggacuggagaccugcuuugugggagugcugaagccagcugcugagggagaaccugguucgacucuggaaaaugccuuuugugaaaaggauguguaugacaaacuaacuugaauagcgagguuggccauaaggagcacaguuggaccuguuauauucuuucuaguuacuuuauauacuuuuuagauguauuuauucuauuuauauguauagguuguuuugucuguuuguauuucugugcaccacuuacaugccuggugccaggaaggccagaggacgucagaucuucuagaacuggaauuaaagaugguuuugagcuaccacauagcuucugggaauugaaccuggacccucuggaagagcagccaaugcucuuaaccacagagccaugucucccagccccuuuauguacucuggaagaacuucucuaguaguggaacuuaauuccgacggucauuucccaagagugguucacaugcucucugcucuuccaaaggcaccuguucauagagcaagaggucaugaaggucaugaagggugaggaccaugaggacccugaggauggcacugugauacgugugcucuuaccugcuccugucaggaaagaaggguugagugguggggaaguggagcuccaccucugggaggcagccccagggcugacugcggcaugcuacugcugagcuaugggguaggcucagguuguuuuaaagagucuucucugggaguucaaaacugcaucauuaggacauuuucccuucuguuuuuuuauucuucuagauuuccaaauccccaagauguuauuugggguggccauccacaaaggauaauagccuggaucauggcaauuucuuuaaaauuuguaaaaaacaaaaacaaaacccaaaaaacuuugugugagugagugguuuucaaacuuuuaauaaacuucuuuuguuaugacuuuaauaauuuucacauacuuuaaauaucagaaugcuuugcaaccugguuuuuuuuccccccuuuaacuuuuuaaaauuuuuuguuccuagugcuugaaaggauuaaagauacauuuucuguauuugaguuuugugcaguaaaaaugccuuuauggucgaaacauacguguauucagaauguucuagcugcacucaguugauaccagcuuuguugguaccauccagaggagcauagcagucagcagccaguugaacaugucuucccucucuccaccagccggacucugcucacaucaguggugagcugcuuuagucugauugacacguguuggcugugucauccacagcacaagugugcuaucuucugucuucaugucugacucagugaucaggggaacucagugguucaguggccuaguucguuucuuccaggggcaauuuggguugccuccagaacacaagugucuugccccacccaggaaaauguguuugaaauucgcuggaauucauuucagguaaaaccaguugccucaucugcucuguuccccuuccuucaaccuuaaaaaugcaugugugggcugguaagauggcucagcagauaaaggugcuugcugugaaucuucacagccugaguucagucuauagcucucauaguagaaggagagcacagacuccccacaaagugucuucugaccuccagaugaugcuauggagugugugugugugugugugugccacacagacauaaauaaaaggaaaucuaucucuguguuuaucuaucuaucuauaugcauauauuuguuacuuacuguauuuuucuggcuugcagaauucauuuuagagucuugacuaaccccagugguaguuuuacauuauugacaagagcuugcaccguugggaucuggcccuagauugcucacuguuugcugaagucguguggcagucagagaaauguacaguucacuuucugcacuuacacaccuuacauuguuuguuucaggucuuaguugagcauauuaaugagcugaggccuuuuauuuacuugcuuuugucuccuucaugcuuuuccauuaugugaaaaaggaaagacccaaugaguacaacagucaugugggauacauagguagcacugggcccgggacugccaguacugcagcagcccagugcagaaagugcauccuaguucauagaauuccauaaucaugguuugcuaauaaagaauucuuuccuaagagcgcaauugaaaucugguaaauuugcaguaugcaggguauaugguauaguuuucaaauaguuguuucuaaccucuuucuuuaaauguagauuguagcaaagcugcugauuuuuaauuuuucauuuuuuuccugaaaacgcugagaagccaucgaauuguucccgagggaucuugggaauguuugccagcuguauaugagaaauacucucucaaaccuaagagaaaggguggccuggccucgucuugucauuggaguggagaggaacugaaguaaacacuucagagccaauugugcuuugcaguuucagaucugcaaguuugacuucagaagaaauugaaccauacgucgugggggcugggaggaacucagguggagcugguccugugccugggucaugcccagcguccagccccagugccaaaccacaccacacugugaucagcagcacagcagggagaggagccguugggugaaaaccauuuuaaaaggaaaagcugcagauugucugacguggcuuaacgaguuuucuuuagugaacuguuguggagauaaguggccccggccauggaaggugacugaugcaaagccacuuguagauuuaaagacagagauacuaagguggccaacugcacaauuccuuagacuuuuguaaaaggcccuuaaaagaaaaguguaggcucugggcgugggaaguaguuuucacucugugcugcacauggaaacugugaaaaacauucugcuuaauaggaaauguguuaguuggacagguugaauggagaagggagagaaaacaaaacacaacacaaacaaaugacagcaaacaaaugaaaaccccagccaaagagcuggccaucacgggcuugugacugcugggugugacuccucuguuaguguugaccacggccaaguuccucccuccccacgcuccuucccaguucacuguuuguguacaaugaggaauucucuuuuaccggcuguagaguaaauucccaccggugggcgauucugauuugcggauguaagggcacacagaaggaaugcugugggaauuuaauacugugacaguuucgggaaguuuuccucucuucugggacucauccauuacuaagugagagucagaacagcacacauccagggauugucacagaagcagaugacuggcauacauuuugucugggauuuauuuucauaagcauugaugauagcuggacacuuguuaguaaucccaggccagagugacagugggccugcgucccugcagucugcuccguuuccugugcggaacuugggugccugcuggacugcugcacaguuccuggcuccccuguucucauugcuggugugagucaggcucugguuuagccugucuugggguuucauuauuuucagaagcugguuaagugcuggacagagagcagcaagcccugguugugaccugaguguaaaggaacuccaaacccacacugaaccacagggcaaaccuaagcagacauacagagcuccagaaaucaccuugucugucuccacacacucaggaccuuccucccacgguggcauuuacaugauagcacauuauuacccagagucaauucacauuugaguucacauuguuaguguugacaggugagacuuagaauaaucucagugcccuggaaaucagcuucaucugucucuuaaagagaaacagucuuucucagaacgucacucgauuagcaucauacaacagacagccuuuucagauuggaccccuucacuuagagauaccauugaaaguuacuccgugccuagccacggcuugauaguucaguucucuucagcucggaagugaacaacuuggucgcuuccaauccagguguuugcaguucaucggugaagcugcuguaaacaucuguggacagaguugugcuuguguguuuuaucucauuugguuaaauagcaagaagcucaguuguggaucguaugagaaggaagugcuccagcuggugaggaaaugccagguuaucucccagagcgacucuaccucuugcaaugcaugagaaccaacauuuggauggucuguguucuagauuuugcucacacuacuagauuugugguugauaccucacuucagguuugcguuuuccuggguccuuccuuuuguuuuguuucugagacuugcugaggcugaccuggagcgcacuguguagaccaggcuaaccaugaacuuguagugauccucucgccucugcaacacugugcagggcugauuugcauugcucucaugauagaagacguggaacacuuuccuugcugccuguucucuuugugaagugcccaaucacaucucuugucuauuuuugaaaucaugcugucuuuuuuaaaauuaaaacauauauuaaauauuaaucuugucuuagguauauaaguguuugccugcauuugugugcagcauugcacaugccuggugccugagaagacaccauauaccccagaacucaaguugguugugagucacccaccguguggguacugagaacugaauucagguuuucuuuucugcaagagcaagugcuccuaaccacugagccaucuuuccagccgaauauuuguuuguuucuuuaguugguugauuuuguuauaguuguuuuguuuguuuguuuguuuuuguuguuguuguuguuguaauuguuuugauacagucuuucuauguaauccugccuggccuggaacucacuguguauagccuuggcuaacaccaaauuuguccuuuuacuugaguuuccucagugccgagauugcaagcuugagccaccacaucuggcugaguucagauaauuuuuguucuuuguugauacauauuuuuucaugcauuuuuuugcuacauuuauguguuuguuugugcaaguugacugagaugaguucuguaaaccuguuugucaauucuaaacaugugaggcaguuguuucuaugugugcugcacuaccagucuugcccugccugugucccagggccuagccuuccagaggcuucucuagguucagacacacgcacacacacacacucagguucacacacauuucugcugauuggagaugcuuagccuauugagaaauagguguuuuuguuuguuuauuuuguuuuuugguuuuuuuuuuaauuggaaagauagcccagugguuaagagcacccagauuugguucccagcacccacauuguuggcucacaaucaucuguaaguccaguuccaggggaccugaugccugcccucucccagucuccuugagcacaugcaugcacccaggcccacaugcacguaagaaaauagauguuuuaaaaguaugguuuuuaagguauagauuacauaugaggaaugccaugagguaauauagacuaguauagacuaguucaguaagguuguguuccuugcacagccaucauuccacuuaucccauacguguucaguuaugcccguaagcaaagggaggguuaggcgggaugcuuguaggccacuccauuauuuuauaggaguagaaauguuggaguaagaugucaugaggagggcugacucuuggccccaggccuucugacauccagggcaguguucugcuguuuucugugcaugguggccccuggagaggugaguguggcuggugguucugugagugcuccacacacagugcugccucuuuccaaguuuaccugaugugacccugaguucaaaaaagccagaauaaacugucuucugugcuugaugguuccuuuuacgaguucccaaaucucaggcugcacugugacacacacuauaauguucuguugcuacugugcaaacagauuauuuauggacuuaggcguguuucagcgugugaccuuugcugucauuuauauaauugcuucaggauuggggaauggaaacaagcucagagaaucaacuuccuuaacauaaaucuuuggcuagcaucuuugaauaggaaucaguuuuccucaggaaauuguugagaccugcaaguuuaugcauccuuuuggucuuaccuuuagguguaguaaguaacuaucagugauucugcauuccuuuauccugcauuccccaaauccuaaaauuucugaaaaaucuacaagugaucugaacugacaugaagcuauguaugauauuugaauuuaguauccaccuaauauuuguauuuaguauucgucacuugggcuguugugauuugauuugggaguuugguuuccucccacacuguggaggaugcauuauauaauauguagcauaugcaucuuucuaaaaucuuuaaaaaaaacuaaacucucaaacaucuggcacucaagaauucugcuaagggaucauguaucugaauugguuaugaauucugcuucacagaaguugcuuuugugcuuaaucugccuuuuuuacaaacuuguaagucacguaagacaccagguuuuggggaagcucaaugccagaguuaguacuuuucuaaaauggcagagcucuggguaggagcugcugaggcuggaaugauggcucugguuggcuaugagcacccacugcucuugcagaggaccagaguuugaaucacagcacccauauuaugccacuuacgacugccuauaacuccagcuagaggcgcuccaacuccuucuucugacccccaagaguguacccauacauaugcacaggaguaaagauaaugagaaaguuguuuuggacaggugacacuguuuauugcaaugagcauuaauaucaggaccucuguuaugugcacugcagaucuguuacugccaucuccguuuucucuuuguuugccuuucuugaaacaaauagcuugcugcugggugggaaauggugaacauuuugugcuaaaaagaugaccuaugguugcugccugaaacagagggucguuggauugaucacugcugugugccgccaugccccgccccgcccccccccccauaucaaacuuuugagagguuucuauuuguauuuagaaacugacuuacgagcgagaggagggagcuugugacgguuguaaacaaagaauauuaaagagcagcugggcuguguccuuaugauacaguagguuuuacggcaacagaagucaugauccacucaccaccugccccagugccugggacaccgcgagacacacagugcacaggcaggaguugccuaguaaauugaugaguaucccugaguuucuguuguucuuauuacagcuacuuugauacagggucucaccguguugcccaggcgguugggaacuggugaucuuccuggcucagccuucugaguguugggguuaugggcaugauuauggguaugcaccaccauacaugcuuaguuuugcucuacuuaacauuuucgcacauuguuuaaaguucccuaucauaccugacucuuuaaauauugacauugcuggaucacaagacugccuugacauucuucauauguguuuacuuuggcuauauaguauugcuuccuuaugucgagaccacggcaggcaccacagaauguggcuucugaccugggcaugcuuguaccacugccuuucuucuuauuguaacaguaaacacaaggaacugaacuggucuucugggacauggcagauuaugugccauacaguacauacugaccauuguguucccugggaaguguuccuccucgaaaccauggauauccuagaggagugguucucagccuuccugaugcugcugugacucuuuaaugcaguuccucaucuugugcugaugauaaccauaaacuuauuuuuguugcuacauauaauuuugccacuguaugaauuguaauguaaauauuuuuugacuauagagguugccaauggggucuugauccacagguucugaaccucugccgagauagaauguguguguguucucuccugaggucagcucucucugccugagauccugucugucauuuccucucuuggaaacuuggagacagcacaucaccaguuugaaaaaaaauugacguucuuuggcugaguauuuaaaauacauaauucuaaaccucauuuggcacaugacuguucagcaggagacacacccacugcccccaagaaugugaugggcaccauuugccuuguccuuugugcuauauauucaggggcagaacuuguucuucagucccugugucugcacaaaucucacucuugaaagggcugaacucaugagguucgcacccauucuacuucagcaugaucacaccuuaacuuguacaucuccuaacuccuuauauauaggcaaggucugacucauugggaccucagcacaucuuucuuugggagaacuuuugggguaggagaacaugacuguagucaucacauaauuuuguuauaauacaugguauuauauauauauauauauauauauauauauauauauauauacacacacacauauauauauauguauguguguguguguguguguguguguguguguguauaaaauuuauuuauuuguuuuuuugagacaggguuuuucuguauagcccuggcuauccuggaacucacucuguagaccaggcuggccucuaauucagaaauccuccugucagccaggcggugguggcgcacgccuuuaaucccagcacuugggaggcagaggcaggcggauuucugaguuugaggccagucuggucuacaaagugagugccaggacagccagggcuacacagagaaacccugucucgaaaacaaaacaaaaaaaaaaaacaaaccaaaaaugaaauccuccugccucugucucccaagugcuaggauuaaaggugugcgccaccacugcccggcuauuuaauauuuuuagugugacuuugguuuuuauuuauuuuugcaacaggaccuuguucuauagcccgggcugaccuugaaucuuccugccucagccuccccaguguggguuuauaauacauauauacuucaaacagacaacauguuuucuauaccucauguccuuugcauuauucuuauugucaccuuucagggaaauaaauccaugcuuugguuacaugcuuugaacucuugguguaggaucugagaaauagggcguucuaaccaaacaaauggcaucaugaaguuuaaaguuuuucuuaguaccuuuuaaacguauguuuaguguuuguauaugugugugugcaugccagggcacauaagucgagggcagaggacaacuugagggaguggguuuucucuuucuacccaugugggaauuggccuaugcuaucuucuuucuguagauucucucucuuccuaccgagaccuaccccaggcuaugaaucaggcagagcugaggcuggcuccagcccuaucuuauuccaaaaaaacucauugccauacguggcuguaguuuucccuagguauauuccagauggcaaacaucaaaauaacaauugaguauuaaaccaaaauaaaauucauacagaagaagaauagagguuuuuuuccuuuuuaugaacuaguuuggguuaaaaaaaaaaacagguuggauauuugagagauuccaagacacacacacacacacacacacacacacacacacacacacaccuuucucuucuuccucuauuuguuuauaaaagacagggucucacucacucugcaguccagacagaucuggaagucacuauagggucuaggcugaccucagauuugcaacccuucuaccgcugaagugcugugguuauagcuaaauaccaccacaccaaguccugucuuuuuuuuaauuaaaaauaauaugaauuuaauaaaauauuaugaucauuauugaaguugaaucauucuagaaauguuaucuuuagccuaacugaaauuuaaacugauaguucucaaggacugcuuuguaaacuuugccacuuuggcagaauguaauuuuaugagcaaauucaaacuguacaagauacuaugagacuaagucucuuucugccugccugccuuucugcuccccucccugccuccuucucguccucuuucuccauccccuccuccucuuccucuucuucuuccuuuuugaaacagggucucacaucauaguggccugaaacaugcuaaguagaccaaguaguuauugaacuaagaaaucugccugccucugcuuucugauugugaugcuggaauuaaauauaugugacaccaugccuugugauuaaagcuuugguguuuuguuuuucacuuguaauaaguuuacccuguauacuguuuguuuuauggucugggauggaucccagagcuuuuguaaauguuaagcaagcaccucgcuacugaguuguacuccagccucuguggcuuuuuaaaaaaagaguuaccaugccuuccuccuccuccuccuucaauauuuauuuaucuauuuuauguaugagaguacacugucacucucuucaaacacuccagaagagggcuucggacccauuauaaaugguugugaaccaccaugugguugcagggaauugaacucaggaacuaagagcagucagugcucuuaaccacugagccaucuguccaacuccgcagccuuuguggcuuuaacauacauuucagugggaaguuuucuuguuuuggguuuguuuuguuuuguuuuugagacagggucucucuaugauguagcccuggcuguccuagaggucacuguguagaccaggauggccuggaacucacagacaucugccagccucuguguuggcauauacgccgcacccagccagaacgaguuuuaauggccuuguauacauuuaaaauucggcaguguagguccuagucaucagaccugguuuugacagacaucucuacaggaauauugcauucauauagggauagcugggcugagcgcuagcaggcucuucucauucuacugcacuucuucuuuucugcacaguaacuuggucgcuccuggggucaugauguguaggcuuggcuguaagugugggguggcuuccgccuguccgucagcuuggggucauguggcaugucucaucggucacaccuugaacacuggcugccucuggccuaagggcagaggaaaauaguuuccaaaauaaacuuugccauugugcaaaggacgccaggcacgacauggacaacacacuggugauagaaggaacgacuagaauuuacuuucuuucuucuuugcgucugagguuuaagagaauaaaucugcugccuucaguuaauuugaaguuaacgugcuucauauuaacuaccauugcuugaaccggggaaggaccaaaggcacucagcuucucacagaaacuggccuucucaguccugggagggagcgcacgcauagcuucuggagcuuguguguauggcaagcuugggugaagcccuuuacguauucuacuuaauccacaaagcaaguuugugaggucagcaguuguacauugauaauccaguggcaaaguggaaggggaaagccuugggguuugaauccggcugucccugacuguauucacagggucuacugugaagguuuucaguguucucuccuuuauccgccuguccauuucucacccaucgcuuccguguccucccuggauccuauagcagaguccuccugaguaguuggcagccuucugcuucaggugcgucuuuuagacucugcucuaagcugucucuucucuaccucugcggcugucacugcagccuguagcaggcagcgugaggggccuggcucucugugcaguccacucccaugggucugcuuuucuuagggcagucagcuaucugaucuuaucaaccaucugcuuuccuuggcugcucuuuguguucagaguuuauccugucugggccugcuucggucccaucccccagcucgcugaccucauagggcagcucucccugccuuuccucccucccuuuccugugcugcacucugcugcuucgugguguucacgucaacuggucggucacucuucacgucugguuuaaaaguugauuuaaguccucagugacuucugugccucucuccuuaaaucucgcuguuuuggagucuaggucuugcuguguaaccaggauggucugcuucugcagccuuagacuccugaggacugagcuuauagacgucagucacuaugccaggcucugagacucuuuuguauccuuuaguuucccuuuugaccuucagacaguuuguaguuauauauuuauauguaaguauuagguuaguaauaucccuauuaagccuugaacuucaugagggcagguuugauuaauuauugauucccuugcaccugcuacagagccuugaauacaaugcagacuaaauuuguguugaauggauugccaaggcugugcugaaagcacacucuguaaauaguucucuaguuccugcuuuccgaucgaauucuuuacugcaacauacaccuguauuuucuucuuaacauccuuugcuugggagcaaacuguguuucccuuuuugcuaagcaucauggcuagcaaaugcguuuggucucagcgccacaguaucaagccagacgugcuagggguaaccuuacacuguggaacggcugccagcucccccugaggggauggcugccacagaggcacaggcgcuccuuuaacuggggugcucuccccagaacccaggcaucccacuuagcccucucuuguguguccuugcaacuucuuucugccauuugauuucaaacugacuacagaaggcagugcuuucucuccagcgauuuauuauuagggcagccucgccaccguuggcacaagaauugucagcauuugugcagccaguuuccgagcacgcuggcugggaauuguauuuauuugccauggucacaccaagcguugcagauaauccagcuucucucucuuuugaauccacaguuggucguguucggaguuuggcuugagugacauccgccugcuaguuuaccaggacugugagaggagaggcagacaagucauguuugacuccagagccguucagaagauggaagaggcagcagcucaggugugaaaugcugauuggcuuucaaaccucucugaucuguugugugcugccugcagggaugcagaaggggcaagcagagaugcaccacagcaggcaggccugugucugcggacacaacggaaacuuaacaagcaauuauggcaggccaacaguggaccauugacauugagaaagauacauuugcuggcgauuguaaucuagcaggauuuuguaagcgucaagcauaguaagaaaauaaacugcugagauucauaaaguucuaguguuuuugccagacaagaagaucauucuguccagauuuucucauagauaguaaaaggugccaaguguggcucgugcuuauaauccagcacuagaugugcugaggcaggaggacggugauuuggggcuagacuaggcuauauaguaaggccguguuucaaaaccuaaaauaaauaaaagguguuaugaaagcuuccucaccuuagagccuuaauagaccgauguucacuguuauccuacccuuucugaccaaggaauugcucauuaacuucccuuguuauagggaaggggguggugggaggugggagggacugggauggggaguaaagacaggaaagaucuuuaccgcuuugagccagacuaggaaagauaaaaauaauaccaaagaacuuugcccuccccggucucccaagauaccucugaucugucgccauggcuggaccauucgcuucaguuccguauuguucagaugcuuacgaauuaaauaaacccacugauacucuuuucuccuuuaauuacuugcuccccauacugaccaaaaucugguagucuauagaauuugugguuaaguaaaugaacaguuauaacaugaccuuugauucaaaaaggccagugggcuguuuuccagccucauuuugauuuguuaaaaauuauuuugugggagugugccugcuacugccuguguguggaagucagaggacaacuuugugacgcuggucucuccuuccaccugugaguccagggaucaaacccaguugugggacagguacuuuaccugcugagccaucucacugguccuuguuuuccagauucugauaagaaccucuguuugcaggaaggaaauguuagguugaaggcagucaagcggggugauagcacuguacuuacagaauucucucagccagccaguugucacacuagugacugggcguauuaggugggcagcagagaaagccgaggacgggcaggugauucacgguugcuuuaaugguagacugggauucgaggcuuaggugagccagcaguugauucuuuggacaggaaggagauggcucccuccaaaugcuucugacagauggcuuagcugagcacucucccuccauggaguggcugccgguggcagagauagagggggaagugacuuccuagggaacuggagccagcagaccugagcagggauaacuugguaauccugauguaggcuuucuuugaaguacucacuacauuaaauaagcagcuuaggcucuggaacauguguagcugguagagggcuacaggagagucuaguugguagccuucuuacuguaccaggugccguuucccacuacaggucauugugcuaugcuccgccauccugugggacuuccugucaccagcccucagccugcugggaggcuguuucuggcuuaagugguauuaaguaacagcuggagcugaagagcuuguugagagaaugcaggaugcucgggauuaacccuauacaacuucagauuccaucacugcuggggugcugcuguggaccggcacaucuuguguugccuuuacgguccuuuuccaguaaaaccccuccuccaccacaaccacgugauaagcacaaagcaucaugggauugagucacauaggacugcaagcaugugcuuuagaccucggucacacuggagauuagauaaacugcuauugugcccauggguucccuagcacacguuaugaaagagaaagacagccggacagacagacagacagacagacagacacaaauacaaaaagaagagaaaauaaaggaaaacaaaagaaagaacagcaaagggaauucaguagaagcagguucucacgaaggcuucuguagggggagaguucuauucuggggugggugagggucacucucaauaaaacuuggaagugagcgugugaggggguauagaguagguaauccuauuaccucugaccuuugagggccagguucccaucacaugcuccaugguccaagguugcuccugucccaggguucggcccucaucucucacagcucuguccugcugcuuuucuuuccugcugcaccaggaaugcuagaaagagugugaaaaacacaagccugcauguccaggcugauagguuucuuucuuaguggcauuuaguugguaaaaauuuggauguuaguggucaucuuucugcucaugagcuccaaacauuaggacuguauaguacugaaauccaaaaaccagaacagagagcaguauuuguuuauggcuucuugguguacauuuaaauguagagacugauacuugaauuauuuaaagagagugauaugucuaucauccaucuccaugucucagucuacacacacguaccgccauuuucuggguaguaucuccuccccagauauuccagacucccaugaauauuguuguuauuauaaagaaaaauuaaacagagauuuugguuuuaaugcaauuuaggcaccugaauguuuugaccaauucccacuugauaaagcaugccgauaaagccugguacaguacaugaucccugaccuugccugccucucuuaacccagaaagcagaggauguuccuauuaaaaugucagccagaugcugucaggaaagcagcagcagcagcggcagcagcagcagcggcagcagcucuucucauggcuuuggaggaucuuuacaacacgcuaagcaacagcuuccaaaguaccaaguaagacauguugcucuagagcagccauggccugcgccgucgauaccugugggcgugagagucuccagagaggggugcuuugguuuuguuuuguuguugcuguuuuuguuucugacacaaauagccucugacuggcuauguagaccuugaaccucuugccuucaucuccuaaguucugggauuacagauaugaauccacaucaggcuuguuuugauucucgagccauuagcccaagcagguauggaacugaucauguaacccgugcugaucucagauguuccugccucagucucccuagugcugggauuauagguaugugccacaguaaccagcuucccuggucuuauuuuuaaaccuguaacagaaucuuaucucuacugcugcugguaaaacaaggucagggagauuauaccagcagccacagacaaacaagcccugaauuuuacaagcccugaauuuuaaggccuguguaugguacauuuauaugcccauagguuauagggcucaaagcuaguugagaauccgcaguucgcacauggucuuuguuccaggaaaaggcagauuauaaaacagagaguggguggaauuuauuaguagagaauaugagaaaucauuggcuuguguuugaagugggaagaaguugauaugagcuguagccagagaugaauccacccucuauuagcaggacccacaaguuuaucuuucuuuuuccucuuuugucauuaugaggaggcagugugugugugugugugugugugugugugugugugcauaaauguguauauauuguaguuuaaaacacuggaaugauugagaaaagcacguggaggaagaguccuuuauucuuuaagcugagagcacauuugcagaggcuggcugugcugaugcgccuguagcccauuaguuugcuucucacucuuucucuugaucauaagggugucagcauggcugagcagucuccaagagagugauucucauaugggguccaauguuagguauccugcauaucagauacugacauuaugguucuuaacgccagcaaaauaacaguuaugauguagcaacuaaauaauuuuaugguugggggaucaccacaauacaaggaacuguauuaaagggucacacacaacauuaggaggguugagaaccauugcucuuaagaugcuuagaggugaaggagagauguugaccgagaaauaagucauaggggcuuuucuuguguagauaaugaaguauuuaaagaaugguggagcugggcagugguggugcacaccuuuaaucccagcacuugggaggcagaggcaggcggauuucugagugaguucgaggccagacuggucuacagagugagcgccaggacuacacagaggaaacuccugucucaaaaaaauaaugccccccccccaaaaaaaaacccacaaaaaagaauguuggaaaggcuagugaguggagucuccuccaggaaacagcuguauucaaggggugacuugacaaagagaagauucaaaaaaaaaaaaaaaagauuccaguaggaagguaauaguaucaaauacauuugauaaagcaaauuagcgugugucuaccggauuugaagaaagauggaaaguggaauaugguggucauuguuagagcagacaggaucaauuaggcaaagccaggcuucucugucaaaagcugguguuuagcacccuauccuuaaaauaaaaaggugguuaaaaagggcacgagagacugguuggaaauuggaagugauuuuugaaauauuuuuacaaaauuuuagagcaguaagaccaccuuuauuucuuggauccucacaaaggccuacuugaaguguaagucacuucuuuccuuucuucuuuccugugguaaagcgccauaaccaagguaacuuaccaaaggaauuuauuuggguuuaugguuccagaaggucggagccuaugaccagacacaugguggcaggaacuggaagcuggggucucacaucuugaaccuccagcauggagcacagaacaaaguagaaaugcaggagucuauaccucucaaagccucccccccccccccccccagugacauacaaggccacaccucccaaagcuauccaaaaaccaacuggugaccaaguguuaggacaucugaguuuaacggggagcgcucucauucaggugaccacagcuagcgauuauuuaguugaguaauacuaaaccaagcuucuuuucaggaucuacucaauauccaaagaagaguugaacuguuuccuucaggguucgauuuuauaaauggaaaugaugaucuuugaugugugagcauauuguauauaaagaagaaacuuuaaaaauaguaauauuugugaacuauagcgggugaucccuguauagaugacaguuguaagguggccagcuauagcuuuaggguacuguugugacaguccauuaaccagagacccaaggauugggagacagugcuuuccauugcauuguuccaugugguguuuucuugugugcaguacacgagaccagcaucugaugucagcaugcuuggggagaugauguuuggcucaguugcaaugaguuacaaaggcuccacccugaagauacacuacauacggugagacugccccugugccgccugcaagaacugcaacaaugguaccaacuuccuaacuuaaaaagcacauuucuucccucuuauuuuuauuuuagaucuccuccacaacugaugauuaguaaagucuuuucugcuacaauggguagcuucuguggaaguacaaauaaguaaguguggauuuugcaccucuuaaguuuuuaucuguuucuagaaaaauucuugaggguuauaagacauuuuaaaugaauagcaagauaagugcacauuaaugaagggguuuuagucauuuucuaauaacagcaaaugaaaaacuuucagacuuucucaggggcuggagaguuggcuuagugauuaagagcacugacugcucucccagagguccugaguucaauucucaggaucugacgcccucuucuggugugucugaagacaccuacagugugcucauguaaauaaaauaaauaaaacuuuuagacuuucucaagugacccuaaagacagacgacuuggucuguuuuugggaagggucucauuagcccaggcuggccuugaacucaacuggaacuugcuguguagcugaagauggccuugaacuccugauccuucuguaucucccucaaguccugaaguaacaggugugugccaccuuacccaucuguagggugcuaggcagugaacccagggcucauguauggcgggcaaaagcugugcgaguuguucuaucccggggcugauugcuuugauauccaucuguauucucuuuguuucuacugccaaucaccaaguauuaauucuccaguuaguggacgggacugcuuugauuugguguugggugggaggggguggaacaguugguagagguggaagaugaagagucggggucuagcccagccucuccucagauucauaauucuugugucucagccuccugaauaccaggauugcaggugugugccuccccucccaguuuuauuuauuuaccucggagagagugaaguuguauaguuucuucaggcagugggguaggaagccaucugucuugagcaguuagccuuuguggccaugcaaaggcuacuuuguagccuuuauugucacuccuggucccauccauccauguccauccaguccccuccacaccuccuggguccaaaggaaacuucacuccccccaauucuggugccauuccccucuacccaaggagccauuuccuuaucaccaucagaacgaagggacacauggcuaucuguggugccauuagcacaccuacaugaaggagccuccaggcuccuucaggacuacaagggaccuggcucuucuuaccuccuccauuucccuaaacaucuccaucucagaagcuuccccgaccagcuucacauucuucuuacaucccugguauuuuaguuauauucucauucucucucucucucucucucucucucucucucucucucucucucucucucucucucuuacacgcaccuuccucucuuggcccacucucucuugccuccuuuuggucugcuuugcucacacccuguguuccucucucacucuccccucuucucucauggcugguccagucugcugaccauacucagucuacuuacucucugcucuggacuauuccagaugcaucugccuguaccgucccucacaucuacauuagaaaccuuccccucagccauauccuguaguggugggguucuuaauuuauacacacccuccuccuauccuucuguauaacuagaauacugaagugucuacccuccuaucaggaacguuucuuuauacacuuugaacuuuuaagcagagauguuuguuaugaagcagauacuguuguuuuuugagacacaucuuucuguguagcccuggcugaucuggaacuagcucuguagaucaggcuggccuuggacucaaagagaucugccugccucugacuccugacugcugggaugaaagagaugcgccaucaccacuuggcuguuacuuguuuuuuugauacaggaucucacaucauaggcccaggcugaccuugaacuccuuauacagcucaggcuagccuggaacucuguguggcucagaauggcccaaacucacagugcagccuacuauggccuugaguucacggaccuccugccccagcaccucgagacaggagcuaccugcucaguuuacauuuuuuaaguaaaauagcuuguuuuauuuuuuaauauaaaauguaaaggccauaagucaagaggcaugcuuuagcaauauauuacaggcauuuuuuccgcaaauaacccuggaaugauauauauauuuccacuuaauauuuuugggaccacuaaauaaguaagucuuuggcuaccuuucacaagauaguuuaaacacuuaccuuuggagcauuaugaguucagcugauauaggaacuuauguuuauuucugauuuuauuuauucacucauauauuauaucaugaccacaguuuccccagccuccucucuccccagucccuccccucuccuccuuucucucccuauccacuuccucuucauugaccuucagaaaauugcaggccucucagagauaccaaccaaacauggcauaucaggugcacuaagacuaggcucuucccuuuauauuaaggcuagaggaggcagcccaguaggagggagaggaucccaaagguaggcaagagucagagacagcccugcucugucucacaguccuacaggaaagccaagcuacacaaccguaacguaucuguaaaggccuaggccagacccaugcggccccgauugucccugugauucugugggguucuuacgguguugucaaucccucgcuccuacaguccuuccucucccuccgccucaggacuccagccucugggucuggcccucuaggcagugucaguugugggcucccuuaggcugcaccagucauugguuagccaggcccacagucucugucccaucuuuacccuggcacaucuugcaggcaggacagaugguagguugaaggcugugugucuggguuggcguuccaguccuuccauggaagccuugccugguuacaggagagagaguuauuucugauuggggguggggcggagcaggggagcuguucagacgugggcuauguagcuguagcccaggcuggccuggagcucaugguucuuuugccucugcuuccugaguccugggacuguagauaugugccccauacuugccugacacuugguuuccuuccuuccuuccuuccuuccuuccuuccuuccuuccuuccuuccguccguccuuccuuccuuccuuccguccuuccuuccuuccuuccuuccuuccuuccuuccuuccuuccuuccuuccuuccuuccucccucccucccucccucccucccucccucccucccucccucccucucucucucuuucuuucuuucuuucuuucuuucuuuuuuaauggcuuuggcauaauguaaauguuuguuuaucccacuaacuauaaaaaacauuuaguucacuuuuaaguaaaaauuaucuuuaauuguucuguguuuuuuucagaguguugauguuugccuccuugcuaaaauaauaaauuaaaaucuguucaacucauuuuuaugaguaauucauauuuucuuaaagugaauuauaacuucgauaugucuaaccccugcuaaaugauuaauagauauuagcuaagacuuagaauuaauuuauuuugaagguuuuuugaaaacccuugaagugaauagcaauaucuuaggugucaguuucuaaaacaaaauuuuaaacugaauaguuguguggaagccgucagucacugaagcacaguuagagccggugucucauuucagacccucagggguuaagagaguagcuggauagguaguuguguagauugcugucuuccaaaacagcuuuauuuucuuccaacagauugcucccaaccuaucauuuuaaauuacugauuguuauuuauuauuauuguuguuguuguuguuguugaaacucuaauuucuuuuuuuuaagauuuauuuauucucuguaugugaguacacuguugcagucuucagagggcaucagauccgauuacagaugguucugagccaccacgugguugcuggugacugaacucaguaccucuggaagagcagucagugcucuuaacagcugaaccaucucuccagccugaaacucuaauuauuuauaaagaaaaaaauugaguaacugaucauucguugucuauaguuaggaaucuauuaaaauacaaauuuguuaaccucuugauuuuuuuuuuucucucccuucccauuuugauuuagucugcaggacagcuucgaauacauuaaccaagauccucaggcuggaaaacugaacacaaaucaguacaauuuggguccuuuucguacuggaaguaaccuagguaaaagagacacaugaacagauagguuuuucucucugagugcuuacaguugggggcgugguuugcucuguuuguuguguucggguuuaguuuugcguuaucuuuaaccuguguuuauuugugugugugccuugcgucuucuguguguucugcucuaggucugcugcaggugugcagcggcaaacugcugcagggguugucugaaggaggaccucuccggcucacccggagcgcuucuuucuuugcagguuuguguggaaugcugagcacagugugacccacacacguuaaaacgccugugcaggcucuuagaaaaauaaauccauuuauucuuuucuagaaacccaaagggcuuucguggcaagagaugcuaguuucaaaugcagcuagagucauacucuuuugaaauuucagccaugaaccucuguugugaaugucuuugcuaaugguccaacugugagcugacuuugaucagaaaugagcccuuaguguuucuaggagaauuaauuucuucugauuuucccaggccuccucugcugcugugagcuguuucucuuugcuguggcaucucucccccauuuauucaccugaucuuuaccugcauggaguaucuaagucacucuauuaggagcaugggagggcucaaucacaccucucucucucucucucucucucugucucucucucucugucucucucucucucucucucucucucucucucucucucucuuucucucucauauuuaacuuaaucaaaucauuuaaaugcaaugucuagguuccuuacagguauaguaaucuugauccucuggguauuuucugggauuuaacuggccuugccagcagagguugcucaguguucuuuguagcaugauuaacaagcacuauguucaugacuaacauuuaauguugugaggaaggcaaaugggauuuguuuuccuucuguucccuuuccuagccugaaauaagcauuguaguuuucuggugccuaaugaaacugauacuaccaucccagcuccuuagaacaagugcagcauguuuauauauucccuuuaaaacuuggaaaauaaacauguuucuaaaaaauacuagcaaguauguuauucauccacaacagugacuucuuguucauuguaaaauuuacuagaacaaauucccaucuaccuuucagcccagugaauguauagcucagucagucugaagccuucuagaugcuucuaguagauacaugcuacuuaaguguguuucuccaaauuuaugccaggaugugaguuuuuucugaagaacuauaauaccauguauggggaaaagaacuggaggaaaaagcuguuaggaaguuaauguuuucagugucugccaagauaacauguuauaaauaaacauuucuagauuuacaaagugguuuuuaacuauuuucuucuuaagcugguuacaacuauuaccgaaacugaguauaaauccuuugaaaauguuguacucuuuaaauauacuaauaaugaagaaauggcuaaaguaggaugcugguggucuuuccugcauggauaguuuaauguacaugcuaauuuuuaauaucugucauucagaagaguguaggcuccagcauaaaggcaaauggcuuuuugguuuuguuucuugguuucuuguggacuuuuuauguauuuaauuugcugucuaguuaguugcuauuauauauuuguccaucaauagcaguagcccacuuugaagucuagaaauuacugaagucauuuuuaaaaugccucuguccuuggcaagccuaauaaugguuuccuugucucuuugucuuagcacacagcacaccuguugauaugccaagcagagggcagaaugaagacagggacagcggcauugcucgaucagguacuuccuuauacugcuuuaacuaauauggcagguaggcucucuguaguagguaauaggaacuaugaagguagucuuugcucuguccuccccccgcccccaacccuuuucuauuuuuccucuauauucuaaaucucaugugucugaggauaugaaacuuugacggucaucaucucagaaugauugugcacacaagcuaguuuuaucuaauacuuaauuuaagacuagcauaugcuaguaaguuucuuccagcagggagcuucauuaugccggcuguauuagggauuuauucgcuaacugcuuugcuuagucagaggauggcgcaggccugugguggucagucugccuaugacaaugagagaugcugcccgcugacccucucuccugugaugcuggucuagauuguaccucagguacccuucucugcuccuuuagaggcuaaccuuaccuaagacugccuuaagaccccaccccaccccaguuucagcuuuuguacacaaauuugcuuuuaauuuuuauuuuaugguucagaucugagguuaguuccaugguucaaggacccaacaaggaggcaugcuggucuuucucugaugaauaugcagccuacaggcagccuuccuucagugagaaccaggaguguccuacuggguuguccugugagcuuugaauccuuuaccagaggcccaccagcugagagagacuagcugcaggccuuggcgucuuuccuccuaucuuuucauucacuucucacaugcugaagcuuccagauucugccucaaagcuccuggguuguuucuggguacugucagaccccggcagucccccuguucagcucuauucccagagucacuaaugaaaugcaauuguuggugaaucuccuuagcuaacuuucaucauguaucacuuuccuuagucguccguguccccccccccccccccccccccccgugccucccaaugcuucgagaacacaaugcguuuggcugucaugccuauucagacuguuuuguucugguuuuguuuguuuguuuggguuuguuguuguuguuuuguuuuguuuuuuguuuugcuuuguuuuuuggcuuuuuuuuuuuuuuuuuuuuuuuuugguuuuuugagacaggguuucucuguguagcccuggcuguccuggaacucacucuguagaccaggcuggccucgaaguuggaaaucugccugccucugccucccaagugcugggauuaaaggcaugcgccaccaccgcccggcuguuugcuuguuuuuugagacagggucucucuauacaguccuggcuguuauggaacuagcuaucuagaccaggcuugcuuugaacucaaagaucucccugccucuguaugucaccacaccgaccuccucagacauuuucccucagaccgucucuguuuuugauaaucaugaugauuuuagucuugguuccacuauuugaaugugcuugcuugauggauuucuuaugauuaaacuguggugugagcugcauaaccacaaaaggaaccugccauccugcugacagggugucaaggguguggacuggcagcuuuaugaguucaguugcugaccuuguuuauuaaugaggcuguagcaacugggucucuucacugcuaaguugauuccccuugacaucugugcgcaugccuuacccuucaccugagauaugcucccuuucuuucaggggcgugagucugcagcaaugauuggaaauuuucugcauuggacgcuguguuuuucucaguucuuaacuuauacuugguuauuaugucaaggacauuuauuuuucacuuuggguaacccaggaguacuuaauauuuguucaaguugcucaggcuuggacccugggagcacugugaugccagugacacugcuuccaugcauggggacagcaggacaggggagcucugacacccuguuccuguacugaguacuuccgagucaucgguuguuuucuaucccugccccagaguuggagugugcgugguucauagacugucucuggagggcagaacgggucucuuguggauauucugaaaagcucuucuguaucuauauuuaaaauaaaagcuaauuuagaaaauugcuuuugaaaccagcucauuaagcuguugaucugguugacuuuuuaacucacucuagcccaggcaggccuugaguuuaugauccuccugcucagcuuucauaccugccaaaaaggucauuuuuaagagguugauaguaauggcuguuacuagaaauuuucaaguaagggggcuagagagagggcccauucuguaaggcgcucacugcauuuagcauugaggaccugaguucagcuccgugguccacaugagaucugguggcacacuucuagcaucccagcgcuccugugaugagaugggcaguggagacaggaggauccacagacgcuccugagucagcuggccuggcauacacacgcacgaauaaaaaagaaagaaaauuuaagcaaggccucggagggaggacacugguugcagguguaugggaagcagcguuuguaggaccuggcaacagcaacacauggguuaccagggaggauggcggaaccaugcacagcccucuggguucuggcuuguggagauaaauaggaagacaacauuaaccagccagcaucaggaagcaugaggccagcaagggagacacaucugagguguuuguuucuuuacuagaacuguccccaaauucuccaauugggaaucaucugcuguauuugaaaugagaaguugucuuagcagggaugugucagagcaccugaaaucuggaagucuugaguccacaguagugaguaguguaagacuuauaggcuggauuuuucuguuuguuuggguuuuuuuuuuuuuuuuuuuuaaagagacaggguuucucuguguagcccuggcuguucuggaacucacuuuguagaccaggcuggccucgaacucagaaauccgccugccuuugccucccgagugccgggauuaaaggugugcaucaccauauccaguuuauaggcuggauuugagaccagucuuuccaggccagcuuaguaguaggcggucuuccccuucaacauguucgcaucuagcaagaaagagaacuuuaccauccucacuguaacuacguguccuguguccuuauagugcccagugugaggaaaaccaugaacacuuuggaacauuccuuuuugaaugaauauaugcaaaugaaccuucagaguaagaacagacauuauugaagaauuacagauaauauacauuuuagcuuugcugcagaaacagcaaaacuaguuucagaggugcugugguagaguaauagucuaaugagguaggcaggagccaccagagauacacaaggagguuggcacgucauuucaccaucaaggaacucuccggugagauuagacaauuacaagucuaucuuugggaagugagaaagucccauaagcaaauauaaauugugggguuuauuguucaguuuuggugguuugauacagggucucucugcauagcccuggcuguccgggaauucgcucuguagaccaggcuggucucaaacucacagagaucugcuuccugagugugggggauucucaauacugagcugacaggaagcuccucucccuuucugugccccaguacauuuuccuuuuugugucaggagugaccagugcagcugcccuuauguccuggcuagcucagaaacuuuaggguauuuugaaacaugguauuuuuauucaagggucuuuucuaggaaugguaaaacuuauauagugcuuuugaagacuuauuuuguuuuaccagugaugcaggccuugcccaugcuuggcaaguuuugugcugcuaaacuguauccccagccuccuuugagacaggcaaaccuugaacuccucucuguagucguccagccuccugaauagcuggugguacaggcccaugacaucaagcacagcuuaggggaccuucugaaacuuuaaagucauuuuguaaucuuaaaauguauugccuguaauuaauuuuauuaauuauguuuauuauuaauuuaauguuuauuaauuuucuguauuugaagaugagagucagaggcugggcaugguagcacaugucuuuaaucccagaaccagggaggcagacacagguggaucucugugaguuugaggccauccuggucuacauagugaguuccaggagagccacagucacauauaccuggucucagaaaacaaaauaaaaaagaagaagaaugaaugaauaaaugaaugagaucaggagaggggaaaaucucacacugauaaauugguugcuuugccuaaguuuuaccuccaagaagagagugaagaaauaggccaaauaugauguugacuaaguuauauauaugggcagaucucuuuagagaucugcauuguauacuuauuuucuauuuauaguguaaaggcugaucaugucugcagaguuguagauuaggaauccgugugacugagaacagaagguggcuaguuguggcuaggcuagcauucuuacuccuuuagaaugggggcaugcaucuguaaucccagcacugggucaaaagaaaagaaaaagucuguggucccccccccucccccccacuuuuuaucugcagaaauuuuuggaagagcaaaauuuuagucucccccugcuggauaugauuggcaaaaaauuuaggguauguguguguaauuguacuuuaggcuacuuuaguaccagccuuuuccuaccagccuucuccacccuuucaaccgaacccuaggugggggagaaagaaaguuagaggagaaaggaggcaucugugucauuagacuaccaccugcugacuaauggcacugaguucccuagggcaauguugaucuuuguggucacgauauccaauuucuuuuuucucuuugcccacagccacuucacaaagcugagcagcaagggaagccccagccucuugggacucuggcauuuuuauacccuguuaagaguccccagaauuccaaacagucuucagcuggcagaaucccaucccugccagaguccacaacaaaucauagacaguugguagcuguggaugaucugaagcagcuguguaucccacaucuggaauuaaaaugaaaacauagucacauaacauuucuguguucuuaaagaaauaaagagucucacuaugugugugugcuuaugauguugaaauacgcauuacauaaaauuuaccauuuuccacucuuacuggggguugucuguagggaggcuauguagcucaggcuagccugagguucgacauuacauagauacacuggccuagaacucaagauccuucagguucugcaucuucagugcuguacuaccaucccgguauauauuuauuauuuauuuauucauucauuugugggaggugugagugaacauguaugugcagauguauccucaugugcugcaugaguuugugucaccuuacgugucauuugcuuuccgagauagagucucuuccugggacauggacguuucugauuuggcuaggaaccccagggauucuccugucccuuccuccccagugccagaguaacaaguacaugcuagcaagccuagguuuucauguggguucugaguaguguccccagacuguggaauccauuguaaaugugcagcucagcgguccugugcaucggagcguacaugcauuguaaggacuuaagcuggacuuucucauuugaaauguacugccuugcagcuucacugagcagccuuuugaucacgcccuucccgucuccaagcucuucuacauccucuuccagcaguuaccagcgccgcuggcuccgaagucagacaacgaguuuggaaaauggcaucuuuccaaggaggugaguuacuuguuuccucuggcuaaggaaaguacuaguauaaacugcuuacggagccuggcaggcuuauccuugccuguugucagggaaagaagaccugaaaccuugugauuaguuccagcuuagucugaaguuuacacauuaaauuguuuaaggagauaguaaauuaaaacuagguaaguuggccuggaauacaauauguagcccagucgggacucaccaucuuuugcuucuacuuccuaaguacaggauugugaguauguugacacuguacccaucuggaaacccaucuuuucauuuagaagauacuggaaaugccugguagccauacagugucgcugcugaauuuggugaugauuaaaagugaauaugcucuauucacuaucuaucccagaaaagcugggauggggccaaaguucaaacaggaucagauaaaccaccuaaacagucccauagccacuaaagaaauagcacaguggcuuauagucucccaaccaaaaaaagcccaggaccagagggguuuaguggagaacucugucagaccuccaaagaaggccuaguaccaguguuccucaaacuauuccacaaacuagaaccagaaggcacacuacccaauucauccuaggaagccacaguuacacugcguauucuccccggagauggaacgguuucugccuaucaggaaccugucacaauuuucuuucauagaggacuucauaagagaauuuuucuuuuuuuuuaaaagaauuauuuuauguaugugaguacacuguagcuguacagaugguugugagccuucaugugguuguugggaauugaauuuuaggaccucugcuugcucuguucaaccccacucacuccgguuggcuccucucacucagucccugcucacucugacccaaagauauauuuauuauuaauaauaaauguuguugcugucuucagacacaccagaagaggguaucauaucucauuaugggugguugugagccaccaugugguugcugggauuuguacuuaggaccuuuggaagagcaaucagugcucuuacccgcugagccaucucgccagcccaagagguuuuuuuuuuuuuauucuaucauauuuaauguuccaaauagauuuuuaaaaguaguugagugcauauuacauuuagugucagaagauaccauguauaucuaagaggcauuuagcuauuauaaauuauuuugaugacuuaaaaaauguuaauacugaguuguauauuuaaaauaaauuuuauuaguuuaauuaaaaaaaaaaaaagaagaaaagcugggauaaauaucuucccuggcuacaaugauuccaauaugauauuugaggcacaguuccuuuguggcacuuaaauccuuagacuacacagguaaaaauaugagaauacauaaagauagccucaaguuacuuucuaccuugauucaguuuguuuuugaaccuaaagcuuacucauuugugugcagagcauacauuugauguuauaccaguagcauccaaccccuugguuuuguaucucaaaacauuuaaauggaauuuucacaugucacugagcuagcuauuuaugucaauucgcugaguuuguagauugccuaguagucacuauguuugagagaaucugugaagaugacucaaccaugugcuugugcugaaguaguugaugucccaggcaacaggugucaaggaagaucaguaccggauaaacacugugaaggcucagagugcauaggaaccaagcggggagaaucgaagugguggggacucugggggggaccgagggugaugaggagccccaaaggaagauaagcugagcagagagcugagggaaucucuucuguucucucaagacccuaaaaggcugcagcugguccuucacuuuagucuacugaguggacuaaaguggaguggugagauuguggagucagagacaagucuagcucugcccucaucacacacgugcuggagcauauuaacugggucccugcagcuucuucuuaagcauuaggaugguaacggguucagccuuugcguuaggagaauacaacuagaugauccagucagguggucaggucacguuuaguguauggcaaauaaaacauuggcagugcauauauauaaucuuagcacuuggggagacuuagggcaagcuguguccaaggccagccuuggcuacacacagacacugucucaaaaaaaaccaaaaaaaccaaaaaaaaaaccaaauuugggcucucaagauggcucugugguuaagggcaccgguugccaagcucagagaccugagguugaucaggagccacacaguggaagaagagagccggcucuaggaaguuacccgugacuuccagauauguaacaugccauagguacacaagccacauacacaaauuuuaaagaaaaaaaaaaaaaaagagacauggucucuacauagcccuggcuaucuggaacuuacuauauagaccaggcuggccuugaacucaacagagauccaccugccucugccucucaggugcccagaauuuuuuuuuuaaacugcagauaaaacauuggccaauggggcaaacuuaucaguguuucugcucucauugguaucagucuggcaugugucagguucaugccauuuccauccccacuaccuuucugcagccucugcagugggaagagauggaugcagagaaccgucacaggacugcucuccagugcaaaugccuuuccaucccuucagauuuauaucugaagcugucgguagcauuuucaagccuaugccucuaaaauauaaaaaaccaaacugaguggagaccuggcacugggaacugugacuuguugcugagccuccaccuaacuaagaaucugaccuucagaaagccugggcacguagugggucuagcuacauaauuuaugggacuagugcaaugugaaaaugccaggccccuacucauaaggcaagaagaaugcuaguacaggugcuaaaauguaaagcucauguuuaaaaaaucuuacuuaaaauauaguaguguuauaugaagaacaacauaaaauuauaaauucuaaaaauaacauuuuuguguuauaauuuaauaugguacaaaacaguaucaugauucucucuaaaucuuauuuuuuucuaaguauugaugucccacucugcuauuguaacuaacacagaagaggaaacacagugaucaguguauugugggucccagccuguccuguaggaacgugcaguugagagguccaggagccucccucugcugcugacuacucccuguaggaaguauguggccuggaaacucaguuuccucccuucuguccauucccauccucuguucuggggcugacacugaucuagagcauggagugcaggcacacucugccucucacggcugaguacaggcacacacucugccucucauggcugaguacaggcacacacacugccucucacggcugagugcuggagugcacacacacugccucucacggcugaguacaggcacacacacugccucucacggcugagugcuggugugcacacacacugccucucacggcugagugcuagagugcacguacacauuaccacuggaacagagccuggcaucaaaagcuucuggcuuugaaaggaaguccacaguaauuaaaaacacccuuccuauccuauauggugguauacaccuucaacucuuaacacucagggagcagagacagauguauuugaggacagccugguauauguagcaaguuucaagcagccagggcuaugggaugagaccguaucugaaaaaagaaagcuaauuuuaauauaaauaaguagaauauucuucuuaaagagaguuaguaguuaaggaugauguaaaucuaaaggcuggcuccuuucugacuucaucgugcuagguggcaagcuuggguuauuuggacaccuguuuguauccugcagcuagcaauagcucugauaccugugggggcugaggagccucgggcauuucaucccuuagggagaaacacccgaaucccaaaggagccagacauggagacaugccccuugcaagccuucuaguuauuaaauugaacaaaguugccagugggacauucuuaggcucaucauacuaucuguuucauagguucaguguaaguucaaaucugaccucaacaguaauugugcuuggcagcucugauauaucgauuauaguuuauucauaugugcuaaaaugaugauaguuauaaauuugagugauuaugauuuugagguacuuacauauaagaguauauucuuaaguguaacaaaacacagcuucauuuacuuauuucuuuguugacauagggucuaacucuguacuccacacucucaugugauagaguauggaauuccaugccuccucugugugaugggaaaggcuuaagugaguagccauggugugagugugugugugugugugugugcacgcgcgcacgcaugcaugugcgcucauguuuuaaaacccacuaacuggucugagugcuuccggaucuucccuguagugcaucgcagagcauccaguagcaugagcuggagcugaugggucagucaggaugagcaucuggucacuguugauuuccaagagccugcauccuggguuauaacucuacaaucguugccagagagcuuucuguccccaagcaagcgcuguuucaguuuguguacuccaaaacagcuugugcagcacacauggaccuggagagaggaugaaaaaguaucuggcuauacaguugguucucugaaacauucccaagcauucucuguuguggaauaauacuuaaaagauaaucaggacacugguuuguuucacuguggagagcugauccaggacuacacacuaaaguccaguggcuuuagaugcucgaagagaugugugauggagacagugagauguggccucgguucagccagggaagcuuuacagcauucagcagguggcacucucugccgugcuaaagcucauagcuguggugacguaguuuagagggagagaaggaggugaaugacagcccagcgauggccacaguuugcgcaugaaaguccaaguggcuugaggaggaugcgagugcuuugcuuuugagaaaggugagaaauagaacauucagcaaagaggcaaguuuuacaugaucacacuguuaagcuguccuuggacuugaguucaaaccuauauccucagccugucugccucagccucuugaguuggugggauugcagaugugcaccaccacacuuggcuagaaucucuauuuguguaacagaaauaaacuggugcauaggaacaagcuuuuaauacagggacuuuauaacaagaguaggagccuuuucaaauagcaggucacuuucugugugaaaaucugugacagucugcaugauucuccaagcuuuuucugucacuaggaugggcagaucucucagagaaaagaguuggugguuuauuaggauauuugguguguuuccacaccugcagaucaggagugaccuuauggccuacacccucaucccagaucuugagggaugauagagagagcagaaacagacaccucagagccuucuuuuuaacauugcuuuccuaaccgugcagcuuuggccguauguuaguaaauguuagugcguguguuaguaaaaucccauauaguucaaaacuuacaagagacugcagacugugaauagagcccuaaaaaugguauaguuggugacaaagaaaaugugccacgugcugcugugugacaggcuaguuauacuaauuugcaguauacucuggccuuuacuuugguguagaacaaaacaauuuuuuuuuucuuauuuucccucuugcuguuaguagauauugugguagcucucgugacucuucauagcauuuaaauaagagucaugguuaaagcguaauuguauuauuccuaagacggguauuaagaagcuauuggcucuguaauucuuuuauuacagaagcagagccuuuugaccauauuagaagagaguugagccuuucugcuuagcggauuuuccagagugcucagucaguuaaucacauggccucuuuggagcauuuagaggaguuacuucaucuauugguauuaauagccuuggggauggugccagugagugucgaagcaugaauauuccacaggacccgucuucugagucucucaucuguucuuaccuaucauuaaaaaacaaggacccgaguuuccgugguucguuuguuuuauauucuagggcacacaugugccagagagcaccgugagcaugagaggacaacuuucaggagucaguucuugccuucugucuuguugaggcaagguuucucuuguuucuccugugucguauucuaggcuagcaggccugcgagugucccaccaccaauucuucugucccugccugucacucgcaguggggaugcuucgaucauggcucugugcugccacaugagccuuuucaguggaucucagagauggagcucaggugacugggcaugugcaacacagcaaagacuuuuaccccacgagugccucucuagcuagacccuguguucucccacuccucagugcaaucagaagggugagagucacacguuuaagcugccacuggcuuccgucugagcugcuuuggaugguaagauggugggugguguguaagacguguaauguugguaagugcauauccucuugguuuuccugauaaaggaguaagagaaugaguuggagguagauggcuggccggcugaauucucgguauucugcacaagcauucugagugucaccccacgacaagacagcuuaccuucagcgacucagugauacauggccgcuuuucaaaccuaauuuuccuccaggucaacugaugagacauuuagcuuggccgaagaaacguguagcucuaauccagcuaugguuagaaggaagaagaucgccaucagcaucaucuuuucccugugugagagagaggccgcccagcgggauuuccaggacuucuuuuucucccacuucccccuguuugaaucucacaugaacaggcugaagggugcaaucgaaaagguaagggccccgggcuccauuccaggcaaacacuuaaauaaggaaauggaaggugauaugauugugaccuacuuaguggccaauaggggagagauuugcaguuuaaagugacacguuauguggagauggccugcguaaggcggucaaagaguguccuguaugaugacccuaggauuuuuaaggcuagagaccagggugcuguagggaaggaaguuacugguuuugaugaggaagaaugucauuaccaucaauauuuuaaauguauuauagcaucguuguucauuagugagucagcaggccagucauagaggaauaucuucuuagagaguaacguggcucucucucuuccaugaaggccaugaucuccuguaggaagaucucugaaucaagucuccgaguccaguucuaugugagccgucugauggaagcacugggagaauucagguaaaguucaagguuggaaauccaacaggaagugaugagcaguaguaugaccaacugucaugagucuaugucuuaaaagaguugggggacuggccauauuuagucaucuuagugucgcuacccaugagagcaggguacguaaagccaaacauugaguaauaacucucucugugccugacaguucuuaauggggucaguuuuuuuguuuguuguguucuuggggugggguuguuguuuuguguuuauuuuaaagugggggucucacuauguaguccuggcuggccuggaacugccuauuagacugagcuggcuucaaacucacagagauccuccugcuucugccaccugagugcugggauuaaagugugcauuaccacgucuggcauaaugggaucguuuucaucagaaugaacugaacacuaauuuuaaagaugucuuguaaucaguuucaugaucuuauaucuguugucccauuaaacuuugaaggcaaagccuuuuuauccuuuguacaaauguuaaaacugggguccaaguguguggugcugccugugcccugaacgaaugaagaaaauaugugcauguuguagagaccuagccagggcacaucuagugcacaugggagccugugguacacgcccuggucuggauagugaaucgaaugaugucccuucucagauacugaaagcaguuucuaacuaauccagagcuccaccaguuguugugaaugagcacugguuuucuauaccccuugcccaaagugugguuagcagggugaucugcuaucagauggggucccccccccccaugcucaucugaguuccucagagccagucucuuaacagggaauggagucucacugaaaagcaguguggcaaauagcugagggguuaaaaacauugcaguuccuagaauguuagaacauuucuugcugaugagcucaaugcugcuugaaguaaaaugacuacagcuuccgaccuccagcuguagauaaggaacuguuuauguugaucaugugaugagugccuugaagguguugaguaagcugucuucauugagggcagcagugucauccugcuguggcgacauucggagcugacuugugcuugagugucuggaugcuaaucuaaucacacuacuaaucuuucagaggugaaaaccugaaaauaaagaaccagaaauugugucuauagaggacuuuuacaguuagacagugagcccuuccaggaacagacaaaauaauguacuaguauuauuuugguuggucgguugguugguugguuuuugagacacauuuucagugcguaucccugguuguccuggaacucaguguguagaccaagcuauccucgaacucacagagauccaccugccucugccuaccaaaugcugggauuaaagucguguguaaccacacccagcugagacauaaauuuuguagguaaauccuaugccuugcuacuauaaucaucuucacugcuauuguuuguacagauauguuuuuaauugaaauagaaugcuaucacuuuguccccucccauguacucucuugauaaccccucucaugugucuuucucaccccuacacucuuacgaugauagacugcugcuguuacaugccuauaugcacaaauagagaaauacggcuugcugaguuugcucuuguguagaugguuucagggaugaccacucugcaguggacaaacaauaaggagacugacucaucacuagaagaggaggcuaacucucccucucccagcagucacuaguugccuacgguguuuaguuuggggugggaccccaggauacauuuuucucacuaguguuaauauguccauguauauugccguugcucugcccuuguuuauguggccauuucuagaagagacuguuucacuaucucugguauuugggcacuugcagucuuuccaccccugcucuguaacuuccccagagccacauguggacagcugugauguagauugacucauugaggauggggucccccgcaucuuuugaucccugcauuguguccaguuauggagucauagcuucuuaacucaguaaaugcuaucuuugagaguguggaguuuuuuuguuucccgguuuugccaagguagguuuguguucuguccugaucacuuucgguacccagcuacauaguuuagucugaguaugccugcuccaucuugauuugggagagaucuguguuacucauucagggcugaauuuccuuuuuaugccguggagagucugaguaaguuuuuacaugugggagccauguagcuuaaaacagagccugccccauccucaccguaccauuaaguauguacauaucugcauuagaaguuggcauaugcuagugaggaggagccauuguguaauucuuaucuaaaacaagauagguguuugauuuagaaagccagcacguuaacaagaaaucaguagaguugagucaccuagcagucucauuuucaaccuagcacgugcuuucucuguccugcguaucugugugugccccacccaccuauucuagauggagucuuacuguguagcuggcugacucacacucacacucaggccuccugccugucucuuccgugcugggauuacugguaugcccagcucuugaucuguauuucuuuaccaugagaaugcuguguggagcugagaauguaacucggugauugagugcuuguauggcaugcaaagagaccaggauuggauucucaccaccacaaaaacaccuacaaaugacugugugauguccuagaaaccugugcggcuucuaagcuuguaugcauacauuuaaaaauagauuucaaaaaugauuauaaauucugaaaaaggacacugaauuuuuuaaccuuuuuuauugugugugugugugugugugugugugugugugagugagagagagagagagagugugugugugugugugugugugugugugugagugagagagagagagaguguguguguguguguguguaugugugugagugagagagagagagagaguguguguguguguguguguguguguaugcaguguuugagaucaagcacagagccauaagcaugauagauggguacuacacccucguacauuauuuucuaaaugaauguuuuuauguuagggauggugugcuuuuucucuuaaggguuucuacacugccaccuaacuuugccauuguccugcagaagcacucaacagauaaugcauaaauaaaugaacauuccugggucccaauaaaacuuuauuuacaaaaugguagcaaucagauuuguguuaguuguaguuugccaaccuguguucauuuauuuuugaauuccuuaaggaauauauagauccaaauaacaauguucagcuuuguucucugauacuaagauacccacaguaacuauuuauuacagcuuguucccucucuuuccuguagagggacuaucuggaacuuauauucuguuccaaggauagcugaaccaguuuggcuuaccaugaugucaaacaccuuggagaaaaaccaacucugccagcgcuuucucaaggaauuuauacuucugauugaacaagucaacaaaaaccaguaaguauaacccucuugaggcucguggcccaguccugagccagcgcauguucugugcaggacaugccuuguccuguauuuggcuaaucuggguaugcuuuugucuguuuccccaagguuuuuugcugccuuacugacugcgguguuaaccuaccaccuggccuggguaccaacugucaugccuguugaccacccucccauuaaagccuucucggagaagcguaccucucagucagugaacaugcuggccaaaacacauccauauaauccucucugggcgcagcuggguuaguaucuaaucugaguguucagagaaugugucugaugaaauaggaaaagaaacaugcuggaaauuguagcuuauacuggccuucugaccaagucacucgaagauugucucuugcaggaauaagauaggcccacagagccgcacugucgggcuccucuccuccccaucucccucgcuggcggcuuugaucugcucuuuugagacgucguagguaaacugaguucuccacgccaacggaggcuguucacccuaucacgguuucuuuaacuacugacuguuuaugcagauaauuuuuuguggucgaguugugauagggcaggggagggcugucucauuucuuauaggucguuaagcaauauuccuggccuccauucgcuagaugcuaguacagcccuugucuuccuagagcucuaaccaucaaaaugucuuuaaauguugccagaugucagugggaagaggagcaagaaaaggagugagggcuguuguuggaggggcuggggagagacgaccagaaggaaguggcacacuuacaucucagcaccgcucugacugugccauagaucccaugucuuauccgcacuugguccuugcacuugaugguagcauuacuuccucaacccaucuguguuuauggguuggcgggcgaggcugggguuacauaucugaguuuaugaggcguuguucucagcaagccuuagagugacaagguaugaucacaugacauucugucccacccuugugcuggaacucagaguugagucacagcuguucaagccucaguagucaccugccugguggaccacgaugagccuaggucaggucuuuuaaccacauccuagugcuuggaaaagagugugcaaggggugugggagcuagaggccuauuguucccuuguuucugaaggccgucacuuaucauuccuaugccuuucuuuuuguauguuagcagcagagccugggccuuuguauguggcccgauaagcacuccagacaucgguugggaugggaucugggcuuguguuugcugugacuugcagucacuugcaccaggcacccuugcucuggaugcugcuccuggaacuacaucguggagcauuaacaugcagggagaaggcuaacuugcaggaaucuucaaaugguaacugcuggggacagcagugcugggggaaagcauggcagcccuaaaacagugucucccaagcugucccaagagcugacaccacagcacaagcuguguacacucacggagggaggagagucucacuccuaccugucacccuucauuuagagcaguaaacguacuuucuuguccuugugcccaggagacacaaaagaagauacaggucucauagaauaaguaauaggcgugucuuuaaugaauuaacuaaagaauuuguggauaggaaaaccaugguagacuggaagugacuacacaugauuguaaucccagaacuugggaggcugaggcaggaggauuaagagugguagaccagucugggcuauuuaaccaaggcucaaaaaaaaaaaaagacagagcuuuauauuuugacacuugguacaaugacaagucccgaacuuaccaccucacucgggguugacuaguccugagaacauauguugcuguucucaguuggggaaaauaauuuuuuuuaaguguaguauuuacugcuggaggggaauaggcuggacauuaaggaaauacagugugcagagucgauuuucaaacagugguaauuaagcagcaugcauuuaauuagauaaaugcauuuagacuucggaaugcuucuccugugggauugagcuaacuaggagccacugucuccuuguguucagcauaauaagggaaaaucccuuccugugggcaagcuuguugcuuuucauuggagaucauaggccccgaaggucuucagcugucucuuccugagaagucccucugaggacuggguguuggucagaguaguuuaggaggaaacgaagccuugcacagagaaagcagccuuguaaagacaagugugagcgaccgagucuccauuaucacacauggugaagcauuuccaugaucagacagagaauguccuuagauuacgguucuuucugugugccacgguagguaggaaaauguaaguucugggggcuaaacaaugcagaugugcuuuuaauuuagguuccuaaguaauaaaaaugguuuucuugugaauggcuuucccauguuacugagggcuccuccaaacagucuacacuucaguucucgcugacccguguggugucucagccucgugagcagaggagcucagcugccuucucucgucacagugaucaggaauugcuccuaggagugcagugauccgguggcuuugcccccgugggcacugugcucaaggauuuccacauuaggcacaccagccaccauggccuguggaagccauuaguggguuggaaaagacuuucaacaggauaguacgauagaaacgggacucacacgcauguuuuguaaaaugugaguuuaggauguggcggcgaccguugccguaggugagaaaccuguucuugugggagugaguucucuccugccgccuucaggucgcccuuuugcccuuggcuuuuugacaguucagcuucagguuguuuuacuuuuccuuggguuuuccuuggauuuucauaguuggcguucauugaccuuggaugaacagaccuaugucacucgugaaguuuagguuuugaggaguccuuguuuuaaaaucuauuucugcuccaguuucucuccauccucuucccagaaucccuacugugugcauaucacagugcuugguggggcucacagacauuacauacaucauucuucauuccucuuguuucuccucagaacgggcaaucccacuugacuuguuuuaaacaggccaucucuuuuucuccacccugaugagaucugcucuucaucagagucuaaggauuacaugaacaucagacuuggcuaccacaaacauggugcuucucauaucuaagacacuugugagguuuccuuugauggagaaggaaagaaacucuucaggagggucugaguggaaugcaccuguguguuucagagcauuauccuuuguuuccagcaacuaguuauuuucuggcaaaaaaaaaaauccuuguaaaucuaauccaacaagaaaguguacauccauuuccccuccuauaacuacagacaacguugcccaccuugauuuugaugguaacuaucaucuagcuuuacccgaccuuuaccaugacuuuucauucaggcgugcgcacguguguguguguguguguguacagccaugucaguacuguugcuguuugccuuguuccauugagaagggccuucucacggaaccuggaauucucuguuccccagcaguucggguacaagcacauguggcuaucccuggcuuccuguggacacugggaagugaaccuaggucccuaggcuuguaggcacucuggcugacuuaugucuauagcccuuacucagcaacgucuucccuuuauccauuucauuuacaaauauaguaucuucuuuuaauaaagauuccccauuuuccauuuuuuauggaagauuuugagcccuuccccuguguaaggggcuuugugccucuuuuuucguuuugcugcugugcucuggcuacaugaauaacccuucuuuaugauuggugaagcccuguuuauguacccuguuuacaugcaaacucauagacugugcugcuccaauacuuagaaaauuaauuuaaaauauauaucaaaauauauaagguucaagccauuugguaaaauuuuuacauguguguauuuuucuuaggggugagaaguguugcuuguuuguuucauacuugagacacagucacuguacguagucuaggcuggccuggaacucacuguauauccugugcuggccuugaacucuuuccuuggcuuccguagucacugggaccauaggcccacaccaccagguugcgugugguaguagcacagagccugcugucacagaaacacccgugguuuccgaagugucugucaugugcuggagcuuggggaagcgggcucagaaagaaggccugcgcugagggcggucuucucaggccaaaccauagccucaucucaucuccccacacuucugagcuuucacucugaaguccaggaugacuucucagaugcuaaggcucccuuagccuucaguccuguccuuuuauagagaaaauuguuuauuguuauuauuucuguccugcucuguuaguguucuuggaagcuguguacaagggaaaacucugcgaaggacaaacuuccuuaugguucccuagagagacaacuuccugcucauucucacagucucucucgcccucagucugcuaauuuuaguugucucuaaccuguggcuuccugccgcucuagggauucguuccccagcugagucugaaccucccucacugaggucgccucucacaugcaaccccugccagcacugguggccuucagccuucugguuaacuuuucagucacuucugacgcuggcuugguuguguaaggguagagucuuuaagcucucagcuuaccuaaguaagcuaagugcauagccaggcagucagcguugguugucaguccucgcaaacauaaucaaacgaccaaacuugaugacuuaguaguuagguuacgguccuuuuuaaaaauguguucuuugagaguuucgaauguuuugaucauauucaccuucacucccccagugcuucuagauccaccccucccccaccuaaccucguguccuuuuuaauuugauuuuuaaagcccaugaagaccaauuuguacugcccaaauauucuugggcaauucuuggguguaugguguuacccuggaguacaguugacuuaccaggggcaauauuccgagaaaacugucucuucuuuucccagaagagacaguuacccauagcuccauagcugggggugggaucuuauaccuaacuuccaucaucaugcugggauuugguuugucaagacugcugugcguucauuugugcagcugccugucccucugugucgagaagacgcuguguagucauccccugccucuggcucuuauauucguucuguucccucuucuacagugauccuugagaagaggaggguacaguauguguguucuguuuagggcugaacguuuuugccgucucuuaucuucuguaccuuggucaguugugggucucugugcuaauaacgauguacaauaaguagaggcuucucagaugcggcuuagaagaugcauugaucuaugggagcaacagucagucauuaggaguacugugcucauuuagcagaaccacaguagcagguucucuccgcagccugugaccuguccagacauagguucuuagcuccauaauucugcugcguaugaguugugucuugugaaacgugacuuaacuccaagcaaagagugauuaguuucucccaugacaauugugccacuauugcaccaggggucauguuuuaccagaccagcuguuucuguagcucacagggcucucagcuggaucugaucugauugauuccuuuucccccaccgcccagcaugcacagcacccuccagcacugugaaagcuagccagcuguggcuguagcuuccaggucaguacuggcuaaguucucuauguggugucuucagcaguagugucuuacucugaaauucuagaggguaaccaagaaugcuggcaauagcuuguaauguuugaggcagccagggguggggucuauaguaucucaucagccaacaacucaaaacaaaauagccaguuccuggcucugggauuuuuauuugauagcucaugguaucugauaggaacacuguugcccuauuguagguaacuccauuuuaacuccugugcuccuguguguguuugugugugugaacuccauuuuaacuccugugcuccuguguguguuugugugugugaacuccauuuuaacuccugugcuccuguguguguuuguguguuuguguguguguguaagcuucuaugguauuagguuuccauaggacuuuuuaaaaaggucuucaguuaucuuuuccuauauuccuucucuacucugucauucguucccccacccccaauuuaacuuugccuuuuccauuacucccuuuuaacccuuuaugucaguguguucugugagcacuauggaaguacuucuguaaucuuuuaccuuucacacugaacucaaagcuggcucauuagcccauuuuaacccacuuaucagcguauaacuaagaugacauuuuguguccuguagaauuuuuauaucacaugaaauaaagagaaauuccagguucauuauucaugacucaguaauuuucucuuauaaauuaaacugaaucuacuuagaguaaaucacucuacuaagauaauuaauugauuuaauucuuacugauggaaauucuugaguuugcauuuuagccuucagguuuacuauccuaggauuuuucuuuauguucaguuauguguaggugcuuguauaucugugugggagugugugcaugcuagugcggguaucugaggagaucagaagguggccgacccagaguuacaggcaguugugagacuccuugcccagugagaacgugggagcuggggauugaacuuggagcacaugcucuuccuaaccagugagcacucuccccaccugaguguucuaagaaaauuucaaauuugcaagauaucuccagauaugucauacuucaucuggucauuuaugcaaagcagugccuucaaccuuuccuugggccagugugcaaccaccugagcacagugaagggcuuguguauccagcagagcccugcuguggucugaugugcucagcuugguacugggcugcagccuguguuaucuuccagaccugcucuccaguaucaggggaacauggucauuccuagaaagucuauaucuugugggucaaaaagugguuggagucugugaaucaaguuaccuguuguuuucuuuuaaagggcagacauauccaugcaugcuaauaccagagggcguugucuccuguccgucuuuaccccacaggugaccucuauggagcuauaggcucuccggugagacugacucgcacuguggugauugggaagcagaaggauuugguccagcgcauucuuuauguucugaccuacuuucuccguugcucugaacugcaagagaaucagcugagcuggaguggaaaucccagugaggaugaccagguuauaaaugggagcaagauaauaaccgcccuggaaaagggagagguggaagagucugaguaugugguaguuaccgugagcagugagccugcccugguaccaccaauccuaccacaggggacagcugagaggaggagcccugagccuacaguaguagcugagaucucggaaggcguuaauacuagcgaacugggucacaaaccugaaaagaacagaugcaagaggccagagcagaauuccgaggccaguaguaugggcuuccaagaggcagaaccugacaguucguggauaccucaaggcauauucugugaggacaaacagaaugaccaagaggcaacccaggauuguucuucaaguccucccagcugugaggugcccaggguaagaaggaggauggaccaacaaacccuccacucgaagcugcauggggagacgcuaaagaagcgagcagagcaguccgcagccuggcccugcccagacaggcauucccaggaggauccuccugucgaaaaggucacuuuccacauugggaguuccaucuccccggagucugacuuugaaagccggaccaaaagaauggaggagcgauuaaaggccuguggacauuuccauggggcuagugccucugccagcucuagcauggacacugggcugacucaagagcagcagggcucugggugcuccuucaaagcugacuuugaaaaggacaucacgccucaggaccacucuucagggggggaaggugucucugaggacagaggccuccgggccaacaugacacaugcugugggacaacuuagccaaguugauggcccccuugcacauucccuuugugccgcagaaagugggcggagacugcuggaacagacuagagaugugcaauuaaaaggcuacaaaggaccuucaucggagccuguuccaaacagauguagacagcaggguggccugcugauugcugcagauguccccuauggggaugccagugguaagggcaacuacaggagcgaaggagacauucccaggaacgagagcuuggauagugcucuuggagacagugaugaugaagcgugugucuuagcccugcuagaacuaggucacaguugugacaggacugaagaguccuuggaaguggagcugccucugccaagguaacacuguacagggaacuggaaucugucccuagccugacacugugaccauguuagccacucaugaugacuuuauauguaacacauguuuuucucuuaaauauuagggguauuaccacuucaaggguucccagccugucugaucuccaaggaugcucaccaucucggugcagcuaaguucuuggacagagacaggugguuggcugucuuugcagcucuugagacguuugggggagugaagagccacaguggccaugcuugcaaggaggagaggguccccucaugucuauguaaugaguauggcuggcuguggaugucuuguuucuaaggugauaaucacacucacugaggccucccuccugccgcucaggccucuuuagcagcucuccgucaaguugcugguuuuuuggucugugaagacugaaaguugcaauuaaaagauuccuucuauucuucuucauuguggugggcacuacuuucugcagauagguuggauucauaaagccauacuggcacuaugauccccagccucacucuuaucccucugacagaggccuucuguuacacguucaguaugauauauaagagcagguuccuaaguucuuuagacaagucucacuauguagccuuaaacugaggacaggcaccuccacaucuagcuuaagaaugaaguuuuaacuagccauggaaauaguauauuuuuuuaggauuccauuuuaauaaaaauuaccuccuuuucucccaaccccccuguuuucucauacuuauagucuuuuuacuagaggacccugauuugaacuacaggaaaacuauuuucuuguaucauuggagguuuuguuuccacuguaauaugaaaaguguguccuuucuuuuuuuuuuuuagcuauguguuuaauauuucaaauguuguucuaggucucagagcaccagcaaggcaaauguuagaaauuuuggccgcucacuucuggcagguuacugugccacguacaugccugaucuggugcugcauggaaccagcagcgaugagaagcugaagcagugccuggcagcugaucugguccacacggugcacguaagugaccagcuuagagccacacgauggccagcagcaggcucuugaucuuacacugaaagcaucugcauaaaggauugcuuguaaggacauagagcggcaugccagccaaugagguggaacuaagggucuggggacucuguaagcauagcugggccagacucagcaaaggaaaagcagguaauggcagagcugcagaguccuggagcaggaacagagacugccugucuggggacagugaggaagguggagcaucuggccuccaguucuccccuccauccuccaguuucuccugcaagaggccagagagcaagggcacagcaaagguagagaccugcgauuuucuauagaggucagccuccuggagccagaacagcacgggcagaguagucaagugggggugaauggcugugggcuggccuggcaacacaaauugacagauggugagugacaguuauaugccuucagaaggaagaccgcagagauguuggguauggcuugcuucuuauccaaaccuugcaaguuuguaaaggcaauuacuuuaacugauuugucacugagcucacucugauagccggguggagauggcuguagaaagauuuacagguauuccuggaaaaucgccuguagcuacugccaagugcuuuucuguugucuccagcaugacaggagcugaacacuuagagagaccgugucauucugauggaccuguuuuuaacugugcugccgcugggcagaugugcgagcguggcuguuuugcaauuagaaacauacgcuaucuugugcaauaaggagaauccuguuaauuuccucauuaagauuguuggagccuggcuuucuuaucuccucauugcacacuuuuuguuuguuaaggggaaggguuuuugcaaaguagaaaagaagacauuguagguuaucuuugaccuugagcaucugcccagauaugaagcagacacaggcuaagcaggcuaaggaugcuuguaugaaguaagacgaagggcuccggugggaaguagagaucaguauccugcacgccauagagguaaauagcuguagaggaaguuccuagggucugggcagggcccacccagcacacaugugcuuacccaaauaugccuaguccuccacacuuugugaucgacaguccuggagucaaacugaaguuucuguuaccuacaaauuacucgaacuucccuucauucuuaacacagauaccacacacuugcuuuuaacauuucagagguugggucaucuauccaucccauaguauaagcacagggcccuccuugugugauaucaccuuccugcacuguccuaagugugacuguccuuuguuuaguguguguugggacaugauaggacccuguuuuauguugucaucuccugccuauauccauauaugcagagcccuuggguguuggcuuucuguggugcuguugguuugauuccuguggaugucgguuuugccccuugcaccuuuaccaagccagagagcugcugcugacagaggcucccaaggcuguaggagccagcgggguuguccucagugacagugagcucacgagcggcugcucauuuuuucggaagugcccagauucagucacuaaccgccauggaaaaacaaucuccugguugauaaccaccuccaaaugaucugugacacaacucaugacauuuugucauuuuuaaaaaugggucaucaauucugcuuucugaauauucaauuuucauugugacaucuagcucugcaguucuuguguuugagaaaauagccaugccuucauggucauuccucuuagagcuuuuccauuuucauuuucucccuuuuaaaaacagcauuuuuacauuguaggagcucucauuuuuuuauauagucaucuugagagguuaaauuuuauuaggcauacuaauuuauuuugugugguaugagugcuuacaaaaugcagucaugugcauagugcuauaggaaauuguaaaggacucauaaaaauaucuucaaguuuuaauaauuucauauguucagauaacauuaguagauuuccaauuucauuuaacaaacucaucaucacgaguucugcguuuguuuguuuguuuguuuguuugagacagacucucgcuguguagccucaggcucugagcaguccaccagcaccugccucccaagcccugggauucgaguggggcgccaucaaggugguccugaguuuugauuuugaagcggaguuucauguagacugccucucuagcucacacucuggucuguaacaguguuguucuguuuuuacuuuaaaaggcacucaacuuccauuuacaaauacuugagaaauaaggguauuuuuaaaacauuggugaguugaccauuuuaaggaacagugguuuucugagcugagaacacugucaggaaaagaagcggcaauuugagagguaugcauguccugugcacugagaacuuguggggcaaguggggucaagcccgugcaccacuugcuuucacagucugauuugcggguauaaauaauuccagucucagggcuggagagauggcucugugguuaagagcacugacugcucuuccgaagguccugaguucaauuuccagcaaccacaugguagcucacaaccaucccuaaugagaucugaugcccucuccugcgugucuggacagcuacaguguacuuagauauaauaauaaagaaaucuuuaaaaaaauaauaauaauaauucuagucucaugccagacuuugggacuuguaauuccuuuucaagaaggauuuugaauaacuuuguaaaaaacaauuguuguaacuuauugaucuuuuuuuuugacucaugcaugauuuagguuauacaaucuggcuuuauaaaugugcauuguauaaucuuagcagacuaguuuucuuuggagcacaaggaaauuucuuccuagaacauccagcaucaagaguaucuucauucuuuuuuuuuuaaauccuagucucuuacaaaacuuuuacuguuuacuuuccuggcuuucauugccuuuuaaauacuaggacccagguuuucucggugugugacacaugcuguuuuucagucugacauuugaauucuuuccuccugaugcauguuacccagcugcuaacaguuuaagguaacuuugcuaucaauuagacauauacuuuccuucaccuuccucuucacugagugcaaggggacggacacaggcaugagccagcaauacuucacccuguggcccuccagcagccuugucugucuucucugucccaucugccaaugagugcugccaacuaggcacuguuggugaccaaaaugaaggcagaggagggcaauagaccaacaccagcagcacuggcuuggcucugaucccugaugucacuacucacugagacuuccaacuacaucagcuaacguuacuuaaaccucaggaggauuuagaggacaucagaacaaggaaacugugaugcaguggguaagaguuugcuucccagguuggggaggaagcucaguaggagagugcuugccugguaagcaugaagacacguuugcucuucaggacccacgcaaaaaagacugggugugguggcaggugcuuauaauccagaccggggaggcagaggugggaagaucccugucacucacugcuggccaagcccagccuccucagugagguccucaugagagaacaugucuugagacacaagauggaugcacccacagaacagcaccugaguuugaccucuggccuacguuugcaaagcugggccuccaaagcggccuccuaggucugaaccaucgcucagcuccuaaugucguuguggccuuugggggaaguguucauccuauaaaauaaagcguacugaugucauuuaaguuugaaaguccuguaguccacaucaaguguugagcacggugccugguguacacuacuaagcaccugguaacuguugaccauuuaaacaugaaaugugaaaaagucuuguaaauggaaaaaguagugcgagauguuauuaacagguagccaucgcuguguuaaaacagaauuacuugguauccucaacacucuuguuugcuugugggugguagacaccugcaggaggcgacugagcugagcccuuugucauggaacaaguagcuggcugucuucucuuacauuagguaaggucaucaggacuaaaauuggcaucaucacagugaucuaggcuucaggcacuuuucagacuaaucuauaaauaacaguuggauauagcagccuguuccauuuaauuuuaagaguagcaacagauugacuccagaaauaucacauaggagucaguagcacagauaaggcgcuuugcugaaagccuggcugugauacaugcucaugaauacuaauuaauucaugugggcaaccaaccagccagacuacaaaagaacagccugucccaucagacaagaaaucauuacuuaaguagcgcauaguauuaaaugccucaggucaaaucaacagguuagagaggaaaccguuuuggaugagucuuguuuacgacacccuggcuguuuucauuucucuaggauacauuaguaacuugggccugcagcucugccuucugcagcuggcgcccugaagcagccccacugggacugggagauguguucagagggcuuuuaaaugaacucaguuauguuguugcuugucuuuucagacaucaucuuaccauguagcccaggugggccucgagcuugcaauccucuuaugaucuucucgaguucugggguuauaggcaugugucaccaugcccaucucacuugucugucccccucuuucccuccuucccacguacuagacaugugcucacugaccuauuaccuccaacucuuaaaauacauguuugaccuauaacuggauuuugaugaccaucuuuuaguaauaaagaggauagauauccuuacagauggucaggauuauuauuuagugagaccuuugcacauugugaguauauauguacaugccuucauacauguauguacacauguucacaugucuaccgccaugugucucuucuucccauaggccugcaguuaccgugaagcagaaacagacuuggguucuuuguauucuuagugugucgucuggugcaugaacagugcuuguucuuguuagauaacuucauaaaaccgaguuuagagcauuguauguuucuuacuggagcggaaacgcucgugggaauaugccuucuucuaggguaaagagaaaugugcagaaucuuucuuucgaguccugaagaggaagagugauguguaugacgugacgcuugcagcucuuugcuuucauuucauauccuuuuaagguuuuuuauuuuuauuuuuauggguauaggaguucugcccgcauaggccggaggaggagcaggaguuacagguggcugugugaguggccaugggggugcuggaguuacagguggcugugugaguggccaugggggugcugggaacccaaguccuccagaacagugucuggcuuugucuuguuuguuuugcguacuuccuauugaugcuucaugaauuucgcaucaugcaccccaaccccacucaucucucaucccuucacacccguccuccgcccuugcaaccucucugcacaaggaaaaggaaaaagauccugucgugaaagcuguagugugcgacagugugucccacaauaggcccuuuuguccucacuucuuuacuugcaaauaagugcucauugcaaugagccauuggccugguucaaggccucuggcuccugcuucccuaucagugcuauauccgcacugagacuccucucagauauccuguuguugccuugugacguggagcuccugcagccagcuuuggaucuguaggccuggcuccuggaacagucuucuuaacccagccaucucuacagcucccuguguuuauuuucuguacuuagaggagacuaaggucuuuuggacuuucugucucuucugcauacuguuucagagcugaacacaugucuacuuucacuuucucauuuucuuucuaguaugagauacuuauacauuuaugucagccuccacgaaaagcuacaaaccuucucuggcauugaaggcacacaguucaucacgugacuugcuuuuggggacucugcgaccuugcacaccguguugcaccuucaaacagaaucuggucucagcuuggcaguugagcuguggccacagguugaauaugggcauuagcccagggagcagagugagcagagccacgagcccagcccgcagaggccgggcuuuucagcccucccuccagcugucaugcuguucacagugccccuuuccuucccugugcccauagugaucauggugucuugugguucucagaggcccccaccuccccacaggucagagugacugcugcucuugcugucuguccuuccuuuccucuuaguuuaugggaucuugcuuuguagcccacgcuggucuuggaugugagcuguucuugucugaccuacuaaguguugggaauccagccaugcacccuugucucuucucauaugacaauucuucauuuuuuaaaaaagauugauugauugauugauugauuacauguaaguacacuguagcugucuucagacacuccagaagagggagucagaucuccuuaugggugguugugagccaccauguuguugcugggauuugaacucauaaccagucagagcucuuaaccgcuuagccaucucuccagcccacaacucuucauucuuaagugacuaacacuaaaccuguuucuaagagagaaauucugcuaaacaaaugcagauagcagugugaaguauaguuguuucuucugagucuucgcaugcacuagcagucuggaggcagccucuuagguuugcuggcuggcuuggcucuccaugguugaaggacguaggcuggagaggagaguuaugcaauggcaggcuuacuuuaucuguugaaacucacugcagugcuuuuauacaguaggcaugucuauuacucagagccucaagugaaauuccagccacacaguguacaagcgacaggagauggcauucuccccgccaacauguaugaggacauuguugauggaguuuuaggguauccgccuaggucuuggcaguucccaaagcuacgcuucuuccucuucccugguauagcaaauaaaagcggucaccuuguaauucugccggaaacaggcuggccuggccgguguucucccgcagcgggugccauugcuugcacagcuuuagggagggaucccaagcauccuuaagcagcaggagcuccuuggggcuuuugauugacuuucugagccuuguagguuucauuucccgaaucuuaguaagcuucacucucuuucuacgaaggaaugcuuuaauucuaaggaaauuucugccuagcaguguguauuauuacacgcccggguuuguaugguuuugauacauauauguauuugauaagaugugauauuaaaaaaauucuacaugagccagcacuuggaaggucaaagcaggaagacugggauuuuaggauuauccuuaacugcauagcgaguccaaguccagugugaacuacaugaaacucugucucaacaugccccaaaucuguuuaguaaacucugccauuauuauauagcuaauaagaaaagguuaauguuaaaaagaaacguaauucugggcauguggcacacaaguuugaggcuagcgugugagucccagacuagucuuuguguagcaaaucagaaaccaucaguguaauucuguuuuccuuugugcaguguggugcuauacacuuuucaacuauagagccuucucagaagagacuuguuccguaagggccagggcuaggcaugguggcugccuucacaggaaaaacaccaugaugaaaaugaacuggaggaaaauucuguaagccuagcacugaagaggcugaggcaagcagaccacaaguuaaagcccucgcuggccccaggguaaaagcccacugggaccuacauacugagggcaugucacaaaaacacaaacuaauuaagcuccagggcaucggguauguguagguuuguguugcugaaacaacccaaaacauggauuuuuagauuucuuccaagucuauaugagcuuaguuagcaguugacuuuuaggccaaaucauagugcauuuaaccuggcuccucuccaguaggccuguuucuauuaguagggcuaucaacagucaauagaaucaauagcgcuuacgugucaucucucugacuguauggcagucgagcucccucacaguacaaccagugugaucucucuccgugaugguuugaccauuucccagcugcuuucuccugacuuuuaagagucauauuucuuuuagaacguucuuguuuuccagcaaauaagcagguccuaggugacacucugagguggaugugcguggcuaacucuucaggagcacucagggacugagcgugaaggauuuagucugagaauauauaacucuuguaguguuuccaaggcccucagugcucaacacccuucucuugcuggagucuguacauaucaggaaacccaugcuguaaggcagagcaggaugccagggcuccauccuuugucugugcagagccuguuauaauucaggagguagcguuucccauguuccugccccugugcuagggaggggcuugaggaaacugcugacccacaggccccgugucucugccuguguucuuucuccuugcuccugugcucccgugaccuaaaggaggcucagcguacuuuccaugagugaucuuccucguacauuucuuuuucuuagugaguuacugcuuuaacuuuauauaccaagcccucugcccuucuugaccauauauguugcuacaagccucugcuauaguucacacauagagaauguucuuucuucuucagugcuuaaagagacucuucccauugguggcgggcgguaccacacagacuguugggagauuggauuggcacauguaccuucccuccuuuuuucugcugcagggagaacauauaggaaguuagggucaguuggaagcuaggacccaaaucacccucagaucaguguuuuaaaggcuagauuuugaagcagagcuuggugacagaugccucuaaugucaccauucaggagucugaggcaacaggaucacuguugaguugaguguggggccagccggagaugcaugcaguuaguaguccaucucacagagcauaauguaagcagaagacucuauuggaaggcuaugaggaacacauagaguugggagagcagcagagcgaucaggguuuguacuaccugcugucggggagagaagagacagcgcugcccagugcugcccagugcugcugccacccgaccuccuucugcaucucaagaaaggagcauuggcuuacuauggccugggcaccucgauagaggggagacagcagcuuacagacccaccaggccuuauccagaaggaaguuaggaaguucagauaagcagcucaaagcaacaaauggucagcacagggugcuggaugguacuaaauaaaaacagaaggcagccucuuuaggaaugaguuaggaaagugcucacaagcauuggccgugcugucugcugcacuggggcaaggagcagagcauggggcuaugaucgcugugcuauugcgcggcccccucccucaugugcauggaggacacagugaggucugucagaaggcgcagcuggugaagcagucauuuuuugaucaguuuuguuaucuauuagaaaaaaugcaaauuaaaaugacuacgcacucugugugauggcuacaauugaaaaguacagucugagaccaggauugauacaaaguaacagaagcuggaauauauagcagauggcaguggagccacuuugcagaguuaagccugcacuuaccacaugaccagcauuuccacucaggauuuauucagagaaguaaaacaguguucgcaccaagauuuguaaauaugaaugcucauggcuguuuuguucuuucucuuuuuuaagauuuacuuauuuauuaugucuacaguggucugcaucauccauguauuccuacagaccagaagagggcacuagaucucauuaugagauuauaagccaccauggggggcgggcuaugugugugcuggggauugaacucaggaccucuggaagagcagccaguacucuuaacugcugagccaccucucuagcucugcuguuuuguucuuguuggccacauuugaaacaaucucucucucucucucucucucucucucucucucucucucucucucucucuuucuccccucccccuccccgucuccucuccucuuuucuccucucucuuugucucuccguuuaucuuuuauuugauauguaugaguguuugucugcauagaagcacaugcaccauaugcauggcugcucuuugcagagauggcagguucucuagaacuagagucagagacaauugugaacugccacguagguucugggaacugaacccaggacuuccacaagagcaauauggcuaugccaucuccagaaaaacaaauuacaagaggauacucaaaaauaaggcacuaaaaugcaaugauuacagcuauaucuuaaaaguacuauuuuuaaagaagccagacaugaaauucuacaaaaguucgagcaauaguucuauguaggcuuagauuuuucaaaaccucuauuuuauuuaggguucuuaaacacuucaaccucccuucuaacccacugaccagagguagaggaaaaggaagcuuaauaaggaaagggugugguggaucuguuuagaaguaguuucuuggaacgauuccacuccucauugucaggauaccagcaguccaguucaacagcaaacaccaaacaugaaucaguagcaguggcuugauccagcagaaacagcaaggcuccaccaaaugagcacaagcaguggaaguugccagaagcagccggaauaccacgagacguucuuuagcacauuucuaugaagugaagaccagcaaaggucacguugcaugacuuagcaauucacaagcuccccacugcaacccccugucugugaggcuucaguuauauucuuucuaaacaucacucacccucucaagugucuguuuucagcaaaacaucacaugcuuucugacaagacagccuccaggaaaacaucacaugacacaacugaguuaaagaaaccagaaauuuccacuucaguucuagaaggcauauuaguuguugcugagauaacuagcuauagaggacugacuacaaaggaacuuggacuucuguggguccagcaaaauucuaaugcaugguuuaugacaguggguacacaaguauauacauuuguuaaagcucauccaauuuacguauauaauuagugaauuguaauguguaaauuacgucaguaaacaagacaaaaagaagcccaaaagagucuaaaagacaaacuuccaacuagcacaccaauacccuucuaacauaaaaugauggacacaugucagucacaugaaccaugggacacuugcauaaagcugggaagacuucuaacaguaugacuaauauuuguaagaaacaauuucaugguaaaaucgaucauuaauuugauaaaauuaaauguaaucauucuauuauaaaacaucacaccuacauauuauuuaugucuguacuguaaaauuuugagauguuuuaaaagucaggcauuaaauuaaucagaaaaacagccuuucugaagauguaagaaaagaauauuuacaauaucaaaauuaucccccauaaacuaggagaaauaacuccagaugaaaaaaaccaaguagcugacugguaaaccuauagcaugugggugcacacaggaugccgggacucggugggcuccuguaaaaugcugcuuuuaccaacuccuagagcacaugcaagccuugaggcuuugggcuugaggcuuggguaaagaccaucccuggggaccucuuaccauuuaccaucagcuccugcuacuaacuuaccacauauaugaaucacuagcucagcuauuuaacaccuacagaacuacaaaguuuccauccuggauagcuacaggaaggcaaugaauucagagcaacuacaggcagagcaaaagccuaguuugagagaugagauauuuaugaggugaggccauuuuuucugauguuucgagguugucuuagucuuuuucuguuacgguaauaaaauacccugacaagacuugcuuagaacagaaagguucauuuuggcucacuguuugagauuaucgucugucacugcagcagucacaacagcaggagcuucaguacagcugaucacauugcaucuguggagaagcagcagaaaauaaugaaugcuugugcucuucacuuucucuuuauacaggaucccaaccuagggaauggugccgcccaucaugagccagucuucccaccuuuuauaucccagucaagacaauccuuuacaagcaugcucuaaaucucacuugacaacuaagaugaaccauuacagauguuuauaccauaugacacaguuuauuaugaaguacuugaacauuuuuaaguaugugucucagcggccagacuuugaccuuuuagauucaucaaguccucagccugaauauaauuauuagaaaugauugguguguacaaccacaguuacuaaagaaacuuugcuuaacaauuaaagcuauaacuuuaaggaacugguauugguaguggugugugugcacauguguguaucuuaaaaguacuauuuuuaaguacuuuuuaagugcaugccuguauauauggaggccagaggucaccauugggugcauuguuccuuaggauaucucuccagcuucugauacuuguuuguuugguugguuuuaaagguauaugugagugugugugugugugugugugugugucugcuacacauaagcagguacccacagucauuagauccccuagagguaguuacaggcuauugugugcugccuaaaaggugcugggaaccaaacugcuguccuuuggaaaaacagggcguucucuccagucccaccuaccuuguuuugugagacagggucucucuuacuggggcccagcacucaccaguuaggcuuggcugaccagccagguggaaguguccaccaccaugucugguuuguuuuuuaaacauggguucuguucauacagaacugucuccuuagccccuaaaggauggaauguuaucuuaacuaaucuuuuuauuggaaaaauagcaauaggauccuucaacuuauuuugauuuuccucauucuaaaugggaauacaguccuucauaaagacaguaaauuuaauaguaaauguugggaagccauguccuuuuguauagcugugaacucuuaacaccuuguaaauuuucugaaaugauauuuugaaaaaugccauuuuucaaaaguuuuuauuuauguaggguguguguguguguauacguauaucacagcaguuuuguaggucagaggacaauuugaaagagucucuccuugucaggcacugagcuuggauuuucgacuugcuaagaagagccuccccucugagccaucccaccgcuccaagcucauuaauuuuaagugcugccucaguggcacaccuuccugaguaccuguaacacuccaugcuucugcaguuugcaccuccauccucuaaucucaggcagagccucuguccacucugagcuggagaaugcugacccaccgucucucucuugcagcauccaguacucgaugagcccauagccgaagcugucuguaucauugcagacacugacaaguggacuguccagguggccacgagucagcggaaggugacggacaccaugaagcugggccaggaugucuuggucuccagucagguguccaguuuacuucaguccaucuuacagcucuauaagcuucaccucccugcugauuuuguaagugucugaucuucugucaucaauaauuauauaacugacaaauaacuuuuauucaauauuucggugauaaaaucacaaguucagacaacaucauuuuuaauauauugaagguuagcuagcguuaagggaaaaugaaacaugcaacaucagaccugcagacagggcagagcuuugacagugucuucugaacaaagcagagaguaaaguagauaaggggggacugagccuagaaagaaacuucaaguccuccacuggagagugucuagauggguccgaggccggccagacucugaagggaucguaguuucuucuguucucugagcauccucacagugcauuccaggcgaacggaagcacuucagaccuggaagcucuguguaagaacuuaaaaugacgucagcuguuccuuuccaagugggauuuaacggucacuuuuguaacaguuuuaaauagaaaggaagaauagccuagaaaguucuagaaaauuauuuguagcuccucccuaguccaugggcuaacaaauuucuuuggaugugugguaugugugcagagagguugaaagcauauccagagaaugagagagaaagguuugucaaggagagaaaugaaggcacgcagcuggacaguguggcuaugcuggccuuagggacacuacguggaagugccugccuuuucugcuuccuuccauucagugcaggguagcucucugcaacagagccugaguucaaaacaucccucugccuccuggccucaggaaauggcacagaacuauuaaacugcaaaacaggaagcugagcaucagguuuuuacacugacugucccuucaccggucaccucucagguuuuacagccagguccucagcugcaccucuuuccacacacgguuagaauuugaugcaggcuuucuaaaggaugggugugaacacugucacacuggagcaggucaggaaaaccuugcagcaucccuggguuucacuuggccaucacuacuugugauggcuuugaagcuuagguuucuuguuugcaacaugaagauguuacagaugugcuguaaggaugcucugaggaccagggaggaagugcugccuuuuuuuuuuuccucaaaagugccacaccagcacagguggcauuaaaagccacuugcauuauauauucacagucaaagggugggcaugagagccaacucggaguucugcuucugugcuguguccccucucagagccucaguucccuuaccuguacagcuggaagggugaauaaacagaugagucugcuucauaugcugagaaaagcuaguuaauucauacgaagcacucggaaucgugggagauuuuacaagccaccaguaaguuagugugacugucacaucucggugacaguucaacaguauggaugguguaagaacuggcaacaccuuucauaacaaucuuuauuggcucuuaacugaagcaugcgcugcaggcuggcuguccgagggguaucaggagaagcaccaggcuuaguaugaucuuauuuuccccuagaaguauuuguccugagaguugaauuuccauuucuguaagggaaggaggagauauuagacgcugugguggugugcugcuguguuuacagaugcugacguuggacugucuaagacaugguuuucauugucugacaaaucuuaacuaugaaagcaauaaauuaaagagcaucccuuucacuucauuugguagaaguguacaugaccacuuuguaaugcgugaaugacuuaccuaggaaaaccagaauccaaaagaauuccaucuaagcauuacuuacgaguguaaggaaaaaaacagcuaaauuucagaaguuaaaauuugcauugcaucucaggaauaaaaucuuacaaagaagggaaaaccacucagcauaauucuauuauauuaggaagcuuuaaaaauauuuuuuguaaaugugggguuuuuuuuuuccauuuagcauacauucccagacccacauuguaucauuuacuuuuucuguagaccaaagauacuauacauaaauuacauuaagacuuaaagaagucaauauaauucgaauguucuuugguaucuuguaacucucauuuaaaacuuugaauuucacuucauaacgaaccaaaacuugguagaaaauguuucugcugcuucccucugcucauggaagggaccauuucugagaagcuugguggugucccucugacuugagcaguacuuacaggcuguuggguucaucccuagcacaauaagaugcuaaccagugagaaacugaaaaguguccacaucucacagacacuuugcccugacguugaucagcccagauggucaggaucaacauuuucaaaugcaucugucagucguuuuaccuugaaaauaagaggccuaaugguccaggaagaaacuaugcaugauggaauuacccugccaaagccaucaggucucucccagagacccuuggacggcugccugccaagugccaaaacauuugcugcuggugagagauguagaugacugcgguucucuaaccuccgaggcuggacaccauuccaagggugaagaugugccccaaaucaugucucucuauugcuacuaaagaccuaguuaaaggacacugucaauacuaaaauaaaagucuggagggaccuuguuccagucauucugcuuuggggaauauauugugccaggacaaucugagguauaagaagaaaacaagaacuaaaaaauuuuccccaaaauuauagcccaaauguagauugcccccuggcuauguaaauaaugguaaguuaacauucucuagcgcauuggccauaaaaauggcagaguaaggaacucuuaaauaugagauuauuaaguuucuuugugacgagaaauuuuugugaauaaagacauaaaaacgaguacaaaaauaaauccauuuuugcaacccagaacucacugcucaguaggguuuuguugcacauaaggaggaguauggugcucaagagacugacauucacgaugguauugaccaaucuauccaaggauagaguugacaauguaaaugccaaaaagacaggagauguucaugcuuacagaaugauuucaauucuguaaaauguuuucuuuuaaagauacuagaaugauauuauauaacaauguuaauagcugauuugugaaaaacugaagcugguaguuuggggggucuauuugaaaggggggcaauuauagcuguguuuguagaaauaacuagagaagcccaacucaacgacccugguggaugcugcaguuguagugcucauugcgaacgcuguugccuuugcaguguaucaugcaucuggaagacagacugcaggagauguaccugaagaguaaaaugcuuucagaguaucuccggggacacacgcgugugcacgugaaagagcugaguguggugcugggguaaguucugugaaaggcuggccuugcuccuaggcguacuggcuguacuuuggugcgggacacacacacaugcacacgaccuauggccugugucaucucuaccuccaggaucaguguuuauuucucacagugcccagggacgcucagcggugugcccauuccccagugaguugcaacguguagguuggagugacauuugaucuaauucugccucuucaucacuagugacacuauaacaaugcaaaagucacaagcugugaggaguaguggcagcuugucucaugugguggaggaggugggcagcacuucuguggacguccugagcucaccccacacaagggaagacuugcucaauacuaaggaugcacgcuaucuucugagggcauuugucacacuuuaucuacaaaaaaaucugacuccacuuucauuucaauagaaauagccaaaaggacuaugccuaugaggaguuucccuccuguuccugacaugauucugcuaauuggaauaagacaguacuaugccuaugucaaccuggacauuuucuacgaagccugauaguuuugguuuuuauaguuaacuguguuucccuuuuugaacaagcuucuuuguuuguuugcuugcuuuugagaugggguaucacugugucaccuaggcuggcuuuaaauucaaaauccuuuagcuucagccccuccaauauuagaauuacaaguacgugccaccaugccugccuugcaacguguuuuucacagcugcugcugcugcuaaaucuaucuuguguauaugaaugcacuuguaugccacauauaugucaaugcacuuggagggcagaagagggacaucggauccccugaagcuggauguacaggcuguuaugagaugccagacgugugcuaggacugaaccccagucuuuugaaagagcaccaugugcucuuagcugcugagccaucucuccagcucuuacaauuaggccuugaauucuuaccagauuuucugucuuuuacagcuagaugagacaguuagcuuuuccuaugucuuagucauuguucggucacugugaagagacaccaugaccaaggcaacucuuauaaaggaagcauuuaauuggugcuggcuuacagguucagagguuuagucuuuggucaucauggcaggaagcaugguggcacacagguagacauggugcugaggaggaggugagaguuugaaauccugauccauaggcagaaacagagagagacugagccugccuggcgugggcuuucagaaccuccaacagguccacuccuaauccugcuaauccuucccaauagugccacuccuuggagacuaagcauucaaugagcccacagggaccggggacugugcucauucaaaccagcaccacuggcauauguucuuuuggguaauccauuuuaaaguauuuucccuuuuggaggccuugagcuuucgcaguuaauuugcaagcuacuucuacugguuuuccuucucagccucauccuguaauccugccucagaugccccagugcuggaucuguucccgugguuacaggacuuuauccuacugucugacuccgacaagugccguucacagucuuagaaagagauugaauuaugagagaaacaacuaagauauauuccucaaacugaaacccuccgguucucuccuccucacaccaccuacagcaauuuaccaaagcauauucuaugcagugugcuguaaggaucagcccauaccgguccaucugaagugauggcaccucuuccuaguuuccuuucucucagaacacucaguagcccaguaaguugcagaaccuguugcuugaagaaccugccuugugguuuccuaagacugauuuaagcuuggugcaaaaggaguaugccuucaagaggaaggagcugcugaggaggccacaaagcacaacauaacauggggaugcaaggaaugaaaagucaccugugggcuucgacucagauguccccugcugcgggaggagcagccuuguacccagcuuccucuagggcaaacauccuuugaagcauugucuacugggagguccuuucuuuuccucaucucuuuugcucacacguguuccucacauuuuauuuauuuauuuuauguauguagaucuguggaggagcaugcaugugccagggugcacauauaggagucaguucucucucuccuucaucaugugagccccagggacaaaacucagaucaucagccuugacagccaguaccuuuaccagccaagccccucuugcugucccuguuuuacauuuucauuaguuuaaaagcuagaccagaagcuggugccuagacauaguacuuucuuaugaaaugaugcaguuuuaacauacucuccuugaauuuuucaacacucaggaucgaauccaaugaccugccucugcugacggccaucgccagcacucacucuccguacguggcacagauccucuuauagccgacuacaggacagcucucauuggaaaaugagacaggauggagggugcucucagugacggcagaggcgugagaacacggagcaggcaccccucguuguuccuguggcugcugccuaguggcucuuacauugggaagcuugugucuacuccaugcagugggaguuugugauuguucaggaacagucgacauugucucccaggaaucaaaagaaaguaaccuuucuggcaggagggaaguguaagcaacacugucaaacuagacagacgugcccaugcuguuggguagaauacugagggcugacucugaguaguggguaaccaaugucuagaacauuccagaaggaaaguguuuccuguucaagcgugagagagcaugaagaguugcucuaagaacggguuguggcuucuaggucagagcucuucuacgaacauugaccugaagaaagccauguugugccacugucagccuggagcuccagcagcuacuguuggacauaggauguggaagaggguugccuauugagaagagagugcuccagaaacccacgguugucacuucucagagcuuccuguagacucagcacagccaccugcaggucugcgagggacucaguguagcacccuguccugccggguauuuuggaggacguagucuggcacugggaacucaucucuggcuuuaguaucuuuagccuucuccagaaagaccuuuuaccaaaguuguuuccaugagcucaggcgaucuucuguggcugagcucgcccagcgcaagccucuuucuuccuagccggcugugcagaugucuguuugugcuguauggggccgcugccagcuggggaguggacuugcucugauaaggauagcaggcagcccgaacauuuaugugauccacaagcgaucuagguuuuuauaugaucaguucugcacuuuuuaaucccucucauauucuuuaaaaaaaaaucuuucuagaaauuaacuugaccauuuguaaaacuuaccaaagugacgaacuguaaaaacccaacugaucauugaaccuacagaaccuuaguuuacugaccauaagacaguccauguucaaauacuuuaaaaacaaaacuucugcuguuuaaaagacaggagccagucaaguaaagucaaacccugugggcuccucaguccuucccaccagucccuggugccugagaaugugggacagcaaauccugauccaugugacaugucugucuccucauuacaaauacaaguuaguggagaccaugugccccuuacgcuacuggggacgaaugccuacaucaucucuuagaagugggccggaguguggacgcucuggacccccucccucccuuuccucucuuccucccccucucgcccugagcaucucucauuuuuugugauauguaaaaauaggugguucuuccaggcccuuaagaucuuuaauuugcauuuuuguguuucacaaaguugaaguguccuauucuuuuacaucucuuuccacuuucuaucaccuggcauuuguuugcuguuuuccauuuccuggcuccaugguaccauuguuugccagggagccccacauguggcccgcugagcugucaaugcagauuuccuagacaccggugccagcuuagagcucgcccuucuuucuccuggcuucucucguuuacacauggacucggccucaccagcuccugaggauugggagaaaauagcucaguacagaaucaguuugguccucgugcagauguagugacauguugacagcuagacucggggaauugagcugucaccagguuaauucucagcuucaugaagaaagacuuagcccagcacuucaaagccugaaaaaaauuaaaccugccucuuaaucuaguguuccaaauuucagaagaaaagugggaaacccugggcucacguggguuaucucagcgccccaccaucacuugcaagaaagaugcgcugcucuucuccuggcucccccggugcgggcgaugacgaugacguguccuuugucuuaaauucauccucuucucagaggcggggaaaacaguaaacaaagcaucucauggaccugugcugacgcggaugcugucauucugucauagccgaagaguccgaaaaggugucccaccuaggcauaacucaaggggaaaaaucuuuuuuuaauguuuaaagaaaucuaccucaguugacaggauuccaccugcccuaggguuucuucagcucuucagucuuaccuguuaggugucacugggcagcgcucugcuugucugaccaagcaggcuggcgaggcacagccgagcagaagugucucaguguccuguaaugaccucuucuagcauguugcaguuuuauauuuguuaaguugauaagugauaugaauguauaggcaauuguguauguuuucaaaaaggacaaugaaaauuuaaaauguagcuuccacacuugugcauaauuccaaaguaucuuauuuuaucaguguuaaauagcuuuuguacagcuucagcccauuuuccagacgugugcuguuuuauacgggaaguaacucaugaucucacucacggagcuguguuuacacaucgcaaauuuuuaacuuaauguguuuuucagaauuaacuuuuuuggagggaggaaauuccccacuugcuaaaugauacuaaacuguugucuggacucuuaagaaucaggucuuuggauuuuauaaacuagucuguagcuuuuuagguucuucauugguuggauguacauagagaauauaaaacaacucucagauucuuuuaagcgucugaaguuuuccuuggaugcacacucggucggguauuauguucacgcagacuuucagcauuaaauugaaaagguccaccgcuucucuuaguuaaugugaaccguuuguuuuuauuguguuugguggagaagaauaauacacuucuugccuaaauccagaagcccccuuugaauguuaauuuuuuaaaauguuagaauuuggugaacaucuggaacauguauuugcauuauuuuuaaauuucaguguuuuaaaaagcagaccauucugggguguguuuuuauugaucuuucauuaagagaaauugauaggacugguuuugguuuuuguuuuuguuuuuuuuuuuuuuuuugguuuucugagacaggguuucucuguguagcccuggcuguccuggaacucacuuuguagaccaggcuggccucaaacucagaaaucccccugccucugccucccgagugcugggauuaaaggcgugcgccaccacaccuggugauaggacuguuuuuuuaagugagcuguguggauacaacugaguguguggaaacuuuuuccuaaaacaacauucauguauuauuucgauccauuuuucugugacauuuggugcaauaaacuuuuugaauuuaucuugcuuauucuccuagugcugcaugauuucuuuguugcauuuaaucaaauacagaaucuuucgaugacuuucaguaucugucggugcucuggaagugcagggagauuuugauuagcacccugcugagugagaccacuggccccagcacacuggugagcuuugggaccggagaugucaggagacacguccccgagcccauugcagugccuccgagccaguuugugugaccuuuaacugcccuaccugacauucgcuggcauaauaaaucucuuuuuaaugaucuaag

SEQ ID NO: 1464 - RNA, 25717 nt, Mus musculus
cagcggggcugcggaugaccgcuagcagaaggagaaggaaagaaagaugcgggaagagagagccgaggcuagcccucaacuccaagaaccgcaggcaggagcacccuagcugcaaucagcucucagccgcaacggcgacacucacgucuccgaucugcagcuccacuugcuccagcggguccacgguuggaccgggacuccugcucggaucccgccagcccaaacucacuggcaugcugagggacgacgaagaggcgccugacgacggagaugagggaggcggcggcggcggcgaagaagcccgaaacuccucagagucagccaugggagugagcuggggcuacuggaccggaucaagcaaccgaacccucaccaacugccuuucgaccgcucgcgcccaaagcccauaggcuccgccuccucccacacggagucccgccccaucuucucguuugucucugcccuggaccccaaguacgucucauuuuuuccagacagccaaucagauaucaagccaggcgucaccaggcuccugcgcacagcuccaggagcuaaacacuacaacucccagaaugccuagcaaaucagccucgcuaugcuucuagggcgcaugcgcacacgcgagagcuugucggccucuucugcacacuagguuccuggcugaggaugacugggagauggagucuucugccuuuuccuggcuuguaugugacccggaaaccuuacuggccuucguguccucuguggcgccggcgcaaagcagaagaggggcggguacgccgcgaagcaagggcggucggcagagcccagacgcugacagaagcugagcagucggggcuucuuggcaggugauggcgccccucguagccuagaaguccagcacccucggcaagccgcagacccacgccucucuccuuuguaucuggucaagucuccgggucacuuugaacauguuggugcgacuaaccaagcuguccugcccuggugagacgaaacuccugguggggacagaaggagcaagguggauaaguugggacaaaacaagacuggggccacacccgggguacugccagcaucucuuuccuugucuauugucuuaggcuaaacuagggcaaaggucaaugcugucagcgccugguggccgacccuaccuuaccgaccuuggaguugccccaguuggcagaauuaucaucuagguuaaaggucaugagaagagaaaauugucaacacugcccccucgguggaguucccccaaaugccgcuccuaaucuuuaccucaaggcucagguauuaucugccgccuuauuaggaaugggaaagaaagaaaaacuuguguggguuuucgccuuggcucugaccugacuuugcagccauaauagucuaaucuuaauugaagucugagcucucauaucguauuaacucauauauuaccaauuaugucuggagucggaauuuuuucugcauuauccagaguuaacaccaggcguuucuguuauggguguuucuuaaagcaguugcaggauaguuuuaaguuuuuacuuaaaaacaacccccucguucaaacagaaguuuagaggaucuugaauucuguuguaacuggcuuaauauaaaucuuuacugaaguuaauuuggcugugggauuuuuaaacaaguauuuguauacuuguuuaaacaauaugguguauauucaaaccaagcaucuauuauccacagaagaugguaugcuuugagagccaucaguuuacagucuaauuuagaugcagucuuggaucuagucagugacuuuucuuuaaacgcuaauuuguuacauuuucauuacucaguguuaccucuaguggugacaacuaaaugugcuaaguaugucguguauggcugauccgguguucagugacucugacuuugcuuucuacuggaacucugucuuuaugccuaaauguucagaugggucaugagagauaccaugcucguuuaagcaaaggaauaaacguuauaccuuuuuaaaauucucuggugggaaucagaggccacgguuccaacuguucucgagcaaauuaguagcuguacaaauaauagaaugaauuuucagaaguaaaugauaacuuguauaugguaaacuacaggguauaauaaauaccuuuuaaaugaugauaguauguuugaacucaaccaaauuugccuauaaguacuuauaaauaucuuucccccgugaauuaggguaaaaaaaaaaagauuuaaucuuggacuuaauaaaguauuucaauaucaucgacugauagauugauuuuuuuucaaggcagaguuccucugugugguccuggcugcccaggaacuggcucuguagaccaggcuggccucaaccucacagagcuccauccaccugccucugccugugcugggauuaaaggccugcaccacuacugcccagcaauauaauacuuuuuaaugugcaaaacaagcuagggaagauuuguuucccuaccucuuuaaaauuaucaaaagaaauguauaguauuuacaagacauuagacuucuacuccaaauguuuuuuuuuuccccacuucauucaaauuuauugucuugaugccagguaucacuugagaaacuauuuuguuaaaauauuuaaaaauauuaaccauguaauuggugguaaaaauaaaauuaguuuauauaagaauaauuuguuaaaaauauuucgucuucuuuuuuuuucuuuuguuuuucuuuuguuuugguuugguuugguuuuugguuuuuuugguuuuugagacaggguuucucuguguagcccuggcugaccuggaauucacucuguagaccagacuggccgcgaacucagaaauccgccugccccugccucccaagugcugggauuaaaggcaugcgccaccacacccggccuucuucuuucuauuuaauuaagaaaaaauuuaccauggccucagguuccaugauuucagagauaauuucagaucaauuacuguucucagaauuugacaaguauuagaagaaacuaucugaauuccuauuugucugauguaaauagggcuuaucguuauuucacaucucagaaaguuaugagggauauuuuguuuggaacagguucucauauagcacagguuggcuauaaucugauugucguguggcuggagauaaccuugaauuucugaucuccccacugugcauuaccacauggcuuaugauguacuggggauccaacuaggcaagcacucuaccaacugagccacaccccauccaagacauaguauuaaaauggaaaauucuuaaccauucauccuguccaggaaaguguaaauuauauagucaaaaugaaauuccuugucuuuacuacuuuuuacaguccauuuacaaaaguuuccucacuuguagaugcuuuauaagacauaguccaaguuagaaaagaccucacuauugugacggaaauuaaacaguuucacaggcuucuauguacauagccauugaaaucguuacuaggaagguucugauccuguuaagaagcacauaauuguuuuuguuuuugaaacggagucucaguguagcccuagcugggcuggaacucccuguguagucuagacuggccuuauugucacagagaucccccuggcucugccucuaaguacugggauuaaagacaucaccaugcccaucugaauagcuguagcucuuguauuucagucuucgaucugccuaucacuguauuuuuuauuuaacuuuuuauuuuguacuugcuuuaggcuuucagaugaguugcagagaaaauagaguucccauguguccuucucaaacuuaacaucauauauaaucauggugaauauggagacuaagaaacuaacauuggcuggacggugguggcgcacaccuuuuuuuuuuuuaaagauuuauuuauuauuuuauguaaauacacuguaguugucuucacacacuccagaagagggagucagaucucauuacggaugguugugagccaccaugugguugcugggauuugaacucuggaccuucggaagagcagucgggugcucuuacccacugagccaucucaccagcccagcacacaccuuuaaucccagcacuugggaggcagaggcaggcagauuucugaguuugaggccagccuggucuacagagugaguuccaggacagccaggacuacacagaaaaacccugucucaaaaaacaaaaacaaaaaacuaacauugaugaaauguuauuauacuacaaaacuauucagguucccauuuucugguucaggaucuaguccauguagcuuuuaguuagccuccaucuauuuucaugggacacuuccucugcuucuugucauuugugauuuugauauaagcauuuuauugaaugccucucagucuaaauuuacuuggugguuucucaugauuuccugauuagacugagguguaaggauuuugagggugugugccacaaagguaaugaaucuuucucauaucauaucaauagcaugugauaucacuguaaugcuggucauauuuaaaugguauuugauucaaauaccauuugauucacuuaauucaaauuauaacuauaauauuuuuacuguaaaguuaguuuuuuuucuuuuaauauuccacuuauuagaaacuagaaagguccaguccacacucaguagggaaagaaucaaaaaauaugugaauauauaaucacagucuuuaguauuauaaguuuuucuauaaaaaaaauugugauuaagcuugauauaguggugaacaccuuuaauuuuagccuuugggagacagaggcagaggcagguggauuucuguaguucaaacccagcuucaucuauuuaacaaguuccaagccagccugggcuauaugagaccaugucucaaacaauuaaaaaaaauggauugaguggaauucauuugacauaaagagcaauguauacauccuuugcucauuuuuuuuuugagaaagcaaaacaaaaguaacaacaacaaaaaaacauauuuuuuucuauuuuuaugccauuuaaugaguaacuaucccccugcaucuauuuuuauuauacuaucagccauucauuuuauuacacugucucucacuuguuuuaagauuguaaauuuuagaugaagaggugcauuaucgguuaagacugcucuuccagagguccugaguucaauuuccagcaaccacaugguggcucacaaccaucuauaaugggauucuaugcccucuccuugugugucugaaggcagcaacaguguauuuacauauauaaaauaaauaaaucuuaaauaaaacaacaacaaaaaaaaaaacaacaaaaaacacauuauggggcuggagagauggcucagcagucaagagcaccugaugcucuuccagaggauccagguucaauucccagcacccacaugucagcucacaacugucuguuacucuaaguauagggauccaacccccucacacagacuugugugcaggcaaaacaugaaugcauaaaauaaaaauaaaauaaaugauuuaaaagaguugaaauuuugcuucaugagcaaaaguuagcuguaucacucauaagaaaaauaauuuuccauuuugauuuguguuaauuauuaagaauauucauucagagcugggcagugguagcacuugccuuuaaucccagcacuuggaaggcagaggcagguggauuucugaguucgaggccagccugguuuacagauugaguuccaggacagccugggcuacacagagaaacucauucagcuuagagauuuuucagucuacaacagauggaaacuaauucuuaaaaagauacuuuucauuuuuaugcagcguaucacugguuucaugccuuaaaaauuaagaagugccuaccucugugugcuccaagauguucuucaaccucugcuguaccucagauuaccacucacuacacuguucauccccgggagaaagacaaaagaugggaagguaggcgacaauuuucauaaacucuugagacuuuccuagauacuuuauauuacccuguuggucuuaauauuuuguuuuucaugacaauuuaaaagcauccaguauaucacaguuuuaucaaguguguuacauauugcugcuuaaguaaaacuuuugugguuguucauuuguuucuuuuagaacaggacuucauguaauggccugaccuugaacuccugaauauaacaggaugaccuugaauuccugauucuccugcucuuacugcccaauuguugugauuauaaggguguaccaccaugccuucuaaauuuauaauaauggauaucaaagccaaaagucuguucauaggaaccaaaauaagauacauacugaaauagaaccuaagagaaccuaaaacucaucaauguauagacuuacuauaauuauuauccauagcccagagagaauaucuauaaauuauacucugaagcauagugagcacacgaaaguacaucuuaaaguauccuaaaccagcguaugacuuacauggucauaucaaucccacaacugaucuuuaacauguuuuccucccaggagugaauauggagagguuugcagaagaagcagauguggucauaguuggugccggcccagcaggacucucugcagcuauucggcuaaagcagcuggcugcugaacaggggaaggacauccgugugugucugguggagaaagcugcucagaucggagcacacacgcucucaggggcuugucuugauccagcugccuucaaagagcucuucccagacuggaaggagaaagggguagggcaagcugguucuuacacgaggucugcucugugcuguuucuacuuucacauuaguaaaguaaaggaaacccuugucauggaaaucucaauuguuagguauuaaauauauauacuuaaggguuuuuuuuaacuuaaaaggagccugaggcuuaagugguauaacaugugcagcaagaccuggguucaguuucuagcaccacacacaaaugaacaauagccaggaagcuaaauauauuuguaugcucuuuacuccuacaguggaggaagcagaggcagaagguugaaggacucaaggcagccuggcuacauagcaagacccaaucuaaaacaagaaguagcagaauuauaacuugacccccuugucaacuugacacacaaacacaucacuauuaaagccucacccuuacuuucuuacucauccccaagaucuaaauaacuuuaaaagucccacggucuuuacaaauuuuuuuuccaauuuuuauuagguauuuucuucauuuacauuucaaaugguaucccgaaaguccccuauaccaucccuccccugcuccccuacccaccgacucccacuucucggcccuguuguuccccuguacuggggcauauaaaguuugcaagaccacggggccucucuucccaaugauggccgacuagaaacuagagagaguauacacuagcagcuuaacagcacaccuaaaagcucuagaacaaaaggaaguacaaauucuuacauaguaaaauuucauucccuuuaaaauauccaaucucuuaaaauccaaagucuuuuuacaauuuagagucucuuaacugugggcuccacuaaaauacuuucuucuucaagagggaaaaauaucaggguacaagucacagucaaagcaaaaucaaacucuaacuuuccagugucugggauccacucaugaucuucugggcuccucccagggcuugggucacuucuucagcccugccuuuuguagcacacaccuugucuucuaggcuccaguugccugcacuucacugcugcugcuguucuugguggccaucucaugguacuggcaucuccaaaacacugcugucuuacacuguaacuacaguccaccaauagccucucauaggcucucuucauggugucaagccucaacuccuuugcaugaccccuucaguccugggccaucaguugcaauugaggcugcaccuucaccaauggccuucuauggccucucacagugcagagccucagcugcucugcaugaccccuucaugccuucaaaaccaguaccaccugggugacuuuuuaacacguuaccaaguccagccacagcacgagguacaaccuuggcuaucucuggaacacagcuucucugugcucucagaaaacacuugccagaagaugucaccucaaugaugcuggucucuucuuaaucaccgcuaauuucuuagcuccagcuaaccagcaucaguagucccaguaaugcaaaggcuucacucuagugguucuaguacuuguuaaucacagcugauucuucagccccagcuaaccagaacuacagaaucuucacaaucaaaacagcaauggcccugauaagagucuuuaaucuucccucuaaaauuucacaagccaggccuccaucaucugcacuguucucaacauuaucucccaagcuccuacagaacaucccacagagcucuuaacacccaauggcucuucuaguccaaaguuccaaaguccuuccacagugcuccccaaaacaugguuagguugucacaggaauaccccacuaugcugguaccaauuucugucuuaguuaggguuuuacugcugugaacagacaucauaaccaacacaagucuuuuaagggacaacauauauuuggggcuggcuuacagguucagagguucaguucauuaucaauaaggugggagcauggcagcaucuaggcaggcauggugcaggcagagcugagaguucuacaucuucaucugaaggcugcuaguggaaaacugacuuccaggcaguugggcuaagggucuuaaagcccacacccacaguaacacaccuacuccaacagggccacaccuaauaauagugccacucccugggccaaacacauaccaaccaucacacauaguaacucauauauuuuaauuuuuuaauaucacuuacuuauuuuucuguauaugaguacacugucgcuaucuucagacacacaccaaaagagugcaucagauccuacuauaggugguugugagccaccauguaguugcugggaauugaacucaggaccucuggaagagcagucagugcucuuaauugcugagucauaucuccagcucccccccccccccaaguuguuuauguauuuacuuauuuuauuaucuuauguauaugagaguuuuuccuacauauaugguugugcuccgcuuguauaccuggugccuuugaaggucagaagagggcccuaggaacuagaguuacagacaguuaagaaccaccauguggauucugagaaucaaacccaggucauauggaagagcaaccagugcuuuuaaccucugagccaucucuccaguccauaucuccuauuuuuauauaaugcuaccuauaagucacauuuauauacugaauuuaccuaauaaaauauaacacuuuguuguuuuaaaucuaugccuaguaaaguauuauguagacuuuucugggauaaugcaguaucaaaaaccaaagaggaaagucuaaccuucuuucauuuuaaaauuuauuuuagaucuuauuuucuauguaugaguguuugccuacaucaugacuaugccugauacccacagagcuuaggaagagggcauugcaucuccuuggaacuugaauuacagaugguugugggugcuaggaauugaaaucagaucuuccauaaaagcuagcacucuuaaccacugagccaauucucuggugccugaaaucaguuuucuaaagaaauaaugugguuuccucuaaucucagcagaaaaggcuacgaguacgacauacggaagacucaauguuaggucucauugcuuucaaaauuaacaugaaauugguuaaaaucuuacuuucaacuguuucucuuguaggaugaguuauauuuguccuauauccaaaauuagaauauuugugaauacccuuaauaaaggucaaauaaguauauaaauguuuacacucauuuuuuguggaauaaacuauaaucugaaaguuuccuuagugcacuccuucccaacacagcggucagcucuaaaugcaugcugcuagccuuuaucccuuuucuaagcuuuuuuucuuccaacaaggcagggaauuuuaauuuggagcagacaccuaggcccacagagacagggaaacaugauguacacaguucaaacauguuucaggaggcaucuggaaaagagcugaggguuagcuuuuaagauuuccaucuuaggaguggguaagaacacuaguuacuuuaccagaggaccacaguucacuucccagcacccauauggcggcugaaaacugucucuaacuccaaaguccucucuggccucugugggcaccaggcacauaaccgguacacagcuguacauacaggcaaacacccuuacacguguuuaagagaaaaagauuucuaucuguucccaacagacauaaaaacaauuuuaguuacaagguuuucaaaggaaggcugaaagaaaagugaaaaggaguggaguuccuuuucccuucucucuuuaaauuuaagaggguuuuaaaaaugcauauuuacccuacaaauacaacugaaacaucuuucuguucuccuuuguuccuaggcuccacuuaauacuccuguaacagaagacagguuugccauuuuaacagagaaacacagaauuccugugccaauucuuccagguagaguauggcagagucauaaaaucaugggcuugcacagccggaaggagcugcguuucagugaggaagaacuuuccucuucagaugagaaaacagaagcccaggaaugugaagggcuugcccagagauacagcucgcuaaggagaaagccagacuagaaugcaguucuuuugucuucuagucuaaaagagccuugaaagccagccaggaauuuuuaauuucaggcuuuaauauugauuuuacucuaauaaacuagaacuuucaccaaauaaugucauuaaagccaagaagauaauguguguuuuuaugcagcaguacacacugauuagauuuuuuuuaaaauuaacuauauuagauugucgaagugccauagcaauauaaugucagaucuuaaauuacauaaauaauugcaggucuuccgaugaacaaucauggcaauuacaucguacgccuaggacaucuggugagcuggaugggagaacaggcagaggcucuuggagucgaaguguauccuggguaugcugcugcugaggucuguauagaucuguuuuguuuguuuuaacauuuauaggaaacaaucucuuuuucuuacaaaagucaaccaauaaguuuacagagguaaauuguuuagaaaauucuugggaauuuagaauugcaggauuggggaaaauacuaaaaaugcuaauccaaagaggaacugaauuucuucuguugccccugucaugugagugagcaccauggggauaugaacucucuguguggacucauggucaucuuuucauguauucaguggaaaucaucugcugugugugcuuugcagaacaaggcugugcgcucuuccacgggcacuccucuuucucacucuuucccaccuuuacucaccagggcuuuguuucccaggcuaauagucucacuucuuucaaccaccaugcucuguaauuugauugcucucaauauuguugcccuccacugaacacauuccuuuccccuuuuaagaauaguaccaugaagaauaaacaaguucaagcuuuauguagauuauucuucauucuaaaaaugucuuuuguuaguucccacaaaacaauaguuuuuggcaaccauuucaaacuguugacccugagaaacuaaauuuaaaaauacaaaagaaucuucauaacuuguaaagaaauuguuugaaucaauuuaauagucaaugagcaauaaaucaaaaauaccacuauuuuaacaggcaaagaaagaaauauccuuuuaaauaaccaggcaccugggcaugaugauauaccuuuaaucccagcacuuaugaggcagagacaggcaaaucacuaugaauuugagaccagccuggucuacaugaggcuauccaggccuauauaaugagacccugacucugucacagaaaggacagggcuggaaggauugagcauguaaaagcucuggcugcuucuccagaggaucagguguaguucccagcgccuacaugccagcacacacacguguccaggagaucuaccacccucuucuggccucugaagccacagcaugcacauucaggcaaaacauaaaauauagacauaaaaaaaaaaaacauacacauaaaaaauuuugaagaaauuugacuagaagaaauaaugaaagaagagagagggauaagaagaaauucuuuuauccuugugucagagaaaauucaguuuuuuuauaaaccacagccaaguaaaagauauagguucuuguugcuaaaaauuucuguuucccacccauaccugugcauuuggguuuuuagaccucagugugagauuuugcauugcuucuuuguuaaacauucuugauaggacuccagucagacucucagguaggcaacuuauuaaguaccugguaucuccuuuuguguguauauacuaauugucacuaacacgguuucucuuuuaguugcuucuuuccugauuguuguuagguguagcaguaguuaguuacaccacuuuggcucccagagggucacacucccagcuacccacccaagagcucuuugaguucucaaaugaaagacacagacacagacacagacacagacacacacacacacacacacacacacacacacacacacacacacacacacacacaggggcaccaguuaauuuuuuaaaugcucaaaggcacggcacuccuaaaccaucuccugcuagcaaacgcuccccuccaguacugcugagacuccuaaaccuugcccuguuaccacagaccaaaucagggaggccaccuacccaaauccauacaugacugguugacuuucucuugcagcucuuacgucccauccuucucccacacccugaguccuggugauucucuccuccuccuucucucccaguuccuagcccucgaaaauccaaaggucccaccucagucuaccugcccagccauuggcuguuggcucuuuauugauugaucaaaaaccaauugggcacgcagauuccuaauuuucccagcauaauugaaagcauuagaaccaauccccaacaguuaucaggcuuuauugugugguuuagugcuccgagccagaccucaguuccuuuuguacccgcuucuccauugcuacuacccuugggucagucuccacccucuagccuucuuacagccucaugugauuccagagugcauuuuccucuagaggaaacaaaugagaaugucagaauaguacaauuucucaacuucaggauuaugcuuuuuacuucccccggccccuucuugcuucacaaauaaacuguaaucaucaucauuucaaauaugucaaaguuaauaugaaucugagauaauaauaaauuuacuuuuaucauuuuuagguccuuuaucaugaagaugguaguguaaaaggaaucgccacuaaugauguaggcauacaaaaggauggugcaccaaagguauaccuuuuaauaguuaugugcugaacaagagcuagcagggcacacugcccaucugcagucccaguacaugagaggcugaggcugagguucgagaccagccuaagcuaccuacauacaagauccuuucucaacaaaaagaaccaacucaagcucaauguuuaggucuuccuauaagccgcacaauaugugggcuuuagaauauaauuaagaauaguacuguuuuuuacaguugcuuaaaaaaaaaaaaaaaaaaaacggaggcaaguuugagcucaacacaaguauaacauguugagugcagucuaccuaugcuuaaauggaugaauguaacuaggcuggugagauggcguagcgguuaagagcaguggugccuuguucuuccagagguccugaguucaauucccagcugaucugaaacccucuucuggcaugcauguguacaugcagacagcacucacauuuaaaaauuacagcugggcgugauggcgcacgccuuugaucccagcacucaggaggcagagauaagauguaacuagguucucuaugguaucuaauucauauuuucuuuucaugacucauaaguaagaggacggccuuugcuucugauggaaaaagcaaagucaggaauguacggagauggaaauguagauucuacuuauaauagacagucccgauaguuuccuuccaguacauaggucuaccaugucuuguguaccuaaauuauuguuuaguuuaucaaauauuguuguuuuuuaacauguuuuugcucuucagacaacauuugagagaggacuggaacugcaugccaaagucacagucuuugcagaggguugccauggacaccuagccaagcagcuuuauaagaaauuugaucugagggccagcugugaugcacagacuuacggaauugguuugaaggagguauccugguuugcuuguacaauuuuaaucuuaaaugaugggauuuaauuuguacuaucauguaguuuauaaugcugauuuaauuuuacacuucauuuuuuuuucauuaaucuaagcuguuccuuauaacuaaaacuaaacaggucaaaugauugccaaaauuacaucuacaguaacuuguaaacuugaaaauauuugaaccuuaauauuuuucauaaccugcccuucuauggcugucucauguguugcuuuuagaauggccacaucuuaaaaagaauuauuuauucaaaauuaugugaaaauauuucaggaaauagacacuguauauugaucuaaaauuuaguaaaguuaaauguauauuuucuuaauuuauucuauacucuauuaacccuuuaaacuuuguuugcagugcuagggauuaaacucaggaccuugaauauguuaggcaaacauucuacuugagcuacaucccaagcuaauuuaagcauuuuaagaaaucuuccugccuaccauuuuaagaaaucuuugcacuaccaugaccagcauauguauguauguauguauguauguaugcaugcauauauguauguauguauguauguauguauguauguauguauguauuuuaaagggcuugggaugucauagagugcugccuaaaauguaugagggucugauuucaaucuccagcauugcaaaaauaaauaaauaaauaaacaauucaauauuuugugaauaaaagcuugcauugugggggggaggguaugggggacuuuugggauagcauuggaaauguaaugaagaaaauaccuaauaaaaauauuaaaaaaaaaaaaaaagcuugcagugaacaacgaucccauugugagauggcugaaguaagagagguaaacugacagaucugaauugugcuacuccauugauuuccccaugccugcaacagugagcgcgcuuacguagccaguacuacagaaaauuuucaauaauuuuuuuuuuguacucccacaaaagaaguucuucauuugaagugcuaauggguucauaacuuuugugacccacuucuuuauguugguuuaacaggcaaucauuugauuauaauacuuuuuaguguacaaaauaauuuuugugcgcuuucaugugcgcuuucauguaauuaauauuacacaguauuacauguuacauaauauuaauauaauuaauacuguaagaccucauggacuuuguuuuuugguuuuaguuauggauuauugaugaaaagaaguggaaaccuggaagaguagaucacacuguugguuggcccuuggacagacauacuuauggaggcucuuuccuuuaccacuuaaaugaaggugaaccucuaguagcuguuggcuuugugguaaguuaucucccguugcaaaagauuuuacuagagguagagagugaucagugugaaaaauaggguuuuuuuaaccuggagaauacuuuuccauuagaaagcugacauuugcacuuaucaguguguaaaaucucuauggcuacuguagauauucaccaacuuacuuagcuguaauacuacuacuccauugauuacauucuaggcacuguucuagaagauuugcggagauuggucagucaauuuuguagccauccagugcuaugaagcauguccuuauugugagcaaauuaaaauaagucuaaccaaaugccacaguaacuccuugucuuaguuacuguucuguugcugugaaaagacaccaugaccaaagcaacucuuauauaagaaagcacuuaaauggggggcuuccuuacagugcaugaucaccaauggugcuagagcaguagcugagagcuuugcacccuagucugaagccagagagacuaggccuguucuaaucccuuaacaucacuaaacccaucuccaguugcaacccucuuccaacaaggccacaccuccuaguccuucccaaacaguucaaccuaacugggaacaaagccuucaaauauaugaaccuuagggggccauucucuuucaaacuaccauaauguuggaggcaggauucaugccugaugcugacuuuagagcccacuuccacuaugccacgcuacuacuaaaaauaaaauuggcccacagucugaaccuacuauuucaaaacaaacaaauaaacaaacaaacaaaaaaaaaccaauuaccucuuccauugcuauagcaauaaauuaauaucuuaaacauuuugaacaaugcagacuaucaaguuucuacaucucauagcugacagcaaugucaagguguagugucaugauccuuuuacaugcuacauuauuaaauuuaugcacucaguacauaauuuaacaccaucagucagguuuuacugugucacccugugguaguuacccuagugacucagucguaugaaaagcaaaaagguguagcuauuaauuucagcacugauacugcuauaaaagcuguacuuccucccacuguuuuucugaauacaauuuacaucacuuaaauucugcccuaguaguacuguaauuuagauuagucuuuuuguuguuucuuuguuguuuuuuuaaaacuggguucuguguagccuuggcuauccuggaacucucuguagaccaggcugacuuucaacugagauccaccugccucugccucccaaguccuaggauuaaaggugugcgccaccacugcccagccuggauuauuaucuuacuaguagaguugguaucaauaaauaaguaauguaaucacaacuccauuuauggauauuuguuuacaaauagguuugagaaucuuuuuuuuucuuaauuuggacuuugauuuccaaagcacaaugguuucuuggugucuucuuaauuuuuaaaguuuucguaguuauaaaugccuauuacccuuuugcuuacuuucuuacccucaguguagaguuuaucucugcuuuaaucuugguuuugguuuaagguuggccucgacuaucagaauccguaccugaguccauuccgagaguuccagagguggaagcaucaucccagcauccagccaacccuggaaggcgggaagaggauagccuacggagcccgagcgcucaaugaaggcggcuugcagguagcucccagcacccacucucaauugcuauuuuguaacuuaaauaaccaauuaagaacauaauuuuuauuucauaggacaaaaauuuaaggagucuaacaaaauacuuauacaauuaugcacaacguaguaauuacaguauaccaugaauuuaguuucaagacuauauugaaggcaggagagauagccuggugguuaagagaacuuguucuugcagaggacucagcauccacaagacagcucacaauguucacaacuccaggucagggcaucugacacuugcuucugaccuccucagacaccaggcccacacaugguacacagcuacacagcaaaacacucauacacauaaaagggaaacaaaaaaccaauauauugaucuaauuaggugugaggugcaugccuuuaaccucagcacuugguuggcugaggcagguggauuuccuaaguuugaagccagacaagaauucauaagugagacccugucuccaaaauacauauguauauuucuagagguacauucaugggccuuuuguuuacuuuuuuacuagaaaacaaaaaaugucauucacacuauuuccuuuuauuccuuuacuuacaccaggaaacugaaaaggaaauguaucuuucaaaaaugauuuaucccaacugaguuuuucauguagccugguaggauuguacuaguuauucuguuaguauacacucaaauauuuuaagaugacuaauuuuuuugaguaauguuaaaugaugaaauaagaacuaaauggccaucuaaaagcuauuaguacuguuaugaaaaauaucaguuagacagguaagguaaucugagaagagcucuaaacauuagaucgaugaccuggaagaagauggcuucucugcuuucaggaucauauuuaaaacaugaucacuucugccucuaauagucuagauuaucaaacuauuuugaaauugguguuugguuuucuuuaaucuauuagaaaaguaacguggagggugcuuuaaaauacagcuuugaagacacugguacuauaacaauaauucauaaaguuaagggaagucaauccgguauuauuauaaacaaggucauucagaugugugcagguacacacguguacaugcaugaggucagaggacugcuaaugggagugaguuugcuccauccacuguggauucugaggcuugagcucgagucaccgaguccaacagcaagcuuugcccaccgagcuaccucagcagcccaggcaugaucuuuuccugacuccuccugcacucagguuuugcuucuugcucuagaauucuaccauuggugggaacuguggccacuccaucacccucucaucaaaggccugucuauggcugaaucuagaaagccccuagagaagaaaaacugagaaugaacaaagaccaacccuggaguaugugcccccugcaguccuuacuucugucccugcuccuuagacaauauacauaccuuuguuggcuaacuggagugcugauaccuuuauuacauugguuguuuuaucagaaauucaaaguucaguuugcuuagaguagcaccuagacaucuuaaugucacuggaguauguucuucaccgcugcauaucagacuaaaauaaagauaugggaucauuucccaaaauaauguaaaagaaguuauaauuuucacccaaacuuaggaaaugugucaacucugacagauacacauaaauaaaagcauguuauuuuaaauauauuguuuugauaaaucugucccauagaggucaggcaugggauaggggaaaaaaaaaagagaacuggccaaaguccuaagccuacaugucccgcugcacccuucccuugccacacuccuguauuuguccuuugcccuacagcuuuagguuuggcguauuuguuuguuuugccucauuugagcugacaaauguauuauucugaaucucuuuucaguccauaccaaaacucacuuuuccugguggcuuacuaauugguuguaguccugguuucaugaauguccccaagaucaaagguacccacacggcaaugaaaaguggaaguuuggcagcagaaucaauuuuuaagcaacuaacuagugaaaaucuccagucaaagacaacaggugagaaacuccuauaugaaagaauuacuaacagucagaaaucuuuucuaaagauuuauuagcugucuucaugcacaccagaagaggucauugggucccauuacagaugguugugagccaccaugugguugcugggaauugaacucaggaccuuuggaagagcagucagugcucuuaaccgcugagccgucucuccagccccagccaccuauuaccauaguaaaguaagaggccaucuaacugggcaugguggcauacacugugaaucaaaggagagaugggcagauuccuaugaguuccaugccaguccagacuauacaaugagacccuaucucuaaaucaauuaguuauaaaaugaucccuagcaaguuucuuauucugaaacccaguuuucucuugaauuucauuuuucuuuauuuauaguauguuacauauuuauaauuuguuauguauacuuuugaauuauuugccuauauauuauauauaaaaaaguaugcauaguauauauuuacauauuauauacuauauauuacuauguaugaauauuaaccauauuuuacuauuaguuuauuauuguuguacuauuaauauuugcuacuauuuauuuuuacuauuauuauuguuuuuacuaucauuauaguacauguaauauguauguuaggcaugcauaaaccauagugcgcauuuaaaggucagaaaacuuucaaaaaaguuuuuaacugucauuguuuacuuguguauguaggucuaugcacaugagugcagguuccugcagaguccgcccuggagcugggaauuagaggccguuuugagccacguaauauggcugggaaucaggcucaggccuucuggacgaauauuaaauguuccuaacugcgcaugucaucucuaguucaguaucagacuuggaaaucaguucuuauacguucauacauuuaugcgggguguucugcuuacuuggcaagugcuuuuacuguucucaaaagcuugcaagaggggcuggagaggugguucagcgguuaagagcucugacugcucuuccagagguccugaguucaauucccagcaaccacaugguggcucacagccaucuguaaugggaucugaugcccucuucuggcaugcagguguacauagagcauauauauauauauauucaaauagaccuuuaaaaaaaaaaaagcuugcaagaaacacuguaaucacauaaaguguugccaauggaaccucagcgcuaugguugccaggguagggauuauuugguugguugguugguuuuaggggguuuuguuuuguuuguuuguuuguuuguuuguuuucccuugccaguacuggggauugaaccuaggauucuaccauuaagccauacccucagcgguugacuucauuuccacaguccugcagugcagccacugggcuacaguuccugaacaugccgugcaugcucucccucaugcucuuugccucuguucagacagcacucucagguagccucucuaaaccacaccaauuggaaugcacacggcccacuuugaacuguuuauuaccaugugccaucacgugacacacuauagauuuggcuuaauuuaucuacugucucuuggcaccuggacaaaaauuccagcaaagacuuguucauuuucaguuuuaaacauuuugaauauaaaccuaguccuuagaauuacagauaacuaauguucuuauacgaagaauuagcagggcuagagagauggcucagcgguuaagagcauugacugcuuugcuagagguccugaguucaauucccagcaaccacauaguggcucacagccaucuguaaugggaucagaugcccucuucuggugugucugaagacagugacagugugcucacauauauacaauaauaauuaaaaaaagaaauaucuugcagcuuggggacuugugguaugguucaaugguuaaaagacugccucgcaugaacaagacucuggguuugauuggucccaagcacugaaaaaccaguaagugcagcuugguuaggccuucagguaucuuaaggaugaagcacagaggcuuguuuaagaggaaaaaaaccgggcuggugagauggcucaguggguaagagcacccgacugcucuuccaaagguccagaguucaaaucccagcaaccacaugguggcucacaaccaucuacaacaagaucugacucccucuucuggagugucugaagacagcuacaguguacuuacauguaauaaauaaaucuuuaaaaaaaaaaaaaaaaagaggaaaaaaaccaguaaaagaugcuccagacaaggcaggauagacaagaugaaaugcaagagguaguucucuuuuucaugaaaugaauguucucuucauuuuccaucaaguacuguuccuuauggaaccauagccauauuguagcuguacuauguauacauaguaccagauaacccuggaauuaagugguauaaaaaggaauaaaaucccuugaaauuuuuaacagaaaaccauuaacuaaagaguauaaucacuuuguaguuugugcaagucaguuaagacucagcuguuucccuuaaagaguaaacgcaccauacuagacguagcccuugcccaguguucaucaagcccuagaucuaaucccuaacauaugcacuccaccccccaaaagacggauugcuuaguugcacucuuaacaaacuacauaacuuuaaacaaguuuuuucuuuacaaguucugcagcaggagguucaaaaucaaggagcgugcucucagaaauuccucuuuucccauacccaucucagcuugauuuaugcauucuuuccuccauucugucucuuuuuuuuaaauuuuuauuauguauuuuucucauuuacauucccaaugcuaucccaaaagucucccauacccucccccccacuccccuacccacccauucccacuuuuuggcccuggcguuccccuguacuggggcauauaaaguuugcaaguccaaugggccucucuuuccagugauggccgacuaggccaucuuuugauacauaugcagcuagaguccagagcuccgggguacugguuaguucauaauguuguuccaccuauaggguugcagaucucuuuagcuccuugaauacuuucucuagcuccuccauugggggcccugugauccauccaauagcugacugugaguauuauucacuuauguguuugcuaggccccggccuacucucacaagagacagcuauaucaggguucuuucagcaaacgcuugcuaguguaugcaauggugucaucauuuggaggcuaauuaugggauggaccccuggauauggcagucucuagaugguccauccuuuugucucagcuccaaacuuugucauucugucucuuguaaaguggacaugucuaauagauuagggaccuauucuacaagaccccaauuaugucuguaaccuuccuaucauagucagguucaagggguaaguccauugggaccucaaaagacaauucuugcagggacacaauucuacucacaauaaaagcuuagugauagcuuugacucuuuuuuuuuuuuuuuuuuuuuugguuuuuugagacagaguuucucuguauagcccuggcuguccuggaacucacuuuguagaccaggcuggccucgaacucagaaauccaccugccucugccucccgagugcugggauuaaaguugugcgccgccacacccggccacuuugacucuuuuuaaagcacguuuauaaauaagccuaaacuugauuagguuuccuuuucaaaccaguuuuuuaaugcuuccaguauaaaacuuaagguguucuugccuacugugcauaaagccccagugccagcacacacacacacacacacacacacacucguuaaaagauggcauuuaugugauucugcgucuguccacaugaccauguuuuuaaaacuaagccucaccaucuaugucucacuuaauacuucuuauuuucauaaaaggacuccauguaacugaauaugaggacaauuugaagcaauccuggguauggaaagagcuacacgcuguucgaaauauaaggccaucuugccacgggauacugggaguauauggagggaugauuuacacugggauauuuuacuggauauugagaggaauggagccauggacucuaaaacauaaagguaauucagauauacuuaaugcuaauauagaucuuaaguaacugcauauagaaaaaauguaugugugggauacacuuauucauagaguauaaccuuguuauagucuuuuuucccccuuuuugguaguguuaggaaccucaggcuacauggcugcucacuagcaaacacucauuaaguuaaucuccacccucuuaacauuuuaaacuugcuugucagagacaugauaaauaugguucuguuuggguauugggggcuugggggggagggauacuuugagacacaccaggcaugaagagguaaauacaagacaguuaauuucaaggccagucuggacugcauaacaagacugucugauugaaggacugagaaugaagugcagugguaaaaaagacuauuagcaugaguggccugaaucaccaauacaaaacaaacaaacaaaaaccaaaggugaguccuggauaauuauguuacuuuauuaaauaucucccccaaaauugcuuaaggcucagacucugaucagcucaaaccagccaaggauuguacacccauugaguauccgaaaccugauggacagaucaguuuugaccucuuauccucuguggcuuugagugguacuaaucaugaacaugaccagccagcacauuuaaccuuaaaggaugacagcauaccuguuaauagaaaccugucaauauacgaugggccugagcagcgauucugcccugcaggugaguaacgcacacacacgcgcacacacacacacacacacacacacacacacacacgcgcgcgcacacaccccacgcccaugcucagcacucuuaggaaacuuuucuugaauguccugauaguagggauuuuacugaggucuucucuacuuuggaugacuuaucuccaaacugcuuucaugucuacccucagacaaacggacuauagaaaacaaauaccuguuuuggggucuuuuuaaaagcuguucugaaaugaugguguauguguacauguauaaacauuaugaccacacugaguucaaugacugacacuaaacaaauucaucgcaaguacugaaccccuuaagugcuaagaguuuucagucaaaauuaaugagaucugaauaugguagaauaaacaguacucagguauaugaaaauuacuguuugcucaagugagauuagaagguaaauaagauccuaucuuaacuuuuaaaaguuauagugcacuguuaacugucagaagcgaggacuggagccaaucuguuuuaacuuguuaaauaacccagagaauacugcuguacuucuuuugugugauuaguuuauauuaauagcacaacauacaccaagaucagauagucucugggaguaaacaugaaaaccccaaaaguuuccauaguucuaagauuuuaauuuccucucacuuuuucauuauuugccuuuuguugcauaccuaaauacauauauauuuuuuuuacaggaguuuaugaauuuguuccuuuggaacaaggugauggauuucgauuacagauaaaugcucagaacugugugcacuguaaaacaugugauaucaaagacccaagucaaaauauuaacuggguggucccagaaggaggaggagggccugcuuacaauggcauguaagacacuaggccuucauucacuggcacaccugacagccaguuuccauaaaacuguaaauguaugccaaacuaacuuccuguauguuuagauaacuucugaacaaguguccuucaaacauuauugaaguaaaaaacuuuguaucuaaaguugccccauaaaaucaugaaguauuugucauaaauaaaacuuuauaaauaaacgagagcauuuauuuauu

SEQ ID NO: 1465 - RNA, 2127 nt, Mus musculus
uaacauauacauaaugaaacuuuauucagccaccgagcagggggaaaaaaagacauuuucaggaagauucauguaacuggagauuucaauguuaaaaaauaggaugcaaaauaaacacaaaaaucaguaguguuucuauguacacaugaugaacuuacuucaaaugagguuucuuacagauauauaggaaggcuacugaauauuuugucaauauguaaagucuuuucuuucaaugaaugucuaggcuguucccuuuuuccugauuuuuggugaacauuacaauaaguauggauauacaaguaucucuggguuauguuaacacugaguacuuuggguguaugcccaugaguugacuggcuaggucacaugguguauagauuauauuuugaguaacauuauagggaaaauguugagguccgugaacuuucuaauggaaucuuuagggucuuuuaaauguagcucugaguugucuacaauagggauauauuaacuucuccaucauauuuauggccauuuuuuauuucuuuuuguuuuuuauuucaagcuaccacuuugaaagauauacugaauaagaauuauguaagugggcacuuguaggaggcacugcauagaaacaggaacauaggcacaggacaaaguguuugaggaaccagacguauuaaacaugcgagccuauuucuucaaaggaagaaaauaacugacaccgguugccuaggaagcugggauggguguuguccgacaaccuagugauccuuuugcugggcuguggagcaggccuuccugaauccucccaccccugccaaaccuugagcauugcggaggcccuaauccugagucugucucucagugaguagaacccaacuuacaaaggaggcucaaaguccuuuguauccuccaucaguaaucgaucauuauuacaaauccuuccuccuuaggccugagcacuguuuaucagccaauccaauccauucuuauuguaaagaucauacaugcuuugcuacuucuauagggacuuucaucgugauaacugucacauggaaaccuuccccuaaaguuuuacggugcuuaaauguguaagaaaaauaaacuccaaggucagguucuggaaauuuagggccagcaccugcaaaauuggugcugauuugaguuucauucuucaccucauguggaugguuuaccugcuggccaugaugcugcccaggucuccaucaggcucucuuaucucauucccuguguuagaggugaugccauuucccauuuaguucaguuacuuacagcuuuguuuuauaugaccuuuauuaggcuaguuuuggcuccuucaauucuuaguuuccacggggcuuuuauuaugaagguugucaaauuuuuucaaagguguuuuguguguguguguguguguguugaaauaaucacaugauaucuauccuauguauuauauuagauuuauuuauuuguguaauggauuaacaaaguuaccuaccuggauaaaacaaacuuagucauggugugcaaucuucccaaucuguaaucugucccugacuuugauucauugauguuuauugagaaccauuacaucuaugaucaaagaauugaucuauaguuuuguucuuuuauuguuuuuuuuuuucccuaagguuuugaucagggcuguguuggguuuguagaguguguuugcucguguuccuuggauuuucaucugaggaacagugugaguagcacuaguguuagcuuuucuuaaaguuuuguuugcagguuguggauauaaguuguuuauaucuucuugauuuaauuuuguuagguuacaugugucuuguaacccuuuuaaacaaucaauugaaacaugaaggcuuauuucugaauuggauuucauugaucuaaaugccaucaguccugcuucucuggcuuaccccuuugcaauauucuaccuaccguccuguucuguuuccucaugauaacacuaacuuagagcgaagccacuggagaacucaguauggagugacagaacaaaugcugguucuggguuuauaacaaagcuugccucccuccuguguguguguguguguguguguguguguguguguguaugggcaugaguaauacauguguguggcagucagaggcuggcag

SEQ ID NO: 1466 - RNA, 61891 nt, Mus musculus
cuucucaucucccuacaccccacucuuaucucacgcuuccguuucucuacucauuuccagugacccccuucuuagcuuugucuaccuuuccuggccguuuuacccccaucgagaacuggugggagacaagaguuagucugcaaacagcccagauguaagguaaguugcaggcccuggacucuggcguccaguuuccccuucccaacuccguggggucaggcaggggucagugggcacuccucauuuuucuaagguauuuauuuggcaacagggucuccgccaacuccagcaaaacacuucagaucacuucagcuucccaaggcugccauuucugugucgcuuagcaaaugagacacuagggggcucccaggggcugaaaggagcagaaaguuguuugaaugaaaacugggucugagcuguguuuggagaaauucaaaauuaaauuuuauuuuuuauuuuuuuagucaucuuuaaaaagaaccucacgugucugaaaacggcgcagcagccaguuuacaaaucauuuugcuccgcuguuagaaggcggcagcuuuuaaggcugagccgagauguuugaaagguggaacacccuuggccaugaaauauguucuccuuacgugccucagccuuucaaaguucugugcauuagagucaggaauuccauucuuccuggagcuaagcguggggccagcuguguaaguaaaguuuuguuuuucuucuuaaacaacuuuuucccucuauuuaaaaaugugaagaaaaaggcaaaaaaaacaacaacaaaaaaaaaaacaacaaaaaaaaacccaccaaaaaaccuagauauucuuuucuuucauuuuugcucucuuuaguggaaagaaaaggaauaaaaaguugugugugugugugugugugugugugugugugugugugagagagagagagagagagagagagagagagagagagagagagagaacucacccuuuucaagcuauauaaacaucaagggguaguuaaauaacaauuuuagauauggaauauauugugaaaacaauguggaacauuaguuaagagaauauguuuaaauaugaacucacuacuugauauuuuuguaauauauaucuuacaaaaguuagggugucuauaaaaaucuuaaaaaguauuuauuucuuuucuuauuucugaaucacaaaaagggggucugcaggggauccugguugaugacuuuuaagaguuuugcuucucagauguaguggcuuuaacugugagcuagcaaacgcucuuugcagcuugucuucauuacuuuaaaguaaaaucagacucacacaccuaucuugcuuccgcauuuuaaacuuuacaccaaacuugguagaauuuguggaaggaaaggguuacucgccucuuuccucuuguagaggaacugaaauggguugaguuagugauucagucaacucuuguuuccauucauucccagagucagcccuccuuucuccugggaaaggcugauaggaguuuaaaaggcuugcgguggccaguucacaaagcguucccagaacccgcagcagcgacccuucucuuuuaccucucugccuguuggagaccacuuagauagcgaagcggacuggacggcuggauucaggaagccaugaaucaugucacccggagccagcugcagacuuuaaacucaguucagcauguggaagcggcagagaaaugaccuguccagacaagccggggcagcucguaaacugguuugucugcucucugugcgccccacgaguguguaaacuuuggaguagucggcgucccaggaccagacggaaccuccugcugggcacugccugugccaucuaccugggcuuucuggugagccaggugggcagagguuccuuucagcaugggcaggcgacugacaggggaccacccaacggucacgacaucuucaagguacccuucucugagauuccccuggaugguacccuggccccuccagaguugcagggcaauggaagcacuuugcagcccaacgugguguacauuacucuacgcuccaagcgcagcaagccugcgaauauccguggcacggugaaacccaagcgcaggaagaaguaugcgguggcaucugcagccccugaucaggaggugcugguuagaccaucccuuauacagcaggaagcugcacgggcagcagaugcugaaguaccuggcuauguucaggguuaccuaaccaagguuggugaacgacccuggagggugcugcgugguccuggagucagaacuagagguucaaacuugcagcagccuagggcccgagagagcaacauuaggauuuauagcgagagcgcccccucauggcugagcaaagaagacauccgcagaaugcgccuccuggcugauagugagguggcuagcauccuaccuaucucuaagagugguacccgcuugcugguguuggaagggagcaccucaggcucugugccuggcugcgggccuagccccugugggcuucucaagcagccgcuggacaugagugaaguguucgccuuccaccuggacaggauccugggucucaacaggacccugccaucugugagcaggaaauuagaguucauccaagguaacagauucacuugcuucuuauuugcagcugcuggggauuugggaucguuuucuccuuucccccacucucucugaauuauuuuccccacccauguuucccauuuggacagcagcagcagcaguagcgucauuuuuccauacgcguggcauucuucuauuucccagucuggggauauuagaguucuaaugcacagcugugcugggcaugugagggaaagcccacacugcaaucuuugcucuccguuucucucugugcacuuuuucguggcauguuaaaucuaauuaaaacuagugacaguuugcacgaugacaggaagccaggguacagagcuugcugacagccuugcauagaaccuuacagguuucuauggaaacuuccuuccuaggaugguuuaaagaguaagggguugggggguggggcauagaaaugaugucucagugguuaagagcacucagugcuuuugcaaaucacacacacacacacacacagacacagacacacacacacauacacacacaggguguuucacaaccgccuguaauucauggguauccaacacugucuucugaccucuguuggcaucaggcaugagugugguacacauccacauaugaagacaaacacuucuaugcauaaaauaaagauuaaauauucuaaaaauuaagaggaaagugguuaucuuuccucagcaaauagucuuugucagaggcucagacagaacugaccacaugagagcuaacucuuuuaccucgacugucaccaauggacucagccucuuuaauaaauaaagagcauaaaaaucauaggugcauuuagaguguagacuaacuagccaugugacuucuucaagcuucacuauuuacagagccccauguguccuccuguaacacaaagguugugucuagggcauguggccacuaacugaaguacagcuuugcagugcuggucuauggaaaugaucuugccacacagaggauacucucugaaugagaaugccaugucgggguuggaaucugaaguacacucagucagugacuuguguugcaauguagaaccacccaggcugaaauguuagagcaucucucuucagcugugcaauggcaauacuguccaccucaugaaguugcugguagcuuacacauagacagcaguucuuggcaccaaccaaaccuucaauaagcgcuggcuauugcuguuauuccacugagugagccaaguaccaaguucccugaguugcuuugggccaucaacccucaaaggucauuuucucuuaugaacaaacuagcaauagaacucuucuaguuugacugugccuauuuugugccagaauuccucuuggacauuugauucuguucccuggguuucuagaauaucaaaaccccuaaaauucaguuugaagaagucucuggcaugguccucgcuccagccauauccaaguggcgguugaaauaaaugaauagagucacagccgcggcucagugugaugaguucaagaguaggauuuuguaucagauggcuucagugguuguucuugcuucaauaucucuucccuucaguguuuuagagucaugaagucaggucagcuuccucaggagcauauguauggacucacgugugcaucauuucauacagguguuuuguuacagugagguaggugacaagaacaggccaguuccagcaugcaacgaacauucucagguuuccccuuccuauguugcuuuuuuucuccugauuucuguugggugugaauuucccugucgggaccaccuauucugguaacucaguuuuacgugagcagugucugagcucugaaagagauccagcucauucuauauaauccuauuguguuaucucucccuucccacugucucugugucugggaggcagcaauguuucuuguauuuuuuauuguguucgagcccacuggaguguauagcauaccguagacacucauggaaugaacacauugaaugaaugcagggguuccuucuugccuuguuucuuugaugcuugacggcaaauccguaccugccuccaguuucuaaugcuagggacuaauaaaaauuaguauuuuuauccuaaauccaggcugggauucaucuggaaggacuucacaaaaaguuuacuguggaggcuaaugacaaauguuccugguagccuuguuacagcacaaauaauuaggcuuguagauguauuaugcugaggacgaucagcauggcauguugauaucaggcuagcaugauuuaaugauggguuuucuauaggcagaacaauaugauuuguuuaagggguaugguuuggucuagaaaucuuuuuauauggaggagagagcagguaguuagcacaucuuguaugcauguagugugucuuaagggcuguaucuauucuuugacuuuuacuuguauuuaugaaaauacauuuaugucucgagcaaggaagauaguuuguaugaggugcagaguuaagcauuuggguuaucucccugacuauccaagacucuuacacaguuggcauuaaaaaaaaaaagacaaaacaccuuaaugugagaugaaagacacgucuguuuagagucauaauaggagaaugaauucuugagaccauaaggaauaaagacucuauuuucucugguuuucuuucuuucuuuuuuuuauuagauauuuucuuuauuuacauuuaaaaugcuauccugaaaguucccuauacccucuccccgcccugcuccccuacucauucacuccugcuucuuggcccuggcauuccccugaacuggggcauauaaaguuugcaagaccaaggggccucucuucccagugauggcugacuaggccaucuucugcuacauaugcagcuagagacacgagcucugggggggggguacugguuaguucauauuguuguuucaccuauaggguugcagacccuucagcuccugggugcuuucucuagcuucuccauugggggcccuguguuucaucuuauagaugacugugagcauccacuucuguauuuuccaggcacuggcauacccucacaggagacagcuauaccagggucccuucaucaaaaucuuucuggcauaugcaauagugucuggguuugguggcugauuaugggauggauccccaggugggguagucucuggauaguccaucccuuugucuuagugccaaacuuugucucuguaacuccuuucauagguauuuuguucccuauucuaaggaggaaugaaguauccacccauuggucuucccucuucuugauuuucuuguguuuugcaaauuguaucuuggguguucuauguuucugggcuaauauccacuuaucagugagugcauaucuaaugacuucuuuugugauuggguuaccucacuaagaaucauauccuccagauacauccauuuguccaagaauuucauaaauucaucauuuuaaauagcugaguaguacuccauuguguaaauguaucacauuuucuguauccauucuucuguugagggacaucuggguucuuuccagcuucuggcuauuauaaauaaggcugcuaugaacauaguggagcauguguucuuauuaccaguuggaacuucuucuggguauaugcccaggagagguauugcuggaauuauguccaauuuucugaggaaccuccagacugacuuccagagugguuguacaaacuugcaaucccaccagcaguggaggaguguuccucuuucuccacauccucgccagcaucugcugucaacugaauuuuugaucuuagucauucugacuggcgugagguggaaucucaagguuguccuuuacugcuuuuaauauucuaucuuuauuuagugcauuuguucugauuauuaugugucaggaggaauuucuuuucugguccagucuauuuggaguucuguaggcuucuuguauguucaugggcaucucuuucuuuagguuugggaaguuuucuucuauaauuuuguugaagauauuugcuagcccuuuaaguugaaaaucuucauucucaucuaccccuauuauuuguagguuuggucuccucauuguguccuggauuuccuggaugauuugaguuaggaucuuuuuaaauuuugcauuuucuuugauuguugugcccauguucuguauggaaucuucugcaccugagauucucuguuccaucucuugcauucuguugcugaugcucgcaucuaugguuccugauuucuuuccuaggguuucuaucuccagaguugucucccuuuggguuuucuuuauuguuucuacuucccuuuuuaggucuuggauggucuuguucaauuccaucaccuguuugguuguguuuuccuguaauucuuuaagggauuuuuguguuuccucuucaaggacuucuaccuguuuagcaguguacucuuguauuucuuuaagugaguuauuaaugcccuucuuaagguccucuaccagcaucaugagauaugauuuugaauccgaaucuugcuuuucggguguguugggguauccaggacuggcugaggugggagugcuggguucuggugauggugagcggucuugauuucuguugguaagauucuuacauuugccuuucgccauuugguaaucucugguguuauuuguuauaauugucucuggcuggagccuguuccuccugugauucuguuagccucugucagcuguccuggaaguccagcucucuucugagucucaguggucagaguacucucuucaggcaagcucuccucuggcagggaaggugcacagauaucuggcuuucagaccugccuccuggcugaagauaaagacccgaaauagggccugucccagauaauggguugccucugcagucugagcguucaccugcacagacuggucuccgagggacccaagacacaagaugguucccucacaugcucuggaggucggagcccucccagguggucaccucuccucugguggggaaggugcccagaugucugcagccuaaaacagggccugucucagaagcuguguaguuucuguagucugcucgcucacccuccgugguccgcauucucaacugcacagacuggucucagaggaccugggagucaagaucuuucucuguauuuuuauccuaaguuuucaaaucuuucuagauuucaccaaucagcuucuuuaaacacauccuuuaaggggccacaaggcaucucuuuuucucuccauauauguaacaaucagaaucccagucauugaauacaguaucacaggugaccaacacucaugcacacauacaggcuguagaaaccucuucucucgagggaauagcagugucuuagucaggguuucuauuccugcacagacaucaugaccaagaagcaaguuggggaggaagggguuuauucggcuuacauuuccauacugcuguugaucaccaaaggaugcaggacuggaacucaagcaggucagaaagcaggagcugaugcagaggccaugcagggauguucuuuacuggcuugcuuccccuggcuugcucagccugcucucuuauaaaacccaagacuaccagcccagagauggucccacccacaaggggccuuucccccuugaucacgaauugagaaaaugccuuacaguuggaucucauggaggcauuuccucaacugaagcuccuuucucucugauaacuccagcugugucaaguugacacaaaacuagccaguacaauugaccccaugucaacuugacacacaaaaacaucacuaguaagccucaacccuuacaaucuuauucauccccaagaucuaaauaacuuuaaaagucccacagccuuuacauauucuuaaaauuucaauuucuuuaagguauccaucuuuuuuaaaauccaaagucuuuuuacaauuaaaagucucuuaacugugggcuccacuaaaacaguuucuuccuucaagagggaaaauaucagggcacagucacaaucaaaagcaaaagucaaucuccaacuguccaaugucugggauccaacucacgaucuucugggcuccuccaagggcuugggucacuucuccagccaugcccuuuguagcacacgcaucauccucuaggcuccagaugccuguaccccacugcugcugcugcucuugguggucaucucaugguacuggcaucuccaaaacacugcaugaccccuucaguccugggccuucaauugcaacugaggcugcaccuucaccaauggccuuccauggccucucacaguaccgagccucagcugcuuugcgugaccccuucaugccuucaaaaccaguaccaccugggugacccuuacauauuaccaagucccgcugcagcaggaguacaaccuuggccauaucuggaacacagccucuuugugcuuucagaaaacacuucccagaagaugucaccucaaugaugcuggucucuucuuaaucaccgcuaauuucuuagcuccagcuaaccagcaucaauagucccaguaaugcaaaguuuuugcuuugguaguucugguaucuuguuaaucacagcugauucuucagccccagcuaaccagaaccacagaaucuucacaaucaaaacagcaauggcccugaaaagagucuuuaauuuccccucugaaauuucacacaccagagcuccaucuucugcaguguucucaacauauucuuccaagcuccuacacgacauccgacagagcucuuaacaacggauggaucuucaagcccaaaguuccaaaauccuuccacaguccuccccaaaacauggucagauugucacaggaauaccccacucugcugguaccaauuugucuuagucaggguuucuauuccugcacaaacaucaugaccaagaagcaaguuggggaggaagggguuuauucggcuuacauuuccauacugcuguugaucaccaaaggaugcaggacuggaacucaagcaggucagaaagcaggagcugaugcagaggccaugcagggauguucuuuacuggcuugcuuccccuggcuugcucagccugcucucuuauaaaacccaagacuaccagcccagagauggucccacccacaaggggccuuucccccuugaucacgaauugagaaaaugccuuacaguuggaucucauggaggcauuuccucaacugaagcuccuuucucucugauaacuccagcugugucaaguugacacaaaacuagccaguacaagcagccuccauugugaccauggcucacugagugucacuucacaccaagcgccauguuguuuuaagaacugggucuccauuaucacaugaaguccacauaaaaucuuuuggaaguguucucaagucacaggacuuuggaacuccauaauaggaaguugaugaauaugaagauagaaggccagaauuuuuuucaaaagcccauggauauaaacuaauaugaaagggauuguguaacauuccuagggagauacaaagaagacccccgaauggcuugcccacucuuggucucccaguagaagcuauccauugauccagucuagugauaagagagccccaacuaucaacacaucucacaucaccauagguuuaugcacugaaauuagaagugcacuuaauacagcuaacguaggccauugucauucagccugucccaccuuaagcaugaucagguaacucccaggaguauuuguacuagacuauagcugggcaaaaucgucuaccaccaagcuuguuuuauaauaaagacucauauacacacagagauguguauuugaugagauguaaaacacaauauccaaauaauaccugcaauauaguaugcuggagguuguugguuguccauggucacagucagauggcuaacuggggcucagugcugucacuuggcauugcuagaaagcaucaucacauacuaguccaggcuagcaucagaggcuaguccagggaaacauaaaaacucagaauuuuagauaugauuucuacagaguacucucacaccaucauaaaguugaaaaguuguaaauuaauuugagcuacagguacagggacugucauuauagaguaucuucagcaaguauuuuucaagguuaaaaaauuaaauuauauguauauguguauuugaguauuuggcuuaugcauguggauguaguguccucagaguucagagcagggcacuggauccccuggaacuggaguuacacaugguuuugagcugccugauauacuugcugggauuggaguucuuucccaaaaguaauaugcucuuguaacuacugaaucaucucuccagaccugucuucacaauuuuaaaaauugauaagagaaauagugauucaaucaucacagaauuauuagcucagauuacucuuggacugguucuuggcuuuaggaugauauguuuuaaaugaaucucuuuaaguauaaaaauauguauuugaaauccauggacuugccaauacuuauccucagcuacuuucuggaaugcugcaaagcuauucuagaaaaggaaaagaguguguacgggaaaguuuguaauuagguagggaauuucagaagcacgccaauguacaggaucuagucauuguuaaggacacagauuuguguucuaugucugucuucgagggagguccaaagcuaaaagcaaagcaucuuuuuaaaaggacccagguuuagucccucuuuaagccuuuaagauuaagaacuguaagucccugauggggagaaagggguuggcuggacaccuguguaggaaaaagagcaaacuacacaguugcugcaggcuaauagaucuaaccuguaaaacugauuaggcccaacauggccaacugggaugaugccuaagaguccuuuacuaaagggccucgggguccuuuaucaagguaucaccaacugugcacuugcccaacauggacaagguccuccguucaauacuaagcaccagaaacaaaugaauaaaauaaaauaucaguaauaucugauauguagaauugguaauaaacauaaagacaagacauuccaugugcuguagcacuaugugaggucuaaguguaaauuauuuguaaaugcaucuugcacugugacaaaugugggaaaucacaucuaaggacagaaaguggcagagaacccccucccguuccugccauuccuugcuuuucucuaccuuaauuaucaaugaaugaucuuuaaguuugucuaugaaaccagugaucuaaaaucccaaggauccacccacaucuugagaaaacaccacccacccuugugucugugguacugucauugcaucuuuaaaauaaaggccaacuuaguuuuauaaaaaaaaugaaugaaauguaacaggauacuuuuuuacagcaauauucaacuugucaucuauaaagacuuagugcuagacguaacacaguauauaauaaugguguuuuagccauauacauaagacaauuuacuaccaugcacuuggagucaugaugcauuggggaauauccauaugaagauagaaaagcugcccacugagcccccauuuuauuuuaaauagggaaauucugaagcuguguaagguuauaaauuucuccccaagccaaaugguuagugguuaguaaaguuggaacuuguaccugauuuuucacaggcuaauucuuccacagauugcuucuguaaaccaauccuauguuuuaaauacuaucugggacagguaugggauaaugaccaaacuguaccaauguuugcaugauagcuucugauugugcuacuauuuauuuauuuauuuauuuauuuauuuauuuuuuaagaucaacaauauuacucugacacuguuuucgcuaggaggaaaaaguacugaugugucacugagcauugcuguauuuauuuuuaaauggaagcuaaaauucugauauuuaacagauuuucuuguuugguuugaacaaccuugagcaggaaaacaugguugaacacguuaguuuguuuucugucucucuuuucucgugcaagauucucaaguuauugcaaagggcaucagguacacaugguguugggucaauauauucagacaacuuuuugaaaaaaaaauuaaaaauuuuaauauaggguaagacaaagcagacuaugaccaugugaaagucaaugcauuuaaggaagaaacucagggcuggcaagauggcuuagcagguaaaggcauuugcuguuaguccugaugaccuggguuggaucucuagagcucacaugguggaaggagagaaacacugccugaaagcugucuuuuauccucaacaagaaugcuggcauguucucucccacaagaaugagugaaugagugagugaaugagugaaaagagagagagauaaaaugauagauagauagauagauagauagauagauagauagauagauagauaggcagacagauagacagauagauggauagaugauagacgaaugacuggaaaccagugccaucugaccucugaauuaggagcuuugccaaagcuccccucgagucugcacguuucugugaaugggucucgggaacaccauguggguagcguuuaagcauccugcuauuuuucauacccagcauggaagaugcauuauguaugcuuuauuuuuaggaugcuguuuuauugccauggagcugucauacugaauuaagguaggcuaguuccaagaauucugugcagcgagcugcuucgaugacaaacuacaggcaccccacaaaccuccauuuaaauucauuguggaucccaagucgcucacuguuucccaacuugcauugccucuucuuauuacagagcaggagaaauauauugugugcuugcuuucuguccuuucaacuuucccgaggaaaccuugggagcccgagcugcugguguuaucugccaggguggaaagauggcagcguugcuuuuacuguuguuucaggggucagguagggauugaauccauuggcuuggaguucuggcaaugccuccccaauuugaaacacacacugguucugauuccuacaaacccuuggcacgucugcaagcuuucuuaaaauauuuauuuaggagugcacaaucaugguuuauuguugaaauuucugcucaaaagcacauucuguucuuuaucagaugagccccagggcuauuucuuuagcaaucaaacugagcuggccagcuuaauacuugcauucauuuggggacaaaauuguacugagcgucccucccaagcaucacuggcuggcugcaguguccccuuguuugcccacuacauaccuucacagauacacuggagaccuggcaaccuucugcuaugcaucuggagugucuuccuugaucucacagugggcuaggacaggagcaacaaugagugguuguuaugguauucacacuguaaaccugugccucaacuccaugcaaaucuacuccucuguuaggacuauauuuaucuguauuccuuuaacagauguuuacugaucacccauguuuuacuggacacccuuccaguccuuggggcuacaucccuguauaacauagcccaggggagcuauccuuguggaccugacaucacucagucuugugagagugacucuuacugccauuaauugcagguuuuaagcaacaucccccugaccucauggccauuacccugcucucucuggacugauguguuguagcucuggguugguggaaggaaugcacaggcucaguaggaccagacaaccuuuccuuccuuaguuaagggucaaugcuuaugacuucagcacuauuugccuguaaugagcuccaucuauuggcacugaauuugucugugaaggacugucccagaacuggggcagggaauaggacuucccuauuuaauagccauucaauucaaauagcaguguagcugagggugaauacuggcacuaucuacugccuggguuugauuccagauccaauaacuuacugaucuuuauuuuuuaugagcauaauaaugaugaucugaauauauauacauuuauaauaauauuuagccuggccuugucacuaaaauuaucucuagauauucucaaauauuuauaauagggcccacugcauacuuauaauaaauguaaccuuuuauuuucaucuaguuucuaagcugauuuagcauccugcaguuugcuuuuuagauugucauaguuucucuaacuuuacuugaguuaaguaaaugggcacccacaauuaauucaaggcgaguccuguagcuggcuauggcugauaccuuuuauuuauuuauuuauuuauuuauuuauuuauuuaaaaaauuuuuggaacugagagcgcuuuccauucacuaucucauguguauguauaagaguaucauacacaugauucccuugugguacugauucccugugaagaaacugaagcuuaaaaguuaacacagguuuccggaugcugcauagagcagcugauacagaugugagcugggagacgucaguagccugauccuucaucauccugccuugcugccuuggcgaucagucaugccacaggagggccuccagugguuguauccccauuccucagccauccagauuguaaccugcuuucagcagucuaacuguccugucucuccugaggauggccccaugcuuucccaguacuagucucauaucaauguacuggugucaguaggugugcguguaugcgugaggguuuccaccccuccuuucuuguuccagaguccuguagcaucacggaugcgcgagagucaagcgcuaguuggcacagaaagcuuugcccguuucccagcuccuuuucucaaguuucucccuaauccuucucauucauuuucagggggaucuuuggaaucgaggauuccuggggucucacagcagcggcauuucuguucugaguccauuagccaugucuuagaacacacgaguuauacaaggacauugggggauuacgaaacaaaucauucauguguuccaguuguuuuuagguucauuuaguuugugugaugugugugugucucagaggacgacuuccagcgguuguuucucuuucacaaugugauccaaggcucaaacucaggucaucuggugugcacuuuaacccauuuagccaucuugcugguccagaacggucucuuagaagucacuguggguagagcaggagcugggaucgguguggaaaggcagacagucucaaaggcuugugaaggcagccuguccucaggaaaaugcggguaguuuugaacuggagauuggggcuggaggaaugaaugaagcgggacaaguuugccauagauggacaguauguccuuuuuccugugaggacccugagcuuugucuucaacauucgggggauggggaguuacugagggauuuagggaagugaaugauaugauugggcuuacauuacaaggcugccagaaacucaugacuccuuuaaccgcaugaaccccaacacuccccagacuagguuauguaaaggcaaggagaacuuuaccucccaaauaugguuuuuugaaucuuuguagagccuggcacccuuaccauagccccaucacuuugggaagccaauuugauuucuguggcgcuuuuucuguuuuuuuuuuuuuuuuuuuuugagacaggucucuaaaacccugucuguccuggaacucacuauguagaccagguuggccucaaacucaagagauccaccugccucugccugcugagugcuggcauauuggcaugugccaccacacccagcacugauuccugcauuuuaaaauaaacaccaagacaagaagaaucuaguuugcuugggcaagucauguuggacaagucacauggcuuucuucccuguucccaggcugcacacuccccugagcaguuaaucagcaaugaaacacugggacgaacugagcucuguucaacccagagaauauuugaauacacaaacagacuugguuuuuuguucuuuguuuuuuccuugcagaaguggccuaaauuaccuagaaaucuaaugccucuuuaauuguaguuuuaguugauaauucuguauacuuuuggguuaucauuagauauauaauauagauacauaauauauaauugauaaauacucuuaauguggcaugguaggcuaauuaaaccuaucacuucagacacuugguauuucuuaauaauaaaaacauuuuagcuguucuuuuaaagcuaguuugagacacacgaugcauuuugauuuuggucaccacucugugcaauagaucaugacuuuuuaaaagcguucucuaucucucucacacaugcaugcgcauggcaguguucucaccccuaugcuccagaugccuugugccuuccucuguugcuuuccauggcgcucuucugagacaguguggagccuggugcucauugucuuggguagacuagcugggucuaccuaacccugcccccaccucuaaccccacucacagcacuaaagcuggaggcacaugagguggccacacccagaauucagguccuuaggcuugugcagcaagcgccuuauccccugagccaucuccccugucacgagaucauugaaucuucuggucccagcuaacugagacuuggcauucuuuuugucaucauaugcccccaagucgucuagcuauucuuccuagacucaagcaacaaauguuuguucuaagaguucagguauuuuagugucuacguaugggauuguguagcaucugucuuugucuuucugucuugcuuugcucaggccuccuguuucuucaugauguccugugugccagcauuucugguucagacugaauaggacucccucgugccaucaugcggguugucuccacugcuuggcuguggugaagcaugccucaguaaccaugugagcguagacuucucugugcaguucugguuucaguucccuggagagcaucuaggaguugggugauaagaguuguauauuuucuuucauuacuuuaaggaccuugcaaacaguuucccacaaugcuagauuaauuucccuuuucaccaacagugucugaaguuucuccuuucuccaggauuuugccaggagauuuuuuuuucuuuuuuggauuuuucaagacaggguuucucuguguagcccuggcuauccuggaacucacucuguagaccaggcuggccucgaacucagaaaucugucugccucugccucccaagugcugggauuaaaggcgugagccaccacugccugacauaauagucauucuaauagauguauagugaugucauucuguucuucaauuuacauauaaaucuauuuccaagacaaauccugaacuccaccucuugguuaguuuuauagcaucuacacauauggaaacuacauaaucuuguuucuacccuuuuuccuucaaaauaaacaauuacgcaaacuuuauaaaaccuuaugaagauuuguucccuuguuagacagggaacauuacacauuccuuuuugggcuucccucacacaugcuagcuugucacaagcuucaagcugagagaucucaccugccuggucccuucagucaaacuguguacauauaaguaacauuauacagauggagcagguuauauauagguuguuuaggaauguauuuguacauacauaaauccgugcaauaacaauuaaugaaaaacagaguccauaaauuugaagaagagagggagggguauauaguagaguuuagagggaggaaagagaagggaaaauguaauuauauuguaaucucaaauauaaaauuaaaaaauagaaauaaguggaaaaauuguacacacacacacacacacacacacgcacguaaccugagaguaagaauuagagagagagacagagagagagacagaaagacacagagauacacagagagacacagaaaaacagagacacacaguuagaaagagggacagacagagagacacagaaagacagagggacagacacacacagagagucaaagaaacacagagagauauggagacagagagacagaaagggacagagagaaagggagagacagagacagagagagauggaaagaaagggagagacauaguuguugagagagagagagagagagagagagagagaguugggggagagggagacacagauagagauuguuuguaguacucuugggaaugccaggcaaaagaccuacuaguaugcucaagccucauuccuggcuauauugaaauaaggucucuuucaagagcucaggcuaacuuuuaaccaguaauaucaacuagacuaccaugaacucaaaaugcccuugccucaauuucuguauguucaaauggggugggcaccacauccagucuacuaccuuugaaaagauuuauuuucaaguuacuuuuguuuauguguacucuugaauacauaugugugugugacaccugugagcggguacccuuggaggccagaagagauaagauccuugaaaacuggaguuguaagaguuuucgagcugccagaugugggugacaggaacugggcucccauucuccaaaagagcagcaagaacuaaaugauugagccaucuuuccagcucauacauuuauguacacacacacacacuccaaauccugcuuuucgagacacuggagaauaaugaaguuaguaggacuuaacacguuuguguaccuagacacuuuguacaaggccuuggagcaauauccauggacaccuuauugcuuuuagcaguggacaaucugcuguagcauaaggcuuucuguuggugacuuguugaugcuugugacggagccccauggaauuuauuuccugcaaugaagaugcuccaccgguuuugacugacccaugcuuuguuuucaagguucuguggaauuguguuuugugaaaggcccgaugcugaacucuuacuuccuuucagucucauucacaaggagccuuggaacucagcccauucgauagaaaggacuuuugauucgcagcucagaacacuuuuugcuuauuuuugucuggugauaaauacgggcagacauucacacuccaccagcaugcuuggccugccccuaugguguagcaaaaccagucagcccuuaaagggaagggcauuuaauucauguagacaaaggagauuguguaaagcauacauucuugguuaauuuucaucuccaucuucccccaaagaaugucuucuuugugcuguugagucaaaagugacuaaagagaacaucaaaauuccgaggagauauucagacauuggaagagaggagguuuuacuggcaagucucauuuuuaagacagcuguguaaccuuuaauucacacggacaucacacaucuguuaaaggcugcuucccaccacucuugacaguuagaauuuuaucucuucgccauuaagauuucuccagagagcacagcacuguaucaucuugacaaaucugaauggaaggagaugaacaccgcucauuucaaaaacccuucagggugagugcguuuaaccaggcuccuguuugcagagaccguuuucccaucaucccuuccgaucuaucaaugcuccuuuacuccucuuaaaagcaggauuuuauauaaugugggauucuccucucaguggcacuuacugagcugggaucugcguuuacaccgacagauauucucacccauuggcucacacacucuuggcucuaaugggaagaugaacagcaggcgaggaaaagcaagaggccugugauccuccacucaccaaccagggagccucagaucacuggcuuucucuguucucugggaaucccuuucccuaaaaagcagggaagaauaagaaugucuuuauguuuugcuggggaaacauggacggccauggagaauaauuuauugugccuauuugcuuaaucaccuuuggcaguuugagaaaugauuuauuagcuaucaggauagagaguguauccaaugacugugugugugccuguaaucucaguauccaugaagcagagaugggaggaaugaagaagguacagguccagcucuggcuacagcaggaagucugcagcugggugaugggaagaaaccaugagcuguggugcugcacacuuuuaaucuuagcaucuaggaggcaggagcaggugaucucugaguuugaggccagccuggucuacacagcaaauuccaggucaaccuuggcuauauaguaugaccauguuucaaaccaaccaaccaaccaaccaaccaaccaaccaaccaaccaaccaagcaaccaaccaacaacaggaaaaaccacaaaaaccaucaaagaauuugaugacuuauagaagagauugauaaauucgugggcauacagcuuguggcaaagauggcccaguaccuauuuugcuuucauaaacugaugucugcaauuuuacauggcugaaaaauaauaaaaagguugacaauauuccuaugacaauugaaaaucauauggaaucagacuuuaguauuuacaagaaaaaagcucuguugacuuaggcaugaccaguugucccuuuacagugugccacugugccacugagccaagcauauagcugaauggcugugguggugaccacaugauggcacaggcccaaauguuuacucacugcuauuugcauaguaugcagaccacugggcuacauuacugcagauuuacugcauaauuacaucagugcuacucaaauauuuaacuguagaauaaacauccauacuauaauauuuaaugauacaauuaugagaauccacaaacuucuauuuuuuccuuuguguaauuuuugcuucuuuauccugugaaaacuuuaugcuuccugagagcaaaaaguuggcaccuacuuguuuacaauuuagcuuuaggcuccaaaacacuaccuggcauauagcaguugcucaguaagcaacaaugguuggguaaaggcuuauguuuuauaagacuguuggaggugcauguguagaaacagcugcuauaaaaaucauccuuaauuaugcauuuaugcuaaacacuaggaugagggguuuuauuuauuugcuuuauuuuuuucuugcauuuuuauacggcaacauaaaaauuuuaccuauuaguuacaggcauacaccguauaauguacaaaugaggguaaaccuaucuaacaugcuggucuuacaacagugggguggcuacagguaacaauuauauguuaaauaugcucaaaaaccuugaggaagggaagucugaauguuugcaccagguagaggugauaaaaguuugagaaagaaauuuuucuuuauacacaguccuauuuaauaaucguggagucuguuuaugaagauacaugaucagcccugugacauggaggaggaagaggcaggcaggacuugucacuuguuuaaugucacuagacaaggaagucagauuagagagcaagaggucuguugggucccauagucuaagucucagucaugaguuaaccauguucucuuccuaaaaauuugaagcuauuuauuuauucaagugagagugaagagggcaggaaaaccugagaaaacaaaacaaccauuugccguggacagcagacaauuggguuuuucuucucauauguucucaugcagaguguucuucauugccuaaaaugaggagacuucuuuuuauuuaauuuuauaguaaggcauggaugcucuuaaauauguggagagaagcaagaagauuucucugacuucuguagaucacuucuugcuccuccuggccauuggguuguacaggaaacagcuuccugccuguucuuguagugacuguccuguggacaugcaguaucaggcuuuaguuaccuuugaacacuuccucgcucugagaugagaagugcuguuggugaguggccguguccaggauacuggcucacagccucucacaguucaguugucccaugugcuugucucagaaaguugcaugauauuuucuauucauauuugaccacacuggcccagcucaucuuccucauaugauagacagaucguacacaaguuuauucuuucucuuucuccuuuuuaaaaucagcacaguauuugggauauacaagauugucuagcucuucuguuuuagaauugaauuaggucucaggagccucaaccacuuaguaaagaaaugaggaggaggaggaaagaaacaguaacugaugaucuuuugggucagcuugcgggucuuucuuucucuuaacugugugucauugacugugauguaccuacuguguauaaagcaaagaccuuccaaaugcucuacccgacacuaucaaugagacgucggaggaguuuccuucgagacaggcuggaguggggggcaauuagaaugguugaauuaauguguuuaaaccguuggugugccaccaacuuccgaauggguccagcagcuguuuccugcagauaagagcacuacaagauucaagcaagggggguugaguuucuagcuaggugaggaaaguuguagauuucaaacaucccaggcuguuucaaagggcuuuccgaaauuccuggcaugucuggacacucccaucagaauuccugagggcucuucuguucaggcuuguucagaaugaguuaagggggcugccuuccuagaugcuuguaauugaguuguuuucuucaagagcacugugcugacuuuugaaucauaaguaacccuggccauaaccaucucugggacuuugcuuggaugaaaugggggcuugcaaaugacaguucugguuuuaagccugaacuguuguucaauagacuccaucgaggucuuuccuguugaugaggauuccacagggauguauuauacuuuauucagcugagcagugaaauggcguuucuauccagugacugagauuuaaacaacuuuagugacauuuaaaaaaaauaucaucuaugcacaugcaguugaagaagugacauuugcuuaaagacaccuugugaggcuaugugugaaugugugaccaccuucccaagagcacugcugugcucacacucuucuaucagaagagaaaaacagaaaccaaagcagucuuuuuccugcuuuccuucuuuggugacuccagaaauugaugcgaagcauccauuuucucuuuugaaucugggacuucuaaaaauucuccccaccccuggcaugcugauguagccucagaaaaucagacagcuguuauuacaaacagagaccgcucugcucagaccuugaauagacaauuauaaaugucuggauucuuuccuuucuuguggcggcugcuuuuuuagauguggaguaaaaccacacuaaaccagaggaugcuugaguaguaguuaggagccuguucuugccacauccauaaaucuuguuaaauuuucuuuuacugucuacaguaacuuuccacuucauaagacuuauaacugaccaggagugucauuuauauaaaagucuuaaaacuugugaagacacagggaccuuggaauuugguuacaaaaugucccacgcccgacaggugagagaggacgugaauuagugagugaucugcccaaggacauuugcuauucaaugcagcagcaugcugagugaacuauuugcuuucugauucuguagauggccgaccucgcccuaucauucucugggacucaucucuagcaucugcaagcaaugauagccauuccucuguuaagaucaccuggggaacuuaucagcgguugcuaaaacagaagugcuggcugaauggccggguucccagaccugagugggacugcacugaaauccaucaccacgagugguccaagauggcucucuuugauuuuuuguuacagguaaguuuauccaaucuccuguggcuuccuaagacuuguuguaaggccucaaaggaaacuucagcaucuggagugucuacaagguuguaguuuuaaguuaccauauugcuaaauuguuauugggagagaauuuagaacugaaaagucuuagaacauauauaaaaacauccuccuuuuuuguuaguauguguguuugacuggaaagaaggaaacagacaggaguggaaacagaauccuccgagguuauaaguccagucuaauguacaugacccucuguuucaaaaacaaaacaaaacaaaaaauguagagaaaacacuagcuuagucaccgucuaaggaaugaacuguugaccuagagaauggccuuugguguuagugaugcagaguugauagugaagacuaagccagugggcaggccauuuaguggagcagagaggcagacaacagucaccugguauuguuaccuugaacaacguuugaguucaguucuaagguauagacagguuauguguuauguauguauuaucucauuuguaagcuuaaucaauacaggaaggcugugaaauaagcccccuuuauauugcauauaggggaaccgaggcauggaaaguauauguauuuugacagcuuccuugcaagcugacaaaugagcccacugcagaaugacuagugcuaguaaagucaggaaauccuugggucugacacaugugaacugcacacguaggacagagccacugguauccacuucacacuucuuugcaucucuaguugcauugggggugauacagcagcguucuggagaaugcuucugauggugucuuugucucugacauggaacccuaaccucagaaucuccagucuuccuauuggcugcuagcaaaccugaugaauauuugccuuagaaggauaugugauuuuaguauuuugguaaggaugaaaauaaccccuacagaguuaagauacauuuguuaaccacguuaacaaguguaaccauuagugucccacaggacuugaaggacagcuccaugacagagugccugucuucgaugggugagaaccugaguauauccucacuacuacacaggcaaaaccaaacaagacaaaacacaaaaccgaagagcaagcuuggugugcugugcagaaacgcccauggagaacuauguuucaacacagaaugaucuagaagcuugcagcugauagacauaaaaaguuaccgauagcaaauaaagggcaaaucucuaucuugauuaucuugcguuaaguauuuuaaaucugaaacccuaacguaaauuucauucugacccaagcuucauuuauuauucaacuaaggagaacacauacgcugcacgcgcgcgcgcgcacacacacacacacacacacacacacacacacacccuaugaucauuauauuauaaaaguaauauaaaguaauuaugcccacuaucacacuccaaaguuuuuugguuuuuguuuccuucuggaaguguaaugguuaggaaaauauaguauaugaaauaaaaggcggauucauaucagaauugguggcaaaauauuaguuucaaguguucugaggucgaaagagggggaacacgugccucagaauagcaaagagagaggaucugaauagaaguuuagauguaaacagaggaggcuguauaggaggccugagcaggacaggggugugauggcauuucucggcauuuaaucaucugaaagaggccauucaaaacagagucuuuguuuaagcaaguacugggccuuccugcuuuggggcauaggaaguggcaaaaaggaaggacuccccuuacacagaguauguguugacuguguugcuuuccuacuguuuguuguccuaacugucagaacaaaguucagccgaugcagcuuagcuucugagagcacuggcagcuuuuacccaugcggggacagugucuguugccuggaggaugaacgugagcacgugaaagcaucacugugaauuugaaacgggcacaaauauuccauguagcuugaaauaauaauacggucaaccugccacucacagaacacuuccuuuguguauuuguuucuaggcacuuuuguacugagcacuaagauaguaauuuaggaacugaggaugguuguuaucuauacuuuagagaugaggaagcugaagcaagcauaaguuugcuaaucuugccugagucacguguucacuaguuccuggaguccuacagaaguucuguuuuaaacaucaagccuucuugauucuugaagggaaaaacuguaccuucaucucuuagacagaaaagaguaccaucuccagucacuguuccaagagaaaaaucuaggagccagaugugagcuucugugagggccauguggguagugaccaacaucuugaucucucuugauuugcuuucuuguuggaaucauucauuggcucuugucuuaacucaagguucgguccuuucucacuuaggugcccccuuuuagccccuuccaacugaaugaaccaagcucacuucaggcagaaguugguuaucugcgggguguggcucucucugcuucuguagucuaugcaguugcuuccucuguuugugguuggaagguuuuccuccuugauaauucacgaggaagaaaucugggcaaggauuuaccacaacuugcucaaacuguaauaucaaguggaagcuccuaacucugguuuaaaagcuuuguauaaaacucaagaauaccauuuauuaaugguuaauuuaacuaauauuugcaaagacagagauaugcagagauaaucucuugugugcuuuguggaaacaucaccuaucaauaaaucuuauagccaauaagccaaggcaggauuaaaagguugggcaucuggcacgaagagagagagagagagagagagagagagagagagagagacucugugagauugucagagggcaagauucccugcccugacucagagggagccagacauaugauacugaggagagcuaaguagccacauggcagacauagaauaguauaaauggguuaaauauguugugagcuagugggaacaagccuagcuuauggccuagacauuuuuaaauaaauaaugagcuguuguguuuuuauuugggaacuggggcaugaguggauaagcccacagcuacauauacauauauacauacacauacacauauguaaaugacaucuguugggggaaguuacaguuuucuuuacuuuucauuaugucuaacagugagccggcgagaggcuaauuuccauuagauagugcaucauuuuaccauuuuauaugucagguuggauagguccucccucuucuccacugugcaaagcagaaggcaacgugauguuucugccaaucaggugaagggugaugaggucuuauuugcauuuuucaguuuuacauuauaugugagacugagaauauuauauauucagguauuuuguugauuucaguaaaucucuuguuuaaacuauugacauuuuauaacuuuccuuauugacuagaaacuuuguauauuaugaaaaggagcccuuauucaugucugcagcagucagcuuucugugauauaaacaaggagccgagagaacaacuuaugaagaaaaaagacuuauggcccucagcuuuuauugauucagucugugauuggucagucccacugcuuugggccuaugauaaggugguagacuguagcagaagugugugguggagcaaaccugcuucucuuguggacaguuaauagaagagaaacaacagagggggccagccugccccaaacucauuuauguuuccucaggagagaugaacgaaccuuugucaccugugauauagcaaagaaauuauuuauccaaauccagcuugguaagccaauguguuuacugagcuuauagguaaaaaggggguggguggucacucacaauggugacaaaacugauacaucaccaaagaaugccgccccuucauggguaaagucugugcaagcugcauuaugaaggucagcucaguuaagugucaccucuuaugcauucuaguaccucccaagaucaggugaagccuggggacacauguugguuaugacaguguuguuugucuuccuagggagacaugaacaaauucuguucacucuauuuagggcaucaaugacagauugaagaaucaguucacccaucuaacuuuacaaaccagugaguucccugggguuacuacagaugcauagacgaaguauuaaagaaacacgugugacucaaaaacauuuguaucacugaaaagcccagcccagcauggguuaggauuaauggaagcugcaugcuuggagcucucuguggggcuuguaggcaguuccauccacaagagucucuucuuucucuagagauuguuuacuguuuacaugaccucuaggagaggccuugugacuccuauccugagucucuugggucucauuagcuuccccauccuuucccacuccccacaggagugaauguuacaauucagaggacguauuugcuuaauaaugugcuccuucauuuccuucagcucuaacacacuuucuuucacauuccaugguauucccugggcuuuggugggggugauauagacauguuggaaauuucuuccauuuauggcugaacauugaguccuuaugcacagaaagagucacuuguuugcagcagguagaccaggcauaagucaugguaucuaucacucauagcaacaaaagaaguuuuccuccugggucaaaccugauagcagcaguaaucuguggguauaaacacaaauacauagaaggcaauuugacaggcgugcuauauucuugaacuaaacaacagcacaggggccuaucagcucuccagccacagaucuuugccuuaguuuguuaccaaugugagaucucuuuacuuaaaucaaaucagagagcagcugauugaaccuuuaacaguuaugccacauuuugcaucacaugaggguaguguaguauguagaguccauauaugagcagggguucuaauggcaguuugcucugaaucacuuacauaggacuucccagaacuagagagccaggcaauaugggggggggggggaucugucuuaguuccagcaugaauuuucaaaacgugaaagucuucaucagcagggccuuacuccccaggaaucuucucugaaaggagacugcagaacauuuuuuauaggaugggaacagaaagcaaguggguuugggggugggcuguugaaaugaccgaucacauuuugacacaagggauuaagcaaggaaguuaacguugaugacuguaccuuauccaggucaccugauuucagggucuuugagucagguucccuccuggacucugaucuggaauuuuagaaugauaagggaacaaagagcaaguugcacauagucaauuaagucaagacaaacaacacuuuuaugacguguguaccuuacuuuagauaacggauaacaguaucuucccucuugacuuccuuuacugguuaacagacaaacaugaaacaucugaagaagcaagauaggagcuggguucccggacuugggaauacaaacucaguuuugauccuaucagcaagguggaauucauuccugagauggcugaauuuaggaaacuaccuccugauaccuagcaacuagccaacaguuuuugugucuaagccauacuuauauguaacugccaaauucucauagcuucauauccugcagugucucaguugacuaauuuucuuuauggucugugggcuugucuaugagggauugucuugaucauuaauggauguaaggugguccugagcucagaaaaguagucaaguauaagccugagagugagccacagggcgagccgacaaacagcauuucucuguagugcuugcaguaaguuacugccuggacuuuucccagugauggccuguaacugggaaagguaagaugauacauacccuuuccucaacuaaguugcuuuuggucagagugucuaucauagcaaccgagaauuggaauaguaacuuauuccuggcaucaagguuuuaguuuaauaaccuauggauucugaguggccuuucccacucagaaucuucaacaucuguuuucacuuuucuuuuagaugugucuucaaauuuguaacauauucaagacacucaagggcauuaugcaaugaaaccuuuuuauagagggcaagaugucuuaaggcuugccacugucauugagcaagugccaauuggucuuuggauuuagcagcuagacuuauacuuuucaaaaguagguagauccuuuagggaagcauuaaaagaucuuacaacuuguaucaauuguuuuauaaacagaguaaaguugaguagagcagaauggauggaugguaggcauggcuauauuuagucuucuuuaauccaugaauucuucauaagcugucuugcuuccucaucuggggcacugccguguggccgcuguacuucucuccguguucaaugguuuccgcugggcugcugugcacugcuuggcucaccuggguuauggcugcacccucaccugcugcucaaggcagggccauggcuguuaucaaucugucgucuauauuugcugcugcugaaggaaucguaggcuggguuguagacucaguuaggguuucuuuuguugugaagagacacugugaccaaggcaauucuuauaaaggacaacauuuaauugaggcuggauuacagguucagagguucaguccauuaucauaaaggcaggaagcauggcagcauccaggcaggcauggcacuggaguagcugagaguucuacaucuaguucuaaaggaagccaaaagcaggcuggcuuccaagaagcuaggaggaaggucucaaagccuacccauucaguggcacacuuccuccaacaaggccacacccccuaauagucccauucccugugccaaacacauucaaaccacaauagugcuacaauuuccacccccaguauaauuucucauggggagaaauguacucagaaugcuggggaggcaauaauugccuacuucuaagacaaucucuuuugacuuuagcacucugucuuccauucugccucacaugccuuuggugaacugcugcuuuggccuuaaagcuuucccaagguucccuccacagcauguggcuucuguuaaaauuuaccugaggaacucuggcuuuucacagaucucaucacuuccgauauugguuguccuggagacgcccauuuguguaauucccaguuuaaauuuuaagucauucagaucuacuagagcaucuucuaccucaucaagauugugccucacccguggcucaguaaaguagcagagccccuugggaauuaauuucuuucuuagcucuucagcaaacccaaacccauuaggcuuggugaagaagcacugaaugucgucucucucacucccgguuuccuuaguaacaauauuuuuccugucuugucuucuagucccugauauucauggggacccaucuagcuauaaccauguguucgagccaguucacuguauugucucaaggaugugugaguagugacucagugucuucaugccuuuggcccccagacuggugccauucauucucauaucccaugaccucauaagccuuauaagccagguuaugagggcuucuuuuauuucuuguuuaaaugaugcuuuucacaacucgagcauugcagauauagaauuuccucauaguugugguuucuuguauaauucccuaguaaugcucccuucugugugcaugcuaagucgggauuuuccucuuccucuguauuaaaaaguuagccugauacugagggacaucauacaccacuucucccuugcucucucccuccacauugauugauucuacuuuggagguuuuuagaucucagaacuagguguuuaacaagcuacuaauuuuuauucucuuucuauuugugucuguaagaaauggcaagguaacacuucuuucucauccuccauuuuuuucauauugucuuccaaguuggaggcuaauuuaaaggacaacacagacaagcgcuuuucuuauaagucuuucuuugacugggcagauugcuaagccucaguugcauguucuauugccuugccccaagaccauggaacaccacaaccgcuuaugauccuaaaccauauguguguccuucagagacugugauauauucucuagucuauccaucaacuuggguuucuuguacucacacaguacauaugucucagucuuggaggcacaucccucugugccacauagagaaagagagucaccuugaguucccccaagggugcucuacccucauauggcucagccuuggcugugguugaggagcuagucccuaguauguggugggagaaaagggccuguggugaagguugcaaguggaugacacacguaacacugagcauggacuuaggguuaaaauugggagcugagaacacuagggacaagacacagagaaacuugcuguggggugugagucggccaagugggccagauaaaaggaagaaaaaggcucuuggccagauauaaugagcuggugcccacuuccugaagcuuuugagaaacaaagguaagccucuauugccuuuucauauccucuugcuuugaaaugcagcuaaccuaaacugaaacugagcauggcuucucucauaagagccuucuaccuaagagauugcuccagcugaucccguugacaagugguuaaauauaaaguugugacagaguuaacuuggcuaugauaaagcuccaaguugaucauguaaaugugagaacaaagagaacuuacuacauuaacaguauaugagacauugcaaugucagagguaccaacagcagccagugauuaaguuagcagucaaauuaguaucugucagugaaauucagagaucucagagaggggcucuaaccacaccuaccuggauuguuuaguacauguuuagaucauuuuuaggcucauuaucaccuccaugguugacaaagaaaacuuguuagaguaugugguugcuuuauuguguuggaccaauauagcccagagacccaaucaaucucacuguaauuaucuugucauuaguccaguuuuuaccauacaccuauaaaaaccccagacaaggaagguuuuugacaucuuuucuucucuuggaaauccuucccacuuuugagaguuucucucacuaucccuaaauuucucauucccccccccccuguaauuccaaauaaagcuuguuucugcuuugcauguuccuauaggaguucauauuuuaaacucucguagugacugugagaaaauaaaugugaacacugucucagagugucuaacaccuagguccuuggauuaugcauaacugugguguuaaagauuccauuguucuaaacaccuucuaucagauacaugugugauuucuccuucagcaagguucaugcaguugccacuauagcaagguaguagaucacccacaugggaacaauauagccuguuagauuacucuuguggaugcuucaccuacagauggaugagccucaaguacaugucuuaucacccauauuaacugcugcacaaaugcucaucccagcucuucucuggucuugugggacgcugggugccagcuaucuuguguggcuuuugccagagagaugagaacaaauguccauguaucuuagguuagccauuaguaacagacaaaagaaaugacuccauccaguucuagcuugccaaaucaauuaauuuauuggaguugcuuguagaaacauggccaauccaagggcagcuggaccuccaaaaaguucacacucgcauggaugacaggcucaugaaagcagcaucacuggaacccaguggccaacuugaaggcaacaaagaguguccucauucuccagccauuguuuacugcucacacacccugggaaggugcuuuguaggucuuguccuuaacuguaaguuucaugaacuuccuuugcuuaguaggucucauuagcuuccugagucuuuguuuucuuuccaggagggaauguuucacaaugauucaauuggaagaaaaugguuuuacaaaagucuggaaucccaagccaagauacucuuucucccugcuacuaaggaguguaaauagacccauugcuaacaccagagacugagcuaucauggugcuguuuugcuuauuuccauuaucaugacuaagaggccacaguuauuucaucaccacaauguuuugccuggagggaaaagcuaugcuagacuauuacagugaguugaugccuugccuuuaaaccugauauacaucagguuucauuacuucucaauagcacaucacugggacuaaucuuucuaugauugggccuuuaagagauguucuagaucuaaauuacuguaguauuuucuuuaugauucuucuaauaccaaaggagcaguguuacauuuuguguaaggucauuuauaauugauucuuucacuuuuuguauuuagcaucauaaauucuugacagaaauugggguuuaugaaaaaaaagucuaaauaaacagacccauuucuugagugucauuuuaguuaauauuuuuguauaaauguuuucuauucaauaccauagaggcugguuucuaaucagaaauaugccuuauaaaaguggugcuugggaugcagagaguggauuuugugagcauuuuuagacaaguuaugccuggagcaagcuauagucgcuugcucggugaugcuggagcaaggaccagggaacacagaaugguuguuauucucugcauacagugcucauuuguuucacccaauuaacaaacacauaauucagaaaggcagaacauuauuacugacucuguaaagugcaaaggaccacaagccaucuuuucuucucuaagugugggguuaugaacugcacagaucaaaauuuaucaccauagagaugacaaagcaaagaauucuagaaaaugcuuuguguuuccuugccccaauuucuuucaaaaaauuagauuaaaauaacaggacugacuucagcacacaagaaccauguuuccugaacuagaagccucuacuguaguacuggaaacugagaacgaauuagucugcagaauuuggauguuaagucauuucuuagccuugagaaaucacuuaagcuuuucucuucuuggcuucuccaucuguaaaauaggacacucacaccacauagagggcuaaugaaagaacguauuacuucuauacauaccuuuguguaauuagaaugaugcuugauacauauucaguaaauauuacauuaguuaugaaaauuaaauacuuagaaauucaaagauguacauaggagguaagcaaaccaaucucccuauuauuuuagucauuaaauugugagucauuugcagauuauaauuuauugaauguucauggacugcuacacaucccuucuaggucuuuucuuauuauggcuuaauucuuuuggacaacucugucuuuucuuauaaacugugaauuucucaagggcaagcuuuuggucuaauuugacuuguaacuuuucgguuaucagccaaauguuuagaaaugcugcagcucuuggggcacugcuuucugguuaaggaaaacuaccucaucaugucaaaauaauaaaucugaagugucaaaucaggauuguuacaagugaaaaaaaacugccuguaacccagaaaugaaguaauguuauuaaagaaaggaauuagaaaaaaauaaauggaagacucuaaugaauagaaaauguuugacaucuuuuuauuguuuuuuucucagucuauuuguugaaugagaaauuaaugaauguuuacauuaaggggaugguagauguguauucagaaauauuugcuuucgcuauuaccaaaacauuauaacauguuucuuuccacuuagacuuuuuccaauucuuuuuuguuccagacauagagaggguuuaauguuguacauaaaaaaaaauugaaagagaugauauccugccuccagaguuacccuauuuaauaugagagaaagauaaccauaguagaauauaucacgcaccacaauuaagucuuaaauccuauggaaagaaacaggaagucauaaauuauucucaaaugguuggcucaagaaugaaguuagggaguuuggcauaaauuuaauccugaaaagcaggacuccauaggaagagauuuuaaugaagaagaaccuuaaaaguguggaaaaguaacuugauugggaaaaugguggcugaagacacuuccuguuuuccaaauguaguuuuugcguagauggcugugaguaaugagcccauggugauaaacucaacaauuagccacauuuucccuuguccugagagcugucuccuccaguuaccuuugucccccuuuucaucuggugccuaaggaauuugcucugggacgacuucuauagaauuccccuugcuuugaucuuuguaguuugaaagucaaaauuccaaccaucuuguguguguguguguguguguguguguguguguguguguguguguaacacauaugcauauauguauguggguauguaugcucucauauguggagguguuuucaucugcugagcuuuucuugccucucccugccagcacuggaauuacaagugugugccaucuugacuuuccaugugggugcucagguccucauguguguacaaacacuuuacccagugagucuucuuugcaauuuucacccucagccaccuuauauauaagggagaacuuauuaccuuuuacaaaacaaaguuguauuugcuuugaccauucucugccaggcaaagaaagauucugcuuauggcuccuugauagcucauaaaggacucuggagcauccucuugucuuccgcuuucucagagaccaaggcucucacuugcagacaucagcagccaggaaggaagaccugucacaggugggcauucugguggcagaagguagaguagccuaggguuccagacaucgagacuuagcacaguuugccuuagcuuuuguuguuuuucaaaauuggagcauuagcaaucuaaaugaccucuggccaugcauauauuggcaaguucaaauaaauggugcaguuucucauuugcuugaucacaaauagugagggaugauggccucaaauaaugucuuaggaacaaguagcaaaggaagucuggguuuagcgucacauagugguuagcuagcaugaugaauugccuuggaccuaaaaguggagagaggaacaaagaggcugcagagcuauauauuucuccuuuuuauuguuuguugauauagcaucccaauucucuuauggggaguaugaaauaaucagaaugguuuccuuggcuacaggucccuuacuuagggaaaggaccuaugcuuucuaaacauuaaaaaugaccgagguucacagaugugucauguauucuccaggaccugugccuuacugaggaacaaugacuucuggggaaugaagaaccaucauuuuuguugugaucuuaaaaagagaaagagcuguaagaauauguucuggcaggguguuggggaaaggugugccucagcagguucaugccaaggcaggcaucccuugccccugagggaccagacacacaccgguauauaguacagaauagaguuuauuuagggcauggggaggggaguuaagagaguagccgaggcagagaaaggcagagagaaggagagaguagagaagcagaggcuggccauggccacguggaggggcuggggugggggaagggaauggggagagagggggagcaaggaggcaggaagcaagggagagaagcuggaguaagagagagaaagaggcaaguaaccccuuaaccgugggucggagcauaccucgcuguugccagguaacuguggggugcaggggugggggugggguggggguggggauccagacagaauaccaacuuuuuuuuuucuuuugagagugugacaauugguaggucucugcuguuccaguggaugaucaaacccccaugcucauauuaauaguacucacuggacuuaguggguuaucagcaaacaaaggagauaugaaguuuaaggaggacguguuggagggcaugugggggaagcgggagugggggauggggguggauaugcuuuuguuucauuauacacaugaaugacauuuuuuuagagaaaaagaaacaucauuuuaaaaaacccgaccaaggucaaacuucauagggagagacaugccgaacacugacauuuauuaugguuauuuuagauuuauaauacugucucauuucaucagugaaauuggagagaaauuauuuuagcaugaucgaugcuucuuaguacacuuagugggugugcuuaggaggauaaugaugcuaucuuauuuaagaauucuucccaagaucucccuuucuuuuaaacuuaucucgugaaauugaaauuucauuguaauaucuaguacuguuucuaauaacuggguggacugacugcccagaaaccuugguguuuauggagcaccaauauguguuucaugcuuuuuaguauuuaggaaaguagagaaauuggaaauguuguaaaaaaaaagacuacuuagaagauugcuuaaaagaacacguaacaggguuuuuucggcauuagaugaaauggauaaaccauguaagaauuauugcuauuaagggagguuugggcuauuuuauguuaguucuaauaagauuugacuuuauuuguuuuuucuuuuugagccaauucuugcuagguacccaugauggccugagcccuucaguauggucaccucagccuccugagugggacuacagguguucucauuacacccagcuaaauaauucccucacuuccuccauuacagcgcaucuaauucaugacacuugucuuauaaguaaaucacacaauccacuaggcauuguuguuaugcauuccuaguuacagaauuugcuuucaauagcagucagucccucagguucucacacugcuuggggguauuuuuaugaacucaccacuagugacuuccucucuugaccuaccuguuuuucuuuauuacacaacuggguuaaaucuggagcuuucuacauuccaagucaucuuuuuuagccuuccugugcuuaaagccucacagucgagcaagagcgaauuuugacagcucuucaagaugauucccauccgccuaucuaucucuccuuccugucaacacaccuuaaucagacucucucccgaugagucagaugccaucgagggcucccaacugaucuccuugucuuucucagcugccauuuacugggcgaaccgucacugaauugaccucucaggaaacuaaaauaauccguaaggacuuccauuugauugggcagugaaguuuaaaugcccgagggcuuucagaguuauuauggaagcuaaaguuauagcugagugaugcagggcaugaugggcaugugugaagcccgagcaucuauccucaggacuaaagggaaugaagacauaaggugauuaaacgauuaaaaaaaguuauaaaaaaaaaaguuauaaaaaauauacauguagguaaggcauuauaaugaaccucugaguaucuguccacaauuuccagcucaugauggccuuguuccuucuucaaugcuaccauuuccuacgcccugcauuaauuugaaggaagucauggacauuguauuacuuaauuuguauguauuuccgaacacaucacuagaagauaaaacauagaagcauacuacuauuagcacaccucaaauuacuaauaauuccugucauauaccaaagcuuuuucuguaaauggcauauguauauacuucaauuuguuugaaaacaggauuucaauaaagccuaugccaugugaucaguucuucauauguaaacuccaagacgccaagccuacaucuuuuuauuuuuauuaaguuuucauuugcauuugcaagaucaugugaggccacuuucuugggccuuuugcugugcaggcccaagagggugagcucucauuuuuauauagacaggaagacuucaacgaacaccucuggauguauuugguaacuuaugggccuuugaucuauagacuaaaacaaaucaacauuucacucuuggauucucuuaguugggggggaggggcagucucuguuuuaaguccaaaaacacauaucccaacaaagcaagacacaacagucccucuuucagaaugaucuugucaaucuuuuugcauauucgcuuucaguguucucucugaagacuugacuccuguccccuuccucacgucccauucuuguauuuucucccagaugugaucccuugcauaaaaccaacacaggcuuuuuagcuagcuggaaauuuuuaaaggugugcauuuuuaaagguggcccaugcacauucaaugauuacauuucucugcaucuuucuucuuccauaccuuuaacaacuaaggaaggacagggggaggcugaaggugaauaacagagaacagaucaagggcaaggcauuaacuggacuguaguggugcuugccuuuaacuauuuggcucagcauuuggaggcagaggcagacagaucucugaguuugaugagagcuugguuuacagauggaguucuggaacagcuagggauaaacagagaaacagaaaaacaaacaagcaaccaaaaaaaaccaaccaaccaaccaaacaaaaaaaccccaaaaaaccaaaccaacagcaucccgcccaaaaccccccccccaaaagaaaccaaaccaaacaaacaaaaaacaacaaagaacaagacauuaacaagcuugaaaccagauuauuuuuauuuuuaucuuauuuuuuauguguaugaguguuugcuuacacaugcaugucuggagcccauggagacuggaaaaagggugucauuucuccccaagaacuugaguuauagagguagcuaccacaucagugcugagaaucaaaucuuagaaucuggguucucugcaagaacagcucuuaacuacugagccaucucuuuggucuugaaaucagauuaugaugugaccauacuaagagcaugcauucguugcuugugaauuuuaacaauauaaggaagcuuugauuugcuuuugagguauuugauuugaauaggguuuguguguguguguguuuguauguuuaaucagcuauucuguucuuguuaguguauuucagcacuccuuauguuacuuuauaaacaaaaucgggaaugacagacaucuagcaaaccaugggaggguuuugaugaaagccaaugcaucucuauugcgagauuuccauaauuucuaguuggccucaguuaucauuugagguuugagggcuugcuucuugucccugacaaaauaccuuuccugugcccuguuucucaguaguuucaccccagcuguuuuugugguucuuccucucaucugcuuccucuuuauccauccauugauaccaucuccuucagcaggacagcacuuuuagauuucacaccucaaacuguguucauugggaggucuaccuuggcauaggcugacaugguuuccucugaggauuaggucuucuggagaccuugagaagggaggaaggagacagugggucucuaguucaagagacaaaugcuuuccauuuuuaugggccuuaaauggaaaacacugcuggggcuaaaguguucuucaagaauauaacaggaagggaaagcaaauacgugugcacugagcuaugaugauaauccguucuacuagagacuugagguuuagaaaccacauucucucacuucacagcauguaagcuauuuaacuaauuuaugcuggcaaugagagagggagggggagggggagggggaaagggagggggagagugggaggggagggggaggcggaggaagaguagucuuuagcuagauugacucauacuugguuuaugcuggccuaagcagucaauaucuacuuuuuuagagacuagcugguuuucuucucuccccccacccccauuuuaaguuuuuagacagggucacacuggcuggcuucaaacuuaacucagggcaaagguuuugagucacacauuauuaugaaaaaaaagugagcagaggcagacaugauggcaccagccuguaaccccagcauauagaagaaccaucaagaaaaggaugaguuugaagaccaagaugucuguucccaacaugaaauauuuaacaauauuaauuuuuuucuucuaaguauuaauauuuuacuguacacauuuaccugccacugcaauauuucaguaugcauauacaauuugugcugguggaaucaggcaacugguauuuccuucaucucuaacuuugaaaagccccaaaucuccucuaauagcucuuuugaaauaagaaauuaauuguugucaaccacaguuauauuccugcgccacagaacaguucauuguuccuucuaccaagcuguaacccugugcucauuaaucauguucucuuaucaucccucccaacccuugccagugucuggaaaaugcuacucugcauacaguuuccaugacaucaacucuuuaagcuuccacagacgggugggacacaugggauuugucuuucugggcuugacuuauuucaugcaauauaauguucuccaguuuuguccacguugcccaaaauaacagaauuuucaucucgucuauaaauaauucucuaugugugacucauguuuuuagucuccauucaucuacauagaugcaugauauaauuucaugguuugguugccacauggaauauggcagugaccaugggacaucuuggauacacugauuuuuuuuuuuuuuuuagaguuguacugaggaauaggaucacugaguuauauggaaguagagcuuuguauauguuuuugcacauaucuaguguuaauucuuagacacuucugucuuugacuucucuacacuaggauguuggcugaacuagguacuugcuuuuguauugaguaaaggagagaagucaaaaccaugauauacauaauugcauauuuuuuuugugauaaccaacuaaguauuuccuggucaauucuaauuuuauaauuagccagaagugaagaaauauuugauuagcuaugugccuuuuaaaauuuauuuucacaguuucuaugcaccuaucagacagugcugggauuaauaauacacaauuagaauguuucacucguagguuuaguuauacucaguagagaugaguuuaggaaagccuguuauucuauacauaguuauuuuagaaucaaaggcuguuuaaaauguuauaugaacuagcuucugccuucuuuucuauuaucauugcacgauucugacacccacugacccuggagguuuguuguuggacuucugggugaaucuguuaugaagcaaauuaaaaacugugaacucucauugggacugaugaauauccaucugcucauucucccagguauucccucggagccacuauaaugcauauaguguuauacauauacuuacauauaaacuacuauauaaugauuuaaaaauuuuccauaguucuuuauugguuacugagaaaauagagaggguaaaggguuaacuuagagcugguugauccauugugaaagcgagguaaaaauucaguuacuuucuuuugugcucuccccagccauguuaauguugcuguuuauagacaucaguuacuaaaagauucguggaacuucaaaccccauuacugcgauguggucaaaucaaauggaaucuggucuggggcaauggguuuuguaggcuuuucaaggaaccaagaggucaaaaguauuuucauaaugcugagaccuguguuuucuccguuugcuauuuucaguguacuaguguuuacacuggguagugcacgugugagucaagguaggcagcaguccaccagaaauagcucuagucugcgcuccucuguacagcccaggaaaacacggaguaagugccagaaucucucaagaaccaccuuggagaagugauaccuguauuaaaugucugccuauaaguacauacuuuuaaaauaccugagugacaagaugggaagacuguguacagccaccucaaggguugcaucucaaagcucaguuguugugcugagacaguaagacaacagauagggaaacauggaagucuggcuucaguacaguggugaguauuaaucauagcguggacacacguggacacagucuucauuuuuuucauuaacagugauuaaguauucuuucuaagauaggaagugcacugguaagacauaugaaauuagucaugcuuaguuagcacaaaaagcuguaauaucuaugaugguaaguaagcccauuggaguuacuagcaugaggcacuguggcagaccgcugugaaaaucagcucauuucuuuuuguggcaucugaguuauccucuuggaguuguucucuucauuuguauguaaugcuuaggcccauaauaaacucaaugcugguuuggauugucuuaaugcuuaauacaucuaugauggaauaagccuugcagcauuuugaaaaaaaaaauagcugguuauaaaucaggcuuuaaugucuaagaagcacagaaauaaacccaucuuagaaugggagauccuguauauaguggauggaaaaacaacuuugaaagcaaggccaauucagaaagcaaaaccaaaauguuuucaaaggcuaacagauaaucaauuugucagaauuaguuacuguuuuaauugaguuuuaucaagccaaugagucuaggcagcugucagauuugucucgucaacucuagccaugaucagaauagucugagcaucaucaccuagucugucuuuauucuugucaauuuucuuuuaauaaauucgcauuuauuaagaaaaauaaaauuggcaggaauucuuuguaaauacuaaauaugaacaaacaucacuguacaaaagaccaguuuucaguggcauuguuccuucagauguaaacgaacaggaguuuuuguuccuuuguaauucuaguuuacguuaucugaaauacugccucauuucauuugagggaugcguuuuaaggagauucuucuuagauuagguauauuucauuuccaguuuaaauuucuuaauauaaauucuuaaggaaagcaauuagguuguuucauccucauuuuguuuauuuuuuuaauuuuaaagacauuucacuuauuuuaaguauaugaguguuaccacccauguuccugggacccagggaggauagaagagggcauuggauccccugagacuggaaguauauacuguugugagcuacagugugggugcugggaaucaaaccugaaucuuuuggggaagcaacaguccucuuaaucccugagucaucucuccaggccuuucuuccuggguuagauuucucuacuuaauauaaauugggucuaacaaaucagaacuucacaggauauaaaaauacuugucuuuuucuguuuguuaguuugagugcuuuuuaaaacucauugcaggaaggugggugugucucaggcagaguuuauuuuuaugcagcucugcuuguucaaauuauagaaagugaauuucuuucccuaaaaauagacuguugguugccuggugccuuuauccagagccuaucugugagacagugaagcuuuuaacauuguauccuaaauacaucacagcacugaacaucguacagagaaaugacaccaugccuuuccuugugaaucuguaauauggaagaaacuagagauccauccucgacuugaugcacgcugguagcgauuucaacgugaaguucugggguggagguggauuagagcagcccacagaugcaggaacuuuaagcccgugcuccuuguuagauguuagacacagaagacuauuguuacaucucucaucauucuucaacugcccugcuagucauggguacaugcuuauuuguugucauggcagcacaggacacagugaaauccauggcuugcuuuaugaugugacacaguucccaagugguauagguacaggauaagggagaacacauucucucucccccucgcccccgcccccgcccccgcccccgcccccgcccccgccccucuccccuccccuccccuccccuccucuccucucuccuccucucuccucuccucucucuccagaauuuugcuuucuaugguucccugaagaagcugugcuugcauuagcaagcaccacggaugcugugguguuuguccaagauuucucuucccacgaugugguguuauuuccuuacucauuagaugguagggaaccaacucugauuccauuuguagcacugcaaauacacacagguuuauauaggacaaacucccagagcacauuuucccaggugaguuucucugacaacuaaauaagcccgaauguuuugugucuucccaugcccggagugcugccagugaaugugauucugugucucuuuuugccuuuuaaaaucuuuaagauaauugucgaaaguaagaucuauuuccuaccugugucuuuuacaagcaagugagauguucaaucaaauaaugggaaguuagaggaacucugccaggaaacugccagccaaggaaaagaauuuccuuuugagauuuccauuucaccugccuguuaugcugaugucauguaaggcauuaugguagauuuucuaccagaugcagaauucaugauccaugguuagugcaguuaaacccaaagacagauacuagccaaaaguaaaggacagacauagaggcagcugguggcuugcuccugacaguacuuuuauaaguuccucuccucuuggcauaccuaccacuuuacugugcucucaguacaaggcacugcuuuguugaaggucuguacauagucaaauucaaauugaguuacaacauuuugcagaguugauucauuaagggcuuugcacuacaaugugcuagccuuuggguaaaucauugagcagaauuucuguuuaucuacauauauuuucuugaauaucaagcucccucccuauauuugauguuuucuuuccaaaaaauggcaguuguuuaauguuugagcaagguguggugguacacaccuuuaauuuuagcaucugggaggcaaaagugggucugucuucuauucugcaaguuccaggacagccaagguuguauagacagacucugaaucaaaaaguugaaacuaaaaccaaauaguuugauuaaggucaguaaggaucuuaagagaggagguggggagauaauuuugccguugguacaguguucgcuaugcaauuuucaugaaagcauagcuuugcauuuuuagugcccauauaaaagcauggcaguggguguacauuuguaaccccagaaaggggaaugugggucagagauagaggcuuauaagccagccagccuugaccaaucagagacagaaggaucaucagccagccagccuagauuaauuuaugagcuccagguucaaugauaguuuuuugucaaacacuaaugggggagagugacaggaaaagacacuugaagucagucucuagcuucuacauucaccuacacauaugaauaaguauaccuacaugcauaugugcacacacaaguuaacaaacauauauuuacccccuucacaaagaauauuaagauauugacuuauuaaacaagaaaugcauauaugcacaccuauguucaugcacaccaguuaagaaugaagaaagaaaaauugguggauaccaauaugcaggcuuaucuaauuuagcugguuuaugccauaacauguggaugacgggaguucacuguccguguugguggggacauccucaugauacucucccuucagcuucccagcaugcuuugcuucaguugucauucuuuuaaugauuucccccgauguccugcucacuguacuucugcucuuccaguucaaugugagaaaauggcagaguuuucagauaaauguauuuucagauuuuucccaugggcauuggcgcucuaacuucuauuggcuucguauucucuuugugucuagcaguguauucuaccuguacuguuuaggaucucccaaggacccaggccacuucagaccagaccaccaaggacucaggccacuucaccccacuucguaucaguccacaacaccaaugcaaacagugccugcuagcaccauuagaaaugcccauagcauuuuuguagaacaguuuuguccacugaguguaaugaaguauaucuucuccagcucaugccaacugacucuuuaaacucaaguccuuuuuccuugcuauucuggccugacguucuuuguacuucugcugagacucuuguaaucaauacuaauugcaugcagaaucauuuaccauuuuaugcaaaugugagcaaauguuuguuuugcguuggcugggagacaguaccugaaagauaaaaucagcacagaugagagcuuggugcuuugaugacagcuuacacuuguggauuagaauccugagcucuaugcuuugugagaagaggggagcccagaggagucaccugucucuuccucauagcucagugucuuuuuaauuucuguugcuuuguugggacauugccugcaauuuguuguuuaaucauguuacuuugaaggcaaugaugauaugaauaaaccaacccaagcccuugauggaccuaguuuugaacacagaccuggauagggugugguuuuugucuaaaaaggagcugguuuucugcagacaucuaaugguucuucagagccacacaaugaggcagagguuuccuugcuuuagaagcaauaagagaacagaaguuacuuagaagauauauuuuuuuccuacagacaaaaugauuacuaccaaaggaaaauggaauuaagggaaaacgcuuuugaaggaaauauaucuaaaaauaucuaucccaucucuuuaaaaaaaauuggcaggaacaccuggauuuuucugaguguaauuuuaguuagguaaacauugaaaagauauauuuuucuaaaaaaggaaagagugcuuuuauggaaaaugaugguuggcaguucucuucagcaguagacugcuuuugcaaaaaaagaagaguuuuccuauauuauagaauaagaaaguaugaauucagguagggccagugacacgcuugggccaggcugacaaaggugccuuguaccaagcuugaagaugugagcucugucucuagcacccauauggugaaaggauagaguccacaucugaaaguuguccuuugaccucuagguguggaggguguccugcacacacauacauaccacaugcaugcacccaaaauuaaguaaauuaauaaaauaauaagaauucaaacaaacaguaauggugauuggcauccuuauugcuuaccugaagacauuuagccacaauaggcuucuuugcaggaugcccacuuaagaacagagacagacuggcacugcgggcacuuuugcaaugcuuaaguguuuugcuuuaaugugugcacugaacaagcacauuaaaauaucaucugggguucacagcuaugcgcgaugugcuuuauuaggcuuuaaaaauuggcgcacuaucuugaaaguacacagaacugcauuuggcaaacaccuaaaccagaugacaagcagauaaugcugacuuuuagggacuuuaagggauaaggguuauaccaauauccuuaguauauugaaugguaauucagagaaaacuaugacaaaauucugagacgauuuggagacugauuuuauagcuacauaagccauuauuauacaagggcaaaaauauaagaaugugcaugacucuagccagagagcagcagaacugaauaaaacacauuaucugaggccuugccuguacaugccuaggcauacauaggcauacacuugcacacggcaauguauucaccaaguacauguuugaaucugaauaccaucaguagccaucauuucccagaagaggaacuggucauaaauaccuaucaucagcggugguguuggucagacuugccuagcacagcaggcugucagagaauuggugaaaucaucagaauaucucaugauucaaaauuagauuauagagaacauuuuagaauacacuguagaaaacagucagaugaggggguggcaauaaaaaauaugcccucugucauucucuccaguuucuaauuacucaugcuuucaugagguuuaaaaauaucaacuauaaaauacaauuguuacagagaugcugacagagcuuaaauccaugagagcuuaagaucaaacaugaauucauucaacauucauggcuuucauuauaguuuggaucauaauucuccccuauguucugucuccuguguuaaaggcucguggcacugcugggagauagguauuggaaucuuuaagagggacagaaguagguagaucucugaguuuaaguccagcuuggucuacagagcaaguuucaggguagcaagggcuacacagaguaauacugccugaagcagcagcagcaacaacaacaaaccaaaaaaaaaaaaaaaaaacaacaacaacaaaaagaaauaaaaaaaauaaguucauccuuaagaguuaaaaucuaaauguuuauucuaguauagucaaaaaauguuucauuucuucaugaguguuaaucuaguugaacaugaacauaugauggugucuaugaaaacugaccucuagccaguuuaagcuuggcucaccguuuugcagacuuuagucccuagcuggcugcccucauagaguuuggacuucuggaaaggcagugguacagggaagaguaagcuaagaaucaaagaagagcaaugagggucuucaucccuuucuguggccuaaauggaucacuuaagaccaccuacugagucucaucuuucaagguuucuaccacuucaacaguguaagucugggaacuaaauuucugcucuaugggccuuugggggaagcauuuagaucuaaaguaaagacuguaugcccuauuaagugugucuaaccuguggcacagggccacauacauuuuaggauagcugugacugugguccaacauguuugcaaauaacaaugucaugcuucagcaucauaaucuuggacagcccugccuguuagggcuguguacaguauuucauuaaucuuucuacuaacugcacaacauaaauaagucauagcaugcaggugacugaacagagucagugacaugaaggaaucuauacuagguugcguagcuaucagguguaagaccagagguuugaguuuaggugacuagauuccugaguucaaguuuacuucacucugauuauccaauauaacuuuuuucuugaucaaaagaagugacauuaagcaauacucuagucaacuuugcaacuuuuuuuuucuaguucuucccacuauaacaaaccccuaaagucuuuauaacuuugucacauauucagaaucuagugauguuucauuguuggaucucauaccuucuguagaguucuauuucagguuagcuacugcaauacuacaguccagcacaguagacuuuauaaccaguaaaguaguaagaaucuguagggcccaaucccagaaagaaaccaagagcuagucccugggucuguagaaauacuaugcugucuucuccuuccugaggaagucagagauucugcuggccacauguuugcaugugauucugugggcacuguggcuaucaagggcggggucgccugaguuggacgaucugcuguuagcugaagcuggaacugcuuaggacgcugugugagucagagggcuuugaacuacggacuuauucuagcagcugcuuuucauuaaagcagccuggccugcauggguucuggcaggucagcuguucagaaagcucccaauucuuuggaaauguucagacuuucccaagcuuuugcucagcaucuuggauuuuguucucauuuccauuuuuuucagauuuauaaucgcuuggauacaaauugcugcggauuccgaccucgaaaggaagaugccuguauacagaauggacugcggucgaacugugaggaccaaacuucugugacguuagcacacauuauccagagaaagaaugacccaaggcauuuggucuucauaaacaauaagggcuucuuugauagaagcgaagauaacuuaaacuuuaaguuguuagaaggcauccgagaguaaguuuuguguucauugugggaagccuaucucacucucuagaguguucugaaauucucuguguagcucagacuuuucugaaacacacugucauucaagcugaccucaaacuuacaguucccuuccugcuucagcuuucagagggcucagauuacaggaaggagcuguuacauccaaaaugaagaguacauuuucuaauacagugacaucuuggaagaucacauguuuguuaacaaacaguaauguuuugugaagacucacaucuuauguuagauauauuuaauuuccaaagaaacucuaagugugggaauagagauucccaagaagaaaaauagcauuccaagagcagacaguacaucuaugagcaguccacaacaccuacacagcucuuuccacagucugccuucacugccagguucaacuuucauugugaaaaccaugugggugagguuggacaugcgcagggcugucaggaguaggauaaucagauggcagaggcuuucuuaugagagcaggggauuggacauggcaggaacaguacagaugucuaagucuguaauaaaguauuuggcaugucaauggaacuaauaggcauggcaggauguuggauucaugauuagcccaagugacuguuaugaauauaguaggaagguagggcaccagaggacagcuggcccuguaaacuggguaggagggcuuuugaguacucagaagucuuauuggcagacagccugugggacuggaucuugaaaacuacaaaggaggggcugcgggaggcgagacaaagaagagcuguuguacucaagauuggcccaaaacucagagaugacccaaaucauuugggagacauuugguaggaccuagaguggaugcagaguaaagagggagguagcaugaagcuaaaggagauagugcuauacuggggaaguaagaacacagugggucucauggcauuuggggauagcggagacucuuacagauggccucuggugggggagcaggggggaggguguuggggagccaggggagaaggacucagguuucuuuaagggacuagccaugggaaguuugaccaugcuccagugaguauauggguaacacaaauuggauuuucuuucauuugcuucuuccauuuuuggggaggcggggaaguucacaagggugggagggcagagcuggaaggauugggaagugagugugauccuggugcgugcuguagaauucccaacgaaucaauaaaaauacuauguugaaaaaaacaagugcagcaggaccuggcuacaaagccugaucagucccaccucaguuauggaagucaugaguaaaucucacagccaguagagccacccucauaauaaccccagggaacuagguuccauuggaagcuuaagagcccacaaaauagccauagccacccccuaagagccaaacaccuggaaauaagcccaauauaacugaaacuaaugguaaaacucagcccuuccaagccuaugccuacuguuuuuuuacuuuuuggcaacuuauguuuguguccuacagugauuacucuuacugucauguggcucaguguguuccauaucuacauuucaaucauuuccccucaaccuuuguacuuagauaaaguggauuuuagaaacucucaacacuuuccuguggguuuugagagugccaagaggguucucuccccacacccccucccccaccccaccccucauccuucccuguuggugugcuuuacagcucugugaauugaaggcagaauacacuggcacauucucucuuuuaaaugccuaagccaaggaaaauuuaugcauagggaaauugacauuccuaagacaucauuuacuaaauugauauuacagggacuuuucuuugcagaauugagagugccgagggcaugcaucuaucuaucuuaaacauucacagaacuaugaauacuuuuauuuauucuuucaaagaagauugaaccuuaacugcauuaagggguauaauguguuuaagguuaaaacuucuuugacuauauaauucauacauuaauaagcaagagugaagucuuugcuaggcucagagccacacauugacuauuucccuuaaccaaugcaauguaagagcccuuagcagagcaauggcuuguuuucuuuuaugaacaggacuucuagucacugaagagaaugggaguuuugaugcucucaucucauguauucugccuaagcuaacuuggcugaagggcuauagaauuaauaauuauggauauuacuacauuauauaguauaacauuaagacaucgcccacaagacugcacagcacauguuuuuaggggacccagagcacacacuaugccuuauuuaauuucacacuccugagauucacucuguccagcucaguaaccuuuggucuccagcaucaccagaauucuugaaccugggucccuagugucuauauguccuaaguauuguccccaagugugucuuuaaauaagugcauguuuuugcccuauaauuuuauaggugcaacuauauuuauuugaaaguuacucuugaaccccagcgauuauaugguauaacacuucugugagcuagaggaggccaagcugaaaguguugcagaauauaaccuaugacuuagauuagacauuuucuaagaccuuauggcacuauacaugcuagacccuggcucuagucuuccuacauugaaaaaaaaaaaaaaaaaaagcaaguucagugaacucucaaugguucagccccggguucuucuuaagugaccucaggguguccagugagaugucauugaauauccuugcucuaaaaguuuaauuuugcugaauuuauuugagaacaacugccagcuuucuguuacuguaaguaaugucugaggugauugucuuacaaagugggaagauuuacuguagcucacagcuuuaggaguuucaggacauagccaccuggcucugcuuccuugaucuuucagugguacuguacacugugguaguacuaaaugccaccauauuucugcuagccauuucuuuccccguaaccaaugcagugucaaugccaauaguaggauaaugcucuguuuucuuuuaugaacaagacuuuuauagccaaggcuggggagguccuuuucacgggugaucagcaguugaaagagaaagagggagggguggaacccuagcauuucuuucaaggcaugccucaaugacaccaucuucuacuaugccucgccuccuaaaaggaccaccauuccccaguuauaguaucccaaggacuaagucuuuaaugcauggacauucgggagacauucaagauauaaguuagagcaucauuuaauacucuacucaggaaaacacuggccuugugccuauccauuugacauguuuauuguuguccuuacuuagcucaugccguguuggcaagacaugggugcaaacucccugguccucugggccuuacaacacaccucucuccucuucaguguuuccuaagccccagaugugggaguuguuuuguagaugaauccaugaggccucaauucuacaccaagaauuacaggcaacuaaaaaaugcugagagcuagaaaaagucuuauccagggaagaacacaccaaguggcuauccaauauuaaauugccagcccuaaaagcauacauauaaguaacaauauauagaucaguauauagaacaguagauauauaaauauauauuuaagaguauauauucaugcaauaacaaauaauacaaaaagaggccacaagucagaaagauaucaaggagagguauaugggaggguuuggagggagcaaagagcagugaggaaugauguaauuauauuauaaugucaaacauaaaagaaauaauuaaaaacuaaaaagaaauccccaaauaacaccaaaaccaaacacaaagcaaagcacagacaaucucucaaguuccaaaaguauaaucucaaucagaggggauucuuccucgaauugaauuuucuucuuaaauaauuuuucuuuuguucuaucaaaagucuguagucauugaacuuuaaaccauaacugcuguucagggaggacacuucgcugaaaccacacacguuuugcuucucucgauuuucuuucaucaaacuucaccuuguuacugaugagagcagacaaaaggcuuucuguagcuuaagaugaugggaaauacaucuucagaccuaaugugaucuuaauucuaugccucuauuugccaaucuuuaaugaccuuuaaguaagaaauuaggaugucacguucugaauggacuagauaauucgguucauuugaaauacauuuuuucguguauuuuauuuucaugagaagugucugcuugucagugacaaaaacauuuugguuuucuaggucucauuugauagugugacuuaugagauuaaggaaggcagagcaacuggaaggagaaauaauauuucugagcaauuucuaagaaugaaauguuguguucucguuucagguuuccugaaucugcaguuucuguuuugaagagccaacacuuaagacagaagcuccuucagucucuguuccuugaucagguuuauugggaaagucaaggaggcaggcaaggcaucgagaagcuuaucgacgugauagagcggagagccagaauccuuaucaccuacaucaacgcacacggggcuagaguauuaccuaugaaugaaugacaaauggcuuucugccuugagggcuauacaugugucacauuugguuuuucuuaaauaaaagauaucaaccuuaaguguuucuagaaacgaggcagcauaguugaauacgugaaacugacgcaguuuauaucaugaacugaguuuaaaaaguuuguagaguuuagagguaugcagauucaagaaguuucagaauaacauauugcuugcagaaugccuguuaauauauuuuccuaagacucugguauguuugucucagcauugucauuguguaaugacccaaaugauuauuccuacugauguuuaaaccauuuucauaucauuugacggaacaauauaaaccagagacacuggcucuucuaauaaaucauucccaugccauuugacugaccugaccagcugcuagaaaugaguugaucggcauucucucauugcugaugguugcaacagcuuuuccaacacuauccagaggcaauucuacaucacgaaauugaggcgucugaucugcaaguacaacagucuugaaacaccuucuaaguagacauggaaguagauucguuacaaacgaccaguauauuuucuagagucuaagauaaucagcuaccucugaacaacaaaauucuccuauccuucccuuuuuaagaaauuuauugacagcauagacauuuccauauaugacaauugauguauucgauuugcugucucaauuuugauccaauuuauaucuugugguuagaaaacuaaaaaguuaugaggcauguugcuaccuguuugaaaauuuacuuguagaaucccuuaauauucuuauugguugauuggcuuaaaaaaaaguuaagguuucacauaguccaggcuggcuuugaacuccuuacgcaucagaggaugaccuuggucuucugaugcuuugccacccaaguguugggauaacagacaguauaugacaccaugccccguaguacucaggaucaagcugggucucugucauguuagagagacacuguaugacuaagcccauaaccccagcccacuuuuaaugaauauguaacaauuugucauuuuauaaaggauauacuguaauuucugaaguuuucuuuuuuguuuuuguuuuuguuuuuuguuuuucgagucaggguuucucuguauagccuuggcuguccuagaacucacucuguagaccaggcugaccuugaacucagaaauccgccugccucugccucccaagugcuggguuuaaaggcaugcgccaccacugccuggcugaaguauuuuuuuuuaaucauagaggacuuccuuggugcaauuagguuucaucugauuuaacugauauuaucuagguauugacgauaaguucagauauuaaauauauuauguagaucagcucaauacaagaaguccuaaugaaagccaacacucaugacugcaucuucucacaaagaacauggauagagagcauauggcaacuaauuaggcaaaauuaagucucaacuaauucucccccaaaucccucuaccaaaccuuucgugggcuuggaggaacuaaggcacacaaaguucaugcucugagucuuucuguccugagagaauuugccaggccaucacuuauccuucuuauacggaaccuuugaaucuagagcaaauucugucucucuugcuuucagcucuacuaccgcuuauuugcaaggucauugauuagccagguguagugauacagaccugaaauccuagcacccaggaagccguggacgguuugcaagucugaugucagucugguguuagugauaaccugucugaaaugugccucucccuucauaaaaacugauuuacugacuuuuucuucuuuuggaaacuuaaaaaaacuaaaauaaaaaguuacacauuuuuaucauacuucucaucuccuuguuuucaguuuuguucuuaaugcacacaucuuccgucuucugaugaaaaauaauuugauauugaugugaacuuuuaaaaacauaccaauauaggcuacaucauaggaaaaaauaccuguguagauuauaauugauacaaauacaccaacuugucaaacuaguaagucuaaguguuagguauaagagaagacagacgaagggaagaggcacccacugaugccucuuguuucugcuuuccaaggcucaugaccaaggacugcaucuuccauccuauauguuuccuuucccuuggcguggugaacuuugucgcguucucugcaguucucuccagugugaccugaguaugacugugggcucuggugaguccccacaauggcugcucucuaugaguuuugucucacaaaucaucuuaauuaucuuugugagcacuuuuacacccccacuugaccuugaauuaaaagauuucugccaaguugucucaugccuuaucaagacgaccuacacauuuaucuuaauacuuuuuuguuuuugcagaauuuaccauuuuaauucacauugugauauuaauuacaggcauucuggcuuuuuaaaaaucuugcuuuuaugcucucaguuaggaugcuucugagcaagcuggccuccccaagaugggucugacccagauggguuuuugccuaguuauuucaacaugcuuaauucuaagcaaaagguucgaggacauugcuuauuuuuauaacuuuuguuuuaaagauuuauuuuuacuguuuauuuguguguauacauagguauacacacacauguguaugcaguacucauggaagccagaagaagggcaucggaaccucugaagcaauugugagcuaccugacuuggggucuuggaacucaacuaagguccucuggaagagcagugcaugcucucaacagcugggcaucuccccagccuuuacauucauuuuuaaaaugauuuauuuuguuuugcaaacagugaguaauugauggugcauuaguuuugacuaauaacuucaggccaaacucugauuucuaacaagcaacauuuuucuuuuauugaaacgaugagaguguuuuuguauuuccgaugugcuaaagaaaaccuacugugauuugguauagaauaucccauuacauggcuuauuugcucuaacagauguaaauagaagauaagggcuuauucuggugugaccugcuuccuguuagcugaugugaaaacacacaugugucucagacccugucauuaaaugcuacaaauuaaauucguguaauuuuuucugauacacgaguuaguuuucaaaagagaauacagugccccuccccuuuggaacaguccacuccagucugucucugcuuuagacagacuuuagucuuuguuuuuaugaccaaauauucuguuuaaacuggaaaacggaauaaacaaugaacuucaaaaggauguuuguuuguuacuucaccaguggaaaaaaagaggcaauuuagaagucaagaugccugccugggucgugugugcaggcaugugugcacgaauuugaugucauaauucaugaucacuaugcuuucucuccguguacauauagcaucguacuauaggguuggcaaaauaauuagcuagcagauuucauuccucuuaggaggagauuuaauuuuuaguuagcuuuccaugguugcugcgagccuuacaguagcuugagcucuccuuccucuuacuccucuuuaaucagguuguuaaguacuuaggaaguguaucauaguguacaacauccuagacuuauucuuaaaacaauuuuaucuauggacuugaguaauaauguguuuauucuacuguaccuuuaaauaugcauuacauuauauguaacgaauaaauuauuuagauagaaaguuauuuucauguugucuuaugaaauccuaauguuuauuugaaugcagacuauuuaagucacauuuaauguacuagucugaaaaacauguugaaaucauauauauaugaauuugauacuucugucucucuuuuuuucucucucccuccuucccccuucucucuuuuguaaaauaauaguaauaguaguaauaguaauaauaauaauaauaauaauaauaauaauaauaauaauaauaauaauaauaaguaauauagccaagaaccaggcugggggaguccaggguauucaguagacuguggcaccgugaugcuuugaguuggagcccaagcaguuggagucucacuggagaacacagcaagcaccuugggugcuauuuaccagacugacucuucugcacugauguguguuagagacacugaugguguguacuugaauuccagcaugcaagaguugagucagacugacuuuaaguuugggucagccuggacuacagucagacccugucucaaaaacaaaugaaaaccaaaacagaacucagaaagcaagaacuuucacuuuaugagagauuuuuuuuuuuuggacuuguuagaacacuuaucugaaaucagaaauaguuuacugugacuuuggcauguucuuacaauguugggccugauuuucuacagaaugacuauugagcaaaauuuuagggaagagauuauguuguagacucauguuucauagaaauacaaguuuuuccugguucaaaaaaugaauguaaugguuaaaauuuauuaccauguuggacccuuuuauaucuauuccaaauauuuuauaauauggcuuuuaaauguuuagcuuuagaaauauuuuaaaauggaccuaccacuguagugaugcugcauuuauuguuaugauaaaauacuucacaaucaucuauuuuuccuaagaaucacuuuuaucuuuuggaaaauuuugcuuuaauaaacuucuaacuacugcuguauacuuuuauauguuugaaaguuauuauuuuaauuuugaaaaguucacuuagucaaacucuuaggauauaauaauauaauuuuauaacugaaugguuucauggauuuauuauuuaucuaacucccacccuggaaauaaacauuua

SEQ ID NO: 1467 - RNA, 336 nt, Mus musculus
ucuagccguccucauccucgucaguauucugcuucuuggugucgacaucaucuuccucaucauccucagcuacccguuugcccguaggagccucagcuuccucaccuucaucucuauucucuuccucaccaucaccuuccuccuccuccuccuccuccucuuccuccccaccuucuuccucuucuucagcuaccucauuuucagccuccugcuccccauuuuccucauuuugacuguucccauaggcaggugcaucucuuccauucucuguuuccuccacaacuucugucuucuccuucaaguccucgguggugaugcgcgcgcgcguguaugucu

SEQ ID NO: 1468 - RNA, 336 nt, Mus musculus
agacauacacgcgcgcgcgcaucaccaccgaggacuugaaggagaagacagaaguuguggaggaaacagagaauggaagagaugcaccugccuaugggaacagucaaaaugaggaaaauggggagcaggaggcugaaaaugagguagcugaagaagaggaagaagguggggaggaagaggaggaggaggaggaggaggaaggugauggugaggaagagaauagagaugaaggugaggaagcugaggcuccuacgggcaaacggguagcugaggaugaugaggaagaugaugucgacaccaagaagcagaauacugacgaggaugaggacggcuaga

SEQ ID NO: 1469 - RNA, 3248 nt, Mus musculus
ugccaacaugaaguauuuccucccuguguuuaacaaccagauguccuccaaguagguaaaaguuauuuuucaacucauuuccucaaggaaaaucuaggaagccuggcuucauauuggagccaucgggguauggaauaacaaugggauugaagaagagcugggguaauuuucacugggauagugcuuaucuaauacuugugaggccugaguuucaucacugacauugggaagaaaagauaaaaguaugcuacauucaaauagcaagaacaacaaucuaguagcuaguaacugggcaaaugguccuauucccuaauuuugagucauguauauaugcuccauuccaagggugcauauuuagcuccacuaugggacaaacauagcauccaauuuccacugaugacaucaaauuguuaaagaaacuaaucagcccuagucauagagaggagggggaacuugaaaacagaaccaaccucuuaugaucacaaauccagaucgauuuggacacuuugugguuggcccuuagaaggccuuuaugugaaucaaguugaccccuggcauugucuaagggaacuaacuguugagaaggucaugccuacagaaccagaggaucaucaacacaaagagcaacagggcaaucaaaacucaagcacaaccaaauaugaggguggaaacuagccaauguaaggaagugacacuuugggaagucaaaaaaaaaaaaaaaaagucaaaagaaguggcugcuauuccaagaaaucuggucacauuccagagugcucuucuuccaagcccaccuguuauucucaaacccugaaacccuaugucuaaaagucaaccugagaaugugcagaaaauagcucuauauugcccccuaguguuagcuagcacuaccucucuuacuuugaaaacuauuaaggugaguaguuccucuccucucuacuuccugcugccaacccuccaaagagcuaaacauagccagauccucugcccacagauuaggaaaugaggagacuauuuuuagcaucaugcaucuuaggaaugagaauggcccagcaucagauggcaccagaauguguguggccuggcuuagugaacucccaucuucuggggaugugaagcuacccaaguagcuagcuagcugcagccagcagaaagcucuggcgcucauugcaaagugaugauagcauguagaucaugagaagggacugcaaggaaaaagcaaaaggauacaaaaguagcaaggagaacgagggaugcugggacccagccacaggagaugagggaccagaaauagaaaggagcacucacugugcagcgauaaguugaagcuggguugcuauggagauuuaguaagaagcaauauuuuaaacuagacauuuauuuuguguuagaaaggacaaagguugguuggauuugcuuccugccuggguauagcugguguuguggcuccuuugaucucucaggucucugcaggcccuaugauuauagauagaucacuaggcugcccuuugaucagcaguucaagagccuuaaggugccacaugccaucacauuagccagagguaaggagcaagcauaccaagaaacaccaugcuauuacccuggcccagcaaugcauaggaaugaugaagagaacauauguauuuuuggacuuuguuuuaagauguguccuuuauagaguugaaauccagaugugaagccuugaagcaauauauauauauauauacauauauauguauauauguauauauauaucacuccauccucauuucccaacugucucuggcagucaucuuaccuggcuagugaaauugcauuguaaauagauaacaaaguaggaaaaacauguauauuucccucuuaaauagcagcgagaaccuccccuuguauuguaaacaggguauuuaauauuccaguuuuaggaugccuacauuagcauugugguuucaugugugguauaaaauuucuauuuacaaaagagucucaaaaaauggcuuuauagugguagaucaagagcaaaggaguuuagaaauugaaugcugugaaucauaugggguucagaggcuaagcaaauuacacccccgaagcuucccuggacuuaugaaagaggcuuuucuccagcucugugcaaucccagcccaggggaacucgcaucugaaaguuuucuaaacauuucagguacacuugaaagcugaaaguaauucucauuuccuaugcaggauuagaucgcuuccaacacacacaaaauagucauucaugaacauacaaaaaaauacaccaccaaaaggugaggguuucggggcacaaaggcacguuuuaaaaaaaaaaaaaaaguucaagagaaaaaccauaaccaauuccuuugaaaauguccaaguggccucuugaccucuguauuucucaccuaauucuuuauuggugccugccuucccauaauacaguguuucgauuaaggaauuuaauaccuuuccugaauucuccauucuuaacacccccccccauaccugcuuaaagucaaacuugccacgacucauucauuuugggauuucuucuuaaaggcaguucuuuuacuuguaacucuggccauaugccaccuagcaauguggucacaguugacuuuuccaauccuuuccauagcccaugcguccucuccacucugagguugcggggcacuucccgcucccucuacucagugagcuucggaaguugcaaacugccgaaaucugcccccaccccagaaagugcacgcggacucaggaaacucccaucugcagcgccagagacccgaccaucagcuccacgacuggaggaccccacaugccaccgcacaaugccaacccgaacgcacagcgagacgcgggaagggggaggagggggcgauacucaccguucuguuccuugucgcuggagagcugcaacuugcugcucagguuggacucagcccgaguccccguucuuuggccggccagggcagaugucagcaggaggaggccgaggaggagcauuuggcugacuggggcgagggcucacucgcggcgggcacuggggaagcgacgacuccaaggcucagcccagccggggaaaggcugcgcugcgguggaagcgccuggccggcucuggcagcagagaaucgcaggguaguuuccacauaaucccauccaaaaguuuuuccuagagcccucuucugugucuccaguuuuugaaaaggaucaaagcaaaaccuggaccugaaccaguuucccaagguuuaa

SEQ ID NO: 1470 - RNA, 4530 nt, Mus musculus
ugaugcgaaccgauggggauuugcaagccgguuccuaauuauguuguguguguacaaggcugcugucaaaacgcuaauaugaugucucugaagcgggaggugagcugcccugguuauguauuaccuuucccauagguucugagggauugacauuuuauuguaagaucuuuaguagagaaagaggagaaggggaagugagauaaguagaugucuuuaggaaggccggcagauuacaauccugggagggacacauuucaggagaaaggauuucuaggaggauaagaugcugagagcccucuauuagacuaagcuuggcucuggcuggcucucaacugagcacauggcaaaacaugacuauuaaugacuagcaaguacuuaauuuuccuccaucccuccgucccuucccuucccuucccuucccuucccuucccuucccuucccuucccuucccuucccuccccuccccuccccuccccuccccuccccuccccuccccuccccuccucucucuguuuuucuuuguagcguguuugugugugugugcacuugugugggcauguguaugaaggccagcaagacaucaggcucaguuacgccaugugauguuuugcuggugcagacaggugaaaggauguuuugugaagccagacaccugaaagaauguugaagcaggcacgugaacgaguguucugcugaagcagacccuugaaagaaugaagcagacgcaggugagauaauguuuugcucaagcagaacacgaaacacauggacggacuugugauauuuagaaagacuauaaauaugacccaacagacagugggaagcggcccuagcuuugguucgcccugcucugcccagucuucaaugaggacgcucuugcauugacucaccuugcguugugcuacugaucuucgcucaucauggcuuuguagagaguaacucggagccuugugguaacuucuggauugaacugccguugcugauuugugaguggcgauggcugaaaggagcacugaggauucguucccaucaugccauggauucaccgcagugcccugauucagguugcccggagcacuucucuuggcucccugucugugcagcuguuagaggcuccugggcagcggaagcagcacaggcaguugaucgcucuagcgcagacuucucgaggcaaggcggucugcgcagugcuucagggaacugcagccccaggaguaguacaauguggccguggagacaagcauuagaguuggacuuaaaccauucacugucuuaauuccgacccuacuacacacuuccuggaagacuaagaccccuugaauucugauggucugagcucucagaaggucuaugcagagaaaaacgccucccaggaauucucugugaauucuaacucaaagaaggugucucaaagaacuuucugaccuguuacucauuucaaaguggugaaaugguaacugcagggaaugaaaaccaccgcggagguccaggcuuuuaugacaucuggaagcucuugguuccauucuuggagaugagagguuuccuagcaguggacaguugcggucucuaaucuguccugugggugcaggauguauaaucaagccccauuuaaaguagauauccaaguguuucgaucuaaaaccaugagauuuuuuuuauggaaaaaaaaaaaaaaaggaaaaccaaaagcuagugucagcuacacuuagcagcugaaacacuccauucuaacuugggacaaccuugucugggugcaucucucuguagcuuggccugugcuguagauguugccuggggaacaggcucugacaacugugcccuucugcucaggucacuuccuacuggguugcugcuuuuccagccucgggcauccauccuucacaguucucuuacagaggaggaggaacaaugggauuuugauucaacauuucugauugggauuuuuugaagacauuuucugaaugcaccauuagagagccagcaggcgacuucuuuucaguggggcugugguuuagagagcacagccaaguguguucaagggcuccaguauaucuguguuuucuucacucaggaauguguuaauuuaauguguguuuccuuuggguggccuuguuuggaaaugguagcaggaaagggcugugagcaucauuucgaaggagaguuguuuugaaauguagugacaaacucauaaaugaaggguuauaacuguugccaguuggucauuaauuuuuuuuuccuauuggaaaagccagaugcuguuuccagcaggccuuaaugugggugauuugaagacuggaacacaucuguguuuuaacuccccugcugaccugggagauuaaaggugggcuuuucccacuuuugcuguaagaacagacuccuucaaacccguagaccugucugcuuagcuggccgaggagaguuuuagagguacaggcugagguuucuggaagaauguguucauccaagaguguuuguaaaauuaaauuauguauuuucuucuugggauaauccauuagccaacagguuaaugcaauuuaaaguaaaauuaagaauuauugaaggugucccuuuaguugcucaaaucaugaauuacgcgauuguuucaauccccggggauucuuccacccgucaguaaggaaggaacuucaugggaugccuuucugauugggauguguucagaauuaucucaccaaagggagaaagcaagucugugccuccugaaaccaaacuccgaaccucugugugauuuguuaccuagcaccccggcugggaagaaagccuuuucauuuucuucucagaccaucucuuucuaauccugcuuaguggaguaucuguuauacugggcagccuggcacauggaucgggucucauuuccuuagcugagaugggagagucuaggagaaccaauagcagguaucugcuugugacucucucuuguacucccguucucucccaaucccuuucuuuugaaugugugaugaucaaguaacugagaauacucuccuguuuuuucccuugggguucucacugugggcugggccagccuagcuaguguucuuauuugcuuuuaaagaaauguuggggucaacuccggggaccacaguccuccaacaugaccauauaaaaugucugcuuacuugcuaauaaauauguccucccucaugugaccguuguucccuucauagaguccucaugucuguccugagggaaguagcugaauacuuuaagacuuggaaagccaaaagucuaaguguagcaucuuuagaguaaaauaaaaucauuuuuuuucaggacucagagcagcagcaucccacagcuugccuggccacaucacaaugggggauuuucugccuggcaguacccucauucuguucugucccaagcuuugccucuuguuccuuuuauaguuuuggcuuuuuauuuccuuacuugcaaagugaagaaacugaacuuaguccuuuuagggucaccucuaauuuuaucauucucuggcacugaaaacuuccuuggugaauucacaguccacuuugguaagacacguuuuuaauuuuaauuguuucuauaaauuuccucguguuucaguauuucuauucuccccucucccauggcagcucccucucuuccucugcacccuguuucuuuuacuccucuuccuugcccucagucccucucucccucucuccuuguuuuucauucugucuuccccucacagagccacauacacugagaugugaaugaguuaaauauacuuucuauaaaugaagaaguggaaguaaaagcccagaguaaaaccaucucccuucuuuaggaggccuuugaaugagcaacuuccagcccaggcuccugccuguaaggauaaggaccggaucgagcauccucauuuagagccuuucacauaacccaggcuaucaccauuucuaacagaaugagagacauggcaucugaaaagagcuuaauguuucuuugaauaagaugauuaaaaagaagauucacaucaaugauuuaaucugggccacuguugaugaaguucagaaaggaggauuuguuccagaggccuguggagagaacgggaagaggacagaaaauacagcuuagugcugcagcagcaaaggaagcuuccacagucacugacaucagcugcuggguccuggcuggcugaagcaagcuuaggcuugcagacugacuggagaggagggcauggcauuggggaaaggaggauaauuggaacuuuggaacuuucuugcauauuucugagucacuuauaacucuuuuuugugaagggaauuuuuauucuauaagauaauguuugguuguucgugugugggaauucuuauaauucuagcaucgacucccuuaguguucauaauauaaauaguuccuccacuuggugucuugcucuuuaguuauuguacuuuggccucauuauuccauuaauauuaaauauaaucgcaucaauuuuagauuacauuuauuggaaguuuauugguaauaaauauggaucuggagcuacaggugccuacauuuaaaucc

SEQ ID NO: 1471 - RNA, 16849 nt, Mus musculus
ugcgguuagcgucacguccggcgacgggccccaaucuccggaaagagcugccgaauaguggcggcguuuucugcggcgauuauuugaguuccuucgcugcuggagggguagacuaaacggcggcgacaugguggagguaaagugaugcuuggguacuugggagucguuugucccuggagcuuugcuuugcccacggaaguguaggaugaaaguggugggaaucuggggaaaggaacuguagucaaagcugguggucucggcacgucggggugggaggaaggccgaugacaucccaaguccgagcuucagucggcgggaagccugagggaauccugcaguccguguguugucguagguaccuggccgucuccugggaggcggggcuucugauguucccaccguggcugggaugcuaguccgugcugucuugucaguuccacuguuauuucaucucuaccgcaguagaggcgugcgguucuugauuuuguuuguuuguuuguucuugcguaucccaaacguuucuuacucccacccacugcguuccagguccacugcaguccuccgagucuagccuaacaucuuuugcccggacucauucaauaacuuccagcuggucuaagugcuuaggauuaacgaacacauugcaggaguguaguucagugcugcuuucuguuccaguguuauagaguaaaaauguuggugguggcagaggucuaaaccucaccgacccuggaaacccacacuuccgcagcauucacaacugcugcgguucugaguuaucuggacaccuuugcagugggauuucccacacuuucacugcuuguaccucuauuccguguaaggcugucucccucucugcuuaucaccugagagaaaccuuucuugauuauaucuaccaauucuccccccaccaacucaucccauugccuauuuucauagaacccuccaaaaauguggaauuauuuugcuuauuuuugucuguugccucuugaguacacugcaugccgcauacaguacuagcucgguaaauaucuacugaacacauuguaggcauuacucaguuacuuuucuaagagcucuggccagacaggagcuuucucaucuucguuguugauugcuguaguuuguuacaguuauugaggaguguauauccuucuccauauuuagcguggaaauugcauaaugacucucaugucgauuaggguguaugggucucuuguuagaugugugauuuuuggcugucucuuuacaggagguacagaagcauucuguacacacacugguguucaggucauugaagaggacccaugacauguuuguggcugauaauggaaaacccgugccuuuggaugaagagagguaagcuuuauuccuuuucaguugcuaaaguauuuaauauuaacagaagggugcagagagaggggaggaggggacuuugaaaggucuuaaaagugcauacucacaggacgcuugggcaauagcaaguggcuuucuaguguaauauaaguaaugguaacucauuuuucuauugucuugucuucugcaguaaaaacaucauuaccuaacuauaguuuacaggcacccagugugaugauuugaaagagaauggccuccauaggcucaugcguuuaaaugcuugcuuggucucuaguugguggagcuguuuuggaaguauuaggagguguggccuuguuagaggagguguggccuuggggagaagcugugagauuucaaaagccuacacuauucccaguuagcucccuuauugcuugucuacucccucccucuuguccagccccccacccccaccccacacaucaugcuugccaaucagauguaagcucucggcugcugcuccagcacugugcuugccugccugcucucaugcucccuacucuuauggccaaggacucuauccucuugagccaugacccccuaguuaaauacuuuauuuucuaaauugccuccagaaugguguuugccauagcaauagaaaaguaaccaguacccaguaauuaggggcaucccugcuaugucaucuuguuuguagugaaucaguuugugugugauuuuagcuucugcucucagacucuuuguuuuguuuuguuuuguuuuguuuuucgagacaggguuucucugugcauccuuggcuguccuggaacucacucuguagaccaggcuggccucgaacucagaaauccgccugccucugccucccaagugcugggauuaaaggugugcgccaccacugcccggcuucuggucucagacucuuguucugcugaaauuguacuuggccaguacuacucccaucuuugcuccgugguguagugaagaguuuugaguggcauauuuuugcuucucgccagcccuagucugggaauuguguuaugugcagugccuuucuuugcccuuugcuuuuuuuuaauaaucuacuuaauuucccucauuugcauucauauuuaauuuauaagguagauuaucuuuuuaaguaauauaaguacauuucucuuuaaaaugcugagcuagccaggcggugguggcccacgccuuuaaucccagcacuugagaggcagaggcaggcggauuucugaguucgaggccagccuagucuacagaguugaguuccgggacagccagggcuauacagagaaacccuaucucgaaaaaccaaaaaguaaaaauaaauuuaaaaauauaaauaaaaugcugagcuaauuuagugcuuucauugggucuaacuuuuuagacuacuaguaaagauaucuauacaauuuaacuauauucagacauuuaaaguuuaagcuauauuaguuuguguaugucuuuaauucacuuggacccuugaggucucauccaaaaagguuuuguguuuauugggcugcaaacuaaggucuuacuuugcuuugaaugaauacuguaugauagauugugagauaaaguaaacguauaugguauggaaaugcauuuuagaauguuguaguuguuaaaauacuauguagcuugagaaaccuccugcaucugugacauggaguaccgugucugcuucugugcuucucugguuagcugacucuuuucacuggugaguguguuuccaguacuuacgggugcauuucaucuuuaugaucuuuacauagucacaagcggaaaauggcaaucaagcuucgcaaugaguaugguccugugcugcauaugccuacuucaaaagagaaccuuaaggagaagggaccucagaacgcaacagacucauauccucauaagcaguaucccgccaaccaaggugaaaaccaucggguuuacaagugaauuuuuaaaauaggagaaaaugucuccuuagagcuucccugggggcacugcuuaguuguugcugugaugguggccguuuugaugagcucgucagaguaguaaugaagaugcuuaggugaggacuuuuucuagaaaacagaauguaugauuaugauucucuuaggagguaggcaagauuacaguggugucuacagggaaaacucaaguugauuccuagccuguggggagaccaucugugaguucuuuaucuugaaaagaugaaauuauaguuacaaagacucugcuauuccaugugaaacuauuuacugugaagaacagcuggaacaggucagugggaggggcgccuugacuuauuagcagcuuacaggcagaaccaucaacucccugccuuucugaggcuucuguagaguuggaaaggaaaacuuaauauuuauaauaccuuugaaaaggcaguacuuggauaaaggcaaacucacuggcaaugaauuuauuauuuuuuuaggacaagauguugaguauuuggugacaggcacccauccauacccagcaggacccgguaaguaacaguaaggccgcacagaugugugggcacugugucuacacagacauagugucuguuggcucggacaguugucagguaccuaaauugaaauagaugaggauguauggcugagauguacuugaaugcauggguauagacaggcuggcaugagggaagcaaauaugcuuggacagaggacaauaagccuuauguuugcaguucacaugggcauuguguacuucuuuuagucacuuaauuuacucuuggaaguagucuguuaauauuugcaugacuacuauuugcuuaugaguauacugucugaaucaauaggaaauuaacuuuauugucuugcguucucuuaauaccaagcugcuuguguucagucaaauuugaucuguguauuagccuguauuuauuauaaggaauuaaaacccaagucaagcugaguguaacgaagguuguugugaacagguguugccuugacugcugauacuaagauccagagaaugccaagugagucagcugcacagucccucgcuguggcguuaccgucccagaccagguaugacugacgcucuacuuacauagauucucaguguuugcaggcuuuggguuuuguuucuuguuaacacguaaaauguggaauccagaugcuaucuuuucuuuuucuuuuuuuuuuuuuuuucauuuuucgagacaggguuucucuguguagcccuggcuguccuggaacucacucuguagaccaggcuggccucgaacucagaaauccgccugccucugccuccuaagugcugggauuaaaggccugugccgccacgcccggcuccagaugcaaucuauccaccuugaaaaaacaaaacaaaacuguguguuugugugugugcacucucgugcaccucacagcccucauguguaaauaaacagacagcuuuugagaauugguucucguucuguuguagguucagugauugaacucauagcacauaccugugaugguuuguauaugcuugggccauggaguggcacuauuaggugugaccuuguuggaguagguaugucacuguggcugugggcuuaagacccucauccuagcugccuggaagggaguauucugcuaguagccuucagaugaagauguagaaaucucagguccuccugcaccaugccugccuggagcugccauguucuugccaugaugauaauggucugaaccucugaaccuguaaggcagccccaauuaaauguccuuauaagagcugccuuggucaugguguuaauucacagcaguaaaagccuaacuaagacaauaccuuugcccacacuguaccauuucagcauugccaccuuuuucuaucuaggaucucucacuggccuggaacucagcaaguaggcugggcuagcgggccuugggcacgggccugaauugucuccaguacuaggaucaccagcaugugucaccaugcccaccaugcccuuuuccuuuuuuucuuuuuucuuucuuucuuucaaacaaagguucugggaauugaacuucucaugcuggaacagcaagcacuuuaucaacugagcugucucccacugucucccagaauccuaaaagaaaguuuggagaauacauaacuagggaugugcugagugauuauucuugaucuaucuauucugcagaguugaugcaaaucguacugggccugcuggaagugaguaccgacacccaggggcuucugaccguucccagcccacagcaaugaauucuguaagucuccugacucucggaacaugauugcucuuuuauccuaaaagucuuacauagauacugaaaucaguacuaucuugagcucuguuuaauacaaauagcagccaggguuaguccuuagcauuucauagcccuaaacacaugguuuugguaaguugcuuuucuuuuuuuuuuuaaagaaucccacgauacacauagucgguuuguaaauggcuaauacugugaucaugauaguugcuccucacucuuagaagaacaagcauuggggccgggagcuaguugauucaguuaagagcacauguuguguaaauacaaggaccagagggcaauaccagcaccacaggaaagcuguguguggcuguggguaacaccagcauuuggggcgggccaaucaaaguagggguggcagaggggcucuggcgcucaguggccagccagcuuagccagaaaaugaaauccuuagcuucagguucagugagagucccguuuucaaagugucaguagaguggggauagaacagaaaaccugucauuuucuggccuucacaugcacacaccuguaccugcauuuaccacaugaaugcgcuugcacacacagaauaauuucaaggaaaccaucuuuauagugcuaagguauuuuucaucuugggcaggcccugccccuagguucuuauauugcuuuuauuucugccagugaaucaguuuauuucuugaaguuacuuuuccuuacuacaguuacugggaaaaagcugcacugguaauaggauccaacgcacgcacgcacgcacacaugcacugaacuguggguggguguggguuugcauuauuucgcacauguacugauguugugaguugguguaugguugcaguugagugcuacagguuuggugacauugaugcgcugugcagccccuugggugaguuguggcuuuacuugcgcagggauggagcucauuugacagucacuacccacaucacauuucagagcugcucucuguuuaggcuuucugcuuccuuaggauguaauuuaaguuucuucaggauagggucucauguagccuugcacucucgguaucugagcuaaccuugaacuucugauccugcugccuccaccuccugauuguuuaaauugcaggcuggagauaaacccagaucuccaugacgucaggccagcaguccacccacugagcuacaugcccuggcccaguucacaccuacuaaggagagaauuucauaguuucaauauaguuuuggauuaaugaaaugauguuaauguagauucuuuaguugagcguucuuuauuuagagugugcaggacuauagguguuuuuagauuagauuuuagauuguuuugcauggaauauugacauacacauuuuaaaauuaauuacaugucuucuuugacauuucauacauguaaaaaaaaugcauucugguuauucuuaccuuucacccucagucuucccuccuuucuacaaaucccuuuuucauuuccaggucuuuuuugguuuuguuuaguggcccguuugguuuaagcaggcuguguauaaacaauggguuuaagacuaaccauuugagcuuggugggcucaguagcacacauccgaagacaaugacccuuucucucccaaaaccucaggagucaguaguuguacagguaggggucggccccccaccccuccccuccccauacacaucuuaguugaugggguuagucuuguguaggcccaaugcagguucccgcagcugcuaugaguucaagauuauacuuguguuaggcuaaaaaaaugguaucugucuguccuugcuccuuucacgugcucuucugcagcacucacugagccuuagaggagcugcugugagagucuugucuagugcugagcacucaacucuugcuuguuuccgcaaaucgaccuccagagagaaaugccaccauuaaguccaggaguagcauuucucugugggcauagagauaggcauuuagaagacuucuagccauauguucuugaccagguuuauaguaccguguguggcuucccuccuguggagcaggccucaaauccaagcacagagcaguugauuccuccugugagagucaugccacucuuguacaaaugggcacaucuugccuaacucguugguauugaaguuuauagagguugaagcuggguaggcccaaugaugccuuuucugcacugagagccugugcagcgccuuccugcucugugaaggcuggcugacagggaguuuccccucucuuccagcucucuuucucuguagcuugcaaccuagugaguggugucuucagcaauagggucuuaacauacaguucuggugggcgucaauuagcucauauauuggcuguugugcacuaaguaagucugaaaucuggauuaggcuuggcuguuggagcguuuggaaguuuaaauguguggguuaaggaugcucaagccuauaucagcucuagauauuuuaacauaaugugucauucuucuguuagaagagugacagauauagggagguuaccaaguuguugccuaaaguucgucagguagugguuggcucaguuggguuuugaacuccagagugauaucugcucagagugcaguacccugucugccuuggggcuuuuaauuucuuuuuuuuuuuuauuauuuuauuaauguaauuauuugcauuccaaaaguugcccccuuuccuggcccccuuccagaguucuuaacccccccccccaacuugugagaggguguucuccuccagcagcaucccuccuccccacucgugagaggguguuuuccuccaccagcauccuucccccuacuugugagaggguguucuccuccagcagcauuccuccccccacuugugagaggguguucuccaccagcaucccuucccccacuugugagaggguguucuccuccaccagcaucccuccuccccacuugugagaggguguucuccuccaccaguaucccuucccccacuugugagaggguguucuccuccaccagcaucccuccuccccacuugugagaggguguucuccuccaccagcaucccuucccccacuugugagaggguguucuccuccaccagcauuccuccccccacuugugagaggguguucuccaccagcaucccuucccccacuugugagaggguguucuccuccaccagcaucccucccccccacuugugagaggguguucuccaccagcaucccucccccccacuugugagaggguguucuccuccaccagcaucccucucccuacuugugagaggguguucuccuccaccagcaucccuccuccccacuugugagaggauguucuccuccaccagcaucccuccccccacuugugagagaguguucuccagcagcaucccuccccccacuugugagaggguguucuccuccaccaguaucccuccccccuccacugugagaggguguucuccuccaccagcaucccaacccccacuugugagaggguguucuccuccaccagcaucccuccccccacuugaacauaguggagcauguguccuugugguaugauggaacaucuuuuagguauauaccuaggagugguauagcugggucuucagguagaacuguuuccaacuuucugaggaaccuccauauugauuuucagagugguuguacuaguuugcaaucccaucagcaauggaggaguguuccucuuucuccccauccucuccaacauguguugcuaccugaggguuugaucuuagucauucugauugcuauaagguggaaucucaaggucauuuuaauuugcauuucccugaugacuaaggauauugaccuuuucuuuaagugcuucuuagccauucgaaauuccucucuugugaauucccuguuuagcucuguagcccauuuuuuuaguuggguuauuugguuuucuggagucaaacuucuugaguucuuucuauaccuuggauauuaucccucuaucagauguaggguuacugaagauuuucccucucuuccccgcccccacuuuguagguugcugauuuguccuauugacacugucuuuugccuuacagaagcuuuucaguuucaugaagucauauuuaucuauuguugaucuuagagccuaaaccauugguauucugucaggaaaaauccacuugugccaaugaguucaaggcucuuucccacuuuucucuucuauuagauucaguccaucugguuuuauguugagguccaugaugguggagcaucuuuuagguauauacccaggagugguauagcugggucuucagguagaacuauuuccagucuuuucaauaaccuccagacugauguccagagugguuguaccagcuagcaauccaccaccagcaguggagcaguguuccccuuucuccacauccucaccaaccuguguugucaccugagguuuugaucuuagucauucugauugguguaagguggaaucucagggcuguuuuaauuugcauuucccugaugacuaaggauguugaacauuucuuuaagugcuucucagccauucaagauuccucuguugagaauucucucagaacauagaguucugaugaagcauuacauuuuuuuuuaaguuaaaagguaucuuagcugucuuccucuucaguuaaugaaaaaaaaagccuuucauaaauccucuuucaauuuguauuuuugaaugaauggcuugaauccuucaauaugauggccguaauggcuguguaaucucucccaugucuagauuauggagaccggcaacacuaagaacucugcacuaauggcgaaaaaagccccuacgaugcccaaaccccaguggcacccaccguggaaacucuacagggugaguggaucugugcucccuuccgucagccaggagugggggugagaacuuugggguggccuggggugagugggcucagcgcugugcuggggugucuggacggcuuuccuagcgcagccacauggugucuuguuuuuaaauaaagcacaggauacagaggaaggcgugcauauagagagcaggugacuaagaaaguucuucacuguggcggugggugaaguaggaacaggagagccugccugauuguuuuccaugugaggguacaguaagacacugccguucauaccugcuguguggggcugauggauucuaauagacacagcucucaguacccacuguggaaucaugcugucaccucauuccugucuuacacucuucccuccuggcgaccgcucaucugaguucugccgugacacgcacaguggauaguagauguuucuggagaguggugucuuaugcaaugauuuugagauaaggugcauuccuuuucuugauuaguaauauucgguugucuagaugcaccucacuuucaguguucauucacugaagauaagcugauguuucucacucuaaaagagaauugucaaacuacaacuguuuuugaagaugaugugguucaaguccuggcugugguuaaaauugagugcauguuaaacaauguauggaucaaucuacucaccgcacuuuuuguugcacagguuaucagugggcaucuuggcuggguucgguguaucgcuguggaaccuggaaaucagugguucguuacaggaucugcugacagaaccauaaagguauauaaggggaauguugggugucuuccauaaguuacuuccuagggagguauugcagcaaauuuaccaucaaaacuagcaacaaugccugcuugcaaagugggauucaaacuuguuuuguaaacauguuaacugccuacuguuaguucuguguagcuuacugaaggaaguuuucauucugugguuauaggauggaagcauaguucucuguagaggugcgguggaaaguugucuaagagcuagacuggugcaguccuaccgcaguuagagcuucaggcggacucagaacaucuguguugaagugcuggcccuuucucuguguguucagggauuuaugguuuaagagucagcuuuaaauugcuuuacaugugcuugcaggugauccucuacugagcuacaucucuaguaacuuaauuuuuuuuuggagacaaggucucacuguacuuguagcuggacugaacuugcuguacagaccaggcuaguuuuaaauucaccugccucuggagugcugggauuaaagguggugugcacuaccauaccuggaagaaaucccuaguuuuuauuuugaaucuuguuuuucucauauagcaucaucuugaagaccuacuaugaaaagcucaguguuuuacaugaauagaauguacagauaauucuauagcuuguuucucuguuguucagcaugaaagguuuuaguuugauuauuuuucauugugauuuacagagccugcucucuguguguuguguuuuguacaagugccaggacaaaagucuuugaccuggcacagaaagugcaacuuucuccccacaguuagugagcuggugcucgguccacugugcugaccauguagcuuuuagauaaguacagggauguggccacuaggaauggguagaugucuaacuguaagcagacacacagacaggaagugaggugaacauggucauucuuaguacuuuucuggauuaaguugccacucucucugguccaguuaaugacgugcuguuguauuuucaucacgguaaauccuuuuauggguugggagcauuaaccuugucacauuccgcaaacacucacccagcucccaugugccuucccugcuuuuaucugcagacgaucacuuuagagucucagguuccccuguguguacacuuacuguuccuucagugagcuaaaggaguuuuggugggagacguaaccgggauaaagcaaaacaauugcuugguuucagauuugggacuuggcuaguggcaaauuaaagcugucguugacuggccacaucaguacagugcguggugugaucgugagcacgaggaguccuuauuuguucucuuguggagaagacaaacaagugaagugcugggaucuugaauauaacaagguaagcguggagccagugccagccagcucuuugccuuggagcugcauuccugggccccacuguugaucuucgugcuguuagagaguguaacccuucugccuuuaucuuuaggugauacggcacuaucauggccaucuaagugcaguguauggucuggauuugcacccaacauuggauguccuggugacuuguagucgagauuccacugcucggguaaaugaaaaguggcugugugguccuucagguguccugugucuucucguaugcaagcgugggauuagugggcuuuuguuuuguuuuccuuuuuguauaggagacuagauugcugacccaucacuaaccuggucccucuggauucgugacuucuguguuuguuugcucuuacccuuucacagggguugccuaagaccaucagaaaacacagauauuuguguuacgauucauaacaguagcacaauugccaauuaugaaguagcaaggaaaauaaguuuaugguuggggccaccacuacaugaggaacuguauuaaagggucgcagcacuaggacggcugagagccaguggucuagacugucacgguggcugcccauuggcuauuuaagucucuagucccaucaugggacuaagcugacagauuaguauccugaucuuuaaaguuucuuucuuccuuggccacugucuccuggucgcacaugggucauuuuccuccauuaauguguccccuucaccauguucagacacgcuggcuuggcaaccuuagagcuuugaaauacagacaccuguccuuuuccuaucaugcuaacuuuacuuuacagaucugggacgugagaacuaaagccaguguacacacuuugucuggacacacaaaugcaguugcuaccgugagaugccaggcugcagagccacagaucauuacagguacgaucugcugcucccccugagccguaccagaggcacggccggccauucugcagccgccgcaagcaccuccaccuccgaccgacucgcguucuaguuucucuuuggauuuuaaucaugggcauuugaaauuuaggauugcaagguguuuucuaggguuuuuuguuuguuuguuuauauuuuuaucuuguguuuuuuauguaucauuacauaaaaagguuaggcauuguaaccuaucauucuaguaugaaucuuacuugaaugacauuggaucuuaacugugacuggaaagucauucuuucaguugguuuguuuugcuaacuacagauuuuaaaauaaaaagauucauuuuuuccccuucccugccauuggaguuuaaaauuacauauuuguuuuuauuugcucuuuauacuuagccacucucuaccgccucuggcaaaaaguuaaaaagaacuaaauauagaauaacuacaguuuuaggauuuugaggaaaugauucacagugauaggacuuucauuuaguguacacacacacacacacacacauacacacacacacagacaaguacauuguguuuaauggguuuuaacuuguggauucuguccggucucugucuuuucacuacaggaagucacgauaccacaauacgauuaugggaucuaguggcuggaaagacacgagugacacugacgaaccauaagaaaucagugagggcuguggucuuacauccgcuacuguaagugugcugugcugauagcuugccuuucuccgcgucucagugacgcugaggccaggggggccugcuguaccucugccugugcugcuuaggacggccuuucaguucccaucugcugcuguugccucgugcucuguggaaugaaggccauagccccucuacagagugacaaauaaggccaaguugugguuaaagcugaaugucagaguaggcgggagucgugucuggacauacaggguacuggacccacuuugaccuguccagauuguuucacauaugguguccugucagagacagagcagaguuagauuccuaagggagaaguaagugugcaggaaauggagggagagacaucagcacugcgguucccagagaaggcaggccacuccugacucagcucaucccacacacaucccccaacccucccccacugcucccugcgccuucccuuucuuguccccuucccuuccuuuccuuccuuuucucuugucaucccucucuuuccuucccuuucaagauuuuuuuugcccugugugugugcacauuuguugggcuaauuaguguguaacacacuaaagaaaacaaaacacugcucugggaucuaaaguaguacaucucagcagcuggacaaggcugguggaacuuggagcgaggauagugaugaguuuguacuguggugaaguuacauuuuacugaggcugucuggagcagugagcacacagagcuuuuucaaagcugcgaguuuucuuugauacaguguacuuucccauuaauuccugucaaucuuuguucuaguuacacauuugcgucugguucuccagauaacauaaagcaguggaaauuccccgauggaggcuucauucaaaaucucucuggucacaaugcaaucauuaacacgcuggcggucaaugcugauggagugcuugugucuggagguaacacaagguuucuaugguguguugagugugcccuucuguugaugugagugaguuaguaucuaaagcaucacacuguuguagugacacaccuacuaggguguaugugccuguuuguaaugugccugccgucgugcucagugguguuccaugcagcauguugcauaguuuagacaucuuugcauucccaugugaugaagguagggauuuacgcuaggaacugccugauguuugguuggauuuuaaauguuauggugucuauaaauuagagacuuagagggaauuagagagagagggagggagggagggaaagagauagugugugugugugaguguguguguguguguguguguguguguguguguguguguguguugcugguguaauguucagcuccugggucaucugagcuguugaggggauagaaguagagcuguguguuucccuugcagcugacaauggcaccaugcaccuuugggacuggagaacuggcuauaauuuucagcgcguccaugcagcuguacagccugggucuuuggacagugagucaggaauauuugcuugugcuuucgaucggucagaaagucgguuacuaacggcugaagcugauaaaaccauuaaaguuuacagagaggaugagacugcgguaaguucuuaguguccaucucugucugucugucugucuuccuaucuuccuuccuuuuuaguuuaauuuaauuuuauauuuuauauuuagagacaagguaucacaugguaccucuggcuggccuggaacucacuuuguagcucaaguugauuuuaaacuugaaacugucuuccugccucugcuucuccgaugcugggauuuugggcaugagccagcacacccagcuuucacaugcauuuuaaaguaaaagaauugcaugucaauuugacaaggacugcucauuugaguacaaaaagaaacagacucacuauaguaccaucaguuucauccucuggauagugaucugaccugcucagggcuucugugugguuucauugaugcagacacaucagugauaaagcauuacguuuuaaguacaguucugccucaguacaguuccugggaaggaaaugauacauuaaucguggcaaacaggagacugcugagggaaggaggguagagguagagcgcugggguugcuguaauagcuaaauggaaauccaaccgaacccauguaucccuggucaaacuuggauaaugccagaaguuugucagcuguuucuaaaauuuuucaagagccacucagcacguccugccaagcaaguacuaugauuuagcagagacagaucuuuucauugaaaggaaacaaacuaauaaaaucacacuuuguuuacuguucugauuuuagacagaagaaacucacccagucagcuggaaaccagaaauuaucaagagaaagcgauuuuagugucuucauggcuguccuguucgugcuugguguugaugaggauauccggucuuucaugaaagcucacuugcagaaaacauugcugcuuuguauuuuacaauaaacugcucccaugucccucaccuguguuuuauuucugaaauaaacaguuuauaguuuuagaaguaaacgguaaauauaaagaauucaggcauguu

SEQ ID NO: 1472 - RNA, 8001 nt, Mus musculus
cucugcucacucugcucccccgggucggagccccccggagcugcgcgcgggcuugcagugccuugcccgcgccgaccucccggcgcccggcuucgcgcguucgcgccgcccgcuguccagagcccccacgagcagagcgagggagucccggacgagcucgagcuccggccgccucucgcuucccccgcucggcucccuccgccccccgggggucgcuaguccacgaugccgcggggcccugccucgcugcugcugcuaguccucgccucgcacugcugccugggcucggcgcgugggcucuuccucuucggccagcccgacuucuccuacaagcgcagcaacugcaagcccauccccgccaaccugcagcugugccacggcaucgaguaccagaacaugcggcugcccaaccugcugggccacgagaccaugaaggaggugcuggagcaggcgggcgccuggauuccgcuggucaugaagcagugccacccggacaccaagaaguuccugugcucgcucuucgccccugucugucucgacgaccuagaugagaccauccagccgugucacucgcucugcgugcaggugaaggaccgcugcgccccggucauguccgccuucggcuuccccuggccagacaugcuggagugcgaccguuucccgcaggacaacgaccucugcaucccccucgcuaguagcgaccaccuccugccggccacagaggaagguaagccuucccuauucgauccacccacucccaagaagccugaggugcuaggaccuggggagugggguggguggggugggggacaccccgcagccaccacuccacauccuaguuuguccaggcuggaggucccaaccuuggauauggcagcucuccuugcccuaaucuguugccauacggaguuagagauauccacccaugcgccaagauuccuccuugguucuaacaguuccucuuagguaguuaagaaagccaaacaaaaguggcaagccuuuuuuuaagauucuugcucugcguccccgcuucugaaagcauuuaccaugauuggguccuagugaugagcacccaggcucagccucucucugcacguucuugucccacuggauaaaaacaaacgauacacguugaucaccuuuugagauuguuuuuuuguccuucgccaauguagguuuggagauaaaaaaacgaagacugucugggagcgaguggaacccugacuauugguuuuaacuccccagguguuugggggagagaggcuaaaggcaaucaacaggacucaucucucugucacuaucugcuuuuaucuuaggagugguuuuaauuagcuggggaaaaaaucaugcagaagaguucccucaaguuuuuagaaaacagagggaaguucauaggcaaaaaccaucaaagcaaugaaaaccucaugcacucuugauacuuuuccugaaaggaaaaaguauacaaugugucugagcugauuugggccccggagauagaaaagggggcuuccuuaccccucucuggcugcagccgcaucucccuuucaaucgcuaauuuuuuuccugcagacaucauuaguuaaagaaaauacaaaguuguuuagcaaucuuuccuggcaggcaccaugagucugcaaucaucuuauugguuagguuucuaauuuauugcaaauguuuggcauuuuucaaacauuugcccaacauauacaauagaauaaccaauacagguugguagcauuucauacacacuccgagccucccgauuggaaguguuucucucugguuggguagggcugggguuguuuuguggggguugccuuuguuguuuuucuuccugccaucaacccaaauagacacaggguauuccuccagaguucacuuuccuccuucaaaauaagccuggacgccugcgaaguuugcuugauauuuucaaaaaucagauaacuuuucuuuuaugggucacaagguuuuuuuuuuucuuuuucccugugaaaauuugauuucauacuagugaaaaccuacaagauugcacuugaauuuuaaugauaucauugggcauauuuauaaauuagagaaagaaaguguuuccuucaugagaguauguuuuuucacgagggccccagacagacugauagcuguaagcccacagcgcgcgcgcacacacacacacacacacacacacacaccgggucuguucagacaaaccccaccaggaaguucuuacucacucacaucgccuugucccuagguuuauuugcuggcacaggcaaggcuaggcaacaagcaccuguaccaaggagcuggaguggggggauaaugaaauaaaucauaacugaaccgcagacuuggcagggaguacaaggugaaggagagccgguuauuugcuggcugugggaaugacugagcugugcuuccaagaugcaaacaagcaggcccuauagguuccucgcagcacagcacugccauccuucccagcccagaugaggaaaaaaaaaaucugcaaaagaucccuagagcccugcugagcaggaggggcuuucuccauguccugcagaugagaagcaucuuuccauuguguuuuaugguuauaccuuuucccaugccccugugggguuuggauuccugacggucuucuuagagauccugggauggcuggagucaugugaggaggggaaggaacugagaagcacagacucuccagagcaucuugccacacacuccuacccacccacuguccacggcuccuacccacccacuguccgcagcucccuuuuuauuugagggcuagugcucauaaagcuagacaugcggccacucugaugucacccaaccagaguuggaaagggcagcuagggaacagagggguccgauuucuauggaggaggcugaagcaggggucacacaggacaauggcugcgcuggccuggcucgguccuuuugagcuguuuacagacgccaccugcuguucccuucuuagcaaacucacugaagcucuuuucacacccccagcucccaaggugugugaagccugcaaaaccaagaaugaggacgacaacgacaucauggaaacccuuuguaaaaaugacuucgguaaguagccgccaccgccaacagaugucacauccauccaaguuucagucaccaggaaaaguuaaaaguagacaucauggguaagaagucgccagaugaggcugggugagacaugaucaccucucccggucccuaaagucaccuaacuggcucuuaagucacuugauauguaacugucgcacucugaguuacacugaauuacacucacuguuuccuuagacaacaaccaaaugugaauuucccaaggcaccaguguacaauggcuaacuucucaucucuucggcgucuuuuugguuuuuuugguucugguuugguuugguuugguuugguuugguuugguuugguuuuggugccaacacacagaaucccaugccauguaucuuuuucaguugcuuggcaugugugccaggcacugggaggcaccuaugacccucagcaaaauagauucaaacuuuuaaggugacacaaaagaaacacuugcacuagcaucaaaugaaaauauuuucacucgaucuguagccccauagcgacacauuggucacaguuugagagagggagagggagagagagagagaguuuucccaaguuaggugaggugaaagagguuggucgugaucgaguagugucaggguagaugaaguaaugcaacccaggugacguuauucaaggagcauaaacaauaagucacucccuuuaggagaugauaggaggaaggagagacuucugcaaagaacauuaccugcaccuacugcugucuacaagcuccacccccaggugugugggggggggggaacuaccuaaacaagggguaaagccaaaaucccacauggaugucccacccaucagcacuguugcuuuaaucguaccucaaggauagacaugcuugguuguauuacaggggacuguaccccuaaaggguauuauucagucgaaagcuggaaguuacugguaagcagagaucacuggucuaccaaacaacauagagucuaacagagcaguguuaacauuuccauaaauucaacacaucuuuaagacugaggaaacgggugccacuguugacgcacgcacacacacacacacacacacacacacacacacacacacacacacgcacgcgcgcgcgcacgcacgcauccccucauuaccugcuaccuugaacucucaggccaagucaggucucgaacacugagaacaguccuggucucugcuccucagggacuucagaucuuuucaggagguguccugaguugaaccuuggcugguuccugaacuguggcccugacacaaggaaacacuuggagcuguugaggaaggagacagacagaacaagaacuccaagucuuaacuaauaacugccaaguaggaggagccucacaggaggucauaagguuucacaugucugucuucaaacaacagaccucauaguaucuaucucagggccagcuguguucacaguggauauucuucagucuugagagucuuaacaaaucacaauucuuugcugccaugucagauaaucauuuaggaaaauguauaauucuauaaaguauuuguuucagcuuuuuguacuauacauacaauuucucuccugacuuucauggcucuuaaagcaaauacauuuagcacacacacacacacacacacacacacacaccccacuugcuugcuuuguggcuuaccuaacagaagacaaacuuucucaaagggccaugugaaguucugagccaaagaagcggugugaguaaccuguacagcgcagccgucaggaucuuugcucuccggugcccugcuccuuugagauagggacaaugcaggaguagcucacuuggccucugugcuuugaggagcaguagauggagcaggcugagcgauggagcuuauuuagcuugcaccauccuggcaggcccagcacuccccacccuagcuccacacucagagaaaugcaaagcuucuccauaccuccauagcacagguuacacaacaugccacugggcuugugacugucaccucugccuguauccucagucacaccuuccagagcaagaauuguaccuuggcucuuugauucccuauguuuugucucagcuucgagucuaaggaggaaucacuaucgccuccccuaugaucuguauuuuagagguaaagagagguaacucaccuccuagcucaaacugaugacgcuucugguauuuggcaaucaagaauguuucauugaucagguggagccuggccccggccccaucuaugucagagacuagacucuuggcuaauguauaaccaguucaauucaccccuauagcagccucuuauaccauaguagagucaugugacauuuccacauagcauauuccauaguacugaggagucaguacuaugguucagaugaauaccacaccaggaaaaacugucacucaccaagucacagcacccacgcuucaccgugcaacaccauucauuucuauuuuggcuguuucgaaagccagcucaguugaguucccugucugaauuuuuuuuuaaaggaagagaaaaccucaaagacauacacacacaaaauucuccacuauuacuaauuuaaacaaugcauuaaaccccaucaaaguugggaagucagacaugcgugucaucuauuacagcugucgguggcaccaagagucuugggacacacuggagcacgaggacgggacuuugacauugccucaagagaacacagugguaguggaggaggaggcuuggagacugagauaggacacacgcuaccuggguggccugguacaugucacagacacuucucucgauuugcauccucguggacuaaugagcuuuuaaugggauggcccucucuaaccugaaaguccuauccuuuuccggcauguguggaguccugacauuuaaucccggccuauguguuucccaacgcauaguguucauggcuauaaaaugugucuuuuacaguaaacaacuugcuuuuuggucuuaacauucugaugacucuacauacacauuuugaaaagugcauacaugaucugugagugccucgguccuggccaggcaagggagagcacgugaggaugaagucuucagaaaaacacuuuuauggcuaaacauguugugcucuuaaaaaaaaaagagacuugcauuuuuuuuucuccuuguuacuuuaccaaaucaaaagcagcugcaagacccauuucuccuuccccuguaaucuggucuucagaaaacggugaccaugauaccauuuccucaggaguuugccuaaaaaccucucugacauaauaaacccagcugaacgguugccgccagggaggcucacguaucacggaagagucaggcauuucuccgcaugcugaagacuccuccaauaggggagucguuugcuggggguagcaagaacuacaugccaagcaacuuaucaagacaagggucagugugaggacaagaguuaauucaauccugcaagaagguucuggaacgauagcugguuggaaacaaaaugcucugccaauguuuggggacuuuagaaauggagcugccugcagaccccagggccaaagccccuacccacaacacuaauggucuguucgguuauaggaagccccucuuuaccacauaucaagggcagaauaggcagcaaagcuuacaagcuccacaguucuccgccgucaucacccguguuuucugauguccuuucugccccucuugucuucacagcacugaaaaucaaagugaaggagauaacguacaucaacagagacaccaagaucauccuggagacaaagagcaagaccauuuacaagcugaacggcguguccgaaagggaccugaagaaauccgugcuguggcucaaagacagccugcagugcaccugugaggagaugaacgacaucaacgcuccguaucuggucaugggacagaagcagggcggcgagcuggugaucaccuccgugaaacgguggcagaagggccagagagaguucaagcgcaucucccgcagcauccgcaagcugcaaugcuaguuucccagugggguggcuucucuccauccaggcccugagcucuguagaccacuuccgcuccgcgaccucauuuccgguuucccaagcacaguccgggaaagcuacagccccagcuuggagccgcuugcccugccuccugcauguguguaucccuaacauguccugaguuauaaggcccuaggaggccuuggaaacccauagcuguuuucacggaaagcgaaaagcccauccagaucuuguacaaauauucaaacuaauaaaaucaugacuauuuuuaugaaguuuuagaacagcucguuuuaagguuaguuuugaauagcuguaguacuuugacccgaggggcauuuucucucuuuggucagucuguuggcuuauaccgugcacuuagguugccaugucaggcgaauuguuucuuuuuuuuuuuuuuuuucccucuguggucuaagcuugugggucccagacuuaguugagauaaagcuggcuguuaucucaaagucuuccucaguuccagccugagaaucggcaucuaagucuucaaacauuucguugcucguuuuaugcccucaugagcucugaccauugcaugcguucccaucccagcuacagaacuucaguuuauaagcacacaguaaccauuccucauugcaugaugcccucaaauaaaaagugaauacagucuauaaauugacgaguauuuuaagcuuuguuuaaaacaucuuuuaauucaauuuuuuaaucauuuuuuuugcaaacuaaaucauuguagcuuaccuguaauauacguaguaguugaccuggaaaaguuguaaaaauauugcuuuaaccgacacuguaaauauuucagauaaacauuauauucuuuguauauaaacuuuacaucuuguuguaccuauuc

SEQ ID NO: 1473 - RNA, 2175 nt, Mus musculus
caugaacaugaaagaggcugccagugacaaaauaucuggcaaaagcagccugaggaaagacuugauuuggcuuacaguuugaggggauacagauuguugugguagggaaggcccgguggcgguaaugagaggcagcuagccacacugcuucugcagagacaaaugguucccgugguauucugucucaaacucuagcucaugggauggcaccgccgacauucagaguuggucuuucauccuagguuaacuguuucuagaaaccuccuccuacccacaccuagaugugaguuuccauggcgauuguacaagccaucaacacuaccgugaaaauuaaccaucaugaaaauuaacugucauacaccucugaaaagaggaguggcagcggcccugcuggggaucucuacuuauagcuuccaaguguuuuaucacuuaaguauuguuaaaauugguagcuuauuugacauuuuuucuuuguuuguuuugccuacucuuagugacaagaauugcuaauaguuauuacuuauuuuguuauuauuuuuccauaugcaggacauuuuuucugaauuaagaaaaaaacaauuuuucuuuuggccauggaggccaucuuccaguaacuugccaaaaugacaaacacaacgggcaggagaaggggcacuggcucuauguucucuuggcuuuuccagaaacauaaaguuguuccuuuggccacauccaugugaaucuacaagaagggugauauuguagacaucaagggaaugggcaguguuuauaaagaaaugucccauaaguguuaccacggcaaaccuggaagacucuauaaugccaccagcaugucgugggcaucaguguaaagaaggaaguuaagggcaagauucuugcaagagaacugauguguggacugagcacaucaugcauucuaagagcagagacagcuuccugaagcaagugaaggagaacgaucugaagaaagagggagccagagacgggaaccuggguucagcugcagcaccaggaugcucuacccagagaagcacccuucaugggagccgacaggaaggagcugagcugcugaagcccauuccauacuaauucauggccuaacgcauaaaauaaaggaccuaaauuguaaaauguuuucaaaaaaaaaagaaucuaguaagcaaaguuguguuucuuguguaaugguuaaaaacauaggauggaauucaguugguauaaagugcuugccuaacacguacaaagauuugguucagucccagcacuugucaacuggguaugugacacauaaccuauaaucccagcaccugggagguagaggcugcaggacuagaaucaaucagcucauggcacguucaaggcuaaugugaccuacaugucacucagucucaaaauauacguuuuccuuuagaaucuuuauuuugaauacugucuuaauuugguucuauauguaugcuucuaccuagacauuaaugucuugucucuauauccaacauucugaaauuuuuaagucaaaccauuggcucucacuagaugaucuggacaccauuguccacuuggguuaaauaguaaaaauaguuauaacuuucucguuacacauuauaaucuuugagacacggcuaucuuuccuuucuagaaacagcuagcuagcuugucuagugaaauguaacauaaaaaaaaugccaagcuaggcacucggguggcggccagaaaccagcaggacuggaagggaccccgcgucucggaagacucuucaagaaaucacaaugucaaccaacacagaccuuucucucucuucauacgaugaaggucaggguucuaaguuuauucggaaagcuaaggagacacuguuuguccccauuggaauggcgggcuuugcagcgauuguugccuauggguuguacaagcugaagagcagaggaaauacaaagauguccauucacuugauccacaugcguguagcagcccagggcuuuguugugggggccaugacucuugguaugggcuacuccauguaucaggaauucugggccaacccuaagccuaagccuuagaagagcugguggcaugggaagugcuugcuuuaguuagacgucucauauugagguuacguguuuguaucuacaauaaauaacauguggguuuagacaaaaaaaaaaaaaagaaagaaagaaaugc

SEQ ID NO: 1474 - RNA, 4766 nt, Mus musculus
caaacgaucacaaauaggacuuuuuauuugucacuauuaaaaaucuggauuuuacacugauucuuggacuggcgguucauauccgucagcucgcucaaccuuagcacccgucucgucuccagcugcuuugccagagcugccgccuuccccaugcagcuccaugagcuugcccacugaaaggaaaaggaagaggauccuguuagaaacaaguaucagaaccuaaacuacagcccgaaggaagcgaccguuacuuugcccugaaaaccuucaugcagaggcuggcucaguggugaagagguggcacuuguccuugcagagcacccagcacccacagguggcucguaaccaucugcagccgcagccccucaacaccaacgucuccaggaacguguguacacacacacacacacacacacacacacacacacacacagaggcaaaucacucauacacauacacccaucaagaauguuaaccagucauuucuaaaaccacguacuugguuccacaaacuucuaucucaugaaacaugauuucccacuuacauucaaacuuggguuucuucagcauuuuuacuuuucuaacaaagacgucauggagaggauaaauggacuggcaagccuuuucuaugucuuucccaaugcugucuggaauccugcaagaacaauaaacuuuuuuuaaaagacacgcaaacaaaaaacccaccaaagucucucauacaagaagcaauuuucuuuaaauggcaaaaaaacaaucuuaguaucuaaauuuaacaccuagcaacaaaaucaacguuuaagucuuccuuaugcuuuuuugucuaacacgcuuaaccaccuguauacugcaugggaacaucagaaaaauguaauguuaucaguggccaucaacugggaccgaaacaguuucucaucacauguucccaugcauuauuaaaguuguuauucauuguguauuaagucuaauuuucacuguccacuguaagauaacuucaauguuagaagugcuuaagcugagguccaacuccaccucuucuuuaacagaaggaugauuuaacaggcauucugaacauuuuuagaggagagaaaagaaacgcacuuacaguuuauuaacuacuuccuucaagucauuagucugcaccucucgggucaugauuuccaucaucuucuuccggaucuggcggacuugcuggugcugcgcauaggaugucuuucuuaucugguuguugcguuucuuagugaagccaacacagaaaagucggagcaaauacccaucggucgucuugacaucaacgugagcuucgaucauggucuagugagaaaaggauacugucagcucauaaugguuuugggguuugcuguuuucugagacagguucucacagcauagcccugguuagccuugaacucagagauuccccucccuuuuauguuuuucacggccuaaaucauuuuaagugcuaauguaaaaccuuggaaaugucaagcccacgugacaaauauaccguuuauggcacuuccuuaaagugaaauuaaaaugauaccccaaaaucauuguugcccucccuuuaaaacaaucaacuggacccauacccuuuacauuuaugucaacaucccucaaacauaaaagcuuuguaaguuaaauucuaagauaguauagacagaaugaaacugaauauuaucuuuuaaaaaggaaaaauagccgggugugguggcgcacaccuuuaaucccagcacuuaggaagcagaggcaggcggauuucugaguucgaggcuagccuggucuacaaagugaguuccaggacaaccagggauacacacagaaacccggucucaaaaaaaaaaaaaaaaaaaaaaaaaaaaaucacaaaaggaagaaaagaaagauccuguuagaaaggaaaaauagguuguguguggcggcuuuaguuucaguacuccaagcaggacacacaaaaauguuggaucuuuuaggaauuugagcccaaaaaaaccaaacacacaauaagcuguacaugacagaugucugcaauccuugcacucaguauacaaaggucuacauagcaaguaccagaucacaacagguuggagacccuuuuuauuuuaaaaaauuuauuuuaugugaguacacuguagcugucuuuagauaaaccauaagagggcaugagaucccauuacagaugguuuugagccaccaugugguuccuggaaauugaacucaggaccucuggaaaagcagucagugcuuuuaacugcugagccaucccuccagaccugaagauccuuucuugaaagagggcaguggagaaguucugcuguaaaacuguauuuucuaaaugccuuuuuauuccuaaguuacacaaagaacuuaaaaacauaauuccaaagcuaagauccaaagcuaaacaaaaucuguaauuagaccauacuaccaucuuuuagaggaccauuuuuguggcaaagcgaucugauuucuuugaauuuuacaaauauuaaguucucaaauauacccaauauuugccgugagcggugguacaugccuucaauccuaucacucaagaauuugagaccagcagaacugcccggaaacaaaauccuggcauccacuucacugcaaaggaguauauacaucaguauguacuaaauagccuauuauuuccaaaauuacauaaaguauaagggaaugucagcaauaaauguuacgguaaucaguaggcuucauuugggaccgaaacaucuugucaucacucauucccauauacaaugucaauaucaggauacaucugaacagcuuucccuugaaucagccuucuuugcuggucaccaugcuaagcccauuucccuacaugucauuucaucuucacaaccccaggggcugauguugaagaaauuaagcuaucaaagcuuguuacuacuuucaaggacagaaggggaccgaaucugacucuagccacacuccacugucagacaacugagucagcuagauagagcaccuuuucucuaucaacucuaacgauguuaacccuagaacaguccccaaacuggcaaagcugcccaacucaccuaauguggccguaacaagcaauaccaaguuaaaggaugcagcucaauguuaggacugaugucccagcauguggaaagcccuggauucuaccuccagcacucaagaauuaacagugauacucaaaugaaaugaaaccaacuucuccauuccauguuuugauacuaccuaccaaccaacacacccaugacacaucugcacacccacaccacagcacucacacucgcagcuuuuggucucaccugccacuucuugaccauggagcacauuuugucccggguaagauccauaccauggaaguuagucagacaguuuuugcccugaacguccucagugauuagcuugaauuuucuaaacgcaacuucaucauucuguagaucagcaaggcucacuucaaacacacgacccuugaggccaucagaggcaauuucuaaaaaagaaccacaaacccuguuaacuuguuaaccaaacccaccuucacaccaguggcuuacugccaacaccuaaacguucucuuggacagcuguacaaacacuucauugcugccacaucuguacuaagaccaagcacucccaaugccaggcccuccaaccacugggcugacauuucaauccagcgccccaucagaguugaccaaggcgccgguuaauaugcacaugccacagcuuaggaacaaagcaaaaggggcccacaguacucacugguuccuugaguccucgugacuagugucuucccgauguuccuaauauugaacauggcuggagcuuucacaucguaccagucuuucuuagaaaauggaucgacccuggaugggagaaaaauaaccucaaguuucucuguaaauuguaacaacacucccgaccacuuuuaaacgcuucuuauccuucagacuucuguuaacaguuucccaggcacgaucuugcaaucggccugcacuuaacacgacggacguccuccccguggggugaacgucugcgaggccggcuggucugccagugcacaaagcaguaaguucgaagccaugccuuccccacuccuccaucacacaggcaguacuauauacacacugcccuggaaccucagggaccugugacagugacugguccgcaacagcacaaacugcugcuaaacaagugucccgggucuccaggucggucccacgagagcccagcacacaaguugacauggggucccgacauggacagccagagugacugacguagagcgguguuaaaaagugccacggacuuccagcaacccaggagcccacaguucgcgcgcgacacgcgagcgacugcuagagacgcagggcggagaucacacgcggcgcgcgacacccggccggguggcggagaggcggccgcccgggacgcacccgccagccgcgcagcgcagcaccgccgcgcaauccaccccgcauccucaccauccgccccacgccgcaccccagaacccgcccaccaacuccugcggagcccaacggccggggacccgcgcgauccgccacucacacuuucuucuuagcucccuucuugccaccuuucgucaggcgcuuguucuugccgaccgccauggugccgaccggagagccaaaagggcggaaguacaacucgcgcgagaacuuaacgcgagccgggcggggagcgccgucuacgugacccuugcucuuucgcccuuccggcuuuaagaaucucgcgacacuagcug

SEQ ID NO: 1475 - RNA, 10585 nt, Mus musculus
ccauauugaauuccugucuuuauuguccagugugcacaguaacaacuacuaagucaaugccagagugaaggaagaagagagugggcagcggggugugcugauuacaaucacagagccauccauuaagcaauuugugggaagaagugcuuuugcauuucugagacuaagcacaggaaggugcagagccagcauccucuaacagcuagaugcuguuagagagaagcauggugugugccugcugagguggcacacguguugcaaagggcugcucagucacucugaaauggcuucacuuucacagccuggguuggugaugcugcugauagcaggaacauauuacacuuuuuaaaaauaacugaaaaguguauuucuacauggauuauuuaucuccugugccuuaacggagguaaaucuuggaaauuaucucucucaucuccuacuuaugaauaagauaguagaggaauuacuuuuucucuuuuagauaugaaauuuuaagagguucagacuccauuugauaaagauauuuauguuauaaagggggaaagaaacacauuuacuacuacagacauauaccacucucccagcagugucaggcuaacuguucugccuugcacauuggcucagguuacggagcgccucacuguuaaaccgaguuggguuguuagagggcacaggcuuccuccagugucccguuacauacugagaaaggcacgucuguaaacgcuggcaugccuggaagcuguggcaggcuuugggcugucuuuaaucucauuugacuuguucaucuucuccuaaggccaucccgaaagauguacugagucucccuuucagcuuucgguaggaucugcaucaguagacauaaaacugcucucaaacaaagaccccuuuccuuugaaguacuugcuccagcuuuucaaaguaguccuagacaucuguccuuuuucuccuuucauuuuucuuuaagaaguuugaaguguagcuucuuaaacuaccaacaagauaaauuuuucucccagcguuacugaaagccaugacgauuuucacgcaguaagacuuuaaaggguuuaagggaaucuguugugcuuuauggucugggcuuugguagauccuagcuccuacucucugagagagcaaagguacagacugucagcauccauuaacagucggagguuuucauccaaaggauaacaugguacuuuccagaagacuuucccugcucuuuaagugaggcugguggugccugcaggaucugaagggaaugcacguguaggaucaucuuauuuguacugaugcgcccccacccccaagucauccuggugugagcugacaagugggcaggaggggcagcucuggagcugacuggagcuuuagccacugccauuugcucuugccuuuucacgccgaggcacaaggggucuugcuuucuucuuuguaugaugaugucaccuggcaccuguacaacccaggagaugaugaaucccauguuacuacagaggaaugauaggugucacagcuccauagaggccaguguucugccuccgacaauccccucugccuuugauuucauuccaagugauucccagaaugucugcuaaagccaagcaguguguaucuguuuggcuuaaauccuauauuauagaauuauacaacuaauagugaaauuuuaauauuuaaggcccuuuguuuauugggauuuauacaaauccaacugauuuuuauuuugaacauacuuuuugauaagaaagugugaguguucuaucuguacuucagacaaaugagccggaaaugacuuuucuucuuacauguuauagauuuggcaucugcagccuuaaguguuuguuucuauacauaaugcaaguugagcacaggugggcuuuuguuuuguugucauuucuuaccauaaauccagcucccugagaagcaacuggcauggcucugcccuugcgcuucuaauuuguuguguuacuugagcuccccuucucagcccuccccaccacccccuuguguuuccugaacugucuaaccuguuuccuggacuaggaaacacuuggccaacaaagcccagcacuaaacaguccuuuauuuagaaucagaccccaggaaaaaaagaccccuuuccauccugaaguugcuuuguacaugcaucugcugauuuguguaaugaaaagugauuugguauauuuugcguucaugaaagcuagcauuuuguaggcagaacuaguaaguuguguuugugaaggagaccguuuauaacuuaacccccuuucugaaguuuccuaccuucugacuucacaguucuagauuauucugcccaucucuucgauuaaaaacagaaaauaguugagaucagucucccccgacccgccacuaaacuccugagaaaaugccccaaaguucagaaaacaaaacaaagcacgggccuggcuuccucugggacccaugugcccuuuguuuauuuugguuuauauauaaauuguucucauucuucauuuacuuuucuucagaccuucacuuuccaccaaagaaagacuauucaagcuaagacacaaaucucaccaccauuaaaaucauuuguaacuuauggauacaaaaauggaacaauugcauugaaaauguauuccuuaaaucauccugaucuuuuuuucuguauaguuuucuguauaguucuguauguuucucuguguagcccuggcuguccuggaacucacucuguagaccaggcuggccuggagcucaaaacucugccugccucugccuccuaagugcugggauuaaaggcaugugccaccacugcccggcuuaaucauccugaucuuaaugguugauuuuaaaaaacauugccaauagauauacucagacaguaauuucaagaauaacauuauaaugcuauuuuuguggaauuuuaaauauggcaagagguggguaugaaggggaccgugaaugaaggguagcuagcauauuaacuuuuuuuuuucuuugguuuuucaaagcaggguuucucuguguagcccuggcuguccuggaacucacuuugcagaccaggcuggccucgaacucagaaauccaccugccucugccucccggcauauuaacuuuuaaacauagaauuuuuauuucuaaaucucauaauuuuuaguaugaaauuaaauaguuuagaugagucuguaucauuugccucuuugaagguuuuuuuucaccaaaauuuuuggacuuaaaagugaaaacguagucuaucacagauuccuucuuaguuuggcaaauagcaagcagacauuucuaauaaguuagguauguuccuccuauauguuucaaacuugaaauuaggugaaaccaggucccugguucaacuuguucuuggcccauuagucuauuagcugaggucucucuuucuugucuagggauauagacuagccuggcagcuggggccagaguacacccaagguagcacacaaguccuuacggacuaaagucucacucagagauucugcuagucaccaaagccuuaagcgacaccauggugacauagcugugcauuguguaaauacacauggcaugccugucauguguuaugacagaccuuaaguuacugcuggccccagggcaggcauagaaaaguccuuucuuaggaguggaggcuucucucuugccuuuuuugggggccauguaucucugugccuucaauaaagccuauuccagucaugugcacguauuuugcccaaauauugaaggagcucauugguccacucccugaaaacuccugcuuuagaggcuagaucagugguuuaacagcagcacuggccuccacaggugcagugguuucugauggauuuuuccugaccuaauaggggucuuuccucugagugagcaguggaucuaaggacaaugagugccugaguuacaguggcagaugauucuuuuccaaagcugcugauaaugagcuacuuucuggggacauuuuccccuuuuagauuauacaacaucaguccucaacucugccaugaaaccaguucacaccagacaaguagaaugccaggcaggauccugcuuguuagcuguuugcaaaggcuuugucuuuacaaacuaaagggagggguggguaguuuuaaauagagcccucugguuaaguacagaauccuguauguccgugugguacaaauucacaacucgggccugugauugggucacuucucugagcuguggccacuuuuuacuuugugacacagaaacgauguuaaguuuucuucucuacuauacauucccucucuccacccuccuucccccaaacucuccaagaccaucaguacaagguucaucaugccucugcugauuggcugaaaugugggagguacucuaugagaaagaagugcacaucagaaaacacuaaaauaguaggugcgcuagagagucgucccacucgagauugucuuacuaggggagaugcacugaaauguuaacuaagccuggguucuuauuuuaguuuuaaucauuuauuguaauaacuuggaacagaauuucacauuauacaggcuuagacauagaucagaauuggaaacaaauuaccccaauugucauugugcucaggggagggcacuauggguaagucccuaaagccguaguggagagucaaaguguagacgcugcgcagagcugcauggccuaagauggcuguucugccucuauaggaacucacaagaugcauaggauauuggaugggcaagaauuuucaguuguuuccuuaaucuaguugugugaugguuuuuguggguuuauuauaaccaaggcccuauuuuagaaucaucucucuacuugagaagcaacuuuuaugagaaaaguauaaaaugcagguuuuaccaucuuuagcuuugaacuuuaaacuguuguugcuagauaauaaggguuccuuaaauucaggaacauagcaccuuuaaaaucaaacuguggcaaaauguggacuccuaagaucaaaauuggcaccguuaucuagucuuuauacauugggauugacuugucuguuuuuuuccuuguuaaaggugaaacugccaccccucgggccauucucacaggccaugacuacgagaucaccugugcugcugucugcgcugagcugggccugguguuaagugguucccaagguaaaguugugguuucuucaaaguguuggcuucuuuugucauauuaaugugaacagaaaugagguuggauccuguucucuaaaacuccagucuauuaugguagccacacagggcuacuuaaauauaugcuacuuaaaacucacauucuguaagagcaauagcuacacuuggagauagaauauucucauaaggaccaaaagccugguuuuaguuuuagcucccuggucuaaaucuaaggauucuagcuacucuauaaacagcagcaguuggugaccuaaucuccaugaagcaggaacaaggaacaucuuuauauguuuguuuauuucucugaccuccagaagguugaaugggaauccuggcccugacuuuaguauaugugugcccacauucgugccauaucauguguguagaggacaggugacuugugaugauugguucccuuccuucacaauguguggggaccagggauuaaaaucaagccaucagguucagcaacaagucccuuuaccugcuaagccaucuugacagccccugacucugcuucacuuccggauuucagaacuaagcaggccuagagugacaugacagacacuggaguguagaggacuugagcuaguuugcuggaucaucugcugcuagcacuugccugagguuagagguacugagugcuccuuccaagagcaggugaaacagaccaggauccagcagcaaagaagcuguuugcaguucagugccucuuccuccaccuaccagucugcccgucuccucucugugauggggacugagcagaggacuccuaucaccugguguguuuuaagcucagaagcacagagcaucugagucacugucucugcagcuugaacuagaguaguacagcuaucgggccagaaugaauauuuaaaguuuugcuuugaaaaacguaguuggucaaagcagugaaaaaguaguaugaucccuuggacuguaucuaacccauaucaaaccuuaaaauuaauuacuauuauagaccaucccugcuuugcacaguaaaaugacauguaaacagaaaucacacagaauuaucugagacacugucucggugggaaauuuuuuuuauuuuauuuuuuuaucauuuuccauggucuaaaaguuuuugucaaaacauuagaaacagccaggcaaagcacauaccuuuagucccagcacccaggagguagaggcaagggggaaucucugaauucaaagccaacaugaccuacaaugaguaucuggacagccaaggcuacauagcaaggcuagacaccuuaucucaaaaauaaagcuaaaaacaaacccagccgugcaguuucaugucuuugagaaacaguucucagggacaggugaacaugggcaccagucuuguucugaaaaccuaagcaucucuucugugccuggggaaauugccaguccucuucuguuugagcgguucacuuuucuuuuguuuaaguguuaugacacacccucaaggguccccuaauguggggcuuuccuuaguuucacuuccucuggacaucaucagcucuguuacaaccacuguccugaguuaugccagcaaguuuccuuuguccguuuccuggcugcguaucuagugucuuggcagcauccggagcugacucugcucucucuacaaaauacuccauuuauauucacuucuuuauugaagcucaucauuguuggccaauacccuucucugguuaccuccuuuuauaaaaugccgcauggcuguuacugugaaaggagaggcaacaaagcugcuguuugcugucugugugaccuaaacaacagaugcugguuacuuauaugccuucaacgcggugauguggggucuuccaguugcucagcugcuauuaauauacgcguucauggucugaagagcuagccaugaaguguguuuauacaacugcucugauaacugaaaucugaacuguguuguugugaugcuaguguuauuuagggaguuggaacugaagcugauguauccugaaacuaugcaaaaacaaacgugugccugucuugggaaacacugaaacagagaaggcgugcucuaguagccauguagggagcaagcauaugugagaccaggaacaaggcagggcaaggacccacgcucuccccgucucucaaacagaaaagcucuggugugugugugugugugugugugugugugugugugugugugugugugcugggggggggguguucagcaguuacuguccucggggucucagccugggguaucacuggggacuugagaguggcagaagccacugccugcuuuagggauaucagggaauaucucacucaguuuaauagugguagaaggaauccagucuuucagccacagagcuguacgcagugagagagaagcugcccuggcuggcugcaucuacauugaugcagucugcucugcccagcccuccaggaaggguaccccugugccuggcgguggcagcauuuauaccccagccucccgugaagcugcucugggacuggagauugucuuccuuuuggaguucuucuuguuucuccccgcucguguuauaauggauugcauacaguaacuucugucucagagcaugaagagccuccagugggaggugagggcggcaagcagaagaaccagacuuugcaaagcgacuggcaugacagcuucugagcgcugggaagaacuguaccauggcacugcagcccugcugaccacugccacggagcugcaccguccauguguccacccugucuguuuucauuauauaauucugccucuuguucucuucucagaagggccgugucucauacacuccaugaauggagaccuguuaaggacuuuggagggucccgaaaauugccugaaaccaaaacucauccaagcaucgagagagggucacugugucaucuucuaugaaaacggcugcuucugcaccuucagugugaacgggaagcugcaggccaccguggagacggaugaucacauaagggugagugccguaggcuccaccuuguuccuuuuacugggaagcucuaaguaaaggauaaguucacugaagcagccuaagucugaacuagcuggggccuccgucccaugccagaggggcagcacuagcuagcacuuagaagcccagagcaccuugcugcaggcuagugccuucacuguggccgugugcagagaacacccacugacugaugucccauagcugauucuagccauaccauuuccucuaagugcuaccuaacagcagacccggcucuaagauucacuguacagcaaagcugaacuagauucugccuaaaacugcuuucucuucacauuggaaacggcagcacggagucgcuguguauucuuggggucagcagcuaauagauaucugcuccgaccuacuggagagcaacaccaaagcaagucauguuagagacuuggguguccaaaugacaggcgcuguuuccccuccugucuguaaggaaugcuaagcuagugggcagcacaggucuugccuugcuucucaggccagcccccaaggcgcuagacauaggggggaagagagccagggugcucuuuggggauaagcuaggaugucccugucauuuucuaaauggaaauggaagagccaagugugguggcacacgccuguaaucccagcacaugggaagcauaggcagauggaucuccaugaguucaaagccagcuuggucuauaaagagaauuccaagacagccagugcuucacagagaagcccugucucaaaaaacaaaaacaaaaauaaaauaaaacaggaacagaggcgaugugguccauguacaaggaggacauuugaguggcagcagagccaggcacuucacaggguggugcaguuacuccugcacaguuaacucaucguccuuaccaccaccggggcuuccauggcagcucuccccggcacagcgugaccaccucuucucccaaggaaacucuagggucuggaagugagcaacagugguugugcacacaggcaggcagcacugguccaaaaccaaaggcccugaugcucugggauucaggccucaguccagugggcgcuucuguccucucgguguccgagaguuaccuccaccucaaacggugcacaggcaaacugucuguuuuuauuucucccuauuucccguaauccaccauuuaagccaaguacacaucggaggcuucucuccuccuuucuuuacaauaauaauguugauaaucugucacucggagcugugauuauguugucagcuacacuaauaaaucuguaaaauaauuuaaagcugucuacugacuagaauaguuucugugguguuccagucagagcagaggcucugggaagggccucggggcagcagcaggggcucuuguggcuuguucacacucacaggccucucccuguacccugaagccaucggggguuuuuuccccugugaaauuccccacuggauuuuaggccuaaacaauccauugcuuuuccccagcacgccugcacuuuaucauacuaaccuguaaguggcaaccaugugauuaaagcgagugcucucugucccaggcuccagaggcugacacuuucucagcuaagugcauuaggaggcaggcaaggaaagagcaggcugggagcccaagaucacagaaauaaacagaaucagucaccagcccagaccaaaauuccauuucuuugaaauaccaggcagccuggcgaguugcgcacuagucacgguuucccacccaccuuucucgauuccguaggagaucacacgguacagcagcuggacacuaugcagguguuggcaugacuagcugagguguaagucggcaggcccuccagagcaacaagacuacaccauaaagccuaaccaccauuucccccagggaacuuuucuuucucccagcuguuucaggacauggguauccacagagacuucuguggccugccagcauccucaggcaccugcgcagcugcagcaccucccaacacuugggauccagagcugaguuaaagcaucucuggggucacuuuagaucccuagcacacuagaccuggaugcugaagagaggcuuagaguaagagccagugacagacuguacuggagggagggggggcagcagauaccugacugauucauuugccaggagaagguagcuaggaaacguuugccuugggacgcacuagauucacacaguguucuagagguggcaugcaucuuaagagucuucauuucacuucauuggaggcacccgcaggauuagagagucuuacuaacaaagaguugaagacugcuggguuuuaauauagcacuuacccagaagcaggccucaaguaugaaguuaggggucucaucagcuguguuuuauaggugugucaaguagcugcuguucugcuccucaaugcaguccccagaccccgagacugcugcuuguaggauggaugggaaaggacuga

SEQ ID NO: 1476 - RNA, 134737 nt, Mus musculus
uccucgcgcggcgccgcccucuuccucaccaucucccucucggugugguuuguggugucccugaagggacagaggguguccuccgggguccaggcccugacaggcggccgagagcgcggaugcccgugggcgugcgugcgugggaggcggcugcacucuucccgcaggggcccagcgccucuagaggauccccggccagggacgcgcaccggccguggacugggccugggcgcgcgcgacgcggcggcgggaacccgggaccccaggccgcgccgggcagccccgaggcgccucgcccacgcucgcgccccuccccccuccgcuuccuuccuccacucagcgcgcccgagagcgcaggccggaugcgaacccgggccagccuagggucguucaacuuggcggcucccggccugcugcccgcgcgcuacuugugaggcguggcccggcgaaggaggcgcuuggggggcguggggcuccucagcuggcggcggcgaccgagggcgcgcgggacaaugagcugggcugcugcgcgcugcggccgccuuuagcuggcugagcggcuccaccugcgagcauggcccgaaugcccgcgccaggugucccgcugcuuuaagacgggacggagcgccuagaucgcggcgcgcugcggccggggcgguugggacguccuuuuauuaauuaauuaauuuguggagagcucucccgagcagccgcgauggccagcacaaggagcauugagcuggaacauuuugaagaacgggacaaaaggccgcggccagggucacggagaggggcucccagcuccuccgggggcagcagcaucucuggccccaagggcaacgggcucauccccagcccggcgcacagugcucacugcagcuucuaccgcacgcggaccuugcaggcccucagcucggagaagaaggccaagaaggcgcgguucuaccggaauggggaccgcuauuucaaaggccuggucuuugccaucuccaacgaccguuuccguuccuucgaugcgcuccucauagagcucacccgcucacugucugacaaugugaaccugccccagggcguccgcaccaucuacaccauagacggcagccggaaggucaccagccuggacgagcugcuggaagguaaauaggaggggcgggcgcggcgcggcaggugcggccccgugcacagcggcaggugcaguggcugcggccagcgcgcuuccccgcccugcgcuggggcagccugccgggcgcuugcuuucuaggcagccacgggaacugucugcuccucggucguuuguguuggguuggggugcacccauuaucuccuucccaagagauuggccuucuaaaaacggaagaaaauucuaaugaucagagacaaauacaaacaaugauggcuguaaaauuagccaacuuauuuuugcuggaagggcaaacuguuugaaagcguguuucuccagugaggcgcuggguaaccuuugguagaggccagugcaguaccugugcuguuccuguguuugggaucccauuguaccuucugugcacagcuagcucguucugacucguucuagguuggcuuuucugguuucauguguggcacaaggcacuggagaucaagagaggcaagccagcacagaaaaagucucacucagccugucuucacuuuggaccgugcugggcacuuuuuaaaauaucggacccggccccaccccuuagauauucugaugugcuugguuuaggguaugacuugggcguuuagaguuuugaaaguuccucagaugauuucaguguagccaaaauggaaagccaccuuguuuaaaggauuuuccacauuugguuggcaacgaggugaaucaaggugagucucucugucuucuccaugaagagaguaacaguaagaaugguagggucuugggacccagcagcaaaggccuguuagaaauuaggaauccuggcacaccaaccaugcaucaaucagagggacuucgugccaauagguuuggucauucuagaguucuugcaguauuuuucauuuuugcuuuuaguaaggaaaggguggcugguaguuaaagaacccaauuuuuaguuccaaacaccccaaaagaucaggcagauaucucaguguguacugagggaguguuuacauauaauuagcucucaggcaucguucuuaaugcagauaguacauuccguguagccauagccacaugagcuugucagagguggaaacugauccccgaacuaagcugcuuucuuauuucagcaugagcuuaugucuaaaggcauuuucucccuuucacagaugaggaaacuuaagcagcaggguuacuauuuucuaauaggccucacuucugaaaaaaaaaaaaaaaguuagccauucugacaagucccuaaaguggcugaguuucucugucacuuuuaucaaugcucaggcuacacaacaacccaauuaaaauuaaguuaucuucuuguguguaaguuuguagaagaggcuaccucacacauugccuugguagugaguuuuggucuuaaagacugaaagaagaggaugugucaguaaaaugaaggcaacagagggccacuuuacuuuuguuuguuucuugagacaagucucacuauguagcucuggcucuccuggaacucacuauauagacuagguugaccucgaauucggagagauucuccugccuccaguuuucucugaccccaggucagacagaguggccgcacauugacaggcucaacuuugccuguuucacaagcacuugccccucaccgguccucaggugaaguaaccuacuuuaccuucagaugacucgugacuaacagcuugaagcaaaggcacacaaacauuugcuguaccauuauuuacagugucguagaauggacugcaugugugguuagugauuccccaaaauaucaucaagggaaaaacguggaggaaacuucccaaccaccuguuugcaguugaagugacucagaaggccacccauccccuagggagagagagacuugauauauaacaugugcuaucauuaauccagaaaaugcucucaccuuucugaugauagucaucugugaagcaguuuaauucuacucaacaacacaucaucaaaauaccuuuagagaagagaagaacauuuaccuucuuugaucaugguagaaaucugucuaauagugggucuuugugcaguaauuucucaguggauggcggguagcacaugccugugaucccagaacucuagaggcggaggcuccuggaggaacaucaaaaacucaaggccagcuugguccacagaguaaguuucaagucacuuagugaggauuugucuuuaacacugagccaucuccuuuauuauuuauuauucaguuuuuuaaagaguguugcuaugcaacugugaggaacagaguuugggucccagaacccacauaacacacugagugucuuuggaggcuugccuguccuucuagcuuuucaggcagagucaggagauccuaagggcaagcuggccacuguaucagucuagcuguauccauaagcucuggguuuaacugagagauacccccaccuugaugaauaaggugaaagaaugauuaagggugauucccagggucaaccucaguccaccacauaggcagacaugcacauacauauaugaaguuucaguuaaaaucgugcacccaaauguucagauucaugcugcugaagugggcagcuuucugaaggcgcuuacauaaucaguaagaguaggucuacggaagguggucuacaaggggauggucuacacccauccgcucggcagagauagacugggugcaugacaugcccacauugccaaaugucugguaguaaaccauguuucacuucuuuugacucuuccgcaccagaaccguacuuuaggaggugauuuuaaaacaccaaagccaagauuguguucaaugaagaggagaaagagcuugacucaaggcagcaaggcucaagcccugcuuccuagcugcucucccuugagcucagaugacaaaagaaauuugcauggcccagauuucuuuucuucugccugugacauugaaagccucugaagaguugagcugaucugguguaggccagaaugcuguuagcgcucuuccugaaccagcagguaccuucagcuagcugauaacuuugcugaguggauggugugaguuccuauaguauugguuaguuuuugcagcucucgugggaccauagcuuccagcaguuaagugugggaaaaucagguugagcuguuugaaaguuugagccagccaaguuuggaguaucccuaagguuccauucugaguguccaggucagggcuuuuaccgcuuuuccauguggccauacccugucuucaaacagaauuugugcacagccugguuauagguauagaaaaugguguaauauuuacugaaauuauaucauagaagaaauguauuuuuuuauuuaaaauuuguuuuauuauguuuaugugugugggaaugcaugccacuucgaggacauggaagucagagagcaaccuguagaagucuuuuguucucuucauccaccacauggguucugggaucaaguauaguucagguuaucuugguggccuugaaaaauguauucauuuuuaaggacuuauuuaucuuuaccuauguguaugugugcugaugguguguguguauuucauagucggggaaacaaaaucuuagccaacaugccaguguggaaggaaugacucuugaguuaauaguuuccgugaaucucaucucuaucuuccuccuuaaauaugaaaagcagaugugccguacacgccugcauaagaagcucuuugcagaagaggaauucugaauuugaaaguuugaauaaaauaauaggggaagaggaggaguauuugggagagcagccauggaacuggagugauacagaaauacccuggaaguuguaaaacaagggcaauauuccacaaggcuuuaagcacuggaaaugaguaucuuguggucucgguauguggaauaaagaggacuaggucucucugguggugaugguuaggcuacuuucuucuguauucggaggcagagaggugucugacuaggucuucgccccucaucuccaccuuacauguuaccacuaaccuuuaucucuuuuacccguaaauaagccaccauccuguggguuagagaucugcuuugcuuauccuugcuaccauuuccuauagauuuuaaguguaauuauugagugagacauuuugcuugguucauuuccucuuaacccauguaauagcuggugagaaacauggcugcaccguccucuguacuguacagauguggaggccuaggcucagagaggauaaagguauugcugucuugucuagugguaggagguaggcauuacacuuagucuuuuaacucuuaccacccgcccccuccaggggaccagcacgugguaggcgugguaggcgugguaggcgugguaggcgugguaggcgugguaggcgugguaggcgugguaggcgugguaggcgugguaggcagagcagcgcuccucacugccaguggcuccuaacuugccuuccuaaagcugcuuugcuccaccauccgcucagaaguggcugaugcaaugggggcaaagcccuucuaggaaggacugcuguuuucauaaaggaggcccuugagagcuuguuugccuuggcuguaggaaacugcuacaaaaggaguugccauuuguaaucagggcuaucccucacaagaaagacacuccgccuccagaacaugcgaaguauauuucuguuuuuauuagucaccuagugugauugguagcuaguauugauuaucaacuugacaggaucuaaaaaucagcguggagacaaaccucuaggcaugucugugagagaguuucuagauuuugggaagacccacccugaguauagguggcaccacuccuuuggcugggauccuacgcucagugaaaagggagaaauucggcuuaguucuugcauucuuggccuucugcuuccugauuguggaugcagcugccucacauuccugcacagaugccuuccuggccauggugggcuguaacucaaaaguacuggcccaaauaaacccuuccuuaaguggcuuuuaucacgcaaugaagaaaguaacuacccuuggguuaugguuuuggauuuggcagcagaauugauuuaaacaugacgauuucuucuuaaaauccguuaaucuuaggaggcaucuguggugggagagagaaauaaucuggacuacuuaacuccuugucuccuuuaagagucagucaggcuggagcuggagagggagaugacucagugguuaagagcacuaacugguccagauggcccaaguuugguucccagccccaugcugggcagcucauccugccuguaacuggagcuccaggggaucuggugccucuggccgucuuggucacugcccucauucacacaaguuugcucucucucccccuucccccucucccacucuuuucuucccuucucccucuuagaauuccuuagagcaaaaaacaagaguggagcaggcagaguauggugguucacaucuauauuccugguacccuggaagcagaggauggggauggcauugcaaguuugaguucagccgaguuuauagagggacucggccucccucccuagaccagguguugugaccagaugaagugcuuagaguuagauguuuugcuuugagauggggggguacacuuuagcccaggcuagccuggaacuugugaucuuccugccucaggcuuauaacagauucuuaccuugugggaggaucuuccccucgcaucaccaucuugaaaauaggaaagcucaucaaagccccacacuggggccgcagugugacuuauccugcauagucauacugggccuuuguugaacugcuguuuugugcugcauaauuuuaguugguaggaauuaguggcuguguuguuuugaaaagaccuuuccugguuaagauagccuacuggauacuuggccacacuguuagaauaaagauggugaaaaaagcaagugacccuuguccucuucuaguuuuaaauguuuuuccagaaaaaaaaaagcaguauauauuuauguuuaacaaauugucaaguucuugggugucuaauacccuuguucuuugaaucagaaauauuuuaacacgaggauuuaguuaaauauacuuucauuccauaagacauaauuuuuauuuucuaacgcauggucuggucagccaugcccccacuagccuauggcaggaugcucauuacauuguauuuugucagaagcuauuaauuaacuuuauacaaagaaggacugggaagaugcugguuuggugagauccauuaccugcuuuggcuuacaggcuuacaauuauuaacauuucgagaaaacacacuaaaauagccuaguuguagcugauaguguugucuuuugauuauguuuguuacauugcagaugauuuuaauuuaucaccguguacuuuugugcagucuuucuuuggcuuagagcuggucguauauacuuggcuggcugggagccccaaggaucugccuguccucuagauuacagguguaggcuccauaguuagccuuucugcauauauucugaaagucaggcugggguccuagugcuugggcaacaaccacuuuaccaacugaacuagucucucugaucugcuguucuaacauacacauuagaauauacauuuauaccaguuuaguucguugaugucuuccuuggaguauccuuuaugaguuuaagauuaauuuaagaauaaugauaaaguucuuccucacggucagugauuagcagucucuucccuuguguccuggccuaugauucaucucuuaauaguauggugccucaucugaagaauaaagagaaaaaagaagccauagacauaaauguauuacugguuuuguucauguuuuucaagucugcauggaagaaagagcuugaaaaaugguccaguggauaucugucuccuuaguuuaguggucaaagucaauagcaggaaaguuuaaauacucagcagccuggccccuagagauuugauauacaguuuuuggaaucuuacagcaagauuauuaugccugacauccaugcccaccuccaagugcugggauuaaaggcaugcaccaucauguucugccuaacuuacucuaacucugaaaagaccauuuggugacucauaaaacuuuggccaucuccucuuccuccucuuccucuuccaccuccuccucuucuuccacuuccuccuccucuuucuccucuuccuucucuucauccuccucuuccucuuccaccuccucuucuuccuccuccucuucuuccucuuccuccuccuccuccuccuccucuuucucuuccuccuucuucuuccucuuccaggugcccaggcucucugacacucgcccuuuagguguuuggaggugggguccugcuuuccccaaaccuuuucauucuuggaagaucugucuguccuuuucucucuuuuuuuuuuuuuuuuuuuuuuuuuugagaagcacuguuuucugaaugauucaucacgugugcugaaucuuauucauaguuugaauagcaaugcucaggucaaaguaaguagcuuguccaucaccucaaacauuuauuuuuguuuguaguagggacuuucaaaaaccucucugcuaucuacuuugaaacauuaccuaauuggguuuuuuuuuuuuuuuuuuuuuuuuuucccagacaggguuucucuguguagcccuggcuguccuggaacucacucuguaaacuaggcuggccuugaacucagagaucugccugccucugccucccagugcugggauuaaaggagugugucacccuugccuggcuucccuaauuguuuuuaacuguaguuauuguacuacuguauaaaauagucuuuguuccucauagcccccugaaagcacaaaaccugagcaauguuugugcuucuugaaaauaagaauaagggugggggguggguguagcucuguguuuuacaaggcuguagcguagugguucuccaccugugggucacaaucccauugucagccaacaacccuuucaugggggucucauaucagguauccugcauaucagauguuuacacugcuauguaauagcaaugaaaauaguuuuaugguugggggucaccacaacaugagaaaccguauucaaaggucacagcguuaguaaccaucaccaccaccaauaacgaagcaaucaguauaaacaucuagcauccaaauuauagaagcccaugguucggaacauuguuacuuaaagauguuuguaaguauaaagacagggcaugccgaggguacagggcaugccgaagguucauacgccacugggauccaagcacagcugcugugaaggaacuggcaaaccuucaugaccugcgagcaugcgagcugcaggguguaaugcugcagacaguuugugcaaugaaacuggugcucccagcaugacugcaguacuuaaugcugagugagucgaccugaugcauuucagaauaucaugcacugggccagcucuauauucuaauuagcuucuacuucugcugaguaaguguaugcccucuggccuuaacuugcugucuguccacaugccuuuagauuagggucaccucuucuuuuccuuacugacuccuggccaaguucuguaucuaaacguuggcgcuuuggguguggaguuaugcgacuaugcuucaguuagaaauacuuagauauauguuccacagugggguggugaauacauuuuauagaaaucagcaccagauuaaaauccccacugugaacucuuaaggaugacuuaugccuggccaggugugaggagcugaagacagaccuggagcugucccuucugccuacugcacgagauccaguuucugaccauuaggaggauuucuguuuucucguuuagcuaauuuuuuaggucuuaagacaaacucccauauucuuucuucauaucugaguccgugguaucuuuugugugcuuuucuuaguggaaaggaucauaaaccugauucaggagagggcuuuguuuagcuucagguguguugaaagaacguguacuuagaggcuauggaucuuauuuuguguccucagcagauaaaggugacagggauucuccugaggccugacacacaggguagagggcacaguaccucagccugaggccugacacacaggguagagggcacaguaccccagccugaggucugacacacaggguagagggcacaguaccccagccugaggucugacacacaaggguagagcacacgguaccccagccugaggucugacacacaggguagagcacacacaguaccccagccugaggccugacacacaaggguagagcacacaguaccccagccugaggccugauacacaggguagagcacacacaguaccccagccugaggucugacacacaggguagagcgcacgguaccccagccugaggccugacacacaaggguagagcacacgguaccccagccugaggucugacacacaggguagagcgcacaguaccccagccugaggucugacacauaaggguagagggcacaguaccccagccugaggccugacacacaggguagagcacacaguaccccagccagaguaagggauuuuguuacuuugcuaauuccuguaauuuuuaauucuggccaguguacaguuugguuagaaaacucaaauaguuugacacaguagacagacuaacaggacacuuuucugcucugugcuuuucuuaagcagcuguguuggggacucaucuccgugugcuucugaggggauguguacauuaaacuguaaugcacccaguaucucucaagcguuagacuucacgaagagcaaacaauaccugaauauguuuuucuugguucauccuuuugggaaaauuuccccuauuuuuugaaauuaggaaaacaucaaaguuccuaagauuuauugguacugaaccuuaaaugucuuucacguuuacuuuucuuuuuugacuuauuuuugcauugccugguuuaagagcagugugugugugugucagucagucuauccgucauuuucucuaggcaugaagagucuguaugucaguucuaauuggguuuguuuuccuuauaaaguuguugaucuguuucuaacauaagaaugaggcauagucucaggauccagauuuuaucuuaacagaauuucugacuugaacaugguccuagaaaauuaauauaauaaaacaaauguaagagacuguauuaacuaacacaaaaguagucuaaaacugcuuguguuggaauucccagucuguaagaucacauguagcuauacaugaaagccugcagccagcaucuuucucaagagugaaaaaucucaaagcuuuuucuugaagaggagaaggaagacauccuuaaacuuacuccuuaaagcaucaacacaguucugaguccugguaagaauagguuuuaaaacaguaagaggucaguugucagaagucaugucuagguuuuaacuaggguuuguuuucagaauggcuggugaaaauaaaaaccuuaccucuguguucaucuccuguguaccagugauuguuucagaugaacuagugugaggcuuguaucuguuuaaggaacauacguuuuaaagaaacucuuuuuuucaaccagguaaagaaugagugugaggaaucaauagguuguaagcucaguguacaggaaacugugugugugugugcgugugcgugcgcuugcguguguacgugugugcgcgcacauacauaagugcacacuugaguggugugaugcuuuauucuauggacaccuugacucagaacuuuccaaauuauacaacuguucucuuuguuucuaguagggauguuaugaagggaagggggugagagagggauggaguuauuauuguaaaugcgaugacggggcgaugacgggccuuguucuacuuuuuuguuucuguucuucugagcagaagaacaugaaggcuuaaggugaaacgcgccugguuggcgugucagcugugcaggguccggcugaucagaggagacugauaaacuaaaucugcccacuuucuugucuuuuuacccugauuuuuuuuucacuuuauuuuagaaagggauuccacugauuuauucacuaucucccugucuuuuuuuuuuuuuucucgagacaggguuucucuguauagcccuggcuguccuggaacucacucuguagaccaggcuggccucgaacucagaaauccgccugccucugccucccuagcgcugggauuaaaggugugcgccaccaugcccagccucccugucuuuuaagaggcaauuauccuccuccuuugcuaagauuacuuuuuaugcccuuauuacacaauuuuggguaguaauguucaucaaacuuuuaucguacuuaaaaauggcaagagcuuuuuaaugugacguuuucuguaaaacucagcgaugccaucaucaugguuuucucacugauacauucgugugcguugccuaguucuauuaauuugacuccuuucaaaauucugcgcaauuuucuaauuaauggucauacuguggaaacaauucuauggggauguaaaccuggauggauggugauggaugagcuaggucucagggugcugcuguagaagugucauagcucaugacugguucccuacuucucacuuucccugucacgugcccugggcauuccuuuucacaugccugaucugucacucgcugaugugugugccuuugggagucucggaggcucuaguaaccagauuguggagaauauuuugauaaugguuaauacugacaaaauagcuuauccucagauuuucuuuuucaguauuuugguuaaaacauuuaugcuucaucuaacauaguuacuauguuaagaaugaacuguaccaaauauaugaaauaacauauucuuuuuucuugcagaaaagcacaaacacaauauuuuuuauuuuacaaaagaagagaauauugagcuacagauaugugcagguggaaggugauuugaagguagagggagaacacagcuuucuuuuuaaauuuuuauuaaacuaauaaaauauauuuaaaaauauacaacucaguauugacauuuuuuaagucaucaaaauaauuuauaacaauuaaaugccucuuaaauauacaugauaucuucugaagcuaaaaguaauaugcacucaaaaaauuuuaaaaacuauuuggaacauuaaacaugauagaaauagaaaauuucuuaugaaguccucucugaauggaaauugugacaaguuccugacuagacagaaaaaccauuccaaccaagggagaauacacagcguaacuguagcuucauaguaugaauuggauagcguuccuucuguuucugaaauaacauauucuuuaugacuuauuucucagagaaaaucuuagcaugcaaccuugccugucgaaaagucaauacuagaagaauugaguagguuaugcauuucuuggagggaaaugacagcuuuuuaguauauaauuuuagaaauuuuggaguguaaaagcuguuagauauuaaguggcaauuaguauauaacuuugaggauguucuuaauuaaacaaaagccuaauuaagcuucgugagaagcgacuggauccuuguaacuuaacauccacucucauguaggagguuauaggaaacuuuguccguuugcauuacaguuuauuuuaaauuuauauuucuucagggcaaacgaugccugccugcaggaugcuacuuugaggagccaaaccuuucauuuuugcagugcuucaguaacugaacagaugaggcgacaacugaguguaauuaggccaacuguguaaagauguagccuuugcuguuugauuaggacugaaauaagaaggauuuuagucguuucuuugcauguguauauuugugauacaaugguuucagucagaaugcacuauuuacuuauguuuauuuuugaggcagaaucucacuguguagccuaggcuggccugaaacacucugccuagccuugccugaaacuugaugacaguccuccuaccuuagccucuuuugcugcuagaguaagaagugugagcuaccauacccagugugagcccaggaccccucccaacuuguagcucaggcuggccucgaauuaauaaucccuccccuucagccucuugaguagcuaagaucacaggauuguaccauagcaccauggcuggccagaaugaacuuuuugugaagaauaaauuaguuaguuugcuuuuggaguuaggaaguccuuuauaauuuaguuacuugcucuauuuaauucugcagccaaggauacugagacuagaagugugacauaaugucuuaucaaaagugacacauuuggguaaaauaagcccagaucucacucuuaguuucugggcuuagggguuuucacaucucagaaaagcagucuacguaauugagaagggagggagguuuggagaagguuaaaggaaaagguuguaaugucccuuuuccugugaccccccaaacuuagggcuuggcuugcaggucucuagaagcuguuguuuacauauaauggauucaggucuacuauggccagugcucagagaucugauauuaugcuaauuauuauuuuuguuuuuuaggugaaaguuacgugugugccuccaacgaaccauuucguaaaguugauuacaccaaaaacguuaauccgaacuggucugugaacaucaagggcggaaccacccgcacccuggccguggccucugcgaagagugaggugaaagaaagcaaagacuucauuaaacccaaguuagugacugugauucgaagcggagugaagccuagaaaggccgugcggauccuucugaauaaaaagacugcccauuccuuugagcaggucuuaacagauaucaccgaagccauuaaacuagacucaggcguggucaagaggcugugcacccuggauggaaagcagguaagugcuucugccugcagcucgauuguugauuauccuuguggguauuugaagagaugccuggaacuugcuguguaguccaggcugaccuugaacuugggaucuuccugguccugccaagugcuaggauuagggugugcaccaugcccaacuauugcaguuagacauuccacagaauguccuggucuccuggaaguaauccuaguggacuuuuuuuaugaaggauugugugugugugugugugcgugaauuagccuuuagcauaaaaaauauaaagggcuuccguuucuccaauuaucuaagagcccauuauaugccucuucaguuuguaaaaggaaaagauugaauuccuggggaauaaguugcaguacuguccuaugcuaagugagacauuauccaggaauaauuauugacuagugguugugacacagaaauaaaaauuaaagauauuuaaccuaguuaagagucuguuuuccuccauuauagguaaaauggaaaaugcguuucauaaggaauuugaauuccuauuugucacaggaauguccagauacauuucuucaggaacaauagaggcaguuaaucagcauuucugaaaagugaacuauuggcuagaaaugugggaguuggauuacaggaacauuguaucaaagaauccaaugugcucugaaggguugggcacaguauaaaaaaaugaauagagaugugaacguugaguguugccagaaguugauuaacgauagaggcuuccaaaguguauuuucccagauugcaugaaacccaaucauuuauauuuguauuaaaauuuuaguuuccaaaauuaaauuucuucauuuugucucuucccccaacauacuuuauuuuuaaacuuuuggaucuugugaugcugcuaauagaccaucauagaagugucuucugggaaacaugacuaagcaucuaauugucuaagaccagaucuagugacugggugcuugcuacaacaacuccugagaauuucauguagguucuagggcuugggaguuagcucaggaggaaaguguguauuugcuguguucaggcccaggguucaauccucaacagugaaaauaaauaagaagguucaggugugguggccucaucuuuaauccuaucucaaaacaacaacaaaagaaacacacaucaaaacaaaacaaaacaaaacccaaaaaaaccaaaacaaaaaaacaacccaaaacaaaccccagagaaacagcagcagcaacaaacccccaaaguaacccagaaaaagaaagacauaacacuagauucuggguuauagcagaguagggugagauuagaaugcuggaguuaaugaucagauagcuucacaguauaaaugaaaacagacaccugugcaaagaaauugcuaucuagcacaguggaacacaaaacaaccuaagauuuacuuuacauguaugugaaaauaacaggaaaacaagauaaggugaguuagaagggugguguuaugguagacaagggagauaggaaagagacaaguuuucuuuucuuuuccuuuuccuuuuccuuuuccuuuuccuuuucccuuugucugucuuucuuucuuucuuucuuucuuucuuucuuucuuucuuucuuucuuucuuucuuucuuucagcgcucagucucucuguaugucugcacaccagaagagggcagcagauccaauuacagaugguucugagcuaccaugugggugcuaggaauugaacucaggaccucaggaagaacagccggugcucuuaaccucugagccaucucucuagccccuagacaguauuuaacacaucuaaccaaaagaaaaaguaaccuaaauaugcaaauuagaauacagaaaaauauggcauagcuggcuaugaugacacaugccuguaauccuaguaccuaggaagcugaggugggcagaucacaaguucaaggccagccuggguuuauauuaugaguuugagguuagcuugcagcaagaugcccugucaaccuccucuaaacacacacauacacacguacagaacauaagcauacauauacacucagaacacacacagagaacacauauacauacacauacagagcacaaacauacauauacacagaguacacgcacagaacacauauacacagacacucagcacacacauacacacacccauacacauagagcacacacauacacacagaacacacacacacgcacucagcauacauacagagcacacacccaacacacauacauagcacacacacacccuacacugaauaaaaugaaaggugauauacaauagaaauugcagaugagauuucaaaaaugaggacucaagauuuggaaaucuccaaaugaaugacauucauggaauauguaagugaaacaaaguaauuggacauuuaauugaaguaguaaauauugaaauuuuaguuguuagccaaaagaaacuuuucaaaaagguuuuacuuuaggaauguaauuuuucccuacauaaguacuauauuuaugucauuuccaccucuucucccccuacuccaacucuucuuguguccccugcccacauuccucaaauucaugacuacuauaauuauugucauacacauuuccauaugcacacaucccccaccaccacaccccccucccaagucccuuuagcguuuucauuuguauauguguuaaggguugggcucuugggaaaaaauugauucucacucugauuucagcugucauucauugucuauagcucuucaccuaggggugucaacuggguggugucauugugcaggucuuguuuagguagcgcuaugguugagacuucaugggugcaguuuucugucauggcuagaagacacuaggagcagguguccugggucuucuagcucuuaaaaucuuucuucauccacuuugacuuuccugagccuuaggaaggggcuacauuguacuaauaccaauugaggcugagcacccaugcuuguuuguuugaccaguuguaauuaagucucuacuacaaaaaggaagcuuuuuuuuuuuuuuugaagcauaagaguuacacauaucuuuggguuauaagaguaagcauuuagaauguuguuaggaauuacugauuuuggaaaauggcaacuccagccauggagaggucuguagugcuagguaugccuucuguccuacugaauagaacuuaaguucuguuagacagcuguuggguuuuuccacgcuaagagugcccuuuugucauuauuguaccguuggggugucuugccaggcaggucauccuugugguucggaggcuccguagcuggcaggacuguugggcgcuccucuccuucagcggcuuacucagcagcuucagcugccacuagagcucucuuggggaagaggcuuucagguccacuccaacuuuauccccaaguccucugucugaaguguguggugucuucagcaaaagagcugaaacuaucaguugcuguguugaaaugagaaagaauuuccuaagaaugaaagcagugggaaaaauuuuaaaaaguaggguugauuggacuguauaaaaauuaaaauuuuucuggaugucaaacagcagauuuauguuuaaguuauaauggcagcuuaauaauaaggggacacuggaaaagugagugaaaaucuaaacaguuugaaaaaaacaugauauauacaguaaucauuaaaaaugcguaaacgaacacugaaauguuuccagggcugggauugugacucaguauggaguauuuguuuagucugagugagacccugggauuuauuccugauaccacccagaagugcuucaguuuucuuuuugugcuucaaauugauaguuuuguuuuuuguuuuuuguuuuuuuuuuuuuuuuuuuuuuguuuuuuuuaaggauaauagcagugaaguggaaacauaaggguucuuugggaagucaguuguguuggaugguguuuugcugaggcagauacguaaaggacugacuagcugaaguggacacaggugaaagacuaaggcagacagugaaggaauguuucacugaagcagacacaggagaggauguucugcuaaagccagcucaugaaaggacacaugaggaaggguucuucauuagcaacacaaguuauauugggccgccuuacacugugucguugagcuucauuuguugggacucagggaaacuuuuggguggugugcuauggcuucuugccgcuucugcagaccugggcugauuggcagaguucagacacacgcacugaggcaagacccucugaggacaugauguuuggagaggguauaaaaaagauguugcuucaaagaaccuuucuaaacagguccacuccaugcuuucuuucccacuaccucugguggguggugggcuaaaagggagguuaaaguguuuaaggaccaucauuaaaaauaguuuuuuuuaaauuaaaguuacauagaaguguccacuguuuuugaaugugcggugauuuggauuugucaaaagaacuggaaguauaaaauuuauaagcuuugaaaagcggugugcugauuuguauaacucaaaggucugucuucuugagcucguaaaucacguuagaaauuuauccuaaguaaccugagacacaaacauacauuguguguaagaacuuuaaguccagcaugcaaucggggagauagauggcaaacaguuaaaucccgaaugucaaaauaguauacguggcauuccguggaacaaacgccuuuguccuggccguugacauguauguuugcagaaaucuuuuaagauuggaggaaaaugcuaauggaagaaaugagguaugaacucuguauguuuuguuuuugauuuugcucacaggaaggacggaaaggguaacuuuuacaaaguaauucagagggauaaaaauuaucauugcugucagaacccgaggcuggcccuucugccgaggcugacccuucugccgaggcuggcccuucugccgaggcugacccuucugccgaggcuggcccuucugauucccuguagccgccugaggucaggcacuuauagaaaguuacccuggaaggacuggcagaggucuugggaugacagggcuacuuugucacuguuuguugguuagcugguuucucuuuggagcuagggucuugcuguguggcccagguuggcuuggaauuggugcacccaccugccucuaccucaugggcugugauuauaagccauguccugccaugcugggauauuuacauugcuuuuugaauuuacauauuuuccauguggaagaaaauguuuucaaacucugauguaauauuuaaaaaaaacaaacaaacaauuacagccuuuacuuuuagacauacuaauuuggauacuacacucuugggauccaggccauuccuaaagaacugcugagguuuuucuugugaguuaacacggcucaguaguugaacuugauauugucagugcuucacaucuauuucuguuugcugugugguuuaaguagauagagcauuaacucuugcuuuaaaauaacaagcaauuaucauguuuaagaucagugaaaaccuuuguguucauuuugacuuuuuuuuccccauaaaauggcauuuuucuauggguuuguuaaccaccuccaugcccccccccccuuuuuuuuauccauuuuugagauaggaucucuauguggccccgcuguucuggaauucucuguuuacuagacugguuuugaaugcaaagagauuugccugcuucugccucucaaguacuagguaggcuuaaaggcaugugccacuaugccuaggcccagaucuaacuacuuucuacagugugugugugggggauauaugugugugugugguagguaguguguaugggcuuguauguaugugguaugguguguguguuuuuauauguaugacagauuccucugaagagaaaugagaaaggaaccuagauauguuaaugaucuauauaucaguauaccauuuuagauauguuaaugaucuacaucuauauaccguuuuagacugucuguguuaaaucuuuuauuccuaguuuacuaacuacccaaauuuguuugcauuuaaaguuaauugggucuaugaagaaauugauuuuuuuaaacaauucacuauaaguugucacugauaucauccugaaaagcagacuuuugggaggucuugcuuucuuuuaugguacugaaggcuuugggaauugaacacaucauaggaaaucaugugacagcaguacuuauguucuuguuacaauaugccuuaaacuuuuucuucuuucagaauguucacauuuuccuguuagcauugacuucauuuauaaaaugugaauuugcuaguaacauuagcuuguauauuuaaagucuucauaaaauuccuuaaaucaucuuuuaggauuucaucuaaguugacuuauagguucuaaaccagcagugacuuuuuuuuuuuuuuuuuuuuuuuuuuuuuugucgucccuaggggacauagaaguauaucuggagucaguuuuuuguucucacaacuagaaguguguauucuuuuuuguaauuuauuuauuuuuauuuuauguaaauuggugacaguuuugagcugccuugggaauugaacccugguccucuggaagggcugccauuauucuuaaccccugaggcacaucuccagcccuagaaguggagauucuguugguauuuggucauuagaagccagaguugugguaaaggucccaagauucacuggcagcuguaguacaguucuuugggcuccacauagugcugagauuuuaaaguccugguaaugguguuauucaaaaagaaguaagucugugaguauugacuuugucaguagaccacaagcugaacuuuaguuuagaccuuacaugcuacaagaacaucugugucaucuaaugggcacauaagcuuugauguacuggauaugucagcuugucuucauugugugagggucgagugugguuagguaguacagcuuuacaaauccuuaaggaaagauguccuaaauuccuuugucgauauuucagugccaagcaucacgauuuaaucauaaguauuuaguacuuaaaagcaaccaugguguaauggucaccggaagccguuagcuugguugucagcugaugggguuuuuuuggaagugauuggaaaacccaugggcuucuaucucaucaguggauuuauugguugaugggcccacaauuugauuggcugcuucgaggugcuggaagcuagcacaagcaauaauuucuugggcacauuucugugaggucauguccugcucucacucuuaucucucugucaccuuuuguuggcagaggugaacagucuucucuacugugugccucagccaucugucuuggcucagguccaguacagcgaggccagccgaucauucacugagacccccgaaaucaugagcaaaaccaaccugcauuccuuuacguuguucuuggguauauuuugguacagggagaaaaaccaaauauacaugguuuucaacaucauuaaaguuggguauagcucaguaaugggccccagguuccaugcccagcacugcaaaagggaaaaagaaaaagauaaaugaaaauucuuagugugcaacccauguauuuauaaacaaguugacuagaauaaaugaucugcaaagaggaauacuggucguuuuauaauuuuauuuaagcacauggugaaauuugguuaguuagaaccaaagcuuugaacuuuuaaacaguuguauagaaaacaaggccuuucaaauauucuuacagauagaaugccuuucuugugauaagucacagugggaaaguuuuuuuuuuaauuuuucuuuuuuuccuguuacagaacucaaagauccagauauaacuuuguccacauaugugaagaauucuagcuuuuagcauucccagaaacagcagaguuuaacauaaaagaaacauuuuauagaauuuuggaacaaguugauucugucaugggcagaagcaaaacagacuuagaaauugcuugcaguuggcgcuuuuaggguaaaacacuuccagaccguaggcccacugccagccuugggaugccugugugcuguguccccuuucgccauugcugugugggccuccauccucggagccguucaggguuuaggaagaggcuuugagccuugcuuuggugaggcuuagcuacuacgugggucacuagcacguggccggcugguuugcagacccccugcuguuuccagccuucagcuuuggcucccucaauucuuccuuuuccuguggaaguacucagugguagaacucuugccuggcaaguccucagcccuguugguuauccagagagcaaagguuaagcucagccacacccccuucguucucagcaucugccuccuagaagaaggaugaauugagucuaaauuaaaaauuguuucaugaagaaaaauagcugagaacucaugcgugcucugaguaacccugcguaacuuuccagauuuaaaaauugaccucauguguuuguugauguuaauauagaaaagcucuaugcucagaacugcaguuuuucaugauucuccuccuuggguauuuuuagcacuguuaauuguagugugauacagcugccagacucagccucugcaguugcucucacccgcuuccacagagcuuuaaugcuaugggcugagggaaugcucaucauccgugaugcagccagcgccuacccagauggaccacgccugcuuucauaggcgguucaggcucuugauugaaaaguuuuauucaaaaaaauuuuuccccguuuugugcugguuuaugguaggcaucucuaaguacgagcaugaagacauuugauuauauuuaaauacguuguuccugugguuuguccucacacagggucauuaaaaugacauuucaaggaugagugauaaguaucguguaugcacgcucgcucacucaugcugcuauuauacgcacaguuguauuuuugaagguuucuucuugagcaccuaaucucucauaguuguuggcuuccccaguuccuguuguaaaauauuauggcugaacaguugaaaauggaaaucaacuuauuagugagccagguaucaaggccuuaagacugugaacuugccagccaagggcagagugacuucaacaacccuuugaaaaugugaauuaaaaaggucuucuuuuuacauaaaacaauguuuaagugaaaacauucaaguccacuuagguaaauugauccaaauuuuaacauccugugugcuucuucacuuaguauugugguccauauuuuauauauggccaaggauaaauaucuuaagaguuuuagaagcugaauaugauuuauuuuucuugcauuccuccuugguaguaucaaucaauguugaaauaaccucucaaccuucuaggaaucaggaaaugcggccaguauaauuugugcccuaaggagcuaacuaaaugguuuggagcccggaaaauauaaaaauaauuugauuuaauauauuucuucccuauguuauaggacagaguuugugagaagugccauccauuaaaaaauguuaaugauagugaaguuaauaagaugcugaucuugagugccaggcuuuuaacccaugcuuauuuuucaagaucauccugcaguugguguguggucauacccuucccugaagaguguuacaaaacauauuaaaagaaaaacuuuaggaguguguguggaggggugggguguaaauaugguuaugaauguucacauguauguggucacaggcauucauauguguggaggccugggguucguguugggcgucuuccuuaguugcucuccacauuaaggacugaggugggggagggucacugaaccugguucuugccuuuuggcugguguggcuggccagcuuugcccccagagacucccucccugacugcuuccugggauugcagacaggccacuguaacuacuugacuuuuuuguguggcuucugggcacccagguucuaagcuuccuuccuguguggcaaggguuuuaccugcuggguuaucuuuccagcccccaaagagcuuugugacuuggacuugaggugaccaucuuugauauagcaguguagcuccagacuucuuugcuuucaaagcuaguuucugauauucaaaggaugaugucuuuuaccacguuauaagcauuccuaauucuuuuccagacucugccuuauagcacaguuuauuuacuuuguccugaauaacuuaccaacauuuccaaaauuuaugguaacucucagaaaaugaagcuugacccuguggcaguuugaauauaaaugacccccauauauucauacauuugaauacuugguccccauuugguggaacuauuugggaagguaggagguguggcuuugggaggagguguguucuaggggugggcuuugggguucugaaacccacauucccagcuaggccucucucugccucguguuaucucaacaucuaagcucucaacuacugcuccagugccacgcucugugucugcugccgugacccccaccaagacggucguggauucuaacccucuggugcugugaguccucaaguuaaaugcuuguuauuaguugccuuggucaugaugucuucucagcacuagaacaguaacuaagacagaccccaugaaggguguucagugacugucguguagaauauaaaaauucugaggauguacuuacuauuaugaaucucauaaagggagagcagacuucaacauugggaucuacccuacauuuauaacuaucuaaacuuuguuauauauguagacaaaugcaauaaauaauaaaugccaaaacaguauguucugguccuaggauuguggaugacuuucugguaaguuuucuuauuauguuuauguaauaaauuacauucaguaucaccagaauccuggguagucuccucaccagaacugaauuaugagaguggacucacaaagagccaacucaccuucaaacuuuauuugaaacuggccaguugucuuucuaagaagggauuuuuauuaaguuugugacauguuuuugggcuaagguagaauuaauuuguucagucauugagguuuuguuuuuuauuguuaggcauugucuuaguugcuugaggaacaggugcaagagaaguucucugcuuuugaggcacugucauuguagcagaacagauagccguaaaagccaauuacguguaggacaagcaagucuauauuuggccacagugaugcaagcugggcagaagaggaaguucuucauggaguuaccacaaguucuucacagaggcaguagagugcuccuuacagucauuccacacaguggaguuguagcauuuaaaguagguuuaguuugcagggaguaguucagguuauggaauauguguauuugaucuuucuucauuuuaggccucuacauuuuuuaugucuuaacuuuuaacuuugaaauuagucuuaaaauuguauaaugauuccauauacuuuuuuaaaaaauaaauuuuaaauuauuuguauacaugaggguuuugucugccuauauaugucugugcacugugccuggugccuggugccuggugccuggugccuggugccuggugccuggugccuggugccuggugccaagaaagcaagaagagggcguugcauuuccuggaacuggaguuagauaggugugagcuaccuuguggaugcugagaauugagcccugguccucugaaagagcagccagugcucuucacugcugagccaucucuccaggcuuucuguaucaucuccauccugcuuccucuaacguuaucgcuucuugaacacaggcaguugucuaagugugguugacagacacaccauuaguucauguguagaccuuacacaggcaagugugccuccucagugucuugcccaucucacacuugauccagaagcacauaugcauuugcucauggucacccuuuccaccucugacagugacacauccuuggcuuuuuguggucuuguugcuugggagagcucuggcuaguuaucuugcauaguuccucuugauuuagaacuuugugguauuuucucacagugauaucuugguuguguuuuugguaagaauacuacagaagucaugcugcguccucugagugccuuuagucagacacacuggauaaaucucauuacugguuggccgcuugauugcagguugcuuuucacuauaaauuuugacauuuuaagcauaaauuaauaaguuguagggauauuucuuaagaaugugcacauauaggcuggagagagggcucagcgguuaagagcacuggcugcucuuccagagguccugaguucaauuccuaccaaccacaugguggcucacaaccaucuguaauggguuaugaugcccucuucuggugucucugaagacaugacggugcacucauauacuuaaauaaaaucuuuaaauaaauaaauaaaagaagaagaaugugcacauauuuuuguuuuucacauuuugaucuauuaauguuagugccugcugauuaucauugacuccagcaacuacuauuauaauauuugcugaauagcuuuucugaucccacuguccuuucaggggucaguagcagaauucuguuccugaggaaagcuuuccucuuucuuuuuuuuuuuuuaagauuuauuuauuuauuauauggaaguacauuguagcugucuucagacacuccagaagagggagucagaucucguuacggaugguugugagccaucaugugguugcugggauuugaacucuggaccuucggaagagcagucgggugcucuuacccacugagccaucucaccagcccagcuuuccucuuucuuguuaggagucuuuagucuguagguuuaauuccuuuacugucacuuauuuugugguucaaaaugucucuuauguaagcaacauuuuuuuugaaacacauucugucuauguacacaagcuggccuugaacccaugaaccuccugccauagacauacaaaugcuaggauugugugugugccgccauacuugaccagauuuuuaaguuggauggugugccucuuugacauauuuaaagcuauaugaggauagaaugcguguuuggcuucaugguagaguacuugcuuaacauucaccaggccugagugguuuuuacuucuucauuagguaaggaaacuuguuaguuagguucauaguuagacucauggcacacaaaacuaagucugcaucacugcuacaguggcagcucuggguccaucacucugaugcgucuuaaugcugugccuucucggaguuucuccuggcaccugucucuguucauuguacauguuucagguuucucucaauguauuugcuauugagaagcuggcccagaggcugggauuuagaguaugucuacauugauugguuuuugucuauuuuagaagccuguuguaggcugcuaacauccauguuuuugucuguagauggcugcuuuuggaugaacaccuaugaugugucuuggagcugcuguuuaagucagcuccauccaagacacaucauaugggcccugugacccauucugaccaaauucuauaaugaauuuggcucuagauggucugcugcacuguagguaucuguacuggcugguuuugugugucaacuugacacaagcucgacuuuaucacagagaaaggagcuucccuugaggaaaugccuccuuucaugagauccagcaguaaggcauuuagugaucaagggugggagggcccauuguggguggugccuucccuaggcaagcugagcaagccaucccaaagcaagccaguaaguaacauuccuccauggccucugcaucggcuccugcuuccuaaacugcuuugaguuccagucuggauauccuuggugaugaacagcauuauagacguguaagcugaauaaauccuuuccuccccaacuugcuucuuggucaugcuguuugugcaggaauagaaacccugacuaagacagcaucuaaggacuuuaugacugugugauaggaggcaguuuugcacaugagagaaaguuggaaauuucuggagacacuauuaaauaugaaccauuaucuuaggguguaccauuggcaucugcugggcgcugcuaaauauagagcccaggaagggucuccagaacaaagagucaucuuacaccacacaucaguauugccgagguaaagacugugugacauaaugugauggaggugaagaggaaagauacaaagguucugagggaaauccaugcagcuugugagcggccaggguaagggguaugggguggugcguaugguaaaguguggugguuugaaauaaagcuagguaaggaugaugcacagauaggguauuuucaagauauuuggaaccagagcuggaccacugaaggcuuguaagaggauccagguuuacuuuggagacuaugaaaugaguccauaaagaugaccagauacagaaauaaauagccaauggucuuaggauguggacugcuguuggguaauucuuccgaguuguaauugguuuacagcuuccuaagugcuuaugagcagcggcuuaggcuguauccagauggggugcugauguucuuaaaggcaagugguuucagagggcaaagauuuacacauagacggaauugaaaaaaaaaaaaaaacuaaauggguugagguaguggaguauuugauaggagauuuaaaaaaaucuccauaaugacugaaaacugguguugcuuauggauuuuaguucuuuaaagaacaguauuuuucaguagcuuuucacugucacccugggaaauguaaguggcagaucaagugccaggaauguugcuuagcagcaaugcugggugcaggcggacagugacuuucacugggugauucugaauuuguguuuguccuuucacuaaccuguucugggcuugaucauucauggucugagcaaggcagagcuuuaccggagaaaccuuguuaccacguuaugugcacaauguaacugcuuccaauaauacauuuuacuuaugaaugcauugaaauguuaaaaaaaaaaaagacaacaaagaaacuuugauauaaaugugcuucuugguagaaaaaggaagaauuauaagcagcauggaaaaugaauggccuaguuuucacaagccagaucaugacaacauuuaucggcauaagggucaaauguuccuauguuugacuaaaaaucauuaucaaaagcauaaccuauuacagaauugauugaaacaauaauuuuaauaauuaaauagcuauuuaauaauucaguauuuuaauaauuuaagauaauugauugaaaaacucuucacuuccugaaauuaaaguuuuccucuuuauuuauagacauaaacauuuauuuggaaaagaaaaaguuaauuuccaccgaugauucagcuuuucaugaagauguuugcaguuuugugcugauguauguuaccaaguuaaacuaaauauaauuuuguauuguuuauauuauacagaguucucugauuuguggcuucuucaaacuauaauuagagcaguuuaggcauugaacuuuuauauggaaguuauuuacaggcuaauuuccuguagaguaaaccuucugcaugauaugggguaugagcacaaagccauggggcaggaguccuugcaagugcucccugcaagcucucagugcucccugcaagcuuucacugcccagugcacucagaacacagugcacugaggcacugcuucucagcugcaacacugucaaucaggacgugcuaaagucaggacacggugagaaaaguacaaggggcucguuaauacuucucauuuaaagcuuaaaauuaucacccagaguguggaagaguucauccagggacggaagacaaaguaggcuggagcugaaaggcugauguguagaacuguucccgcccagcaccagccugcccgccccacccuccggagcauguacuuacagaggcuguugcgugcauguuucguguacacacacacacacacagaggccuacagaugacauugcugagaggaaauggggauaaugcugggucgugguaggaagugaguugggagaaauuuggaagcagaaauggaguuaaguucagacuuuuagcuggagaaaggacauuggcuguugauaaaacaaugauagaaugaagccaaguggugguguuggcccaggccuuuaaucccagcacacaaaaggaagaugcaggcuggaucucugagcuugaggccagccuggucuacagaguucuagggcaaccagggcuacacagagaaaccuugucucaaaaauaaaaaaaaaaauaaaucaaauuuuuaaaugauagaauaaaaacugcuuugggagucaagcuacuguuuagucugaggcuacagagcaaggagaagcucuggcauuaucaacugggaggcacuauuuguguagguuuggugaucagacuaccaugguggaagcaggacaagaugugggcccaauacagaagaggguaggcucucuacccauagccacagcuugcugagauuaacagaggauuugauacauucuugcugcgaaugugaaugcugcauauaugucugcuccaugugugccuagugcccgaggaggcuagaagagggcauggcauccuuuggaaauguugcagacaauugugauccaccauguagaugcugggaucaaauccagguccccuggaacagcagccaauacucuuaaccacuaagccaucccccuagccucaacccucccauccuccauagacaacucuucaaaguucugguuuccuaaggggcagaaacaccaaggagcaaaaagcauacuucuacaguugaucauuucagcucuucauguuuaaggcuggaaaaagccgaguacgguuuuuuucuaggacuaaauuacccaguuuacuuaauguugcccuaauaagguagaaauaacaguuuuguugaauuacauauuccagaaugcugugugggaggcuuaaugcauaggagauauuuuugugugaaguaaaaguauuguuuuuaccaagguaaaauguaaacccagcuuauguaguaacaaggcuccuuauuuugcuguuagccuggugugacccaaggaaacauaaugaaagaguaagcuuuugacaggagcuaguucugcagaguguguaugguagccuccaaguauauccugugaggaaauagcucaguaaccccucgguguguuuuugagucucugaucagagcucaggaccaccacggcaccgcaccucagccuuacugcacucaggaacaccagccagaacuuuagcacuguacuuggggaaaaauuuuaaaaaugauuuaaaaauuauguauagguguaugugucugaguauggauauguacacaugagccugggugccugaggagacuacaggugcuggggccucuggagcugggguuggagguguuuguguacuucugggagcugaacugaguucucugugagagcaauaguggcuuguaacugcuaagccauuucuccagacccacuggggacaauuuuaaacagaaaaccugacaacaaaagaaaaauguuuagaaacaagugacuaugaaaaggauauuuguuuauaacacaaaggagaaacaacaucaauuucuuuguuuagccccagcugggugcaugcugggugacccccuucccacucuguguuuuugagagugaccacaaauaguguucuuaggaauaauaaaagauuuuuagcaaguaugugaaucugcaggugagaacuaugaaaauuaaaaaucaacuacuauuuaauaaugaggucacaaccaucacaguaagaggaauuuuuguuuuauuugacuuuuuaaaaaagauacagcccuggauagauagcccaggcuggccucaaauuagcuguguagcugaggauagccuuuggucucuaaucuuccugucuguaccugcuggguguugggacucuucacuuauaacaaguuaaaaauugaauccagggucugugcaugcuagggaagccuagcuacauuccugucucuguguuugauuuguuacagagauggucuauagcaggguacaauguauauguauguaauaaacaaaggcagccuucucuuuuguaauuggagagagcugacucagaggguggagaaaguuucuuugugccaacaugucaaaaggaaaccugaaaugcauauacuuuccuuugcuaagucagagggagcaaggugugguaggguugauaacuguacuaauaacagucauuaaguggcaucuaauuacaauguguuaaagagucuaaguaauaauaagucacauuugcuacaguucaugagucaucucauguaaacaaggauuguaauguaauggggagaugaagagagcagguucagauagcagaagggcacuuggguuggagggcucugcuuuuauuuauucuucucuucuuauuauauuuauuuguguauuuuuguguggaugcauguguguguguguggaagucagaggauggcuugcaggagacaguucucucuuccugaacuguagauugaacucagguccuuagacauggcagcaaggcuuuacccacucagccaucuuugcuggccucauugcauacuccacccugccuucuaguccuuguuuacaggaguccguuuagauaacauugugauacaguguugauaggaaaugagaacuauguaucaugaaagaauucccuuuugcagggagcucuuguuuucaaauauuuugaaacauuguaugauaggagguauguuaugaaauaaacagauuuuggauaaggcagugcuugcuguggacagguuacuuaagauguuaucuugauaaaauugagucacuuuuuuuuucaugugaggugcauuucucucaguguuucccuucuuuuuuuucucuugaacucacugaaaucauuccacacagugauagggcuauaccugaguuccugagggggcugcuauaauuguaucucuaagguauacaacuggcuuaguaggaacaaggguuggguuucaguccccaggaucaaaccaaaugaacagcuauuucaaucuacuuuuauuuuuccauuucuagaaauccugguuuucccuuuuucuuuucuuagcccggagcacuguuggacuguauuucugucugucauguucuuuccagccguucucccaaauccuguguuguugucccuuguaggcuuucauuucacucagacucagugaacacuuucucuauugacggcauuuugcuuuuuugaggacuaggaugccuuuagacaacugcuggcuuaucuaauucaaaugagugcaugaauuauggaaaaagcugauuucauuuauuuuagaaugaaaagguucuuaauaugauuuuaaacaauuuaugaacaauaucacuggugaugauuuuuuauuuuaucccucugcuuuuuguaguaauggggcgcgcgcacacacacacacauacacacacacaagcacaaauauacaagcacuuguauacagucucggguuguauaugggaaaagcuuaauuauuuugcacacucagagaauguauguuagcuaauaagacauuuacaggucuugaaaguaaaauuguugcaccguuuccccgagauuauucagccauagaacccuuuaaugcaagaagacccuauccuuguaccucuggagaaguguaucguaaaaugccacccuaaaggcaagcgcuugaaugcucuguacuccuauacagugaguaguagucuggugugcucuagguacugagcugagugcaaggcauugcacuuuaauugcugauggagagcuuccacuguccuuaagaagaaaccaccgaagguuauaaaauacagugugguaggugcuuugaaagaguuaaguagaagccaggcaaugguagcacacgccuuuaaucccagcacuugggaggcagaggcaggcagauuucugaguucaaggccagccuggucuacaaagugaguuccagggcagccagggcuacacagaaaaacccugucuugaaaaaaaccaaaaagagaaaaaaaaaaaaaaaaaaaaaaagaaaagaaaagaaagaaagaguaaguaugaguggguuugugaaagacuuucaaaaugcacuguauuugucuauuuuaguuucuauuauaaacaacagaggcuggcuaacuauaaagaaaagaggucugcugcuuagcuuauuuacagugcugaugaagguucuaguccacacaccccacacccugcuguaucaccacaccaccauggcaauguaggaacaggugugagggaagaguucgugcuuaaaccagaaagccaguaccucuguggccaugcuccuagcuggcugaagaacucccuaaccacaccgagacccgagcuccaaagccaugaaccauuggucaagggagggagggaaaaauguucaaacuguggcggauacuagccauacauagcagagaaagcaccgcacauagcauaagggcacgcucauucauuuugcagauaugagcaucuccucugaauggaggacacagcugugagugggacaaggcucuuugcugcuuuaaaacuuaaaucccagcuggguaaggcaggaaaaagaagcaaauuuaaauuuagcauuuuuuuuuuuuuaaauaaugaaaagagcuguggagaaagaaaaguuggcuggggcugcuguguaaauggauagaguaugaaauagggaagaggcuugggggaugccaguuuggagaacuguggacuuguggggucaccaggacauacagaaccucuaguuuuccuuguugaauuggcgugccaguuaguuuuuugucaucuugacccaacucuggaaugacuggccuguaggcaagacuguguggcacuuucuguacuaaugacugguauagaaggguccaguccacuaugggaggggccacuacuggacacguguuuccugcaggucuaagaaagguagguagcuaaauaugagccuggagagcaagcuggugaauagcguuccuccugcccucugcuucaguuccugccgccugguuccugccuugaguuccugcccuugcuucccaucacaaugggcuguaaacuguaacaggaauucaagccuuuccuccucaaguuacuuuuggucaugguguuguuauagcaauagaaagaaaacuaggaugcccuggugugcugaagacaauaguucagugauggauugcucaagaguggggguuugcugagacuagacagggaaugggguuuugcugcucaaauagugggccauugagacucaacuggacugaggaggaagcaguguuaagaggaaucccagaagcaguagauguggugaagguguuacauuccaaaguguaaaagugugguguggcuuggaagguuagagcagcguguuaguccugggggcuguagaaguagguucccacugaauaaugcaggguguggucuuacacugaagaggcugaggaauuuugauggaccuggcugcacuggagauaucuggggugugaggaugguuguuuaugucccauccuuuuagaacuacuugagggaaagaggccaugacccauguuuuaaagcacuaggugggagaagucaggugucaauugcacaccacaaauggcuguaaugaaauggugucagagucgaaggcguagcccucaggauugcuguuauguaagcagggcggaagugauuagguugucccuucuagcacgugacgcaagggaggggguguggagugaguuucacaugccagucugggguccgcagaggcuguguccaugugguuagcaagcaugugucacaacacuuuuaacuuauccacuacagugauguagaauccauggaguaaaaaacaauuaaaauucaccaagaaaccaaauauauauuucugugaacaaaucuauugauugcaguagccacuguguaaagcauauauauauaaugaaccaagcaucugaauuuuuuuaauauuugaagaucuauuauuuagaaauuguguuacucaacagaugauugcccccagaacuccaucugugaacacaucuucuuucccuaccacuaguucuguauaaaugucacuuucuccuuaauccuuucuguacacacugauccugccaguagcuggauugucacuggaaacccaagccuacagcucacaucaagaccuuucagaagaacuuauuccuuguguguguugggggguccucucugagacuugcugguccuagaacgguuucuagagggugaaggagggcuuugcagguggagagaaauggauaauguuccugaauuucauguuuauuagagguaugaccuuccucaaaacacuugguaaucucauuguuauuuguaaaugaaggcagcaagaucaauuccaaagcgcucagcacagagcccagcuccugcucugugacuguggcugagagcuguagaggcucucacuagcgucugcacgcauccugcgaagaagcgucacugcagaggcacccguaaaugagacgagggaagggaaaagguauucagaauaugucauccuaguuuuauuuggggcauuuaagagcaagucuguugugggcaaggaggucucaccuaaaguaaaacacaaauacagaccaaaacaccaaaguuuggacuaugauuaggcuggcucugcuuuuuuguuugguuuuguuuugguuuuguuuuguuuuuuuccauuuuuuuccuccuuugucuuucugaaauguguggugcugaagauugagcacagagccugcuauaugcuagucaugugcuguuccacucagcuacauucccagagcuagucggcucucaguguauuacuguacccgggguuucuuaauugugacuguacaauaaaaacucuugaggaucuuaaaagaaaaagaaacgguuuauugaacuuauucuuaggagauuucuguuucuaggcacaagguagggucugcacagauaauuuaaaaauagguuucugaacugguaguuagaaaucaggacuaguaaugccguuucccccaaauucucaacccgaaauaagguaacaugugaaauugccuaguuuacaacugcaauuuauaaaacuguauugguaguuuuugaugcauaguacguuaucccaaaacauuacaguguucauaaguaaaccuuuguuuucauccucuaagauuugacugcagcagcaccucugacgucucuggcugcuugauaccaggcugggggcagugcugaugcagcucuucccauggguuuggacuuccaugcucagggccagcccagcugucguagguaccgggagcaagggggcaccauguggguauaaaagcuuagauucucuauuagugacuuugcuaucacugugauaaaacaccaugacuuauagaaggaagagucuacuugagcuuucauuccagaaggacaagggucugucacguaugggaggcauggcaaccagagagcaucgagcacggcgcucacauccacaauggccagcauggagcagaaagagcaaacucuuuuaaacucucaaagcccaccccuggugacauacuuccucuagcaagaccacauuuccuuuaucuacccaaacagugugacuaacugggaacuacauauucagucaucugaaccuaugggagacacucuuguuuauaucaccauauacucagugggucauuaggucaaacucugguguugaggaugcugaaagauccaaucuguuccagaagccuaaauaugagcuguuacuuauguuuaaguagaaccaucacauagggaaagaaguguugauaaaguaccuguuguuugucagauucagugggaaaaggcugagaaaauugguugggaacugccccaauuaaagauuauuauuauuguauguuaauuacuauauaaguuagguagccuugggaguaggggugggguaacauuguggaaaccuucacauaaaaaaaauguauaugcaauuuccaaugagcuuuggaacaguaaaguacucauaagaugugaccaccuguauauauuucuuaaaauccucccuuauagcaacauuaugaaugaaguuauugaauauacaaaugcuacccuuacagauacagccuaguuagaaaguugcauauccaaggggaagugcuagccuacugccuuucaagguacaggcucugggugcugaucucuugcuuccauuauggcugugugcaugaacauuuaucucugccuguauuucauuuguaauaacgucugcccuuugguagaggcuaguuauuaagguuagauguaauaacaaaguaugugaaauagcacugagguuauagaguccuaaaaccaguaagaaauggcaccgauuucccuaagaacucgagaaguaagcuuugggcucugccguccacugauuccuggcuuuguccuguucuagcuguggcguguugggcaggguggguaguugucucacuguucuucauauuaacaaaggaacuaagcaccuuuccuagcauaucagcugcugugaggcuuaguaaacuuguagucugugcaaaccuaugucacacuguagauguucagugaaggcuaaaacucuucaacaguaaacggaauucaagggugguguuugcucguucagcccucagugauagcagaagaaagucuaagaugcauaguaauuuugugaacuuagcucucugaguggaaaagcuuaaagaguuguguuuggggauuuuuuucaagucucaaguuaccuaaaugauaauuauucugugaaaaauguaugaaucaaacauguacugccacauguacacuaaugauaugccuagcaaagaacuuaaggcacuguguccaucuucaggaagcuagcaaguaguugggaaaagcaaagugacuugugguguccagcuaggggugagcgccacagugcagacuagcuguguaaaaggagccucuguccugagcccuggacaccaagugccuguggggugauccuguuaccuggauagugagaccugggugacaguucuguuguuagccgcccggugugcuuauguccuggucagcacagguccacuauugcauuguuuccuccgguguguuugagaugcaaugagaagacgcagagggagaaauggaguuuuacaguugauauguuaguguuucugaagauccugaaaggccucuucuuucagggagagugcauggaaaagucagcccagcaccagcugcauugccuugccagagcaaaugugcccugcgugcuuagugaagugcuguuagcuccuagcucacuagggaggcaggacuggcuccuucaggauacgguggcucugcauugcuaauguuaaugccauuccaagcuaaguacauggucaauauugucuuugcaaccuaccuuuuuaguuagauaacuuaaaacuuaauaucaaauuaauauuguuugccuauuuuucuuuguucaagucacaugauuugugugugcauucuggcagguguuauauaggcaaguuaauuuagagugugacugcuuacugcuuaguuacugcuuaguuugaacuaagagucuguauaggugaguauuggccuguaucuuacagaaauaguguuagugaaagauuauguaauagaaugaaggagucccauaacaagagugauuggagaguauaguuguucucuuuguacaaaucguaagcauuucaggauuuuaaauaaaguaaugcaauagaaaguauacacuagauaggaaggcagggauggccagcuuaaaugcuguguuacauggugauaccuaguuucuuagaacuugaguuacuacagaaaaacgcauuaccuuuaaccuauucucaugggcagaggagggacugaagaggcugucacagcgagaauagaggugcuuccugcaaccuguggucuccgucuccaggacucaggcaaacugucacaguagcaguggaggugucugugugauugaaguguccccaggagucaggagucauucaggugugugacaggaaaaagccaguggccaaggugcucaccguaaauggugcuugaggaaacggagccuagucacacuagacuuggugaugugagaugguacugaccuacgcucagcagaugggauagcaagcuugcgugaaaacguaccacauucagcuuaguucuccuggucuuguuugaacuacaacaacaugauugaaauaauucuugagggaaugauuuuuaaugaaaugauugauacuuguaaguaaaauguauacuauauuaaaauuagcaaugucauaauuuugaaccuagugagagguuuugcagaauaaauaaagcuauuggauaggaaaauauauuuguuauucauauucuuagaucaucauuugucuacaaaauuaaccugaccuguagaaagaauaaugccacuguauucuagcucugccucucugucaaccuaaacauuucaccagucagcuggguuuuccuucuuuucucuuuuccuccccuccccuccccuccccuccccuccccuccccuccccuccccuccccuccccuccccuccccuccccuccccuccccuccccuccccuccccuccccuccucuuucuuucuuucuuucuuucuuucuuucuuucuuucuuucaugucuuuugaacaaaacugcaaaaaaaguuuuuggaagguuugcuuuuaguauaauggaaauguucauguuauuuuccuagcugaagaucuuaaugcuguuguacauauguauguauuagguguauauauaugugugucuguguauauauguauguauuagguguguguauguauauauguauguaugcauguauguauuguauauguguguguguauuauguauguauauauuuuacuuguucuguggauaagcacaagaccuggaucacccuagguaaccacuccaucacugagcuauauaccuuuaaccugugauuucuugcuuccgaccaguggacaauaguucagucauauugucuguaaucaguaauauucuguaaaauucucuagaguuguaucuuaugaaaggccuaggaugcuguauguuggcuuucuuuuccccaaauaugacuuauuuucaagcuuucauucaaguuugggguaugggugugucucugaauacuccuccccucacuaccagcagagguugugcugacaggauauuaauuucucagguguccauuuugguguuucauuuugcaaagcuagauaggggcuggaagggagaccugaaacagccagcuuccaaacgucucuacucuuaggggauaggacccauucaaaggcucugucacuucugaggucgaucuucaccuucacagaacugaccguuccgacauacccagcaucgcuuuuuaguucccacuaauguuaccggguacuuagguuugggaaccccugccucagugucccgauguucuaaagaaaguaggaaacaaauuaauaaaggcaaguaguuccaugcacaguuuggccaagggcagugugagugugaacaccuccccaccuucccugggugguauuacaaauuauagaaagcugugagacagaaguuagaacacaggugaguuuaguggugagacaggcuaacugagucuuagggccacgaggugccucaguucucugucacagaggcaguuuuuauuuuaaauucaaguccugaagaugaaaaugagguccuaaggauccggacauugaaacagaaguugguuugguuuggggagaaugugaaccucucgcccacccugggccuggcagaguucuugcucccagugcucccagugugcaugguuugcuaggugcaggauggaagccuuuuuguuucuuuucuuugugagccaagaugaaaagaugggggaaauuggagggacgugagagggagaaguaccccuugcuugagggucugguugagccucucaccagcugggaaucaagaauuccagcauuaacagcaucuacucuggaggugcugcugauagaaacacuauuccuuuuauagugagacaauucaaaugggauuuaaaaacaacaacgagggcgguggugguggcggugcacgccuuuaaucccagcacucaggaggcagagacaggcggauuucugaguucgaggccagccuggucuacagagugaguuccaggacagccagggcuacacagagaaacccugucuugaaaaaccagaaacaaacaaacaaacaaacaaaaacaaaacaaaacaaaaaaaaccccaacaacaacgaauccuuuaucuggcccuuuaguauggcuuuucucuguugaaaauuuuuaacuuucuaaaaugcucacaagagccccuaauuacagugaaagacagaucucaaacucuugugcaagccuucaagccauggccuuccugucccuguggcaguucuguuccaaguacggcuguauccacccuauaaugccauuucucagaaaaggagguagagaugagaaaucccauagaaacuuuuuaaaaguaacauaauuacauuccagaggccucagaaaucuucuguggccaucuaguugcaguugagguauaaagcaucaaccacgcucaggcgugguguguuguacuauccuuucccucaauaucucuucuucuacugcacaccauccacccuugcuuaaaucuguauuacagucucuuccuaauaaauucuaacugcuucauccugacgcuucaugacauuuuuugcugguaugaagucaggaauucuugccuuccccagugguggucccugaagcuaguccgguauugcagguguagccagcugugacucuggcuuaggccgcacugccacugaaaguuggaggucugcuuggaaaggagcugagccuuguggcacugaggagaguuaggaaugaaggauuagaggaugauaaacuugaggugcauuucuugucuuggcugaaggugcaaaggaaugaauagcuccacggcaguugugaaucaccucaccaaggcuugggggaugcucuuucuuucuuucuuuuguuuuuuuguuuguuugguugguuugcuuuguucuuaaagagaagaaaucuuuccucacuagagcagcacagcuucaugucuuggaacauggugguuguguugacccauacagucuggauuguagcacaccaaauaggcacaguccaaagcuugagguuuaauguuugauguaaauacuucagacuucuugcaggaaagauuugugugacaaauaagucaccacacuagucuaaguuaaacgguuucaguauuguuuuuuggaaacggagauccaugaaguuucugaauuuuucuuuuguuagcaaaaacguuuuaacagcugucauugugagcagaauaauuauucagcacagcuucuauauaauuucuuauacagccagguauucuuuuuaacucucuugucacuccuucugacucccuuucuggaucuguaguuaguucucaaggagcauauaugucauuauccugcauauaauuaacagccuaugacgcucuaaugucugaauugcagcauagggauaaugauuggcuaauuugagaugcugugauugaccccggcucgcccuuuucugaaggauaauaguacacgaugguuucuaaugcacuuugcccuucccauucaaaggggagcggcauagugucugcucgcaugggguuuuguucccuuaguauuuguugaacaugcuaauuuucuacaacauuuguuuuucauauguuccaaauuaaagucaguuucugcuggcauuuguugacaucagcauuggcuucagacauuuugcuuauggaaccaugaucaaauuaccaaaaagccagacuuggguagagcauauauagauagcucagugguaaagugauugcuuagcguaugugaggccuggguucaaucucaguaucauacaaacaaaaacaaagcaaagagccaacccccagagggacuuguauauuaacuguuucacaaucgauugauccaagguaccagaagucaaaagacccuaauaaugugguuuguaaacuuuguggacuuuugaauggcccaaauaaagcagcggugacuucugaguaagguuuuucuugaguagagccuuggaaggaaauguuguagacagagaaaugaagauccggggaaugcuucuacagauacuuguuuccuuggugccuugguucucgcuggucccgugcucugccacaggguauacuggcaggaggcaggcagguuaagggagcaaaccuugggaauuggaguuagaggcuuggaauugugggugaaugcaccuguguccuuaucugagaaaagacuaguagaaagcaccccgagacugugucaccccaauagguguggaugucuagcugcugcuggucuuuguaacucuccccuuaaagccaaguguuggcagagccauuugcuguugccuuuaccuuugccaccugagccgcagcuuugcugagauaaaaauuacuacagugucuagacaagguaggugucgccugaaaugcuaaaauuuauggggggaaaguaacaauugacgacauuaauucucaaaucuggccuaaggagcaccaucagucuugcuuagguuuuagaaauguggucucaguuucaaccuuagcugucuuggaaggaagaagcugacuuucauaguuucuauauauggugucaacauuugggccaaagaaacugcagcugaacguucugcacacauugguuuuagcuaaaugguuaaaguuggucaacaucucugaaccuggaccacgcgcgguguguuggauaguuuuaugucaacuugacacaagcugaagucaucugagagguggaaaccucaguuaagaaaauguguccaugcgcaagccugugcugcauuuucuugacugugauugauggggagggcucaguucauucugggugaugguucugaauccuaugagaaagcaggcugagcaggccggugagcaggccucugcaucagcuccugccuccagguuccugcucuguuugaguuccugggcugacuuucuuagaugaugaauagugaugaaaguguaagccaguaaaugcuuuucucaucaacuggcuucuggucaugguguuuuaucacagcaaugguaacccuaacuaagacacacgggaaggcuuugccauuccucugagccugacccggggaaugucuuacuuuucccaccgggcugaagcacuggggucuuaggcaugaccaugcucaugucaguaauauacauuugcccaggacuucauccucucugcaccaugggcuugcuaguucugcauaauugguaccauagcacaugaagcaaacacugucuuuauccccuaucucaucauguacaguuuguuuuguagaaacugggaugugaguguugagugugaugcuuguacucgauggaaaguugccuuaucuguugaacugauacuggcggagugcagggaugaaucuucguaugcauuuacuguggaaugugugcaggugugcucaucucucugugugugcaggugugcuucccucugugugcaugugcgugaggugugcucaucucugugcgugcucggaggcuggagguugacuugaguguccuccucuauugcucuccaccuucauugcuuguuuuuuuuuuuuuuuuuuuugagacagauucucccacuaaaccccagauagagcuugccuuuuaggcuaacguggcugagucaucuccccagccuucauugugugguccccuaaaaguccauaucuucaacucucaguuucucaggaugguacccauggaagguaguggaauguuuuagagguggagccuaaugggaagcccuaaggucaugggaguuuaccuucccaaagggauuaugagaacaugaucucuccuccugcuuucugcgucuggaguguauggucagcaguuugcguugucacacauuucugccacaaugugcugccuuccugguaguccuaagccccuggggcuucuugaucaugaacaagagcuuucaaaacaguaagccaaaauaaaccuuuuguccuggggauugcagcucaguggucgaguugcacacacugggcauucugcagaucucauccucucccaagucugauaugucuugcaacauuucauuuaauaguguaugguuuuacuauuuuaacuuuaugaauuuucccuaaaucauucaagcuaguuuccucugaaaaacuuuauauuuguacucagcacuucuucccuuuaauuuauguacuaguuaaucauaacccuuugccagcauagcuuugugaacagacuugggaggaaccaggacugucucuuggucuguguugagcugagcuagugggugccagcguuuagguaccagaauguggucugugagcacuggacagaagggugcccuucagccagaguguucacaagggaauggucggcaguguggugaggacuuggcaagcuuuauugcaguguucauuuuggcaaguggcuuaagcucccaggcuugggugaaggccuucuaguuuguggucugaggaguuaaauguuucgugaauaguaacuuggagucacuuggcagaaaugugcugugucacaacauaaaagccucuguucucauggggcagggagcaaaggcgggcacauuuuccuuugucaccaugaaugccgcuuacucuuugucuuugaauuguauucaauaaaccaauucuauaccagcucucagaggcuggcuagagauggaaaugaggugacucagagacucucaaagugguaaugaauugucuuaacauccucgccuaagacagaaggacucacauuacacacuauuacagaucaaauaaaacuucacaauuuugaauauaucuucuauguuaaaagcauucucuagccaggcgguggugguacaagccuuuaaucccagcacuugggaggcagaggcagguagauuucugaguucgaggccaggaaacccugugugugugggggggaagcauuccccucucucucucucucucucucucucucucucucucucucucucucucucuguguguguguguguguguguguguguguuugggaugccauagucagaggacacacuaaugcaguccuuucuuucugucuacauuuaugucaguccugguuguuggcuucaguggccaggcuugcacggcucccuagcccagccugcugauuauuacccagagcccauuugacaaagacauuuugacaaaacccacacuaauuuuguucacaaaucuuacauauacugacuucucagaaacagaaggggaucuuucccuauccaguguuagcaaaugagaagguuagcaaagugugcuugggaaugaaagacagaagaugaagaaaaaaauauauagagagagggagaaugagugugugugggcacaugugcuugugaugagaaggcgcacacacuuacugaagugugcgaguggaagucagaggucaaccucaggguuuguuuuugcuuuccucuugaggugugugugugugugugucuuguucacaguugaguuugccaggcugucugaccugugaguuauccuuguguucugccucucauuuuaccauccaugugcuuggauuacagaaacauccuccucagcguuauguggguucugggaaucuuguaguacugugccuauggggccaucuucccagcccugagaauaucugauagguguucugcaugaccucccuauugcagaaaagucauagaucccuuccuuccuuuguaugcagcaguugaacguuuaauuuuuuugaauucauuggcaucaaaauaauuuuuauacaacguauuuuuuauuggauauuuucuuuauuuacauuugaaauguccucuuucccgguuucccucccucccagaaacacccuaucacauccucccuccaacugcuucuaugaggguguuccuauacaauguauuuuaaucauauuuuuaucuucaacuucucucuacuucccuauacacccaacuucaugugcuuucuauaaauaaauaaauaaauccaaucaaacaauaaaaaccccaaaagacaaaacaaaaccccaaaaccaaacaaaaaaccaaaacauaacaaaagaacacgauaaaaacuagggaggccugacaccagaugucucugggagagccaaacaaaacaaaaacaagaagagcagacacaaaaccauggaguccauuuuguauuggcccaacuacuccugaguauagggccugucccuggagcauaaaaacaucugguuuaaggcagagugcuccagaaucugacaugcucugcauauuguccggcuguggcucuguauguuagucgccauuuacugcaaggagacgcguuucugaggaggacugggcaaggcacugucuguggggauagcacgaugccauuaagaaccauuuuacugcugaguuccuuuagcagaacaguagugguggguuuccccuagggcccaggccaugucuagucucagacuccuggucucguuagcaauguuaggaauggguuccaucucauggagugggccuugaauccacuuuguaagaaauggcugguuacucacaugauauuggcaccgauaucauaaucgguuaccuuguagggaggucacuguuguaguuggguaguauugcugaugcuauugcuucucuaauacuguguauaguaccuuccaauaccauggaugcaaggcagggggcaccuuccuguuuugauuaagaggaugugcugcacugaaagcguuugaagccuaaccugggaugacgucaguguguuguguuuagucauucagaaucggguuuuuuuuuuucugugaaauaaagacaguugcccuuuucaucugaucuagccucaugggacaucuguuaagugagcaauuacacuuguaccguuuuuaauucagcacuaugcuuguaucugaucaaugcagcauuugucauuucagaaacacugaaguaaauuuugugggccauuccccuggagccugaugcuucuauuuaugcagggcuuaaugcucucuugcugggcaguagcacuuugggacacauuguucagggcuauuccuuccaucucuuacuuaaaguaucuccaaagugcagggaaauuauaguuaacagacuaauagucaguugccuccaucuuggccuuuguugucuggugaacuacuggccaguaaugagcuuagaauuucuuuauguccuguggagucccauuugggaacuuucugcagcugaaguaaaggacagcugagcgaccaagcugccccuccucccguucccagcagcagaacuguggguguacagccuuccuggcuccagcagccucccaggcuuccagggaagaguugacucucuagagccuggcacccacuaccuugcuuaccaucggcucucccagagacaucugguaucaggccucccuaguuuuuaucuuguucuuuuguuuuguuuuguuuucagcagaccuuucuauaacaugaaaaaagcuucccaaaggaguuguuuaucccuaugggucucacaaaacucccaaacuauguaggaggagggaaagcauuguguaccucaauuuuacaaccuucuuucugaaaaaggcaacucacagaaagaacucaacagaaugauucccaggccugaggaggcaucuggguaaaguuauuuuaagagcuucaugcuucacguuugggugacccaaaguguagaccuguuugcugcuuuggaggccacugccuucccugugguccuggcauuccuuucuacauaaggacuguuggaugaauuccuuuagaaaucuaggaguuaguuagcuuuauuuaguuccccagcaagguuauaauguaaaguaugucucuagguaagacuugaagaguucugguuggguuuuccuguaguuucugucucucugcuguugcuagauuaguauugaacuuaagagcugaaggcucuucccgccucagcaucccgugugcccacuagggcccuuguuaaaaauggacagaugaugagccacucugcauaaacuaaggcuuuguaaaacagcucccucauuucacacauuuugcugcaguuuggacauauacaccaaauuguucacugaacuauagaaaaguauucagaugaaagccaagguuuguugacuuugcaagaauaagaggaaagccagguguggcggcacacaccuuuaccugugcacaggagacugaggugggggaucucugagaugaaggcacauuuuguaugcacauauuuguggaaagccaagaauacauagcuagagccuguuaaaucaacaacuguagugaaaacaaagcaaaauaaaaagccagcaaguacacacacacacacacacacacacacacaaacacacacacacauauacacgaauuaagggggggacgcaaagaaaauagugagaacagcagccacaaaauuuggguucuaugaaccuuugagaucauaacuuuuaauuaagaaguaaagaaggaugaaaaaaaaacauacuuguaaaauauuucuuuuuaaaaagugaugugcagaacagagggaacaaaggcccaguaacugaucuugcacaaugaauucuugccaaagcagacacugaauggugagacuggugaaccaacacaaucaacaguuaagguaccacuaaaaauacuucuucuccaagaguagaaaugaaagccuuccucuuuuacuaagacucuuacuuugcuucugucugaauauuugaaauugagcuuuaaauagaacaaaccuaagguugauaugaucucugugucugggagaagacggagugaugaguuuggggauugcuuuaggcagcuaagugcuacagggacaaaggcgugacucauuuuauugaagggaccgucccuguguucacagguuggaacccuuuaagcagagccuugauaaggaagacuauacaguuggagaaggaggacagagaacuggaggagguccaagcagaggcuuugcaguauguggauguuccuggaauacuuggcagucauuuagaagcccccagugcugugugugcucugugugucuguguggaggauggggaggcagaguugguauuaggagaugagucacuuuugagaggccauaauuagaugguaagaggccuccugugccacacuuaaggcaaagagaaaccaccagagaaccugaucuaaucccauaacccugcucacuagguuggagcaguguacaaccugccagccuucacaccugcucugcgucauccuccccuuggcaaacucugacgcaccugugaagucucuguuaaggacaguuuuguuaaaaaacaaaacaaaacacaacacccagaaaauggucuaggcuguugugaguggagaucagaggcaucuguugaccacggcuuaguccggcuauaucagcuuuauuagaaaaucugcccgcuagccuucucagcguguuuccuugguuguucuuuccacuguuggccucugauagcaucugagcuacugcaccauaguuucagguuccaauucaucucuccaagucauuuccaagcggacacaggcaacauaguguaauuucaaaaucaaaccauaauuggaaacucagugcuccuuuggugugggucccagaucauucugggccagauggaggggaagggauuccagggagaagguguuuggauacuuacgaugguguguuuaaggggagaggugaacauaagaaaaccaaggccagugcugccucuaaagggagcacugaacacggagguugguaaguaccugaagcucuuaccaaauaaagaacaucgaggacaaaaauguuggacucaguuuauugaaagauguugguuuuaaacaaaaucucaaucauuagauuuuuacuaauaaagacuuaagagccagaugcuggugugaauaccugcuagcucagagaggcagaaaaggcagccagcugaccuuccuccacagcugacaucccaaaaggaaaaggaaguucuucuccacgaagucucaauugaauauccucccuucaaacugaauaucccucccuucuacuuccugugccugucuaucgguccuccugaccuccuuucacucucuaugguuuuuucccuguguuuacucccuaucaacugguugcuugccccaccucuugaccugugguugacuuuauuuaauaauccuguuuacaauaaacaggaagcucuuggauuaaaggugugugugcuagagcugagacccaucacaacuagaaacagguuuuuugaauaaauaacacaaucacagugugcucaaauguccuguagcagagagaccuugccucuccacaaagguggugaggggcugcagaucuugcuaacaagaucuugacaaaaucaaccugcuacauacagucugguccaaaaguguccaucuuuagucuuuucauucauguguucgaagcucuuucuuuugucaaugugucccuugggcuguuggaaaucuaaugcugccuccccacuagacuaggagcauuugaaaagcaagcacuccuuuggucagguuagaagcacagacagcugcuuguaucaaauguuugauuuuuguuagggaugaaaagguaacccagcuuggacucuguucucucuauuuagauaaguuuguuuucucuauauaugaaugucgggaaacaaugugugugccuggaguccucagaggccaggagagaaucagaucccccggaacugaguuacagaugguugcgaguugccaggcgggugcugggagucuccucuucucuugagcuuacuuugaagcggcccagcucagggucagucugugacagacacucugguuaccaguggaucuugagaucuagacacaucauuuuacacagaaguguaaaugucagacucauuugaaguuuuauaugaaauguuaguuuguguuuuguuuucuuguuuuguuuuuuuuuuaagaaacuaacuuuacuaucauaugacugacuauaagcagguaaaagagggcaccaugguuagcuuagugauagacgacuuggcuuccaugugcaacagaguucugacacguauuucucaauaugugucaauccaaacucaaacugcccuagagacuaggguuucuuuguuaguuguuacauuguuucucuauuuccccauacugccauugguugccauguuugcaucccuguaacaaacacuaaugaauuuaagaagaggaaagcugggcuggagagaacugacucaguguuugagagcccugagugcucuuccggaggaccuggguucuauucccaacucccagaccccacauguuggcucccagccaucuguaauuccaguuccagaggaucugaugaccucuguggacauugcaugcaugugguacacugacacacaugugccagcaaaacauucauacacauaaaauaaaaauaaaucaaaacaaaucuuaggaggaagaggaggaauagaaagaugaggggugggggcggaagcuggguagugguaacacacacuuuuauucccagcacuugggagucagcgggcagguagaucucuugcauucaaggcuagccuggucuacagaauaagcuccaggacagccaggacuacacagagaaacccugucuuggggagagacagagacagagacagagacagagagagauugauugauugauugauuugggcucauuguuuuaauuuauuaauucuguugggauuccaguuuaugaucagcugacccuauugcuucugggcuauuucauggggcaguacaccauagcagaggucugcagcaggacaaauuugcuuauauugugcccagaguaagugaguuuguguugggggguugauaguuuccaugguucucccugaggaaaacccuggcccuguggcuugcagaucuucuguuaggcaucacuuuucaaaguccccacuucuguagcaacaccacauuaggguccagggauuuaucauguggacuuugagguuauaagcaccuuguaaaugggaugcaaacgggagcaguccucaaagaaaguuuuaaguuaauuauauacacuaguuaauacaaauuccaacuuuuacauuauuaagauauguaguaaggaauauuugucagguaggguugacaagggacaggaguuauugugauaacugagacugcucuugccccuuuguuagcuugcaaaaaaauacacuuauugaauacguaauauauguugagcacaaugauacuuucuagaauauagauagauauagguugaauauauaguauauguuauaucuccggagguuauguuucccugauggaaguguuacaguucugaggugaaagguauucuagcaguugggaaucaaagaauaccacaaagucacaaugcacaacaaaccucacaugagguuuauugggagagacacgagaggguggcuaccucugcucagucaggaagcaucgggggacugagcagaagacaggcuuauauaggauuucuuucuuucuuucuuucuuucuuucuuucuuucuuucuuucuuucuuuuagcagacuuaauucuuucauuuuucuuguauaaaauccuuauauaguagccacagcuggagccuggguccucugaacagagacucugguguggguuuucacaagaugaucagugaauuccugauaaggagacuuggugaagacagucucuuuccagagguugggggucagguagcuguaagucuuggagauggcgucaaagguggccuuagcaaaguugcccaggguggcagugcagccuuuggcugaaguguagcagucaucuauaccagccaucaucaggagcuucuugggcacaggagcagagacaaugccagugccucugggggcagggaugagacgcaccagcacagagccauagcggccagucaccuugcauggaacaguguggggcuugccaaucuuguucccccaguagccucuccgcacagggacgauggaaagcuuggccaagaugauggccccccagaugacaguggcaaccuccuuggagcacuuaacaccaagaccaacgugaccauuauaguccccaauagcgacgaaagccuugaaccugguccgcuggccagccggagucugcuucugcacuggcaugauuuucagaaccuaacccuuuagggacgcacccaggaagaagucaaugaucucagacuucuuaauaggcagggagaacagguagaucuccuccaaggacuugaucuucauguccuuaaccaggcggcccagcuuggugacggggauccacucacuccuugucuucagcuuuaccuccacaagccccgcggccucuaccgcggccccuaagaccgcugccgaauucuccgcggaaucugccgcggccuccuaauccugggccccuggguccuccgggcccucccacuccaccauuugguguuuucccgaagaagaagcuuauauaggauuucuugggggaggaguuuuccaggguggagauuucugggauggaaauuggugaaauuucaagccaagcccagggauuggugggauuucaugcuuagugacugauggggcuuugauagguuuuucaaaccuaguagugggcucagaccuuugacccuacacacacccuuugagaccagaaguguuuauauugcagauauuuuuuuuuuguauuuugaauauuugcuuaaaaugagauauuuugggguggggaauaagccuagucugacugacuucauacauacuauauauacauagccugaaacucuaugcauuguacuuuagcagagauguuaaauaacuauuuguugauagaauuacuaaagcguuggaaugaguucuguugaaagggaguuaagaaaaguuucaccaauaaagugguaugccaggacuaucuugaagaguguguuaaauuguaugauuguguagacauaucauaagcaaaacaauaacuagaucaggcgcauaaagcagggaggcugcauggugguuuaggagagugaugggagcacagcaugugggagcaccuguuggagcacagcauggugggagcauagcaugugggagcacagcaugugggagcaccuguuggagcacagcauggugggagcacagcauguaggagcaccuguuggagcacagcauggugggagcacagcaugugggagcaccugugggaacauguggguuaaaauggggucccaugucuggcccagggcuugggccucuaggcgaggcaggcacgggaaaguuugguugugcaccccacacugcugcugggcaggugucagacugugagaagcugcgguacacuuccccucccccaccccuccccugcuccgggggugggaaagggcagucugaggucccuggggaagagggcagggaggagagauguuaacauggggaggagaguccuuugcuugcucgggcagguggauugguggaagccgugccugggaacgcaggggagccuuuagagggaaaccugcuccauugcuccagcacagcggauccccaugagaagagguaguccaugguuuuaaggcguuuauuguagaaaggcagagagagggagagaguagggaaguagaggcuggccauggccacguggagagaggggagacagaaugcagagagagggggagaaauagggcaagagagaagcaagcgggaaggcaggaguaagaggaggaggagggggcaagcagccccuuuuauagugggccaggccugucuggcuguugccaggcaacuggguaggagcauaccuggcuguugccaggcaacuguggggguggaguccagacagaauacagcaggcagcuugggguguugcccugcuugccugauggccacagaauuauggagcuggggccucgugucugggugcauggcaaacuuccuucugucccuugaagaguuaucugcugggucuccaggguuuaaaccuagcucaaccagaaaacaggcugcccaucauggacccacaggaacacagccugauggggaacaugaacgagauuagagccaggaucugaagacauugaguaccaugugagcagugagauauuaacuaaauaagcagggcugugccacugaggcagccugcccuccacagggacugcucuuuacauccucuguaccaucugggguaaauaugccagguuucccaggugaguuguggagcugcagagagcagcuucuccucugucaguuucuccuccaccccagcucagccuccaggcaccucgcacuccacucacguacuguaaggcauauuugucuguggcacuucuuccucccguguaucccuaggggucaucuccuacucuuaagauacuucucacugcucacucaccuuggaaccugucacaggcaccucacuuagaaggcauggccgcuggcaagacacacuucugcaugugugccccggugugugcgagcugugacgagauggagugucaugugcacuccugcgcagagcuuuuguggugugcagugaugcaguagaauucuucacuggggaaaaggagccuuccccagcuuacauaaaagugcacugaaugggucaugagaggucccaaggacaccaguaaacuugugucucgucagaggucaauuaaauaccccaaauggggagguuaaauaacuuacucugguucuacgggaguauuuguuauguuauauggccgagggcgugggaguauuaaagaccuaauaagugaguuguguuucagagaaaguugggacagagccaaaaaugguguccuuucugugaucuguuaaaaacuccagcuaggcaguuuguucccauuagaccuguucugaaagaaggaaaaagaagggucccacauaccccaggguauuaggaacauuuguguuauuuggucauacauaacaagaaccuaagaaauaugagucaaggcuagguguaguggaaaauacauaggaucccaacacuuagaaagcagaggcagaauugucaauucaaagcccacaguacauuacaaagugauguucuuuaaaacaaccaaagcagaaaacaccuuuuauuaccuucaguuuguuagugagauaauuguuagaagcaacugugacuuaguggagaguccugacuacaaaaucagcacccccacucuccauuaaucuauucuguacugugacuucaaaaaaauuagucaaucuuguguguguguguguguguguguguguguguguuguauaucacugagauaguucaaacaauuugcaguaaaagcagauaagaggaacaaaauggcuuuguuaaaacauccgauuacuuugagcuuuauggagauugcaucuagauaaaaaaaaucaggcaguugguguguggaaaacuuaguuuaaauacaaguaggagguuucccuuuugugguguaaaucagcccagaauugcauugauguaggcuaucuguuaacccauaggggucuuguaaaacaggaauaaaugugcuuucuauuugcaguuccagcuagccucuauaaauuagaaaaauaaaugaguucuggugaaucugcagcccguggagcuacuccauagguguucccugcagagccagcuguaagucugugcuccuugcucagggguaauagaucuaggauguacauuacaaaggaacaaaauagauuuuuuuuugguucccagaggccuaacaugguucccacuucuuuagauuauaccagauaauuuauaagacaugaaacugauaaaagauggcaugacacucuauaacucaauagaguaacucgcaaaaguuuucuggaaucaguuuggcuuucagauauaugaacaguuugugagggaaggaaggaaggaagccagaucauacacacuuacaaguuugcacagaugcacacacuguccagggauguguuuccauucguguuuggaaggggcugggagaguggggggugagagguugaaauuugugaaacuguuguuuuuuuagaguugauuuccagagcuccuaaaugaaaagggggaauaauaugaccugcaagaugcuugcuuguggcuucuuuucggggcggaugagaggcacuauugaucucugacaguccggagucuucuugccaggugcucaagagucugugacuuuccuucccaggccugaucggguuugaucagucauguacauauugacaugcgugacuuccuacaugucuucaucuucuauuacugucuuuuuuuuuuuuuuuugguuauuuauaacacuacagucauugaauuauuugggcucaggugacacgguuacuaccaucuagcuuagauuguacuugguuuucucuuuuauucuagaguugggcaacacugcgcuccauagagcaggauugcagaguuagcguuccagugagcccagcagaggaggcugggcuuauacaaauagacugaggggagcaaaaacaaaaagugagcggagcggucauuuccagguuacucugcucaucggguagggauagggagaaagacaacuggaaaagaaugugucaguuaacaucagguuacuuaagaaaaaaggugaaggcacaggaaacuucauugucaugucuguagaaauaggccuguugggaaguuuggcuguugucucucucuaaccugauuuccuugggguuuagaccuaaguuucagcuagaauaugagacugcagcacaagggacuuuauuucaaauuuuggacccaguccaaaaacagugacccuaaaauuuuuauuuaacauuaucaagcuacuuucaaaccuuuggccacaugguucauuucugacauuucuuuauuuuuacgccagcaggauaaaggugaccuucaguuuugccuuggaaauuagaguauaaugucuauuucucuuaaccccagcugcaaacuaggaucaccugggggagauuuugaucacuuaugaaaugcagaugcuuggccauaugccugaaccagcuugcaggguucagggcuuuguggugucaacuuuuuuuuuuuuaaaaaaaaaaacaaaacaaaaaaaaaaacucuguagccaugguagaaaccacuucucugaggaccauuccuuuuaguauauacauccucucaaugccucuuuccuaacgcccacaacacacuccgcagauuaaaaccugugucucaguaaguugcuacaguucuggagauacucuauagguuuuuauagcuauugauugaaagauaagagaaucuguugagucuacauacuguuuaaagauuuggaauuuggcugggcauuguggcacaugcccuuaauucuagcgcuuaagaggaaaggcagguggauuucugauuuugaggccagccuggucuauauuagcacauuccagggcagccaaggcuacauagugagugauauccugucucaaauauauaugugugcgugugcaugcguguguguguguguguguguguguguguguguguguauucauucuuugaagucugcuuguaacuugccaagggcuguacuauaacuuaucucuuuggauguuaaagauugaucuucagguacaauaaccuugcacaaaggaaacuauuuccauagacucuucuucacucugucaggccucuuacuguucccuguuuccuuuuaaagguucugaucacuuugauuuaugaaaacacuuauuuggguuuacaugaguaaccucuuuauuucauagccaagauccauccugagauaagucagucuguaaccuugaggggaggggcccugaaggcaugaguguucucccucugguuaggacuguccuuacaugggagaaacuuccguauuuaagacacuucacuuaauaacgacuguauguugaggcgguugcgaugaaaugaaaaugaugauugcaccuugucugacucugugguuucuucugcucuuugucugucuugaauaaaugccaccauuuuuguccgguagcuguagcagcugcuagaaaugccaugcgugcuugcugggaauugggugguaaucucauauacaauaucuguugauuggauugcccaagguuguuuucuuuuauaaauuugucuucccacaaaaaagggguuagauuggagaauuugccccaauuacuaaagacugauuuugaaugugcaguguugucagccauaguuguugcuguaggcagcugcacacugaauuauuaacuugaguucauaguaacuguuucacaguaggaauugggaaaaaucgauuagaggcaaggaaagcaagggaaaaacuaaaggaaaaaaggacaucaaaaaggugaaguuuaggguauuagauuagauaaucucuugcuucuauuuggguauguuucaauacugcuugcauuuacuuuaauuaguuggcauaugaggcaucugaacuaggauucuaccccuuagagaaaguuuagaugacaguaccuacacggaguuuauuguaaaaucccaccaauauuucccugucccucaccugcaugguugccuauguagaguaugcugugccuuuuuccucagaggugaaauucuggaagcucccucacacgaugaauacgcugucuuccguauucuuuaugugacaaaggucacauaagcugaaauguuaaugcauauaucaucugagucugcaaccgggggacucaaaacaaggaugaaaagcccucuacccuuggagccuuugcacgccacugugaaagggcucugccuagcccagugcugguuauuuauauuuuaguuuaauugauuggaagacaucccccaggcagucccucugcuuccagauccuuaugaauagucuaguuuugcuuucucuuuuccucuucagaauccuuucugcggugauaaauggugggugggucacugcuuaaugaagaccgugaucauguaaaauagccucugauugcagaguagcucagugggugcauuauucuccugggaggcguauuacugggguggggugggguugauguauuacauuugaagugagaaagcaaauuuugauuuccuugggcugcuacaguggcuuuggcucaugaaaggcaaacccucaugaguaugcaagucauuguaaggagacuuugugaaucugauucucauggaagaguugcuguaaaaugguagugggaaauaguuuuugucaccuucucaccucacaccaguuugcugcuucuuugucaacuuaaucuuuagaggaguuuaacuuuugauacaaaaucugauacuuauguaggaaagucuaaacuucccuggguuuucccacucucuauaguagcuaccauuacaguauuagucuuagacaggaaggugagcccugauuccaguguggucacuguugagauccuagaacucugcgauaggcuuccauugacauccagaauuaguaagugcauugguuuggcaaugauguugugagcacucacccacauccuaucagcacugaagaaauggcucagcagcaguucuuacuuguuagcuuugguuuuuggguuauuccaaucauugaacugaucaugaaacugagcgguuuuaguuuuuccauguggccuuugaaggccaaagaugagaguugguuugaccuggagauucgguguuuauuagauauuuugaacagccuuacccuagauuuagugagagcauguuccuuuaaugcugcuguuucauccagugcuacacccuagaagucucagaagaugcauuucuguaaguugcuguggucacucuuaguucccaugugugcacauacacagacauuccccagcauuucuaggugaugggauucuugucauagagugccagucuucuugauaaaaaacugucauugaauuagguagucuuucauucuggaaaaucauuaaaguauuucaccuauaaaguucuaaaaguccuuguacaggaugagguuugacacacacccucccgugugugugugugugugugugugugugugugugugugugagagagagagagagagagagagagagagagagagagagagagagggcuccuugugcaguguagccagguagcauuuaaauuaugauggaguugaggugcagaaagaacuugaccggcuauacauaggcacuugguuuuauucagacagggucuugauuaauugacugcucauggucaaagcucagcuggugugacugccuaagacauagguauuguuaaguauauguccaagccaggcuuucagguuguuuuccuucuaauaauuuagauugcaauuuauuaaauaaggacucgaccuauagaggcaaccucgggcaaauuuaauuuaguaagauauauuuauacuaaagcaaacugggauauuuguaauucaaauuuaacuacaaauaauacaagaaagaaagagcaaaaggaagaauaagguuuguuaaugcaguggagggcguuuaagagggaagaaauuggucaagaagguuccuagguccuuccacugugagaagaguuggaaucuaaccaguuuacaauaaacuaaaagcuugagaagugacgcuaggagcaaugagggggaauuggagugaaaagacagucuguacaggagcggcaggguucauaggugcccacugugugcccguggauuugggacaaugagaacagggugcuucaguuaggcucacuagagacuucucggccugcuaccugggcuccccuagagagaggugguaacugaaauauuaugagacuagauuaccuggccacauuuucacuauaauuuagaagcaaaauggagaccagaaucauggcccuugacccuuugucucugaaaccuguuuuagcgguacuuugauauaucauuaguuuggaguaaauucauguaaaaaucaaguaauuuucauaaaguggagacaucugaaaagaacuugguuguauaaaagugguugcaugcagauauugaguaccaccccaucucuagaaaauuacguuucccuuauggaauguucuggaaaacuagagcuuuauauauuguuaaauuuguuauuagaaauaccaccaaauuauaucaccuucugccuccccuuucccuccuugcccuuagcucuuccacaguugcagaugucccauugguacuaaacuauuguccucguuucaccucuucucuaaaacaccuuuccagaguacacauucuucaugacuucauagaagauaaguuggcaaaaugaguccaucuugugacauguccagaauguggcuucauaaugucagauuauuucaggucucccaagaguggacaucccuuaacucuugcuuuaaggcaucaucaguuuguucugucaggaaguguuggugaaccccaaaaguccaccaaggagccauuucugauguaauagcauuagggucucuuuauuacaagcucgggcuugggcucuccuccaacccaacccugacacagcaggacaggaaggaaagguggaacagccuugagaccucagcaagacaagguuuuauagggaugggaguaagugaggggguguccagccuggcgaguauggaacugaaugucuguugugagccgacaagugggugcucugaagcaggagcaugaacaaucacaaauggucugaaagcaugucugaaacagacucauuuuugauugacuguugcuaagaaguagcugugccguagcucugagguuugggccaaggacaagccgugggguaagcugguaggugcucugccuaggcuuuuaucaguuauuuuuaucccacgugcuugaggaucuggcuugacuuaacaaguaguagccuggaaagaaggaagauccugaugaccuccugcugaagauuucagguccaggggagaucuugucucagaaacacugaucucugaccuccacacacauguguauacagguguauaagcgcccacacacauguguauacagguguauaagcgcccacacaacacgaacacacaggugcaugugcacacacagaggccaaguaauuuguaucaggacaauagaaugaugcuuuaaggacauuuaaagaauuaucuggauaucaccuaucauagaaucaagguuaaugacuuuuaacugaauggaaagacucuuagagaagagaagucaacauggcauugcuuacacacggccauccagagaaguauauuccuagguucagccguccaugcacucagaaguaucuuuagcuucgggucaaggguucuagacaccgauggagcugacagcagacuuuggaguuggucaugugaugcuguuuuguaggcauaagaaauaggagagguauuagagucauaggccucugcaagcuuucaaaagaaaccugaagccaggcaguguaugucaaggucaggacccuuacagggagccccaagagugcuuugugaaguuguaggguugaaagcuguaaaguagagacccugggaaguuggagaugccagggauauaggcuaucuauuaaggaaaggcccaggcagcacauggaaccagcccaggaaacaggucaugugaguuugcaaaugccaaguuauaucaugcuaucacaugccacagugcuggacauggaauuacaggacuuaauguuggcccugguggguuucaguuuugcuuugguuuuagcugucaaaccuauguccccaccccauuacugccuuauugcaaugggaauguuuacccugucacugaauccuguaagucuauaauuugguuuugauuuuuguaggaucuuauagcuaaguguuuacucugggucccagaggagacuuuggauuuuaacuuaugaacaguguuagaacuguuaagacugugaggacuuguagaugggcuagaugccuuuuagauuaugauguggcccugagccuuuggcagccagguguagaauguuauagccuaaauaugaacuuacuggaggcugagcugcuagcucacuggcuuugggaaagagauugaagucuugagggcucugaaccaaugaaucccuugauggauucauaauauguugacaguguuagguagugucagagguaaggccuaguugaggaaugucuccuuccugccugccuuuucuccucucugcuugccgugaccagaacugucuugcuaugcauucuccugccgcugcgaugucccuuccuagcacacuaggcugagcccagugaaccugugagccaaauaaaccuguccuccuaaguuuuucuugcaguauuuuggucacagcucgacaccuuguuucuucucacuuuugccuggcaagacaacuuuugcaguauucagaguacaucauucuuacauacuucaauauuuucucugucauaggauugaagagaagggaaaaaugggcacagggaaguagaucaggacuugaucguagggcagacuugguuuccacucucuggcccuucguucugcagugguagcauaggaugaagagcagcaaacgcaguauucuaguuguguccuuuuggacccuaagaauccuuuuagaggacagugccucucccugucuucggcucuuguuuguugccauccagcucaccugugcccagugucuguggagcauggcaacaggaagcacaagaaaacuugcucuucagaagugucaccagugauacaguuaagguuacuagaggacugaguucuauuguguggcugagccaggcaucucccuaucuugagggacagaaacaccuuuucuucaccccuuuugaagugcugauccuacccugaaggauguguuguucuagaaggaaguuucugcuuuuggcaauagaaguaaaacagaauuuuaguuggaccuacauccucagcugugagugcccugcauuguccucucaggcagugggaaaacccuggggcugggaggcugucagcugcaaucagacacuugcacuggggggagagggcggaccgccaugaauuuuaauaggcugcuggaugggguggagaggaguaagagccaagccaacucaaaacaaaaggaucaguagggaggugucauggccaggaugggagugaaacucggauuauuuauccugcaaugauucugaugauuuaagagggaaggauugccaaacucuuaugaaguggugaaguauaaaucuuccaugauuauuaaucccgcuauacugauggcaacaagaauuuguccgagccaggcguggugguccacgccuuuaaucccagcacuugggaggcagaggcaaacggauuucugaguucgaggccagccuggucuacagagugaguuccaggacagccagggcuacacagagaaaccuugucucgaaaaaaagaaaaaaaagucugucuguccauccauccauccauccaucuaaaucaaagaaugacuuguuaacaguagaaucuaugauuagggcaucagacacaagccaggagaaucgcagccaccauugugcugaugaaaguucuuccuuaacagacuucagucagucacucccaugugugcaugcccacagagccauggagucuagcaugcugcaggaaaucuuuguucuacauuuugcuuccccuuaugauuagcuauggagcguccuguuugucucagguuaggaguauuagaaugggugaucagggucagccuucucccacagagcagauccuguggaucucaguauccccaaaguagucucccacggucgaaggcuugucuuuguauuaccauaacuccucuaauucuuaauguuggugccugcugugacacacggaagcuauucguguuuuucagaacacagggcugcuuuggggguuaaucuaugccuuguaguaguaggagaccuuuaaagggguggagagucaugucagaacccuacuuuugugaguaaagcaugagaaaaugucuuaagaaggaugacacauugaaaaacaauauuacaaauuuucuuuaucaaguuugucugccgauaagauggcuuauaacaggaagguuugauccaaacagcguccauuaucuaagaaaacacuugacuucccuggugcuguccaggagcugggguguagcauaaaacugucuucugcugagcaaaagcaguaguugcuuccaaagcagagguaggaucaauuucuuguugauucuucuccauggcuggaggggaaugaaucuaggguuucucuggugccaaguugggacucuagggugguauacaugagaaauggggauugggaagugaacugcccaucacugaaccgugauggaguuuauccuuaguccucuaugagggcuuaucaucaccuguuggagauggagguuaaaccuuuaugggccauauuccaggcuucaauguuugugaagauuucaucuucacacuuaaaauuuaagcauauaaggauuuuguguaguuguauuguguguguuuuuaaguaauuggcuacacucaagauggcaaugguuucugcagccucauuucgacaucuucauacuuuaggggagguggacaugguuguaucuucucacugaagaagucuuucccucccugugaauagcugaucuuucuguagucucuuggcauuuucucccuugccuauaggauuccugacacuugaguuucuuuuaggacagacuguuuuaaguugcuuuagaucagcgauucucaacgugugagucaucagauauccugcauaucagauguuuauauucugauucauaacaguagcagaauugcaguuacgaaguagaaaugacauaauuuuaugguugggggucgccagaacguggggaacugguugagaaucacugcuuucgauggacugugaugaaaaguagaugcaggucuuuggucaaaugacauugauuucuauguggcauccgccaguguucagauacuucgaacuaugcugccacaccucccuuuucugaucucguucaucacguuggcuuucugcuucagcacugggcucuucacagccaacugcauuuuaguagggcgagcugcuucccuugagccuaauccgaugugcgcugugugcugugucuucugccugccuacauguaauucacccauuggguacgugcccugagucuagaugccauagcaggagagacagacuccgucuccauauguugcaugcuaacccuguccaagacaugcugaccuguccaggcguccauccuugauauuccagcuggccugaucacaugagaauucaagggcaacuuuuccucaucgcgauggagaaauaacacagcaaagcgucuuccuagagagggucugagaagcauuagggcugugcuggggcaugguguucugagucauucaggugccaagacugauuggaaaauagccaagaaggaaggaggcuccucucuucaagcuaaauaacagccuccuuguugggaaggacuaaucaaucccagcuguagaaaagagacagaauuuccuuugcuuccccauucaaaucuaaucuuaugacaugaguuucugacaugagcagaauucuugcccagacuuguggccccagggaggggaugguuauuuaagacagcuggcuccuccgcaaggcauauaacuugaugauaaaugcuugcagacaacuucccuuacuuucuggucccaguaccaguuuaauugacagcccuggagacuugcaaaaaaaaaaaaaaaaaaaaaauaaguagauguuucuuugaaagaauaucaugucucuggaugcaagaaaaagauaagaaauucugcaugcacacaauucaucgguguuucccagcaugcagaauucuucagggagggacuccuuguaugcauucuucaugaaacaagauugccgugccuucaagcccugucuugugugaggaugcagaccgaaacuuuuaggauuuugcauuuucuuccuuugcuuggucuuuuggaaagaccuauuuuaaagaauuaaguccuugacauccuccccucccccaaauuagauauaguucuuuuaagaacaguucuagguuucaguuauuuaagauuuccccagaguuguuaauagcuccuuccucucagggaaccuugcucuuuggaauaacaauuuugccuacaucucuagaucuaaaugucaugaguuugcuacagguuccuaauuggcaauugcagaugaagucuggauugauuuuuuuuuuuuuuuugucuuaaaucuuugcuuacauguuagaacuugguuguuaaaauauaauauauuaacuaaaguaaauauucugagaaaacagguuucuuugaaaggaucaagagacuauacaggaugguucuuuuaaauuaaaauuaaucaaguugauuguacauuaguaguuuuugaaaaaacaaacuuuaggaaaccaccuaaaugugaaaaggaaacauaaaaaacuaaaaccugguuguuucgaucaacacaggguuaagccugcaaguuccuggcugaugcaugcagcaccacauagcuuaggguuuugguuuuuguuguuguuguuuuaaaguacugaacaauuuagacacacucuuuguacuaggaggucuacaaacauaacuuggaaggacacuuacagcuguuuaauaacauuguccuggggaggcggagaaaggaugugugaaguagggaggaggaggaggagaggagggcugaggaaaauuaaaagaagacauuuuuacuuuccuguguuuccuuauauuaaaggggguuccaaaguagaccugacaaaauaaucuuaccuugaggggugagacuuuauuuauuguacuuuuaaauccuagauuaauauauacauuagccaaaagcauuuccuaacuucauuuugagguucuacauaaaugaaaaucuagaaugugugaguaaaaaacaaaacaaaacaaaacacaaaccaacacaguuucuguuugcauuuggagagacucuuaauaacuaggaaauguaacuguuaggcugucucacuuccaauuucgcugcaaugacgacgacaugucuguugugugcauguaaggguagcaugcuuucucuguaugccaagagcaggugccuucuaaacagaaagugugguauuugcccuggcaacaucaguuucauuuuuuaaaguguugccacgagugaucugagugguggugugcuuuccuucugagagugagccuuccauccaccaagaccauaccauggagauuuuuuuuuucucauugcuuuucuuauaggauuuauacugguuugaaaaugaaaauuuugacauuuuguccugugaaaauaaauguagcuauagaaaccaaaaccuuauauuuucuauagcacaguauuuuucugcuuacuuuggacucagcucuaacuuguccuucugauugaaccauaacuaaaaacaagaaaacagagggaaguuugucauuaggcaauacaaauuuuggaugcuaaagcuuauuuucuuccuucacaaagccaccagcccucauucauuuuuuauuuuaaauuuaguauauuuguauguguaugaauauauauguauguaugugagugugcguguguuauggugugccuuugcaggacagacaauagucguugguaguucucucuuagaaugugggcugggucggaggaaucugaggucgucagacagaccccuguaaggauggaaucagcuuacuauagcccucaguuuacucuuuuuuuuuuuuuuuuuuuuuuuuuuuuuuuuuuuuuuugguuuucgagucaggguuucucuguguagccuugacuguccuagaacucacucuguagaccaggcuggccuugaacucagaaaucugccugccucuaccucccaaaugcugggauuaaaggcaugugccacuacugccuggccucaguuuacucuuaagauccucuuacauucugcagcuugaaaugucucccuaacaagugugcaggauguucacucuaccaaaucagauguggguagaggagcaacucaaaagggaaguuuguugcuguguaagacuccugggaaccuuagcuuacuggggacccccugagagaaccacguggagccgggaucaaugcaaaaagcacccccagacccgaaggagaggcagcgaccaccagcaccccaaucagaucaguccagucggcgaguuuuuauaugguuuccagggggcagaauagaccaucagcaacuaggcacaauaggauuggcagagcagugcacccuuuaaagugauuggucuuuagggaaugagaugacaaggacuucccuugucugaagguggguaacagucuguccagaggaaugaguccccacccacagguugguuccugcccuguggugugagaaauguuaauucuccucuccuuucuggaggcucaaguguuucaugaccuucccauaguuccuuagcugaccuuuucagcuggaaucuuuagggucaaagauucucuuucuaaagccugcucuuuagaagagaguuccagaacagccagggccuuguggaagaacccugucuccaaaaagcagaaaaaccaaaccaaaccaaaaaacauauuuuuuuauucuuuuggcuuuguguuuuugguuuuuuuuuuuuuuuucaagacagcauuucucugcauaaaagcccugacuguccuggaacuuguuuugcagacuaagcuggccucaaacucacagagauggauggaccugccucugccucugcccugccacucccggcuaaguuuuuuuguuaggaauucuguaugaaugaaaccuaaucauauuuuccucccccaccuuccccuugucccuguugacauguacccuucccaaccuuauggguugguugguuuguuuguuauuuaguuuuguguuuauaacccaguuaguguugcccacaugugcaugagugagggccaugccauugcagcaagggaaaucugccugugacugaaaacaaaacaaaacaaaaacaaaaacaacccgagaguaucuucacuccugucaggcugguuaaguugggauggguucugcuguaguuuuuucuugaugccagaauguaaguucaaagaauaacucaagaaaggagagcaccaauuuuauuuagagaggagaacaaaaaaguaaaagacgaccugaccccuuucagauacaucguguuuuagaaccuaaaugccacagaacaauuaaggauaguaacaacguuugugcuggcaguguugaggacuuucauuuuccagaauaauuaaggauuaauugaucagguuucuccauaucaucuuaauuaacgauucuaaggcucuuacuucucuugagugugaucacguguggugaugccaugcugauaccagaguguaagcugaugugauuucuaugugcagagaaucaauuccugaaaaauccugcagguucugccuguuuuuaaaauauguagagaucauaguauucauuagcacauauugauacauuuaguauuuuuagucuggcaacaaguggaguccuauuuuaaaaccauaugauugaaacuuguguuuauaauuuguuucaagagaguuagccaauuuguuugaagauaucaauuucagaacauauucacuauucccuaaagcauaagaaguuggccugaacuuguaaugaccuuaaaacauuacuuagaagucgauccuuuaaaaaaaaaaauuccuagguauaagauuacaucguugccauucacuuauuucauaaaagacagaaaaauggcccaguuguuuggauuuuagacaaguauaaaagcugcugacuuauuucauaagcucuuuuauguuuucuuggagguuguaaaucacaguuaauacuucucuuuagggaaacagcauguggucuagcgagaagucuccucagcuggcucugugacuuggaacauuuugcuuaaccuuuugagccauguuaagccccuuuuagguaaaugggcacgugaguccuugguaagauuguccugguggcuaagagaaaguuagugagaaugagauuccuuguguaaaguguguccuuuucccccauggauguucccuuaccucaucuguugcaaauagaccaguuuuagacaguuaccaccuugagcugugguuccauugcccuuuucguaacauaguuucuuuuuauuuguuuguuuguuuauuauuuggaaugacuugagcccuagaaagucuucaugcaaggugcuguuacaucugcuuagaaacauuugguccccuagucccuagagucacagcaagacacagaggguggagucacaggagggcuggcucaguaggcugacuucccauuuccuugucugacuucaucuggaauuuugcuguggcuucuguuccuuagaaagcccuagaguacauuggacagcuuuuucugcuuuaauacuagcagucaaauuaucuuagacauuuucuucuuuuauaaggccauugucucuccuagaaaguaucauuugguagcuuuaaaaguuuaaggucuuuugucuguugacggaaagaaacauuuuaugaaaucaaauguuugguuguaaaacccuaugauuaguugugauuggugggagcaguaggaaaauaaagcugaaauccaguuuuuguuguuuuuauuuuauuuuauuuuauuuuuuuaacagacaagauuuaaacgcagggguguagggacugucugcaggugccauugagaugccuuuuacuguaagugcugcugccuuugagcuuugguucuguuucuauggcaaccgcaggaucuaugugcuuggcugaauggauuuacaggaaacugaaaaacauugcuauucuaaguagcuuguuguggaaagcgcagccagcauucacugagaacaaagcaggcaauguaugcuaauuguauuccuugucggggcuaaagaguuggggagaaucccagcgucugcuuacugacuuuguguuucuugaauuuuggaggacgaaaugacuuacucuuuauuuauuucaaauuucauauuugguucuccugucuccacccaacccccuuuucccaaaguguugaagaugggauucaugucgcagacaagcuagggaaguuccccgucccccauuucccuguaccuuuaaaaaaaaaaaaaaaaaaagcuauucuaguagaauugauuuaaacaaaacaaaucugucugucugucugucucucucuguguguguguguguguguguguguguguguguguguguguguaagauaauguuucaaugaaguaaucugcugguuuucagggucucaaacaccgaggugggcaaucuaaugcaaguggcucccuuugcuagcacuguaaauuaaaauggcacugaggcuuauccuuuaugucaaaacucuccuaccuagaguuuccuugacguguggaagcuguuucucuaaauauuuacaaaacagaagagucauguaauaaacuguugcuugggggaucagaaugaaaugcaguuuuccucuauuauuuuauucacucauugcauguuuacagaagacugcacauugaugucaguacagcucuauuaaaaggccacauggugauuucaguuucaauauaaauauauugggcuuccuguuugagauuuuucaagucauuuuuagaaauaagguacaauucuuuuuaaaaauguaagguauucaguggaagcagccauauagaaggacucugauauugaaagcuuuugauuucaggagcuaccucccccguucccacccacauacucaguuaaaauggaagaagacccauaaaaauccuaauguguacccaccauccuauuauuucuuguaugaagugucuuuguucuaccagcaaggcaauuggcagugcaaaggcucacccuuauuauuacacagauuuaaacuagucuuucucugagacugaagauguuuucugugcauuccucccaggucggggaauguggaauauuucuguaaaguacacuucugauaucucaggagacccucaucuauggaaacugcaagcuuccagauaaaucaaguauaggguauaauugugaauugcagucucuguagcccauagguggaguaauuaggaaucucaaaguacucugagauauugaugaaagguuuaauucuucagagagacucugugauacaagacagaaucuaggaaggcuagauugguuuuguuuuuuuaagaugucuaggaccaaaauuuguugaauagaucuuugcugagucccuuuaaauauggaguuacaggcuuugacaaacaucaggaacuggugcuaaccugauugcuaauggguugagaggaauuacaggacgaugaugcgagagcuaggaggaggagguaggauccauaacacuccaaucgggauucacuccacagaaacauguagagcaccuggcaggugcugugugaggggccagagaaugagccugacuguguggcacuuagucuauggugagcuccacaaggagccaggcaguuaccucagugaaggggcagugggcuugguggccccaaaagauccuuggaagugaagaggucagcucaggaacuuuggaaaauuccaccaggucccuccccuccuggaagagaaaaauccugaagcacucggcaccccuccccucuggaagggagggggaaggaaaggcuuaguuagguuccucagacccuugggggacgggggacgggggggacggacgggggggggggacggggggggacggacgggggacgggggacggguugacaccggggacgacacauuccaagaccaccuacagacaagggaaguccuugucaccucauucccuaaagaccaaucaauuuaaaagucacucuguucugccaggcacauugugccuaauggcugcugcucuaaaaccuguauaaauacuguggucggggcuggugagauggcucaguggguaagagcacccgacuguucuuccgaagguccgaaguucaaaucccagcaaccacaugguggcucacaaccacccauaaugagaucugaugcccucuucuggagugucugaagacagcuacaguguacuuacauauaauaauaauaauaaaaaaaauacuguggucauucucucucaacuucauguguaggacaacucugaacaauaaauuccuccugcuuuuugcaucgauucccggcuccaugucauucacucagggaguccccuguauaaggcucaccagagucuuacagaaacugaaacuugaacagaaaaacaugaagcagaaaaacuuaaguauugcuuuauuuccugucaaaaaagccuacuguuuugguagcauuuuuuuagaagguaaguuauuagacuuuggaacuuucaggcuggaaaggagcccgagugucuagccugcuuacucagcggccccucucaacucugagcaggcaaagaaacaggagauucucagaguggugugggucaggguguuggccaucuuugcaucacuguaacaaaauaccugaaacaguuuauaaaagaaaaaguuucauugucuuacagauuucagcccagaugguuggcccuguuggggagggagcucaccauggcagacacuuuugauagcaaaaccacucauuucacuguuggagaacagaaaaggaucucacaguccucuuggaggucaugccccugccaccugcccauuguaccucuuaaugguucuacagcacccuaauaaugcuacuguaaaguccuacaagccuuuaccaugugaggcuuugggagacuuucaggguccaaauuacagcaacuaggaaaucaagacacagugcacccuccuugguuuuuuauucacaauacugauuccccccccccaaccccccccaacccccccucccccccccccccccccccccggcccugagacagauuagugacuuguaucauaucuuaguguuaaucucgggguuuuuuaaaaaugaaaauuaaaagaaaaaauucagaauucaaguaugugaaauaaguuguaaacaaugaaaguaguacuugagugacuaaauaugaaaaugagagacguagaguacaaaauuacuuucucucucucucucucucucucucucucucucucucucucuuucucucucuguuucuuuuacugaaugucuuaguuaggguuguauugcuguggagaggcaccgugaucauggcaaaucuuacguugccaagcauuuauucagggcuggcuuacaguuucagagguucaguccauuaccaucauagcagggagcauggcagccugcagacagacauggugcuggagaaggaucugagaguucagcaucuugaucugaaggugaaagaguaguaaacucagugcuccaagguaugcuaaucauaaaacagauagugacauuccuccacccacccacuuccugaguucaaggaguauuccuucaaagaaagucacccugaccauuaccggaagcugcaaugcaaaugugcuauuguuaggggcucuuagaaacugucuugagaguuaacaauuaccagguauuccuugugacaccugugacuuuguacuuccuugugacucuuaucugguauuuuugguauuuuccaacaacgcccuucccaccuccuugaguugugguuuuuuccuuuaaauacccccuuacucagcuacucggggcgccacaguccucuaccccugcgugguguaugaccgugagcccgagagcgcucuugaauaaaaauccucuugcaauuugcagcaagaccgucucuugugggugauuuuggggugucgccucuccugagucagaacgugggggaguccucacguugugagucuuucaaaggaagccagaaggaaagacugucuuuugcaaguagccagggaaaaacucugauuucacacugggcagagcuugagcauaggacaccucaaagcacggugaacacacuuccuccaacaaggccacauuuccuaacagugccacuccucauggccagccauccaaacacauaaauccuuaggggugaaauccauucaaaccaccacacugaacucaaaaauucaguguuucuggcuagacuggcuugcuagccagcgagugguauuugucucugccuugaauaccagagucuacagauuaugcuuggccaugcccgacuuuuacaggauacuuaguauuuacauggauacucagauccucucccuugcaaacaaggucucuucgcuauugagcaucucuucagucccagcuauucuguuuuaccauguuaauucuucuuugugcuccuuuauucccaugaaccugauagaagugaaauaucuugcccaagauugucuucgugaguguguaugugcacacacaugaauggguaggugggugggugugucagcaaucggcuuguucaggugccuaguuuccagcacaaucucugugcugauucuucaugggcugugcugagaugguacugaagaaagugaaaccccgggcuggugagauggcucaguggguaggagcacccgauugcucuuccaaagguuugaaguucaaaucccagcggccacaugguggcucacaaccaucuguaacaagaucugacucccucuucuggagugucugaagacagcuacaguguacuuacauauaauaaauaaauaaauaaauaaauaaauaaauaaaaaaaaaaaaaagaaagugaaaccccuucuccuucugugacuacuggcuuuuauccaccuucaacugugccaucacccugcccucuguuuuaugucugugcauucagauuuauagcuuaaacagaaucaugauaagcccuagcacagcuuuccacgucugcuuugugaaaacuauaauggagaccuguacucuaaaagcagugguagggaaagcaguuccugauccuuucuuguugauuuugaucuugccuuccucccuuuagguuuaauaggaacugcugguccaucccaggcuccacuggccuggccuguagcguggcuccuaguaugccuguaacucaggaggaagccugucuuccauacccaguccagcucccaccagcucucucggugucugaagccuugugaaguccagcaggaaaaacgguccaggagagguuuuguuccugugucuaguuuguuuuuaucuucaguguucagagcauuuucuuuucuuacauuucuagguagauguaaccccuugaaaugcuaauucuaccacaaaagguggaaaaagagguuuugauuuuucuaaaagccccacaggcugaaaagccucauuccaguuucacaauugauaauuucuccugugacggcuuccuguucccuggcgugccuucugugcugcccugcaggcagguucugucccucccuccaggagcccagauuucaggcuuaaggcuucucucucucauacuuaccucaucuccucauggacugagaaaacccaaagcuuuucucuuuaaaaccugcucucaaauguaaaacaaacuaagaagaauaaaguaaaaccaucuacuggcaccuuuucuccuguccucacaccuucacugugaaagccauggucucauccagggccccucauuuucucugcccacugauuucauucgaccucauaaagccaaggcucugaagaaaaagaguuuucuuuucuuucccauaggcaaacuuuggugacuucugggucuuugcaacaauaugcuaauaggugccuguuguuuuucucaccuuaggaaaaagcaguuacuugacccuugaccuggccuugcuucuccacucagaaaauguugccuguccuucccaggagcagccagcgcuguuaaccacggagucaucucucucucccuucccugaguugucagcucuaucuccuuuguccugugaggaacugacacuaaggccccuugaaacacuuucuugacuugguuuccaacacauguaaacaucucaauuucuucccugguuuugcagcuucucccugagccuggcauguggcugacucuccacguugaccuccuccuugugugcauguccaagggcuuaguugcuaauaccauucauaccggugaauccagugcaggcuuggcuucuccccugcacuugagauuuguaggauauguccagcuuuauggacagcaccucuacuugacaguuugauggucauuucacaguucaugucccaggucugaauuuuggaacacucugucugccacuaagcucaguuugcacuuuucagugucagagcuaauggcagcaacagcauuccuguuacacuagucaaaagccuugacuuuucuucaucucucguuuccuguguccaccgugacccuucuuuuuaccuccagaucccuuugaacagauaacauguguacacacacaaacacacauacauggacacacacauguacacacauauguacuugcacacacauaugcacacucuuacauggacacauacacacacauauauacacacaugcauggagauguguacacaugugcauaggacacacauacauguacaugcacacacaaagacacaggcacgcacacuaaaaggccucaugugaaaaacuguacugaugaaguggacccugagguggagaugcuaugaauguccaucaggggguguggcuuguacaagccaguguuacaccaccuuagaauacaauaaagcaccuaacauuuguuauaaucuagaugaaacuuaaccaagcuaagugagaggccauuacagagugccuuguacuguaugauauagcauauauaaaauaucugguaagggcuggagaguuggcucugcaguuaagagcccuggcugcucuuccagaagacucagguucaauucccacauccacaugacagcuuguaaccaucuauaacuucaguuccaggggauaugacaccuuuuucuggcuucuggauaccaagcauguaugugaugcacagacauguauguagacaagccagucauacauauaaaauaaaaaauaaaauaaaacagcauuuaaaaaaucugggcuccauagaaccacagauauaagguagaguguggguaccaaaugauaagagaagagcgcauaggaaaugacugcuaaugggcugagaauuccuugucugaucguggugauggcuggacaauucugaauguauuagguguuucuggauuguguacuugaauggguaauuguauagcgcugguuauuuuaugucaacaugacacaagcuagagucauuugaaaggaguugaccucgugugagaaaaugccucagaagacuggccuauaggcaaacaugugggacauucugcugauugauuggugugguagggccuaaggcaguucuggguuguauaaaaaggcagguugagcaauccagucagcagcacuccucugugguuucacuucagcgucugcccugccuucccuucauggugggccucaucuguaagaugaagcaggcccugcucuccuggagcugcuuucuuagaacaauagaaacccaacuagaacacuuuaugacucacgccuuaauaaaggaaaaccaaaacaaaccacagcugcuaugcgggugggaacacagugucaugguugagaagugaacaggggacuugucacagagacaagguugaagggaggggugaagugacacucguuuguaaugagggugguguggucguccugguggugugauaacagugacuaggggauguggggagauuggaggucagauagccagcaucaggacagcagcggacaccaggugcgugugaaccucguggagguugacauacuugucagccgugugaguagugggaaggaccugcugugggagcagaaccgagcauggcgacaggauccccaggaguguuguguggagaaagacauaauucacacaauccaaagagaggauaaugaugucaccaccugagguggugagcagaggcaggguuagcagaugaaaggugauugguacuuuuaaaacacugaucugaugagguguaagcuaacuacagaagcugggucuugcuugauaauuggaagauguggacagaauccaugccuacugcaccagcuggcugcagagaaacauauccuuugcaugacuguaacccaagccguucgguauaucuaguucacgguaguuuuugugcagacuuauuuauuucaguauagagccgaguugugacuguagagauagacaaucuuacugagauugcggagaacuuccaaguagcugagcauguuuuuaaaaaaaugaacacauuauuauuuuggaaauaaagccauuuucauaagagaaaauuuuauguagcuccuuguaaaacacauugaaacacagcuuguccauauggaagugcuggaaauggcucuguugucaccaguaggccgaagguggacguuuugcugcuguggaccaggcuuucugggaucugaaacacauuaauauggaguggggaacuuuuuaaaaaacugaagauguaauuuagacaacagaggagaguugagccuuguagucuuagugucauuggccagugucacggccagucuuccccagccuugauaaagguggugcguaccucaguggacaggccucugucccucuacagugcuguggguaaagcuugaacaugcguuuaauuuugcugauuuuuauugcgcucuaauguuucuaauuucuuggauuuuuuuuuuccagguuacuugucugcaagacuuuuuuggagacgaugauguuuuuauugcauguggaccugaaaaauaucguuaugcccaagaugacuuuguccuggaucauagcggugagacaauucauugaccaucuuuguagcuccugaaaugaaagcucccaauuuaggaacucagacguguuagcccagguguacuggcgaaagcucugaggcagaaggaucauuugacuccaggaguuuagccagccuuggcaacauacugaaaacauguugaaggauaauuaauaaacuguccauaguaauuaucugaguuuuuuuaugucauuguuuuguuuuaaaacaugcuuuaaaaaacauacauuguuuauauauauauauauaaaugaccaucucguggaugggaugaaaauucccauuucuuuauuuuuaccuauuaauggaguucuuaaccauuauuucaaugauuccaaaugauacugguuuuagggaaauggcucuauccuauugucuuaauucuguauaccuacucuaguagaaaugacuguuuuagcugauagaaaaaucaaccuaguuuuuuuuuuuuguuuguuuuuguuuuuguuuuuguuuuuguuuuuguuuuuucaagacaggguuucucuguauagcccuggcuguccuggagcucacuuuguagaucaggcuggccucgaacuuagaaauccgccugccucugccucccgagugcugggauuaaagccacgcccagcuuuuuuuuuuuuuuuuuuuugguuucaaccuaguuuuuaagugagugaaauucaaguagguauauuuuacaaaggaaagagggauuagagcuaugaucucacucuuuuauaaaugagcaagaugucuuuuacagcuugagaugggugauagaaguauaucacucagagaaugccuggucucaagaaguggcucagcaguuaguuaagagcccauucugcuuuuacugagggcccagugcgauuccuaggaucuucauugagggacucacaacuguuuggaauugcaguuuuaguggguaggaugcccccuucuggccucuaugggcacugcacucagaugcacaucccccccccccccaagccccucacagauacacauaauuuaaagauaugauaaauccagugguggugcacgccuuuaaucccagcacucgggaggcagaggcaggcauauuucucaguucgaggccagccuggucuacagagugaguuccaggacagccagggcuacacagaggaacccugucuugagaaaagcacaaacaaauagacaaaucaucugaaaaauugauaauugucuugggcuaccuguauuauuacacuguuccguguaauuuuauuuuuuguuuuccugugugucucccaagcacgugcuggcucucagcccuuuguacuuguucauuucaguuuucaccucugcuaauuaccuaaaagcucucuguuuugugccacucugcuggagugauucugucacccuguaacaccacugggaagccuuucauugugaagcugggcuuuuguguccccugugccgaugaccuaccccguuccuguaacaccaauaucgacugaaacgucccuuuacccaucagcuguaguuuucaucuuuauuuuagcuuuuaguuucugaaugauuuugucaguaaguagacaguuugaaagucaagacacugaaacugaauucugcguuguagguuuuaguguuuaaagaagugcaguguaaaaagcagagcuccagacagagaacaagagaggguuuauucuggagccaaauaugaacggcuguggcccaggaacacagauucggguuacuccaguuaccuuggcaacaguuucaugaaguuucuagaguaacugaacaaaguacccacaaaccaagucaguuuuaaaauacguuaguagagauaucaggcagacaggugucagcgaagcaggaaaacaugcuagaggccucaggugcugucuggugaauucuuagcuugcauugcugaaacuaggguucuguucaucauauuuuaaaaagauuugccgaacagucacacacggguaggcaguaaaugguuauuagggggcuaagguagcccgagaggaucuggcccugucucugcaucuuucuaacacuucacaaucaacaaagcucuaaucagugaagauggcagugacuuagucacuguagucaccaugguggugcugaugguagcaauaacgagacauugguaagugcucacucuguguauaggcagggcugccguugcuuuaucugagcgaguuggauuaucuggcucuuuguaguggcugaugaagaaggccucuaauagauuuuaaaaaaugcguccuguuaguuuuuaccccaucuccaauauguauuuauuuaaucuucuucaaaaugggagugauaaggauaucuuauaaaacuuuucaaagauuaacugaauuaaugugucacauagccuggggucccugugugucuugcuguuuuugcuguugucagcuuuguagcaccaucuuuacacggugaaguuguauggugagagcagaucucguuuuggauucuaucacagauacacucaugagaacgcaaauuguuuuuuuuuuuaacauaagguguguaauuguuuugucuuaagagcuccagcuuugaaugucacacauuaaagaucaugcauuaaaacaacaacaaaaaucaaaggaagcaugacguacguuugaaagcccaccaaaacaauaaagagaaggaaaaagaaagaggaaggagugaaagagaaucuggugugguggcggaugauuuuaauuucagcaugugugagauagaggcaggcagauuucugaguuaaggccagcaugguuuacauagucaguuccaggccagcuaaggcuacauaaugaaaccuugucuuaaacauucaacaugcauagaauucugcuaacccagccguucucaaccuuccuaucuucauugcuacuuuuuaacuguaauuuugcuacuguuaugaauuguaguguaaauaccugugauuacccccuacccccgcccuggucuuaaacgaccucugugggaaaaaaaaaaaaggucauuugcccucaaaacgguugugacccacaaauugagaaccacugugcuaaauuaaucuuggucaaaucucuccugauuccuaaacgcggguggguuucugaaguucccgcauauugggguuuguuuuguuauauccugcucauuagagggacauugucucuaaaauguuuaacagucuacacuccgagcuuucgagacaauggaacacaauccauaauacuaauguguuagcugaaaguggagcugccccguuuauauaaggucugauuagagccuuucagauguuaacuaggcuccccugguguguccccccccccucauuagaauacuucacauguuaauuuaccaccccggcgauuuagauuaaaauuaacucccuuuuuaaucuuuuugcauaaaucgaaguauuuugaaguagaugauagacaauauguuaucuaauuuaucccuuacuacaagcccgugaagcacacuuuauucuuacgcuaauauguuaggcagaaauguggaggcuggaauauaaggagggucuucuucuaguuagcaaguguggagacuaugacucaucccagcccgccugacugcaaauccugugaucuuaauuacucaaaugugaaguggugauugcagcuguaauuuguucugcuucuccaaaugcuguuuuauucggcggcuuauggaaaggucaauauuauuauuuaaagguucuauucuccauuuugcuuuuccaugcuuuggagagauggguagcuagacagcaaauagaucauaagucaguuucauguccuuuugauguaagagaggcagggacuugaagagggcaauaaaauuacaaucugugcugccugugaaaaaaagcuguggcuuaucugaaugauaccgugcauuugcuuaggacaguggaguucuguacccaguaagaacucgguccaaacagugacgagucacagaugugagaucuaaccgaagauguaaaccucauauguucuuucaggacgguugcugcuuacauugaauuugugaagcucgggggcuggcagcacaccaagucccggguucaauuuauagcacugaaaaaaauaaaaggugggaugggaaagagauugucggguaauagcaacagggcugggggaugccuugguaaggugcucaguguguaagugugagggcccuaguucaaaucuucaacacucccacaaaaugccgggcauggugguucauguaucuguaaggccgguacugggaggcccacacuagaggaguccuggagcucacuggcccagcagccucgcagagccggguggcugaguucaguuaggagagaguucaucucagguagguggagagugacugaggaagaccacuugcuucuuggcguacacguacacuaguuacaagcagcuagcuauagucacgugugguauguuugaucaccgcuaagaucugcuggacuuacaaaugcacuuuuguucuuuacagaaugccguguccugaaaucguccuacucucgagccucagcugcgaaguauucuggauccagaagcccaggguucucccgccgcagcaagucaccagcuucagguaaugagagagacuccguggacggucuuagagggaguguuucuccuuaguuuucucacaggguuauagauguaacagccuuggccagcuugugugcagccacauuucaggacagugauagacccagaggucucucagggaagcccugcacuugguucuggcccauuuucuugcagaccucacugucuggucuuacacuggugugcacauaaaaguacuacacauuuugagcccuguaugcugcauuuuuaaauucugugcuucauauuuguggauauuuaccuuuuagaaauuacuuccuauuggugcagcacguaccgcuccacacagaaguauauuugcuuuagagauuccagucuuuuccuuccucagccacauagugaugaugauucucacaaaggauuacuuaaguucuaugcucuucagacccaaaucuuacauacuuacacugcuuugauauuuguaacauucaaaacacccaaacuauaucucaauaagcugaauuuacagucauugcacauaauuuugcuuauugaaucuauuguuaaagaaaugauucuagagagaaagagaguuuuguuuuugcauucagcguucuuaccccugcccaggcugcugucccucagagugaacuaaacuuuccuuuguuuggaacagagguaggguuugacacgugaggcaccugagaguggucccagauaaaccaucucucacaucagacuuggacagacauucucucugcugcuccggcggcagugcccaccccuccucuagggcaggcuguguuacugucuuguagaccugcugaauaaccgcucuccuuacugucuccuccugcccugugcauaugcguguguacaguaaagagggcuggccacuccagugccuauucuacagccaaauccccaggugagccaggguccuuacaacuuuggugcucugcugggcuuuguuucugucuccugcugcauuucuguuuucuuugcuccaucuccauaaauguaucuggucuucuccuguggacaucugugccguguguaacagcguuucacagugcacaggccacugcagccucccugcuugccacagaaccgcuuaaccuaagaguauugcccaaugccugucuguaguugaagcccagcggccugggggcggcagucaccuccaggaggucuguguucuagugaacuguugaaaauguucugugacuaaaaaggcuaaaaauuguuagcaaugaagauaaggaguuucuagccucacacuuugcucauaccuggguuaaagguuuaggagucauuaaauuuuuucuuauucaagguacuuuauaacggccugugccagaauaggauaaugaagucuuuccugcacaugaaaggaggcagcccacacuguaucuuuuuaguugggaaacaauuauuuucauacagcacucuacacuuaggcuuucuaaauaugugacaguugacacuuggguuuuuaaaccaaagguaucucugccauugcuguuauuuuaaauuguauugacucuguaguaucuuagaccuggaacauaaauguuuuuguauaugguuuucuggcugaauuauuccuagcuuuuguuucaggugacagguuuauagacgcuugucaugucaggaaaaugauuacauaaaaaguagagagaauagcucaggagucaggugugauuaauucagcuuuguccccagaggucugaagaggaaacuuacugaauaguaacauuucaugaccacauuugucuucagaccaucuacuguucuauggugaagcccaggaaauaaauaguuuuguuuguuuguuuguuuguuuuaaauauucugaauuugcagugcuuaaaggucaggugaggacuagcauuucagugcacgaaaucuucagcugaauccuuauuuggguagagucagccagccacagacuucucagugaacguugugagguuugaaaaccacaucucagcaaauggucuuuggaagaguccauugaagauguuuaacacuuuauuuagagagcuggaagcgucugcccugcuggcacagugauuacugcuguguuaccaacagugcuuucuccucauccuuugacaacacggggcagaguauugaaucauuacaauucguaguaucggaaggaguggugcuugaugguacagaggcucugcugugcugugggcuguacucuaacaguucagguaggagauuuaaaaugagccugggcaaugcagccaggcccugccuuuaauuagcaacaacaacacuacuaaaagauuaacugggauuucagaaagagcuaguaacucuauaauauuguaauuauaauauuauuccugccuauuguagguuagaaagcacugcuguaagugaaguuucugaaucuacuuaaucauccaacaagacucuguguaaauagcuaauuagaguguuguauacacagguaguuaaguagguaccauaaaugagucaaucuuugagucuuaaaaauccugcuuuuagggauuggagagguggcucaguggcuaagagugcuugcugugcaguugaggacucagccuuuagauccuagcacugauaccacaagccagguauccuauggauguuucugaugugggguggagaggggggauugcugacuuccaaccuagcaaagaaaucaaaagacauggauacuaggagagacucuacuuugaaggaccagggagagugauagaugagaacacccgacccccucuuccggccucuguugcaugugcguguagccauguugucaaaggcaccaaaggcacugccccccaaaacacacacacacacacacacacacacacacacuuuuuuuuuuuuuuugguaaugcuaguuuuagguuuguaguugugacucuuuaaacauagcuuauaaagauaaaaaagaauucagagcagugaaacagaaagcccaccuuauaacugaggaaaggaagcuugcuggaaggaagucccagugggucgugggggauggagugccauguacgugcuggcuggucaccacacuuucccauggcugcagcagugaagggaacugaugucacauagcaccuucaggaccacuguuauucaccuuuccagaacuucagagaaaugugcaaauaagggaaauuaaggcugccuuaacagcaauucuuagaacuuuccaaaggcuguugaaaacucacguggcuccaucggucugcaccuucuuaugaaggaguuauuugggggugggcuggacauguaguuaccguguuaaguccuuagcuaggacaugaaguuuuaggaagccugucugcuccagaaacagccaugugaggaacugauuuuucuguuagccccacucucaguugguaccagauggaugcaaguuuaagcccauggugguggcuggcugugcacuggcgaccuguacggauauuugaguaggauggagguuuaaaaaaaaaugagugaaguucugucuccacuuagagcaagcuuucuagcuuacugccugucuuagucaggguuucuauuccugcacaaacaucaugaccaagaagcaguuggggaggaaaggguuuauucagcuucaacguccauacugcuguucaucaccaaggaagucaggacuggaacucaagcaggucaggaagcaggagcugaugcagaggccauggagggauauucuuuacuggcuugcuucuccuggcuugcucagccugcucucuuauagaacccaagacuaccagcccagagauggucccacccacaaggggcccuccccgcuugaucacuaauugagaaaaugccuuacaguuggaucucauggaggcauuuccucaacugaagcuccuuucucugugauaacuccagccugugucaaguugacacauaaaaccagccaguacacugcccaugaugaucucuacuuuaugugaguccccuuaaaagggaguuuuuagagacuccaugaaaacaguuucagacuuacagcaaaucugagccaaagauugagguuucccgugucucccuauuugcauaaacacccacagccucccugaucaccaguaccuuuaugaagaagaguacaguuguugcagccaacacauuaucucccagaguucaugacuugcaagucacuucugugauuugggcaaauucaugugacaacugcccaccauuacagugucacgcagagucguuucuaugucuuuaaaaaaaaaaaaaacugauuggggcugggcaggugauucuccaguccagugccugcugugaggacucgaguucaaaucccagcaccccaggcauagaccugcgucuguaaccccagcacugggaauguggggcaggguucaggagcucacuugccagccagucauccagccuagcugagugcauuagcuuauguuuagugugggauccugccuuaagaaauaagguagagaucuguggccucaugcauguauguauacacauacaugaaggaacguacacccaugcaugcacacaugcaugaacacacacauguaugcacacauguaugaacacacacacacauacacacacacacacaugcaugcacacaugcaugaacacacauguaugcacacaugcaugaacacacacauacacacacacacauaaacacacacaugcaugcacacaugcaugaacacacacacacacaacacacacacacagaggaaaaucuagauaacccaguaauuuagaguaaggaaauuaaaaguucuagcuuaucauauaugcuacuuggucuacaguuucugccuccacuuaggaacuacuauucaaauuuuugagucguccgugcaggaucucuaucuuugcauguguacacuuaauucagaugaucuaaaacaauacugucugccuccuuaugucuaaaaaaaaaaguggauuucauuuugcuuuucauaaagcagguuucaucugcucugggcaaaagcuuuugaggauuacuguugaaguaagagggauuacaaguacacugaagaggggaacaaaccacuaaucccagauauuaagcacuggguucaugagaucacugcagaaauagaucugcaugauauauaguguaugugaaggguacgaaguugguugaccagcacccugcaggcuaaucugugacuaacuccccuuaugaacaggguuagccgcucucugcuuagcacagacuccaguuuaagcuuucaaccaaagaagcaugcagagguguagaaggggggauagaaaacuaccagcgugugcuaaagaacaggcaaauacagagguguagaagggggauagaaaacuaccagcgugugcuaaagaacaggcaaauacagagguguagaagggggauagaaaacuaccagcgugugcuaaagaacaggcaaauacagagguguagaagggaggauagaaaacuaccagcgugugcuaaagaacaggcagauacagagguguagaagggggauagaaaacuaccagcgugugcuaaagaacaggcaaauacagagguguagaagggggauagaaaacuaccagcgugugcuaaagaacaggcaaauacagagguguagaagggggauagaaaacuaccagcgugugcuaaagaacaggcaaauacagagguguagaagggggauagaaaacuaccagcgugugcuaaagaacaggcaaauacagagguguagaagggggauagaaaacuaccagcgugugcuaaagaacaggcaaauacagagguguagaagggaggauagaaaacuaccagcgugugcuaaagaacaggcagauacagagguguagaagggggauagaaaacuaccagcgugugcuaaagaacaggcaaauacagagguguagaagggggauagaaaacuaccagcgugugcuaaagaacaggcaaauacagagguguagaaggggggauagaaaacuaccagcgugugcuaaagaauaggcagauacagagguguagaaggggggauagaaaacuaccagcgugugcuaaagaacaggcaaauacagagguguagaagggggauagaaaacuaccagcgugugcuaaagaacaggcagauacagagguguagaagggggauagaaaacuaccagcgugugcuaaagaacaggcagauuaaacgugaggaaaagggaggguuagaaauaagcagccuguauuaggaauauuugaauaauuaucuuuuaaugacauucagucagucaaauaauaaauauuauaagaagaaauaguugcuuucacuuuccaguaauaauauaccuaaagguuaagguuguagcucagugguguagcaugcagugcuuagcacaguucuuagcaccaaaaguagaauguacggaaggcaggcacacacguguguacuuguguaauguacggaaggcaggcacacacguguguacuuguguaauguacggaaggcaggcacacacauguguacuuguguaguguacggaaggcaggcacacacauguguacuuguguaauguacggaaggcagacacacauacuuguacuuguguaguuggauuacagucuaauugauuugaaagagccguaggcauuucucugugacucccauuaguaaacaccaagaugaagaugcucguuggcaaucucuaauggccagcaucacugaccauuguagacccagcagcuagucauucauuuguguguucugggaggaggcuguauggacagggucucucacucacaccuguaauuccaugauugucuucgauauuuguuuauaucauuguugggacacuauuauugcaaaugguucuaauuccacuccuugugugaccuuguguguacugcaguaagauacauugccuuugcuucugcugauccgucaucugcuaugggcuuugaaugaagcgcagcuucaucggagccguucccugcaugugccuaguguuuucacaaucuggugguuugcaguucugauggcucuucccucuguugucuccuggucagugaauggaacucccaguagccagcuuuccacuccgaaguccaccaaguccuccagcuccucuccaaccagcccgggaaguuucagaggauugaagguacgaagggagagauguggcgcguguaugugauccuguuaucuguguggugugagcuucuaaaggcugcacugggucuuagcauaaaguuagcucaucaucuuaacucucucccuuguguucacauccuguggggaugcaggguugugauagguugagcgagauguggugaacguuccguauagacuuuauugaagucugaaacaucaacauaacauuuaugccugcagaaggguggcacaagaaaaacacguacguuuuggugaggaacguagcauaaauaggcauuauuuaugauguaagcuacuuaacagggaggauauuagugcacaagguugaagcuuacaaaauuuuaacaggcuucauuugauuuaguaaauccuagugcuuuaaauuuauaaaaugugccuggcaaaacaucaguaaauaauugcuguuaaacacgggauguuuccuuuacugacacagucagauuguuuauaugguaaggugcuuugaaagggcuaaaguuugucaaagcugugcauccguuagucaguuaaccagcuuuuccuuccuuaguggugacagauaggcuaccaccaggaauccaucucugcaaauggcugcuuacauaccucaaauaggguccaagcaguguucucuaaggauguugaagaaucucuuugacaauucucaugaauagcaagggcugcugaccacuucuguguggaccaggagccuugaggaggugcaugaagcgcucagcuucccaaaguggguaacguuagccaccugagugcaaguacugcccugagaaggauaugcacauaagagacagagaauaauagacccucuugguuugugcuugccugguuauguaccuuaguugaaacgugggaugagacugaugguaaauuuagggauaagagaauacauaacuuguacaaucuaugcaucacuagacgcacuuauuagaagaacuggcuagaucuggugauuccagcuuguauucucaauuaaguaggaggcagagacaggaggauucugcaaguucaaggcuagucugauuugcauggugaauucuaggcaaucuagggcugcaugcuugccuagcauguacagugcccugaguugaucccugguauacuccugggugugguagccuggguguggugccugcaauuuuagcauuuaauagaggagaccaggaggagcagaaguucaagugucaaguucaaggccagccugggcuccuugaaacuccgacucaacccaccaauuaaaacaaaaacaaaaaacgaaacaaaaaaaacccaaacuuuaggcuuuuauacccaaaccauaaugucucaguauaagaggaugguguacauggaccugugguagaagcugucccuguagccuggggaguagcugggauuugaaagcagaacuagucuuaacagauggcucaaaacagcagugucagaacaaaaauuuauaaacggaauuauuaacgugcaggcuaccuagcagaccccuguugggcugcaucuaaaauggaguuccuagguauuaaaacuuggcuccccuuuguuuggauuugggaaagauggcuuuucugaaaagcacgaccgcuuuuggugauaguugccucagggagaagcaggucagacagaagucuucuuuacugcaagcuccugcuuucuggucucgguaccauaggacuuugcagugaggcccguucaugaaugguuauaaggaugcuuagucuucugguguucuugguuuucuucauccuucuuuagcuggcaaagaauucucuagguuccaagcaaucuuaguuaagccuuggaaacuaagacacacaucuuuggcucaggaucaacggggaauggaagaaccccggugugcagccccaugaggagccucaggcacaacgaagcucagagcuccacuugagucagcucucucucauguuuggaggcagauacagggugcugugguuagaagcacagacuccaaucagagugccuggguuugauguugguguggccccucacuggcugugugaccuuggggaagucacguugcccuuuucuaugaagaguguuugugggguacaaaacacagaguaggcgcucaggacagcuucagugcccucccuguaacuguggacucuucaggcucagucucacauggaggggauuccacaugaaacauguaagugugcaauggcguguaugaaggaagguaagcacaagagcggucagacagaguuuuucucuucuauuccuguuuuauguacauaaaaaaaaauucugaccaagauccccuugcuccaagaaaguaaaaauauuuagcucuuaggcauccugaguaacuuucucagaacccagaagaugcaggucacaucaccugagggacagccuuguggauaauagauuccagugcccccaccacaggccacacucccugggauggaguugaggguucugaagguuuauugggaauugcugcuaaggucuguagcugagggaagggaggagcuagcagcagggcugggagucucacaucuuguuccuuccucucucugguccuggacugacuucccuucccaaauugucccuccucgcccuucugugcuuucagguaucacaacacuuaccagcuuaacaacaguaaacacucauuuccccacauacacuuagaaguuaguuggauuucagaagcaggugaauugagugguucuggcaggcucuuuuauugcucgcuggcaggguacgcaacuggguuagaguuaccugcggcuugaugggcaugggguauccauuugcaggugaugucuuguuuugcugacaguuggguuggaggcaggagaauaggaagcugaaaaaagggguuccauagauucacauaugaauggcagaagccagggguaaagggcuggcaaccuucucugagcuuccuucagccaagggcacauggcacauuauguuagugacccauaaaaggucacugcacagcucaccucuuuugcccucugagugccaggacacagaccaaauauggcacaccuccaggcuccuccgugugccccacuuaauaagcuguuuccuccccggcaacugacuguguauguguguguauaauucauuguaaagaagcugaccccgagacucagaucauggcuggcagaggccuagaaggccuugucccucccugcuggggugaaccugauguccucacaagguggcugcucccuuuuuaaacaugugacagaggaaggaugccaugcaguucuguuucugugacccagcuuuggaagccaccagaccuucuguuaccauagcaucuuaggugucccacaggucagugguucagccugggaggggacgucuggguccuuucugugcuagcagcacacagcuaccaugccuuuguuuuaggcugcccuucuuuuccauccaucucccugaacuuccuguccaucuuucugccuggaagucaccacggucucucuccucaccaguuuuacgacucucucucucucucucucucucucucucucucucucucucucucucuccugaucuuuucauucuguucccuaauaaccauuuuuuucuucuagucuuggaauccacugcugacauuguuuucuuucgcccuaauccccaccuuccugguuuuguccaugaccucagccugcgagcuccuuucuuuggcagggcaccuccaagucccuuggauguggcuggcagcucucuucugcgggauuacuuacuguccuuaaaucacagcauuuggggcagggggcagacaggcaauaaagaguacuaaauaugucaugggcugccagauagaugaagagaacauuucccugaacuuuaauucgucaucuguccaaacugaaggcuucuaaggcagcuguaaccgagggcuucagacucagggcacacaguuugggaugcccgaguucugcccggguccaugcccgggagcucuccaaagccagcauucuuguugguugaaagggcgaagaagaacaaaguccaaauggaaugucaccagcaucuugagauuguaaacugucuggugugcugacguuuguuuuaucucacagagucuccugggucugcugguggugaaagcuuucccagauuugugaggugugcugaagcgcuuuugugucuuaccugauuggcagagcuaaaccguaacucucugaccuccugaaccuggaaccuucuuuucaaagcugugggauguaaauccacaguagccgcugaccuuagacauuuuugcgucucccuggagcucuggcuuuucuggcgaauuuaaaacuaaguuaauaauuuucagaaccagggagcuggccacucugagguucuuuucauuucccccagaaacacuguguggugacuucaucuuugaacguaauugauuuuguuagacagaaacagaaacaaagaggcagauuaaguaguuuugaagacuucggugcccuagcaaaauaaaucaugauauugaauaccagauucuguuuguucauggugguuucucgguugguuugaugaguuuggggauauaguucagcccucaucugggcugcagcacauuaggguagauuggaggcagugaucguugugcaagucagugucuauaaagucagagcaacuguaagaacaugcguucguguucgaugccuccuguuugugagcgcuggacacuagaaggucuucguggugguaggguaugacugcaguagccagccaugacaccuuggguccuagagguagugaagcucccagcauuuagacauuuuagacaagaggcuuuaugauacugcccaucucuugcucagaucaguaaccuuaccugaagggaccacucacauaugugaugagguucuaacugauuuugaccaccaacuagucuauggagguguguugcccuugcccguagccccuugggauaguccuugggguacggaggaguuagaaggcacggauucaacgacauggaccucgggagucaggugugaagcagaagcagacugguuuauugcaggauuggggagugucuuuauacacuccaccccugccccauugguccaugacggcucccccuuguugcuggcaccaucugauuggcuguccaggucaugugcucugucaucauuugacuccaugugcuagaucuuaagguuguaaaauguagauggagcuguugaacaugcuaggaccauuaugggccccuagucagggucugcugacucauuccuccuacagagaugugguacuaaggauuggaggggcucugucagcaaauccacaaagccugcaagguagccacuggcuuguguccuauuuacauacacaguggauuccauucaucaccauuaaccagcuacaaauguaaaaggaugugaguaaguggguaauucucuugccagugggaugaugcccagaauaucugcaaaggaaguaacagaauacuaucgucacuguggcuccccaugcguuaccacucuuggucugcaugucuacaggccacagggaauauuaugccuucuauuuaacaguaguguuuccuguccaccagcagucucucuggggaacaugaugaaaagccagcuuuucauggcccuggagagccaagcuucaugguagggaagucaagugaauaagaucauaaacugggagauuaaaagguauagccuuggguaaucuagggcaaugugaccccccucuucugccuuucagcauuuacuucaggccuugggcucugaccuggaaugggcaggcuuugaggaguguccuaacuguucucaggugucucacagaacuaccagcgugucucuucuucgccuuuguauguuucccuuccuuuuaaacagcaccaguggucgcuguggcuuugacuacacagugaggaaagagagggagauuuauguuauuauguuuauuccucauuaugucuuggccucaguucaucugugauacagaaaaauuauccccucuaguaguauuuuccaugcuuuuuaaaagugaaagccuuauuuucaaguagaggaauauauuggauaugucacuccuguuaagucaaugcagggauuuuugaaaagcuuuggcacuuaaaaaaaaaagucaauuugagaguugaaaaauggguucugucguuauuugcuuaaaaagccgcagcuccugcugaucacugaagcgucuguuggacgcacauggaccuaaccuggcucugugcccucacccuccacaggguguuccgccuucuacacucauggcuuccccaauuuggcacuuuuuuauuagagagccggcguccaacaccuggucuuuuccugauuucuuuccaugccuuuugucccccuggaaucccaguacaaagcggguuuauaauuauucggcugcacaaggaguggggaucgggaagaaaggggcuuuacucagaauaaacacugggggaguuuagaaggguccacaggaacucgguggguaaacacucugaagugcuugcaggugccauguagguaaaugggccuguuccagccauugcgcuugcuccguagggagcuucuuagagagcccuggagucagucaggacauccagaccaagagaggggcuuagaacaauguuaacugcuucaggaaagcuggccaaguagaaagugggccacaggaccaagacugguccuaacaucucuggauguuaggaguucugggugcuggaggcagagaauguaccacgucugacccagccaguuagaggcugucuccuucuaggcaaugagauuuagaucugugaacagaguccagccauuguuacuagaauuuggugacuuagcccccuggucuguuuguucagaguccugggaguaaucaccagggcuccuuuuauuaaucuuugagacuuaacuuugcaggaaaauuucauucuucucauuguuuaguccuuuaauaguuaggcugcuaggaauggugguacaaauuuguaaucccagcauucaggagucuugguggggguggguggugcucaugcguucaagaugaacuugggccacacagcaagaaugcuaucacaaagaacgggacugauauuagcuuacauuggaucucucauuucuuuggcaauuuuucgaugaaggaguguauuagaagaggaauuaacucgcagugaaagauuuaacacauucagaaauugugagcuccgugcuaggcaccuggagggaaaggaguaaugacggagguugguuaguggucacgggagccagccagauugcucaguugucuaacaggguugaacuaaugucggaucucaagauuucaagcugcuuugccuuuucagagaagaaauuuagacugagggaguuuaagucaauaacaaguacagaaauuggucugagugauguacguauaaaacucacaagaaaaagugaugagaaauacacuggcuaugagguggagacacaccauggccuggaugccuggcugaagauuggggcugauguuguugguaagaaagacccacaggcauuuuuugaucccuugaguuucucugaucacuuaguaguaguuuguaaagugggagaggccaggugaagcuggaagaggaucugaccaggaugguagccguaagaaauuaauuacauuuucuaaaaagccuccuuuuaaucuccucucugaguuugcucuuagacauuacaacuuuuagauugguuuuuuuuuuuuuuuuuuuuuuuuuguacagugacuuucaguuucagugccaagacauaaaauaugacaagacauaaaaacauugaacacugagaauuugauuguucaccaguuuugcuuuguuguuugggagugaaaguaugggucuaggagccggggauuuaaucuagaacuauuagacuccuugguggucccgagacagcauuugcccuaaucuugguaccuguuuagcugugauuucguaaaguaugcuuuauuuuauuaaaaccaaaacuaacacagcuguuaaaaaguagagugucaauuuuugugauguuaaaucuggguuggagacuguaucugugaaauaaauucauuaauguguuauguuguauaaauggaaaaaggauaagaaaaauuguauauccuuuccuguaucagucauuugacauuaugugaaugcugucuagggagcugaugauuuauaaaugcauccuaauaaguaaugguuauuuucuucucuuagcagauuucugcucagggcagaucuucuuccaacguaaacggugggccugaacuugaccguugccugagcccugaagguacuucuccgucugguuauuacuucuauagagcaaaccaccuacccaagcuugugggccaucagaaucccacacaugccacauucuuccuaaauagggaugugaccaugucaccugcuaguugaguuagcuuuagggggguguugagaguggagucacuucaggguaugcagugucucugccauacaucuuguguuucagauguuaguccugccuguguuucagauguuaguccugccuguguuucagauguuaguccugccuguguuucagauguuaguccugccugccuuucuuucgcucuuacugguuaugugcucauaauuccuagauauuuuuuuauucucucaauuagaugagaaacaaauauauucugcuuugccugggauaacaagacacacugugaugguggacucguccuaacucacagcccauuguacacuuuuuugagaaggcguugcaccaggaauuagcuucaacacagugccuuacuuugauagaacuuccuucuuuucuuuccuuccuuuccuucauucccuuucuuuccauccuuuccuucccucccuccuucccucccucccucccucccucccucccucccuuccuuccuucuuccuuccuuccuuuuuuuccuuuuccccccgagacaggguuucucuguauagcccuggcuauccuggaacucacucuguagaccaggcuguccucaaacucagaaauucgccugccucugccucccaagugcugggauuaaaggcgugcgccaccacugcccagcagaauuuucuuuccuugaggcuaggagagaucuccggggcacuccucugguugacuccaccucacaccuccccuccucccuggugggaguuuugaaaugcucagguuagacaucaccucugccuggagauagucauuuauuuaaacuggcauuucaagauuuguuggguuuauugauuuuuguggguuucugauucuaaccagcaaggucaaaaggaacguggugauuuggcauucuacuuaggaaauaugcugagggcuuuccuuuaguuuugcuuagaccuauaaaugauagccuugccuuugauuauuuuccaagagcgcaggaaucaguaggaagugcugauguuugcucagaguuugcguuuguccucggcugcaggugugaauggaaaccggugcuccgagucguucccccuucuggagaaauacagaauagggaaggucaucggggacggcaacuucgcgguaguuaaggagugcguggacaggugaguggcucgugaucuggucccuguacaguucucccucuggaauuagaagugccucuucccccacuuuuuugggcagaaaacaguuacauacauaaaauuguuuuguaugcagaggaccuaucagaaaucacaucccaaccuagagauggguaaggaggaaaacgagccacugaaagaagacugccgccuucuguggccuuucccacgccaggcucugcguggugcacgcugugaaccuucagagcaaugcucucucucacccagugccaagcugcuagacccauagcucuggaugcaggagccaugacugugagaugagaucagaagaagucaacucuuuaaacaauacgauagucauuaugauugcagauaaacuuuuuuuuguguauagaacgcuacccuaccucuuaccucuucugaauagcugguuuuuauaguuuguggcagguuuucuagaauguucugguaauugcaguuuauccauucuguugcaucuccaaugagagcucacugcccuuuauauaucgcuauguaagcaacccccuguucuugaagccuuuuuacagagcucuggcauacagauugcugaccaaaacagugaggcaucuagaauguaucuucuaaggaccuguuaggauuugguuuauaguaugaggggagcaauuugaguguuacucuuccaggcugggccuugucccuuuggcagaacagccccagaugagaaagcacauguuuucugaauacuuucuaagaagacuguugauggucucuauugcacugcuuguauuucagggauuuuuuggucauucaaauucaacuaugccaauauugaguaaaaauuaaauuguauuagauuaagauucuugugucuaauaagugauuucuuuagacccaggcagggucuguaggguagaaaucacauagaccagaucuugcugaagauauggaggaaggcuagggacuaaagggcgaggacuuaacuauaaacugagguggcuuguguaucaguguaaagagacauccugagucagguuuucuuucuccuguuaaucugauuaacuuuucuuucccuuagcuuucuccuuagagaccgucuugagguuuaaguaaagaaaguguuucuuuucuugguugauacaacagaacuuaaauacuucaauacaaguuaauaauguaaagaagguuuaauuagccuggcuuuucuuuccucuucuuuuuuuuugggaguuccuuccucccaugaccccuuuccacacuguguaaggggcagaggugucucggcuguacagggaauuggaaggcagguuuagucugacuuguagcuuuaaugguuuuccucugguuauuucuagguacacuggaaaagaguuugcauuaaagauuauagacaaagccaaaugcuguggaaagguacaguauacacaacugcuacaaagaaagaaaagagaaugcguggguucucggugagggaggcguuagaguggggacucggccuucgcugcagggcagagacugcuguagacagcagaaagaaaagugauggguuuccagccugcuguucuccagcaacuuuuaacucuaagauggcaaauuaacugaucuagguuauagcuauagaaaauguaaaacucucuucucugggagauuccuagucucaaauccagcaaaauuuaaaggcuagaacugagggccaugaauuguuaguuaaccuacuccaugcuaagaguuagccuucuggcuucagagagacaaaagacauuacuacuaauggcagugcaggugaccggcuugcucuggcucccaggugaugauacccaagggcucagucagauaauauacacuagugggguuuguguaagacccaaggggccccaagcuugagucaccuccugucuuaugaggcagcgacugggaaucacccaggcuuuuugcuacagggaaucauuaguuucauuaucagggucaggaaaugaucuggccuuguuccuguguucugaggguguuuucuacauagauaucccugggagggacauuuagagcaguggccagugcagugaagugacuccguuaguucagugacccauuucugucuguccuccucucaaacugggguggaaaaggucagcugaggacagucugcuagagggcaguaaauacucaggguuagcgcaggccuguuauggcagucuaagacaaggcugggcaguggucguaucuaccaccagggggagcugcugccugcauauggcuaccaagcacccagguugaugcaagucugaaguaagccauaggcuaaaguacacacugguauuugaagacaaacuauauaacuguagaugacuauauaguaaauuucucaguaauauuuucccauuuuacuaucugauaaguguauucuagauagacuggauuaaguuacauuuuaaacuaaguuuucccauuuguuguaguuuccagugugacuauuagaaacuuuagaauugcauauuugaauuacauuguaauccuguuggaaaguuacuccaagaccagaguauauagaauguaauucugccuucuugcuguguggcccuggacaaauguuugucaccugugucuuccuuucuucuucuucuaaauauguugacugauaguguguacugcagcggucaagggauugaggaauggggaaugggaaacacgcgcagaggcgccagugugugcagaaggaaccgacacguguuaccgucggugucguuaacaugccaggggcuuuggaacuuacaacuggagggugaggcgacagugcugacuuacauuguggaauugcuaaaaauccgaaaacucauuuuuaguggacguuucauaaucgugugguuuuaacagaaaauuuaaaacaguguaaggauguuuuagaaaaaucuucuacccaggugacagauuugucaccuacuauuuuaucuuauaauugucagcaaagcaaaaguggcaaaaugacucauuucuguguguuuacuuuuugucuagauuuuaugugguuuuguguauucuuuaaaacauuuucauggucauuuuugucucuguguauauauauuuauauauguuaaauguugcgugugcacauguaugugcauuguguguauauguguguugugugcacaugugugugcaauguguguauacacaugccaaggauauuugccucugucagucuucugucacucgggucccaggaaucaaacgcaggucuucaguugggcagcaggcaggcacucuuacccacugagccaucucuugcuggcccucuuugcuuaugcaucuaacgauauugauaauugucgaauuuaguaacauuuucucuauauguaguuguuagucuuuccaucuuugagguuaucuaagcacaauguauagggagccauguucuuaugacuauuaccugcuccucaaaaauauuaaggauaaugguuaggauguaaguagcuauauucaaaguuaaagaugauuguauggaagaauuuaauccgauacgaugacuaccuacacacauggggauauucggauuugugucuguuacugaauuuguuuuauuuuucacaaucuuaugcuuuucuacauuuuuauauuuugcauauuugaccagcaaauuucauaucaauauuauauaaaauuauaauuuaaaagcuugauguuacaaguaaguugauuuuuuuuuccacugugaaauuauguucucagauaaaaauggcuuaauuuguuuacaaaguuuuaguagaucaucaagccauuauuauggggaacauugcucaccucugcuuugugguuuuauauagaaaauuauuauguuggaaauagccaccagcuugggaauguagggacuuuacacagccgugacuuagaacacuuguaccagcuguacagagaaggaagcagggacuuggguuaaauggcuuccugcaaaucaacagaggcagagggcgacuuagcuggguacagcgugugcuuugccaaucugcugugugccucuguguuucagcuuguucauucuucacuaauaggaaucugggaacagacacuuuucauucauucuuaccgccuguuucuucuaaaauccaccaacacuguuagauuaaagcacucaccuguauuuuaauguguguuguguguguaagacacggugcugggaguaggucaccccccacgggaauugaugccaguccuucugaguguggucagagcucaggaaaagcuuauggaagagcaguggguacccagugaggauuccauggagcagaaacguuugaggaggaugggacauauggcucaguggggaaaagugcuucccaugcugccugggacccuaaguucaaaugcccagagccuguguaaaagcagguugcauugcuucugcaucuguaaucccaguauucuuaaaggaagaugggagccgccaggagaaucuguggauggucauggucgucuagccuggcauacacggcagaaaacagcuaagggccuuuguucuccaacagggugaagauggugauuccugagguuguucucugaccccuccaucacacacagacacacacacacagacacacacagacacacacacacacacacacacacagacacacacacacacacagacacacacacucacacacacacacucauauacagaagaaacauuugagcugguccuugaaccguggcaggauuuugguaggaaaaaacccugccagguggccagacagagugagcaaaggcccagacuuagcucugccuuacggccacguuaacagagguugcugaggaggcugugguauuggguuaggauucuuccuguucuguccuuagaucccucauuccaaaugaauauugacugacucuccacaguaaagaaacccccagcuguccuuuucaccuuccaaguuuguauucauuaugugcuuguuaugggcccacacaggacacaaaccugaaaguauauuguaguagcuuugaccuguuggaguaaauuaccacacagcuuaaaucaacaaaaauuauccucucacaggucuggcuuuggacauggaaaucuacacuuugucuggggcuucuggcucugagcacacuuccuggugauuggcagccuuaggcuacagccacaucacugcagucucucuccagcuucccgguuucucuucugggcuuucauugcugcucuuacaucccugugaauucccuugccucucuagaaggcugcugugauucauuugggcuagucuguuaauagaaggcuggcugucccuguauugcucuaucuccuuuuccuaauaagguaauauuuacaaagucuggggaucaggaccugaugcguuuggguaacuaugucagaaaucacacaaagugacuugaacacacugucuugcuugcugucucauccucagcagucuagcuaccagcagggaagccauugguagggagugugugcauguucgugugugcacgugaaugugcaugugcaugcaugcaugcauguguguguguguguggugugugugugugugguguguguguguguguguguguguguguguguguguguguguguguugcucuuugcuggaaagugaggcagagcagcccaccaacagacuacaguaggaggagagcuaugauuuuucuacgugugagagaacagaugguggcggccagccgaggagagagucaaccagcucagccuugauggagcagggagguuuucuucacgggaagguggagucacuuccgcuggguucagaugcugcucacacucuacacagagagaguuugauaaauacauucggcggaguauuuguacacaguagaguaaaagcggcuguaggcugcgcaggacuucuggaaagcaauuguguagccuuuauauuagugcugcuguuuggcuuuucauguaacuaguuugaaaacaguggcucucaaccuuccuagugcugcgacucuaacacaguuccuuguguuguggugacccccauccauacaauuauuuuuauugcuacuugauauuguaauuucuacuguuaugaauuauaauauaaauaccuguguuuucaaugaucucaggcaacccccaaggggguugugcccuacagguugggagccauuguuuuaaaaggaucauuucuuauagucaggcauagagagaguguguggaaaaaccuaggagcagcuucugggucccaacaggaacauuuccucucugcuuagaugggacuguuuucaggagcgggccaguacauucacauguagcuuauguggaggcuguuguccccguauuugcuugauguuugaacuugacaccgcugguagcuuucuaacccugccaagaggggucccacaguggguccacagauguuuugagugccuuuuguugaaaauaauaauaauuuggggaagggucucuggauagcguagacagcauauuuuaacuccauacaaagagcuuuuguuaugcugcugacaccgacugcgucacacuuauucauuagcauccaaaacuuaccugaaaauaacuuuauagacucuuaacacugcagaaaaugggcaggcagaauauggcauugaggcuggaaaccauaaucuaguuaguuuuaaaauaagccuguuuuacucuagugguggugacugcucuugucgagugagacaaauucucaucgcugcuuuuacaucugacucacauggcgugaauguguguggaggguuuacugugucuucucuguguggccaccauggcuggcuguacagccgcuucccuggacugggucccagugugcuggcugcugcuuugugcuaugcucagcagggggcgcugucccugacuucccaggcuuguuaggcuuugagagacuuggaaguguugagucuacagcauucaagaagcccaaguccucuuuccugaaaggagaacagagcccccuuacauaaagcuucugcggcucuuccugucgguuuguucguccugucuuuucaucccaauaauaaugucauguuuacagcugccauuuaaaaaaaauuccagcuugaguuucucagccguuccccuuucacagugauguccaguaugagagaugugggcuuagaggcgggaauacugggcuuacacucccaucuccaaggacugaagugaagccaggagucagagcauacacaaagccuuacucuguggcagcagucaggggucauuuucuaguagguuuucugacuuagcguuucuuguccuuugccaacgcuuaucccaugacaacugggauagccauagaacguucugugcucaagaauuucgacccaccaugugcaacagcuuacaguagauuuuauucugugugcuauuguucauuugucauaacuuacucuucaagauauugucaggagguuuuugaauuaguguaaaaacauaaauacuauguguacgcacccaaaauauaggaaaacuagaaauagugucugaaacuagggaucaagugccaugucagaaugccacauuuugcucugacagucauggugguaaaggccaagggcagauuaagcaccacacacauacaaacacacacacacacacaaaugcacacacacaccacgcauauacaccauacauacacacauacaaacaucacacauacauaccaugcacaacacacacacacugcauacacacauauauacuacacacacacaccauacacaccacauacauauaccacacacacauauacacacacacacaccacauacacaccauagaugugcaauauauacacaucuuuaggugauaaaugacacaucuauauaaaagcaucuuauuucagcauuuagaacguugaaggggucagcuacagauuuuauccuguacuuucuaaagccaaauggauuugccauugaaguuagugaggaugcacacgugcagccuuuggaacagaaggcucacugcguauaacuuguggauaauuucuuaauucuguacaugagcauuuuacgucugagcaguccucacccacaucacucagcacgggcaacacugagguaguguguucaguggagaggccguugccauuaaaacgagcugugugguucggugccuuccagauuucugaaauacgaaguguaaggaacucccaucuggaaaaugacuucauacccacucauaaaagaagaaagcuuauuuuucaugcauguuaacauaaaauuaaaauuuauauugguaacagucaaacguuuagucuuagaguucuagugccauauuuucuuauguuccuagucgcuguuuuuucaugaaauauugaaauuagaaaguggcucuggucuuccugccuuacagaaggcacagugcuguguggacaccugucuuuuuuuuuuaagauuuauuuauuguauaugaauacacuguagcugucuuuagacacaccagaaaagggcaucagaucucaucacagaugguugugagccaccaugugguugcugagaaucgaacucaggaccucuggaagagcagucagugcucuuaacugcuuagccaucucuccagcccuguggacaccaucuuuacugucauugccuagaguggaaucaguacaguuacaaugagcccuucugagcaugcucagaagccaguuucuguaggggcuuggcaaagagauauacacuaguggccugucccaucccgggggcuaaguaggcaagugugguuguccuuccugugcugagagacaugucucccuuggcaucagaaaugaaggcuaugguguaccguccuccaggcuuugauggcagagcagaagguucugugguuuuuaugucccucucuccacccuuuauuugacaggagcaucugauugagaacgaagugucaauccugcgccgagugaagcaccccaacaucaucauguugguugaagagauggaaacagcaacugaccucuuucuagugauggaacuggucaaaguaaggaugggcgggcucacugguguccaaggucaaaguaaggaugggcgggcucaauggugucuaaggucaaaguaaggaugggcgggcucacugguguccaaggucaaaguaaggaugggugggcucacugguguccaaggucaaaguaaggaugggcgggcucacugguguccaaggucaaaguaaggaugggugggcucacuggugucaaaucucagagcaugcaacaauucugaggaaccuugccagaaaaggauccuacagccucuuaaccuuugcuacucaaacacaucaguuucuuuaucuucugcaaacugaugugacacccuucuuauuucagaggaccgaacuguagacauuucgaugcaucucuuuccuuauccuguaggguggagaucucuuugaugcgauuaccucuucaaccaaguacacugagagagauggaagcgccaugguguacaaccuagccaaugcccuccgguaccugcacagccucagcaucguccacagggacaucaagccugagaaucugcugguguguuagcaaucucugcuguucuuuuaaaugauugcagugcuauggagacaucacagcacagaauaacaggguacaaaccaauaccacagugguaaacagagagcacacgaaagggacuugagaaaagccagcaaguucaaguugguugggguguuuugcaugcacacauaaaacccuaaugggcaucuugaaucagugcauacguuauuuucuggacauuagaaaguacauuuucauuugucuuugauuauguuauucagcuucauguucugauaaugggacaccugccauaauuaauguguaaaaggggaaaggggguuuggauuugggcucaaaguucagagguuccagucuaauaggggugcaccuauugguucagggacuggcugacugcaguucugaagagcaugagguaaggccagcugccuacuuugugauccaggaagcagagaaagggaagaagggagacucggggaccuuugaggguguguaaugauguaagguaccccgcacaaagcucuuccugauaacgguccaccaccucccaacaucgccacccugggugucaagccucgcacacagaggugucuggggcccuuggccaucuacccuuacggcagcgauauucacugaagaacgaaacuguauggugcauaacuuccaacaauaaguuagggacaaguaguugcccaggggugggagaagcaaaccagaugaguucgugugcaaacagacuuuggagguggucucuguuccucuaagcuuuguagauagggacauugaagacacgcuugaaaguguuguguuuucuguucuacagaaugaaaaguaguuucuacugugaggcucgguggcccagguucguggguccuggucuguuuuaccagccuucugaccuuguguuaccccuuugucuucugacucauggccauuaccuuuaacccagacuuaacauccguuccugugauaacgaaagcuuaguugcuggggaggaguucuugagauuccaccaucaggaacuggggaagcugccugggagcuuugcauguacacucucuuccacaugcgauauagcugccuucucuagaucugugugccgcuccacugucuuaacgccaucuggucucuccauccuccgcagucaagcuucaccaacagugucacgccuccauuucuucugucugucuuugucgguacucguaauauccuuucccaguguggcuaaccucuucaucacugagcacaguuaugccuuuaauauuaccccagaaucucugaacagacugcagucauggucucuucugguuucuguagcauuugucacaagguugugauuuuauguucucugaucugccuccuccuucagauuguaagugccauagacuguaggucuuauguccuccuguuuucaugacugugcuaagcaggagcuucguggagugaggagugaucccuggugguggcucucgucgccacucagccagccagcagcugaauaaagacauuauagccagccucaaguacuacacagaugaguguuaaaaggaauguguggagaccaucccagugacuuuucuucuuuuuaaaaauguauuuguuuuugcuaaccccaaguauccauuuaccauuugcuaaugcuauuuguucaugauuuguuuuguuuggaagcuaaguagcucuccuccccuccccucuucucuuccccuccccucuccucuuccccuccccucccucaguccccuccccuccccucucucuguccaguccccuccccuccucuccccuccccucucccuuccuuucucuuuccuccccucccuccucaccucuccccucucuccccaccuuccccuccuuuccccuuugcuuuucccuuccuucucuuucuuccacucccuuacccuccuuccccucccuuccccgucccuccccucccuuccccucccugcucucuuuguagaaaacaguuucuuucccacccuucaucuucccauguuguuuaagcuucugcaguagaauggcuaaggcaucaugguggugguucucccuacucuacccugggcagugggaguugcaagcagccgucuguagugccuguucagccucugacuagcuaccuuaggcugagcagcaguaaacucaggguuagcacuguccauuugcccugacauccuuccuuggucauacccuucucagcaguagccgccugcucacccuuuucaggcuuuucaggaugacugugguagcagaggucaggcaugucccgcucuguuccaccucuugggagguagaaccacucuuguagaccccacacacagugagcuccucuguuguauggauggcaguguuugcacagcaagggcaucuguuaaaaaaaaaccauggcaggaagaagccgacauaagaugcuucuaagaggaguugguggucagcucugggucuaacaauaucaggagacaugacucccggaagcugcccccaucugguuagugaaggccgcaggcacgauguagcuaccauggagaugcucugugacagcaggaaacuccagcauagccugugaguucauuguccuggaggagauaacgcuaugucaacagggcuucucuugacugggcugccagcaggagcucgaagguucucuucaguuuaugacaugugccgucagauccccucuguugccaugcuguucaucugcaagucaggauugcugccaucuccauagaaucgugcugcaaggaauuuaaggacauguuccuccuuccuuugcaggacacugagggcucuagacauccuguaaacauuuuccuuuacaagagaacagugccauacagacccugccuggguaccacagaaaggcaggauucuuuucuuacugucuucuacccugagagauuuacacagguuuagcauccauaaaacccuuaucugaaauucagacacauccaaaaacguacguugagaguuaggcauggugacacaugucuguaauauaguaaguuugugccagccuggguuaccaagugagauccugucuagaaaaacaaaagagauguuuugugugccagcauuucuccaaguggaaaaauucauaccauguaaugucauuucauacacaaaauaauuuaaaaugcugccugaaguuaucuucaggcuauggguuuaaagcauauguggaacacaaaugaauuuuguaguugauauugaagauacuucauuugcuguagucggaaauguuucuuaucauuaucauugagaucgugacucaguguguucucaagacuggcacugaguucuagagauuauccuagcuucuugagagccuaggacuguagauguguguaugacuguaccugguuuuagacauuuuugucaguuuauggugcuaaggcuguggggucaggcuccagaaaugacccuagcaguguacacauuucucagcagcacauguggcagcuacgaaagccucuuguaucucucuagauuuagucagcagauuggcauugcacugaagagacagccacugaggcacuaacaguggacaccccacacgacucuuguucucuuccugucugggaacuaaugcaguuuuuaggcagcagggcaucugacaucugauuugcauucccuugccugguaucauaacuuaaaacccugccaaagcagauguaugggucgcuguguuggggagcacggagguggccguuaaugcuaugaguuacagcucggcggugcccugucauaguuaaguauggagacuagugauaaauucaguguuuccaggaguucggggacagaggagagaagagguugaguuucucgugguugauguccuucuaaaucauuacgcuggcguuuuauuuagcgagcaugagggguucccuuuggcugugggaccugcguucccugcacuugucagccuugcaucccgccagcugcuugacagagcaucucucagugugaggugggccauuugaacaucgcggggcuggcguuuucacaguuguugaaauucauucagagucuucaugugaggcugcugggguuuuggcuuuguuuagcugcagaacccauugcagggugguucaaugggaggacgagggguccuggcugccaagcuggcuugguucugugacccucgauuuccuugccugcaaaugcagguagcauuucuugcuugagagaauauguaaacuugagaaguuccuguggcucucaguaacugucagggagccucgggagcgguauucuucugucccucucugggccucauuucccuguccucauugccaggcccugugcagggugagcagucucuaccgcucaucugcccagcuucacagcuccauagagcacagcgauguuuaaucuucuuuguagauuugacuagaauccccagcuaggauuuaaagguuauuaauacauugcauauuuucuucucuauugggaggagaugaaucagcaaaagcacuauuauuuccuacuccaucuaagccauacucucgugguuagccaaggagucccaaccagucagcaagcacaggcugcccacucccugucuguacuccugcgucugacugaguucuauaggggauguagaaacguggcuucggagacugacagcggcuucuuggcaccccacacaucucuaaauggagcacagcuuuauaaaaacaguaccuaaugacuuguaaauaugaaauagcagcgacauuacugagacauugacucgugauacagacauuuaggaaauugugcuuauaaaugcucugaucacuacagaaacuuagaauuuuguccuaauguuuggguuucaguaaaugcaccauaaauccuaauuguaauuauccuagauugcucucacuaauguuuacauuaaacacuauggauggcaagcuguccuauguggcauaacuaagaaucuugauucuguugcuucaagcuagagcauuuguauauuugcauguuucugcuguguugugggguucacacagagugauacauaccuuagagggguucagaguccccaccacuaccccuaugacucucuaaagucaugaaggcgugcaugagccguguguaugcuauguguaaauauggaggauacugugaugucccaaagaaagaaguguucuguagcagagaagcagaaaaagguagugagccauccaucauugguccuucucaaggcccauaaagcuuggcucaugucacagggagccucagggucucugggcucucugucaaugacugccuaagucccuucccucgguggcugaugccagucacugcuuauguugagaaaacaucguuuucuaaauauuucccuucuaaagucugaaguaguugaaaugcaaguccagcucaauaguaaaacacaagaagaaacaggcuguguuuaaaauacagaaugagaguuucgaguauugauuuggucugugaagcuauuuuucucugaaguuuggugcguucaaauggacucacaagagaaucuacuuuggcaaguuuguuuaucacacagccaauccccaguuagcugucugugugcucaauggcuuccaaaacugucuacguguuguguuauuuccuggcucuucucucuuaaggaaaguuugcuuggauauaaggcagaguguucuuaauuauguggucauuguaagcacauggguaugucugcacguaugagcuguagggaggacgugaaagcagcucucagugcugugccugagggcuuguuaagccuagggcauuguaauucacauaaaauuuuaccuuugcaaagcacaguugaauagaagccucugagaucucucagcccuuuacaacgaugguucucuuaccagaagaacuuucucuaaacauuuaaaaagucacugugucuuuccugcuuaauuccaaggcuccucucacagcuguuaagggggggggggacccaaagcaacaacagcaacaaaaacugguaauuauuggcuguuuucuguuccaggugugcgaauacccagauggaaccaagucuuugaagcugggagacuuugggcuggcgacggugguugaaggcccguuguacacggucuguggcacgccaacuuauguggcaccagagaucauagcugaaacagggugagagucugccugucucuggucaugcuuugacacggcuaacaaaggcacauagcuguugcuguugcuuuguguccaguauaccugugaaggaagacuggggagcggagauaugugaccuaccccguuggcuugacuugagggaguaguuugcucuuaucuggacugugcuucuguuggggguggggugagaaggcuacgggugugaggugguuggagacggucacugauagcggucagauggggagaaagcacacgccuuuucagaggacagcuccuccuuccgugugguacuaacacaguaccacaguacugcagcagcgggcacaagcucuggcucaccauuacccucucucccucacuuuguuccaguuauggccugaagguggauguuugggcagcuggugugauuacauacauacuucucuguggauucccaccauuccggagguaaccauguuagaauuauaaauucucagacacuuaacuacuggcagaaaggcccuaagccaguaaauaaaauuaccaguuuaaaaucauauaaacacaccuuucucuguuugucuuaauuuacagccuacuggugaaaacuuguacuuuuuccuuugguauuuugauuuuuguuuuugucuuuguuuuuucuucucucucucucucucccucccucacuccuuccuuucuguaugggagcgugaacacaagauucauccauuugugcacacucugccucugagcugucccuagcaugaccauaaaggccuuugcuuugugugugagccugugagcucuuuggccaucauuccaugaaaucaguuccuaggagacccuagacuuugccacuucugagucaucuugaggaaggguggauggaauguaaagguccuaauggagaagccugaaucauucagguggacuuuuugaaguucuugguaucggugacacuuuuacuugauucgagagcagcauuacuugauuuugauaugaaauuucuaaaccacccaacuuuuaucucauaaaccaagaacgcuuuaugguaguuuuaguccuuccuggaacauuuauuaccugagaagugaaguuucagaaaauuuggugucggcuggccuggaaacaaacggcgguugacacuuggcaggucagugcuggccuggcgggaacagcggugaacacagccagccauaggaaugcuugcagccuggccagcccagccaucgacccaggcugauucagccacacugacugcagcucuucuucuggucuguuucaucucgugugcugcggccagcgacuaacuuggaaacuguagugcaucugcucgugcauggcuacuuuucugccguuuaucuccacugccuccuccucucuguuuggugagcagugagcugggugugccagguacuguuccgagugauggccaugguucacaagcaccuuagagcugugcuuuuaguccagcucagcugcuguaaggaacuaacacagacuguguggcucauuaggacuggaaacuuauucucacagugauggaggcuggagauuuaagaccagagcagcagcaggcuuggugucuggugagggccuacuuccuggucgcuucucagccaucuuugugaagucacacagcagaaagggaagggcaaccucuaggaacuucugaguaucuugucuuccuuuuuaaaaugauguuggggguugcaccccaggccuccugcuaggcagcacucugccacugaccucuguccucucuagggauuuuccucgaagacacuacagcugaauuuaugaaggcucugcucucauaacucuggcucucucccaaaagcccaccucaugaugccuuccaagugagaauuagguuucaccagaaggaguuuggaggaguacguagucguguuuaauguuguauugggucagugaaugaagaauagcuuaucuuuucucuccaaacauuuguuacgaaaacuuccuggaaaaaguuagaaaguugaauuuuuauuuuuuaauucucauauuuucaguuugaguucaacagugggucuuuuuuuguuuguuuguuuguuuuuauugauuauugaucaucgcugugcacagaaugacacagaaauguuagucuguuuuugaagagcuuaugguauacagacaugaagcacaggaauaaugaccagaaacaacugguuguguaugugugauuggcuagcucagagauggauaagcauagauuaaaugugaaggaagugacuaaaggacuccauggugcaaggcagaagggaaggaggagagguggguaaucuguguucucguuuuacagugaccugggcccugggcugguuugggugaugguuuguuuuuuuuugggggggggggguuagucaaauguagaagggcaauguguuugcugacagaugauaacgggaccaauuaacauggaguucuuucuggcuuacccaaggggagaugaagaaaaaggaguuaagggucagcauuaggggaugugugcucacuacucccucuagugucuguggucucuggugcagccaggaagagcagcgguuuugcuguuauccaggugagggucaaguuggaggucacccagggcagcaucggcaucaugagauggggaggugacuugggcugacgagagcagcccacagcauucucagggggcugccuaacgucagggauucccuggcugccccacuuuuacauuucaagagcauguuuucccucuucgcuccugaggucaucugugacgcuaaacaagacgccgccucuucgcagcgcagacacacacaucaggcacaucucacaacugcuauacuaugacugcuaacgguaaagcagaugcaggagauuaaggaugugauguguaaaugauucgugccuagaguggauggcauaauugugacucuggggcuggggagggagcucacuugguuccaucuccauaaagcccagcauggcagagcacgugccuauaaucccagcaccuaggacauggaaucagggaaguuaggaacuucaaggcuguccuuggcuguguagcaaguuugaagucacgcugggcuacaugagacccuguuucaacaaaauaaaagcaaccauauauauauauuauacauaauacauauuaaaguccuuuaaacaagugcuucaaguggaagcuucugaacggaaauugugaucaggaauuuacugcuccccucugucuaauggcugcugccuucucucagcgccuuuggguuuuagcucuagcuugcuuuccuucuguuuguuuguuuguucuucuuacuccuugagcucacuugccccuuauccucuucuccucaaccccagagucaucuuuacacuaauugguuuucagagacguccgaaguuuucccaagaacgagcgugcugcagcuacugacuaacgcguuuguaauguugcucugagcuuccugaccguccuuccucagccccgugcccagcucucucugucacacgcucacguaugagggcugugugaaauggcuaacugaccuuaucaggugucacugaaagagaaacuguuuuuucuucaugggcuguuuuacgccuauggcccugucaucuaagggauauauuguuuuagaccuuguauuauaaaugugaugauaaauccauuguggauucaaacagaguagccguuugucccugacuaccagggcagauggacugucugcagggcuguucuuccgcugggugcuuagcucuggacauugacaguguugagcccuggagucucguucuaucuguuuaacacucacggguccuuuuuugcuguauuggacuguuguaaauggaugaagcagauggacuccagcuuuuagaucuguauuggccaagugaucaagucaauauaagcuaccuguaacuccaggaauaaaauggagaugaauggagaaguaggaacacucuugagagucaguuauauauaugucuucuucuaacaccuccugcuauguacgcucucacuuccaaaggcuucuguaaagucccaguguguucuucugcgucauucucacucccugggaaggagcacugggcugaucacagcagugcaaaggagagaaaccaucgugcuucccuacagacaguugugugagcccacuuuccaggaguacacuggugaccucucaccaugcuggcuuuucucaccuggcccuugcuccucauuauaccuuuggccaucaguggggccaaagcagaagucucacaaaugcuucccuugagcauagcaggcagccaugucaucagagaguccuagcaauugucccuaagucaccuuugagaaggugggaaucagaacccaaaaggcuugguggaaaaaaucuaagaaguuugcagucuccccagguaacugcuggcuuguacuccuggauuuuaauucugaguuuucuguuguggccugugguggaccaggaaagcuaagcauguuuccuguuugcauuccuguguuccccacacaugggaacagcccacauccagucuuucccuucccuguuuucauaguuccaccaaaugucgagagccacggauccauuagacaccacauguguguuuggggaaagaccaagcagcucagguuggcagacgcccgcccaagagcauccaggaugcuuugccuugacugagaaaaccuagcuggcgucuguggaauauucacuuucugagacugagcacaaaggaacauugaguugugguggggaggcaauuaugucaugguuuuuauaaaucuagguucugaacucaguaugauuuucagugaaaauguggaggguuauguagaaaccuuccuaugaaggaaaaaaaauaaagguugcguagaugcugcuguucuacauaggcaugaguuauggugaaacugccgaccucccccugaggguuucauugucuguaauuucugguuuugcuugugauauaaauacauacauauuuauauagggagagcuaaauauauauuauauauguauacauauauaucacacauacauauauacgaauacacacauguguauacauauacacauauauaugugugcauauguauguguguauacaugcauguauauguguguguguguguguguguguguguguguaauacauaucuauaucuauauuuuuuuucucccugagauggacucuggccguauuugcuuugucuugcgcuugccuuagcucuccaaguaucuaguucuggagggacacgccacgcccccuggcuuucaugcuaaccauuuauacacuuguuuucugaggcauuaaguauacacucuuucauaccauccacuacuggaacuuuuccaacucccaacuaaacugaaacucucccugagucauuuucugucucugguucccaggccuaggaaauguccuuuggcucauugucuagaaggaaaauccugcugucaccaugcaccuaugacacacagcugagcagugacaugcccaagccagagccucuaugccuuccugcuacucagacacuuuguuugugacucuguucuuccguuuccuugucaccagugagaacaaucuccaggaagaucucuuugaccagaucuuggcuggaaagcuggaauucccagcccccuacugggacaacauuacagacucugccaagguacuguguagggcucuuccuguauacacuguaggguccuugcauguggggcuauagcagcccacagcuuggggcuccugagacuugacuucuaauauguggccuuucuguaaguuuguauaguguacuauaguguagucuccggaguccucaacuagacuuugaaaccuagauggcaauuccccuccuccacugcugugcuaaucacugcaaacauagugaugaaaauggaaaaugccacaaugucccguggagugaggucagagauccgcaggucuuaggagacagucugggaucccugacaggagggagacaccgcugucccaggcacugugcugacacaggcagugaaucugccugucucauaagcccugaucaugugggugguuggcuucaugccccaguggcugagcugcuauguuggcuuuugaguucuguauuuaugcuggaaucacccucuuucuccuccucuguggucuaccaccccuuccuucccuccccuuucuccccuuuguaggaguuaaucagucaaaugcuucagguaaacguugaagcucgcuguacugcgggagaaauucugagucaccccugggugucaguaaguacccacauucccagggaacgagugagucuguguuguguggucagcagcaugcuuccuugcuauguguuuugcacagaugcaguuguacauucaaauucuauggcagguagacugucucuccuaaugaccaaauaucaugggagaagauggcugauaccggagucccucgucugcuucgccugucccuuguuggaccucaguuuacucaucuacgaaguaggguuggccaagaugcucuuuaaggacccauuccaugacuucguucuaguuuugggguuuguguuuuccucagagaugaauguguuuuagacugugaccucuguguccacauggcgugcagucccauggacuggaaggagagacagucuccuccagagguaucgaagagguugguagugaccacauguucccucugggcagaagugaacuagaaggcaaguccugaacacuggguuaauuagccacauggcuguacugcuguacccuuccacucuucacacuguuucccugggcuaagacacaagucggggagacagcacaucucuuugugagcaguaaggcuaucaguugagugacugauguccuggagauggagcucgagccuucagcauacagcauguucuccugccaguuuuguuuuguuuuaauuaagaaauggggucaaacauuaggcgcaagccauguucccuccucagccugucccguaaccagagagcuacagcaagguggcacagcacacaugaauucuucaugcaaacgauaaacucuugguuuuuguguuucugugggauggcuuguauuguauaugccuugggagagggccugagaaccccacacagugccguccggaggcgugucugccugaaggcauggugcugcagaccaugcugaggauggaacucagggucucaugccugcugguccagugcucuuuccuggcgcuauacaguggcagcaguuaguuuugaaagaacuaaacuuguguucuucuggcuaagaugagccuguuugggacgacaucauuagguggaugguggggguaacuuaaugagcaguugaagcugaggauccgaaaucacuguguuugguucuguuccguaggaugaugcaucccaggagaacaauaugcaagccgagguuacagguaaacuaaaacagcacuuuaauaaugcgcuccccaaacagaacagcaccaccaccggggucuccguuaucaugguaagugggacacagagcucugccucggagagccggggcuggccgagcuggaguugcugucuagauagccaggguucugcucauggaagcuggugucuuccauguuccugucuccauggaggauugccuggcauguagagggugcuuucagcucuguucccuagacucugcauggcagcuaggggcugggaggagacagagcagcagugacagggagcucuggcugggccuugccucaccugucauagcugcugcuaccucuagggauagauugcagccccauagcaugggcacuguaaggaaauaaggcccagccucugguugaggugugaguucuuuuaaacuuggaauaggaaacagccaaguuaacaaauuucacuuuuuaaagacugcuugguaaaaauaaaaauaguugguguguuuuuaaauccauagaaguauuuuuuuaaaucagauuuucaugguuagaguuuuauuuuaaaaguaacaaugaucccauuuuuguacuucucccaaaaugcuuaaggccaugaaucuaaauauuuaaacacaagagacaaaaguaacauuaaggagagccagaagaaagaguacaggacaggaaaauaaacccaagugaggucaguggugccugagucccucugagcaucucccaccugcucaagucagccaagguacaaaccagccaaggucuccaacagcggugccucuguccuccucaccaccacagcagacagacagccgacacagggccaggggcguggauaucgggaacuugccucuccgaggggcagguaccugaaauaggccgucccugcagcucugucauuugcuucuagagcagccucuugccccaugggagagguucuccguauuccuccuacauacagggauauaggcuuauucucacugcacaguguagucuaaggaugccaggaaaccgugggaguccaggaagccacaaugcacacacccacuauggacacaaguauucugcuguugguuaagcaccuguggcauuccuggucccugcuuucugugauguauucccuuccuccaagggucuuaguucauuugguagacucccucccacuguccucgagacuccugugcucccugcagggaucugugugcuccguuuccuccccauacgacuugaguccacaaacugggcuuugcgcugcccuguaggacucuggagugcuccuugaugaacacaggaaggcuggagguguggcuuuuccugccacuguagugauguuuuacugaauacuggagaaaggcagagaugucacagauauggagcccacagcagggggacauuucuagaacccaaggauucucuuuugagacccagccugugagcagaagcaggguggaucugcgccaugcauggugugguagggagcgucuguggaaguggaagagaaaaccauuaagagucagcauuuguguuggggugcagcucagcggcugugcguguaccccaauaucccccaaaguauauauucagcaucugguacagccuugaagagaauuuguuggagucagaauuuccuaucaucuguuaauuagcuugcuaaucuucuaagauuuguuaguuuugcagcccuggaauuaaaggccauuaggccuguucucugccuccugacccuaaagcucagcugagggucuagaaugauugacaguccucccuugagccggcauaagcgguguaagcugcgcuguggauaacaaugcagagaaccucucaccacuuacaaauagcgguuucccccuugcuaauggaguuagucagaugucagacccuugaguuuuaacagaguguuccugagacugaacaaaccuuaagaaggugacuguauaaaaauuguguguugauguauaugcaggagcuauuuggcacauguuggugacauccagcuaaccacauucucugccuaagccuggagacugagcacagggaacugccugccaauggucucacugcauucagaaucuacuggacagauuccugggacuuguuuccggccggccgucucuguucucagugguucaaaagccagccugccaaauuuugacuuggccccaaaagcagcagaaggcuucuugcuuguccuuccccaagccaguucugggccuauguauggcugcuggguagaaccugugacauacuucggggccccgugucauguauaucaugacuguauaacugagagcaguuuuaaauuguuuuuaugcauaaaguaacuacaaaaugccugucucuggcaugaguuagucauuacugaguauacgggcucaguagcagaggaguagauguguuuguagcucaaugguuaguggucucugcauaauuuacagaugagguccucucugucuccugucaccucagaacucuccccaaguagguaccuggggcuccagugaguaguaugcuaggguagggcugacucaggggaaagacaccgaagugacacuguugucugcauuucguuugacaguuugauuugacaguuugagcgacacuucagaguuucguucuuugcccaguugagacuaugggaaacccugaagcagacccugguauucaacacccugugcucaugagagccgcaccuaacuuucagccccucuuccagcugcaugcuugucucaggcuccggcccucagcuuccugcugguagggguccucugaacccacugaccuccuccuggccagcccagcccagcgcgccuuuggggagcuuugugauagacuaagcuugucaagucugguuuccugcucaggagcaggggccaauaguucugugcccuguuccuguuuacauaggugaagggcaucuuucugcaaaugacagcaggggaugagugucuccgugagguuuuagugcuuuguccagagcugcauuucuaucagccagccuccaugaugagaacauggucauaucagaaagaguuucagaggccgauggcuccggguugcacuuuagcgcugucccugacauugcuuagugugcugaugaaggacaguguauuccaggaggugguuucuuugucccagugagggacgaagggaaaaaaaaaagccucagagaccagaaggggccaucuuguggcagagaagggaaugacaagacaucuccuuccauggucuuacaagagggagaaauguuagucaaaggauaccagaggcucuguuuacuuugguggggugggggugggacucagggguucuuuccuuauuuaagacagacaagacuguuaaucgugucgcuucuguugaaaguaagucuaguuucugucccugcuucucuccccuccugccucucccgcugcugcauugcuuccccugacuagguccaaggccaugguacguacuaacugcaccgcgagcuucucucugccacgcaugcucauguucucucggccagaagagaagaggggaaauaaucagggccgcgugguccucaucuaccggggaaaguccgggauaggaacacguguuugcuguaucuccuguggguguugcugggguggagugguccggacugguaccagcagcucaagaggcaagccucagaccaggcuuugcccacuuagcccguuagccggcacuguccucggaagguuaccacugccgggagcuauggggagcacggcccggaggccacuggcagucgagucggccuugggaagacuugccagguguuuucucuauccuuaaguuuguuuguuaacguguacuggaaguuccucggccaacaggaguuaggcugcaaaaugccuccugguccuuucaucguauagcugaagugguacccaagaccugcaguccccgcgccuguaguguaaaauggcaguugcuggcuccuagggcacacaagccccagugagacaaagaagacuccaugccuggguauccccaggaugggucagaaggcaaguucacccaugaggagguaagcagaugaguaagaccaggaagacagcagagugcaggcuucccucauagggaggggggccaggcaaggacgccauggaggauccacaaggcugcuaccaccccaguggauuccugggcauauuccacaugcccuugggugugagggcauuccuuauuuaugacacaugagauuuauaccccggugacaguaacuuucucuagauaagaguaguagcuuagcuaguguagcuggcugagacuggugaucaccagcacgccuggguauggguauaagcaagacacucggaauucaggugcagcucacaguggggaccuucucgggucaccuuguguaggccagcuggcuugauucucgagcgcugugacccaucacucccuaccccuagcucccagcacaggcuguggugagggcugaggcaaagggcagcugcugggacgggagcagguggggggcucugucucccuuaggcuucuacuagaagccuggccuauuucuccucuucuguuucugcguccugugcaugcccugucuugcuuucugguccuggcugugugauggagcccggccuggguaaugugugaucucugcugcucucucucucucucucuccccagaacacggcucuagauaaagaggggcagauuuucugcagcaagcucugucaagacagcagcagaccauccagggagcagaccucgccagucccucccucagcccaggaggccccucccccacuggagucucccaggcccccugguccuccagccaccucuggcugugaucuggcagggaccuggcgccgccaccgagacugaacccuguguacacaggccaaagccgcucaccgugccaggcaggccgcucuucagcgggccucaucaacuccuugcugaaagagccucucucuccuggcugcugcuuugacaguuuguuggcauguucugucacugccugagaacagaacuggggcauccuggagcccgugugcagcauggccucaugcacuuugggcucugcccucucuaguuccuggccaugucaagcaagccaugucaguuguggagacauauuuggagugacucauuuuaaaucaucuguguuuuuaguucaguagacacuuggccgcuuuccccagagaaugugcaacuuuuaucuggaauuacaucguuuuuacagaaaugcauuggacgaauuaggauucuccuuauugaaggacacuccaagugcucccuucucaggacacagcuaugguuccuuuguucugugagaggcaacauggccucuucgucuucauagggcgcugaggcaccuggcuucugacuaggagugucauucugacuugagagggucauuugccuccugacuuugggaagugcauucugaagccccaggaagcagaucccgaccauccguccguccgucuguccgcugggcuggggugcugggcucgcagaccuagcugacucacccuugguuucccgacucuccuuguguguguuuuaggaaaugcuuaugaagcuggcccgugggcuucccagugggacgugcagcaguucuuggcagagcagggccagcucugcugugucaucuccagggucucccaucaccucugcucuuugccauggcaggucugcugagaccccgcggggacgggggcauggugcucccugauuggccugugaccaaccuucuggaaggcugcuggcaguuuucccuguuuuccaccaccccacucuuuuuaauaauuguauauaacuguacuuguucuacuugcuugucuuuaaaacaggggcccccacaguucacucucacuguuagauuuugccuuuuccagguauccccaaccugcaauaaacucuucccucuucagaaaaucca

SEQ ID NO: 1477 - RNA, 2110 nt, Mus musculus
cuucuccugggugccuucagaacaagauguagaacucucagcuccuccugcgccaugccugccugggugcugcagugcuuuccaccuugaugauaauggacugacccucugaaccuguaagccagccccaauuaaauauuguuuuuuuaggaguugccucggucauggugucucuucacagcaauggaaacccuaacuaagguaccacauaacucuauauucuauuuccccuuccuugugagauucucccuucugcccaguuccuuucuuuguaucuaaccucuacgguuauuguuaagaggcauuuucccaaguucagccaucucaggaauaaguucugucuugcuggcaggaucaaaacugaguucauguucccagaccccggacccaaguccuauccugcuuucucaggugucucauguuugucuguuaaccaguaagggauggaaagaagggagaugcuguuauccuguuuucuaaacuaaggcacacaagucauaaauguacugccuguccucauuugauugacuaugugcagcuugcccacuccuucguuccuuuaccacucuaaauuccaggucagaguccaggaggggacuugacagcaaaagcugauucaaggaccuugaaaucagaugacccgcauaaggcccagucaucaauguuaacuuccuuguuuaaccccuugugucaaaauauuuuugaucaaugcaacagcccaucccuaucccucaugcuuuaaaaaugcuguguuagcuaucaggcacauucacagacaaccaaaaggaacucugcggacaauguugacaaucagacaucuuuacaaccugcucccagagacccugaaagaagacacauccuuacaugcccagaggccugucauuugucuguuugugcaugagccaugguccccgaucaaaagcuguuuucucuuccuccauaccuuccucucuuccuucuguucagaggcagccucuauuccucuuccucuuaguaaacuccccacaugagacuuguggcagggugugauuuuugucagaaccugccgccuguuuccaucaguaagaucuccauuugggaaugagguucagaucccaaacuggccgccucccuugcacacacagaaaauaaagcuuucauuuuaagcuucuguuucugaggagaguuuuccugccuuccaccugaacccaacaguuaaacggauuauggcauaucuagcaacaagguaacagcuacauaaauacauaccauauuuuugggucugguuuaucucuggaugauuuuuuucccucacuccauccauuuaccugcaaauuucacuuuuguuuguuuuuguuuguuuuuaaugagcaggauaauauuccuuuguguaaaugcaccacauuuucauuauucauuuuuccauugacagacaucuaggcuauuucuacucucugucuaucauaaguagagcagccaagacuauggauaaacaagugucucuggaguaggguguggaguccuuuggauacguggccaggagggagugguauagguagaucuugagguuauucccagcuuccugagaaaccaccaguuauuuccacagugcuguacagauuugcacucccaccagcagugaauaaaugauccccuuuauccccaucuuugcuagcaugaacugucuuuuuuguauaaauuuaucuuggccauuaugaauuuaaguugaaauuuccagguaguuuugacuugcauuucuccugauaacuaaggauguugaacaugucuuuauguguuucucaggcauuuauguuuuaucauuugaggacucagaguaucaaauguuaucauuugaguucuguauccaguuuuuuuuuguuguuguuauacagaggccuguaaagcuuccuucaaagccaaccugagaugcaguuaaucguccccuuggcuuuucacaugucucuguggaacaccacagaguacucugagagccagaaggaaagugugugagaugagcgguuucgggaaaucuguucaggcuguggcucugagcccuguaaccucuaaaucuccaggaaaggccugguccucccacuuacacaacccuguccuuuaaauacagcaaacugua

SEQ ID NO: 1478 - RNA, 14754 nt, Mus musculus
ugaagcuccugugcuccugucagcgcggaagagccuuccuucugcagaggguuccagccccgcggccuccgagccacggaggggcaccgguaccuucugggcggaagccgugccgcucacgacaccgcccccucccacccuggcccagaguggaagugacgaaagccgccgcggagucacuuccuucuggguggaugaggaggagcccgagcugccgcggaggagcccgaguggagacggacggcgccggagaggugagacugguggcgucggcggucgcggcccgcgcgggcaggacggaagggacgcggaugagggcggccguggaagccgcugcggaccagcgggagcggcgagccccgccgcaggccgggagggugaccgagcgcccugggggagucgcgaacaccugcagacgcgccugcgggcuccgaggggcuggaugggcacaucgggggccggaggaucgaggagagggugcccggcucgggcgucggccagcgcgagcccacggacaccaggcugaaggguguucuggagcagggaaagggcccugcgauccgacagcgcaggguaggaguuagucccggacagugucccagagccuuggagaaaucggugucucuucaaccccaucaucacggaaaugggagaggaagcucugcccagcccuggugccuuguuacuuguguauauccugugugugccacugucugucuguugccucuuuccuugagccauuugucagcuccuggaucccgaggguugucauggacugaaacuuacuguucuccuuaguguauuugucgucaacgaaaaugcagaacaccuagaggaauucuagguuagaugaaauuuccaagauuaggaauuugucccaccccacccuggggccucugaagcaccugcaguugcuccagaccugcucugguuggugccgggggcuguccacccugcaggguaaugagaguaagucaggucucuccuccuccgucauucccggucaguuucacccucuccuccuauucgcugaaggacugacacaaagcugucugcugcugggaacgggaaauuuauugaggaacuauaaaucugcauggaaugaauucagauccuagcaagaugccuuccuccaccggccaggcgaucugaaguaccuacuuuacccuuuuuauuucccuguuaaguagauggcauaacauuuuuuuucacaaaauuuuaggaaagugacauguuucuuguauggaguggcuguacacaggacauguuuacuuucuguaucucagaauacuguuggaaggugagcccaguuucugacuggaagauguccuucucacacaauucaagaaauacguaggaucggauguuccuuuuugaauaggggauuuggauuuuuuuuuuucucccacuucuuaaguuggugugucugggugaauucaggcuuguguaucuuggcaucugggcuugucuaccaacagaaaacaaacuguguggcuugcuuuugcugccguuuuggacuucuuucacuguucccuucccucucuuaugucggagggucgguuggucacaaggaagaaagcagauauuaaggacaguguuuacacuuugcggcuaaggucaggugagagauaauuauggcuuuugagguggaugacccaaggaccaucauuugaggacaugaggauuacuaguuuagaggugacauguuugaaagguuaaagaaggcuuugaaacgaaguaaaggcaacaagaaggauguuggggggggggaacugugacccucccccccaaaaaagccuuaauuagauaauucauaacaucucaaaauaguagugugacuugucucucucagcaggagggcgaaaaugaaagcaggcuguagcaucguggaaaagccagaaggagguggaggugagcagaaguucgucaucgucgcugauagaucuggaaugucccuuggugcuuccuguucucccuacuugggcuuaguugacaaaugcuagaccacgaccgaaggucucacagcugucuagaucuugguagaguggcuguaggccuguuuccuaugaauaagcauauagcuuucgcacccuacacacguuuacugcacguuuucgugucuggggauaaggugccuucugccauaugucccuaaaacauuaguuuaucuuucuucuuuguuccuuuuugaccuaucgugucaaauagguaaucuacauggaaaggucacgaauuaggguauauaggcacugcugcccaacuuguguuagauaucagugauugccacaaguauggguaauuucuccauccuuuccucuccucuucgugcugagccuagcugacuggaaggguguguuugccaaguacucuagagacugugagccguggaauguggagguggggguacuggcauguuuguaccuaacuccuagcuacuuugaucuugcccucuuucccacacaaggguaucaguuuccggauugggccuacaaagccgagucgucgccgggcucccggcagauccagcuguggcacuucauccuggaacugcugcagaaggaagaguuccgccaugucaucgccuggcagcagggagaguacggggaguuugucaucaaggauccagaugaaguggcucgccucuggggccgcaggaagugcaaaccacagaugaacuaugacaagcugagccgggcccucaggugagagaaaugagcccccagauguguggcauuaacaaaguuggaaagagagugugcaguucugugacuguuaucagaaaggguaucaggugaugaaggacugcgcuccucgaguggugugugacuugaaagugugagaaaagaggugucgggucugaguggccuaggaggugaagggggugggagggaguuccaauguggcuggcacuggcuccugacagcugguucugcuuuguaguggguaagaauacauggcgaaacauggacucggacucacugauaauccacaggauuaguguagacuucccuguugggaaauuccuaccauuucuuugcuguaggcucuucuauagaggaaucgagaagggaaaaaccgaguauggcagggagguuugccugaguggcucugagcccagcugcucacguacccgggccgcagccugcaugccugcaugucuucucugucagcuuuuaaacuuuauaacucuucuguccucaaggggccagcagguaguugaugauaucugcuacauaauagacgccagagauuccauucucaguagugagaguguaaaaucuaggcagugaaauguuaucuggagccucccacauccuaugugugccacauuaaaggugcagaaggccaggguggugguggugguucccagcucaucccauaucccacuugcuacuguaaaacagguuuccggcgcuuugcuucuuccuugcgcuugggcuccugacugaccucgggagguuucccugaagacuugucagacccaaccagggcaagacagaaagcaacugcacaguuaguuuuauucacaguggagcaggaaggaaguggacuguagaucgaaacuguagagaaaugagacggugagugguuagaaccaaggaaggcguuugggaucuuaaagcagagucgucaagcucuggccaaagacuacagccaggcugacacuggaguuagcgcuuaggucugcaaggccuaacuccagggccaggcgacaaagggaugcuggagguuuuuguaagcagugcuuaagagccaggauuggucuugguaauuacuugaguguagcaaaugcugaaccguguguccuuccuuuguagauacuauuacaacaagaggauccuucauaaaacaaaagggaaaagguuuacuuacaaguuuaacuucaacaagcucgugaugcccaacuacccguucaucaacauucgcucgagugguaagaugcaggcaagcaccugugauggagaguggguuugaauucuaaaagaauuuuuaaaagcccaaaucugagacauuccccguguaaggagauguuuagaagcagugaaguaacgugauccccuagacuaccucaagcccuccuuacucaucuauggggguagugggcugcgcggggcuccgaugagcugugcggggcuccgauacgcuugcuucccccuuuauaugaacuauuuucagucuccuggagagcaacugaacucaauuuggggaaugagcccauagguuuauguuguguuuuaaguucaagacucuguuuuaacaccuugcccaguggcuguuucauagcugugaaccuguuucuacaaacguuuccgauuuucuaugaaacuacaugcucucccuuaucacgugaaugccaucaaaaccacagcauccuugaucggagaaggggaaguugacguguucgcagugaaaggcugaggcugugaugugcagcagcgcucagcuccgugccucagugcagggcucagggcugcaagcaggcuuucccaguccagguuacagcauugcaucacagcucccagccucucggucugccccucgauaaagacacggccacuuagaaaagugucagauguaguugauggugagauuagaguuuucuuuuugcuucgggguuuuuuuuuguuguuuuuuuuuuugguuggggggcagcauuaaaagaugauaaauuauccaccugcucaggagucacuuuuuuuuaacaucggagacaaguuucacuguguaaucagauggucuugaacuuuacucuguggucaaccuggccuagagcagucuucugccucaucaucgaagugcuaggaucgcaggugucaaaggacccucuugaccagucuuaucuuuguucuuugugucauucugugcaaagaaaacgugaugauuuugaauaaaaguccucagagauuggcagaaacuuaaaaacucaaggaggguguggcuaggagaagcuaauaccagaugucuguagauguguaauuacuacacauaacagguuagggcagcuuuagccugacugcucucggugcaguuccaucucuccaguaaccgcucccuccugucccuggggcaugcauuuggggguggggguuggaaugcaccucuaauuacagccuguuuucuuucccugugccuaagggagcugcauuaggaaaucagggcuguucuagccccuggaaucuuguuuccuguuucucacucuggcuucuccccugugagccucuagacaguaggucugcagguagacagccaucagucuugaaguagcguguugguccucacacgcuuucgcuccagcucccgauacauuggucuuguucuuugaucccuuuucaaucacuugaaagcccagaaguccaaccacuuaggcaacuugacuaaaauguccauccagccuagaaguaauccgauuuuccaaggcaaggaaucauggacucugacuguagaaguucuucuggucugcaaaccuaacaguaguuaguggucuggcacaccacaccugagacacccaaagcucuuaaaccacaggugaucuuaaauagguucaagaugguaaucagaaagucccggggugccauagcucagaacagcacugccuggcauguauaaggcuguggcuucaaccgucaguacaaaaaaaaaaaaagagaaaauaacaaaguaaucccaggaaaagcacaacagugagccgucccuuuaggcuguugguuucuugguauagauaagaccaacgaagcagaaucauuuguuuacagagaacuuuugcccauauagaccaaguguucaagauuaacauaaugcugacgaaggaaaaugacauuauuaaacaucuacuuaguagagguacuuugguuugguuuagugaauuccucuaugccuaugauagggacauauaucaugauacuaugcagaggacaaaauuaaggauggaaagagcagagccaaaggcagaaauagguucaguccuucaucucacuauuaaaaucaggcuuuggguaauguaucgugcaucuuccucaugauuaggacucacccaugcauuagcggacgugcuaauccccaaagagaacaaaggagugugggcaagcucucuuccuccaggaaccugggaguuuagcugagagauagaagucuggguuuguguguugggaaguagagaguguguuagaaaguuugucccgugacuuagacccugaaggccuaacagagauucucccuguugcugggcugguguauagaacuauuuuugucuuucuguuuuuaaguagaaauaaauggccaaauacaaaaccaaauacuacagaacuuuuaucagugugaauauugcuuuucccuccacauuuguucuauucauuguuauaguuuauaagguggaacugaauaugguagagcaaguuuguaauuuugacacuggagaaguaggagguccaaggaacuggaguucaaggucacccuuggcuguuuggcaauugacauaagccauaaccuggacuacucuaagaccaugucuccaaagcccccaaaagacacuuuaggguagaguauucaauauuugagugguguuuugauacuucuagaaacuaagcauugugguccacacccacaaucccagcacuuagaaggcugaggcagguggaucaagaguuugaggucaacauuggcuauaugaugaguuucugucucaagaagguacaccugugugcaguaucuuauuuuauguauguguguguguauguauauguauauauguauaucauauauaauaugguccacauguaaaaaaguauuuaaauuuuuaaauuauugaauuuuuuuugaaccauuaaaaauuaagccuggcggggcgguggugucacacgccuuuaaucccagcacuugggaggcagaggcagguggaucucugaguucgaggccagccuggucuacagagugaguucuaggacagccagggcuaaaagagaaaccuugucucgaaaaaaaaaaaauuaagccuggcauaguggcuuaugcuggcaauccagacaucuuauucuuuauacuuuucuauacuuacauauguguauuugccuaagaagcauuggaaaguuagagaagaugcugguuuaaagaggcuaacgcucaguaggugggggcagggcaggcuaaaccugucucucaaauuugccucuuugccaacacccagauuuuuaauacugaccuuggaaaacuugaagccuacugaagaauugaauggcaagcagaacacuggccuacccuccaccugaugacugguggcuaccaucguugccacaugugcucaagcucugucugcagauacuuucuguaucaagagauuaacgugcaggggccauggcuucucugccagaaacaaggauguucuuucccauaacugcaguaacauugccacacccaggacauugaguguuccucuaauaauauauauaacaugcauggcccguauguaaacaguauuuacauuucuuagauuuagaacucugaauucugaauuuuuuuuugaaccauuaaaauuaagcuaagcacaguggcucguacugauaauaaaagcacuuggaagccggcagguggaucucuguuaguagcaaguucuaggccagccaagacuguauagaacaaaaagaacaaacaaguuuaauuuuaacaacauguucgugcuaugcacagguguauuccaaaagccucacagauauuaccuauuucucaaauauuaggauuggucuuauuauuuccuacgugagaaaacagggccagaaagguaauuuucuuuuucagagacacgugggaagcaugggguuugaaccuccgcagagaacuuauuauuugcauuguuuacagagggaguaccaaagcuccagcuuacacuaguuacaugguagcagauacaagaauuaagguucagauuucugacccugguccgcguggccugccagaaggcccucuucuuucagguacucacggacacguuucagcaggaggguuuuuguuugcuugcuugcuuguuuuucagacagaacuguagauuugacaccucgguauauaacgugcaaaggcgagggacuuugcaugagucagcagccacccuucacaucagccacacaucacccuuguccuaccuuacccuguccuguggaagugcguuuggaaauaacuuauuccuccauacaggggugcagugugccuuaguaaguguauaaaaaccagaggagacuccauuaaaaguaaaaacagagcugacuugacuuaagccagcaucucugacuuuuuaggaaacaggacuuccuucuccucuccacauucuccuuguaucuuauauaaucugcauuucagauuauaaacacauuauuuucacuuuugccucuauguuucaccugucugcguguauguacuugcacggcguguguacagugcccauggaauccagaagauccagauuuuggaguggcugaaacuggaguuacagaugguugucagcuaccguguggguccucucaagagcagcaggugcucuuagccacugagccacuuuuacaaccuuuagauaagacuuaauaagucaagagucagaauaauaaaaauaauggacucuugguuguuguaguaaacuaaggaagagauccauuggcuuggacccagcuuggcucuuuucaaaucguaugcaaggucaugugucuaguucuccuaguuauuaaucucaauaauuaaggagccuuuaaacaaggccuacaggagagcugucccuggcagguuucacucaaccaugaacaccagggcagccagucucccacacaguggccugcucaggaguuaggcccgagaacacugcugucagugucugacagugugugucagaacaacaguccuggcaccaugccuuaugcgcugucuuuucuccugcaccaccaaacuuuaacugucucucccuccccccuuuuccuuuuaucuuuccuccauguguacaucaucauguuagcagccccugguuucuccaggagcuucuagggcaccugaagguucagguggccgcuuucuuccuuacaccuuaauuuagggcuuuuaggggaaguugagaauuucugagcuuuucaaguugaugugauacgguggucgucucuucuuagaguuugaacuguggcgguugaacuugguuuuuuugaucuaucccaaccucaaaucacaguaauuucccugccuaagccucccgaguacugggauucuaagccaucacaccugccagcagucggacuugggagagaaaacaguaggucgugaguuuucucccacccuucccggugcuugagaacagcagaaggaaguaucauuauauaggacuugucggucauagcuacagaacgacugggaucucugagauaaugauugucuaucacaacucuauuucacugaaguaggaccuugucccugcccaucuaugugcgguagagacuggguuuucagugcaaccacaugcauguguuuuguguggcugcuggguuuacuuacuuuauaaacacagccaaaauuacgauggugagaaaaaccuuccucgucaaguuggaaacagagauagaugauaucuacacgugauagaguugccaggcagaggcucucagacccauugggauaucguuuuaaauaacagguagucuguuguaugaaacguaaauauugcucacagauggaugacauggccuguggggaggagggccacguggacagagguaggaggccaagcugaauggaaaagcugagcuacugcccuugaaggcucaguccucccaccucagcccccgagugcugggauugcaaaucugggccaccacacccagccugagcaauaguuuugaaaaagacucagacuagguagacuagguagacgacuagguagacaacuagguagacuagguagacgacuagguaucagacuagguagacuagguagacgacuaggcagacuagguagacuagguagacuagguagcagguuugcuugcuguugucacuucacauguguacuuagcuaguguaaguaaaggcgaugauggcgagugacccgguggccagugcugacuucgguucuuuucuuccgucacaggugugguuccucagagugcgccaccagugccaacagccuccucccgguuccauuucccaccucuagacagccauucuccuacuggcgaugugcaaccgggucgcuucucugccagcucacugagugcuucuggcccugagucagggguuaccacugacaggaaggucgagccuucggaccuggaagauggcucggccucugacuggcaccggggcauggacuucaugcccucccgaaaugcucugggcggaggagcagucggccaccagaaacgcaagccugacauacugcuuccucucuucacccggccagccauguacccugacccgcacagucccuucgcuaucucuccggucccuggccgcggagggguccuuaauguccccaucucaccagcccugucccugacucccaccauguucuccuacagucccucaccaggccugagccccuucaccagcagcaguugcuucuccuucaacccagaggaaaugaaacacuaccuucauucucaagccuguucgguguucaacuaccaucugaguccccggacuuucccccguuacccagggcucauggucccaccgcugcagugccaaaugcauccugaggagccuucccaguucuccaucaagcugcagcccccgccggcuggacggaagaaccgcgagaggguagagagccgggaggaggcuguucgcggcucugugcccgccagcgcuccuguucccucucggauuaagguagagccggccacagagaaggauccugacagccuccggcagucaacccagggaaaggaggaacagacccaagaaguggacagcaugcggagcaggaccauagaagaggggaaaggcaccggguuugcccaccccucacccaccuggcccucuguguccauuagcacucccagugacgaaccccuagaggggaccgaagacagugaggacaggucugucagggagcccgguguacccgagaagaaagaagacgcccugaugcccccuaagcuucggcugaagaggcgguggaaugacgacccugaagccagggagcucaacaaaacgggcaaguuccucuggaauggggcaggaccccagggccuggccacaacggccacugcugccgcugaugcuuaaaaccacaguggaagggaagcuguucauauuacaaucaaaauacauauuuauguagcaagauucuggggcgggaggugggguucagcugguuugauaauucuggggcguggacuuguacuuuucuguuggggaugggacgaggaucuuguguuguauaaauaagugggguauggacacuuuuuuuucuuggcgcguaggacauagggaggcuaugaacuuuggggaaggagccuguuuccuguccccuccugcugccugacaagcuccauaggcccauacacuguagucccaucacaggucaggcccuauagucuuuccuauuguguuuauacauacagaaagcccauagugggauaguuugcuuugagagggagagagaagaggaagaggcuggaagguuaggcgugagaaacauacuaaccauguaccugaguauguguuucaggagaggaaaaaguucaucgcagucuuaccgaaguggggggcauuuagaugggguucucuacuccccucucccccuucucccucacuggagugugugugugugugaugugugugucuaugugugugugugcacacacacagagacacacacaugcucucucccaugcaugcacucucucuuucucucccuggggggagggugacacacgcacauuuggcuccccuccccccuuuuuagaaaauguuuucaagacacaugaguguacugccaguuauacugggcagggagggcaccggagaccccccacccccggccccucagcuucagaguugaggugggaaggcagccuggcugcgagguccucaaacucucaccuucuucaccuucaaaaagccaugaggaguuguaaacucuugaucagggaagaaagaagagggcaggaggaaguaacccaaugccuuuaaaaacaaaacaaaugacagaaauagucuucauuuucuuuuucuuuuucuuuuuccauuguugguuugguuucccaaaccaagcgugacugagcacguuuuaugaggagcaggauagcgccguugaagauguuuuucuguugugucugguugucuuacuguuuucuuaagucgagccuuaacuacgaacaugcuuuaagaugauacgggucugucaacauaaaccugugaagggcauggacgcuguucagauaacccaggaauguugaggcacagucgaauuccuagcugauaguuauucccucugauguugccgguccggguggcaaaagggcagaauugugggaaugaaaggcagaugauaaccugcaaacucaauguacugcuugucgaaacugaaggaagagguaggaagguggugaccagaugccaaaaggucugguguaaaggagagagcgguguugccugcggugguguugcccgccuuguggucccccguugcccagauuguucugaucggucgacuguucccaaaaugcaguucaccaacaggggucauuuguccuugggaaauccccuuacagcaacuucaaaggaaugggaagauacugaucuuaggugaaacaaaacacuagcacuaggguagagagaaagcggcaccagccaacggccucugugcacgugugugcucuaguagcucagagcagcaagaagaaaugguuuccuaucugcugaggcaagggauggcacucgggcaucagagugaugacucacuccguccgccaccugagccuggccaagaacuccauacuaagugacauuugaguguugucuucugauggaguguuuggguuugguuuaguuugguuuuauuuucuuuaacugaaaugcaugcacaaaaggagcucaggagacauuagaccuggugaaaggugugagcugacguggaucacuugaggcugucauugcuguuucuugaugaguguccuauaacuugguccagauuccacgcaugugugaaaggccaggaagggggccgaguggucucuggugacccaggcucuggucgggccacgaaggacuucaacccuccuguugccuuuggugguuguguuuugaucaguuuccuucucugcaccuugacggaccucugaaucagaaagcaggcccagcagguagaggaaggcucucugguugguguugcccaucaaaccagggaggccagcuggccaccgguugucugcuaguggggacggccagcgagcaucaguaugaacucaggaauagaagcguggggccuuuaaaaugagggcaggaaauccaugaugcauaccugaaaccccuagaacccaagugccggaauucauucuagaugcugcuuccauuugaauaaagccacugcuuuuacacuugaaagugaacuccaugaaaaaugcuuuuggacuuuuaugaaacuauuugccguuuguuucccuugauugccauuccaccaguaaucucuugguugauuggcacugcacacaguuggagucuggaucuggggaagggucugucugcagagcagaacuugggcucgcucaggaaguggaccaggaaauguagugaucacugauacuuccuggggcagaggagugagagugcucgucucuccccagccccagccuggcaguuccugccuccagccuggugucaccuucuuucuacgagcacgccauugaccaucagccaggcgaaagggggcuaaaagccgggccuacuuccucucccuggguuuuuucuucccucuaaauuuuguugugccaaauguguaaaacuuuguagguguaaaucuauugcaaucucacuaaucaagagcuuguuuauuuaaacaguuugcuuuuuuagcuguaaagaguagcagacucucggggcaucagcucugcugugcucgcgggucuuccuagacaucaggcugcacuucuaaccccagcucgggaaugcagggaacccuagugacccauaggccaagaaacuuccagaagcauuaaaaaaaaaaaaguuauauuccacuaccaaguggauagucauuuagcuguuugucccuuguuuuuuuauuuauuccauaauuauguuugugcuuuuucuugugugaacaguaguggugaggccuauguuuuuauguggcuuuagagaaaacuucagucuucaaagaacucuucuaauuaguuccuucuuagaaaaaguuaugcguuaauuuguuucaaaauauuuaggcauucuuugaauuauaaacuugugaugcagggauuuaugaaugagacguucacaugugaagaugacuucacuaagcaucuguguaagcagaauaagauguguauauguacauaaacuauaaggaaccugaacaccauugugcagugccuuuuagauguucugcuuucuaaagucuucaaauuuuuugcauauauauuauauauaugauguaauguuauagaaauauauguauaauauacauauuuuuuccagggguaucugauagcucuguauuuuguuauggaagucgaaagaaaaaaaguauuuuaccucgaaaauuaaaguuaaauuuaaaaacaaagaguacuu

SEQ ID NO: 1479 - RNA, 4744 nt, Mus musculus
cgggggcggggccgccucaugcaccagcuggguauaaaagccuagagcucuggcgcccagcggcugugcaauuguccuccacgcggcuugguccccagguggaaggaucuguucugcaaaggagacagcaaaguaucuuuagccuaaaggacucagcguccaguguucuaguugaagaucuaaagagaaagccaccuugcugccacuaugccuaacuuuucuggcaacuggaagaucauccgaucggaaaacuuugaggaaaugcuaaaagcucuggguaaggagguuuucgugaguugggaagggaggacaagaagggcgcuggggucuuuagagcagaggccgaauaaacggaagggggccgaaucagggaauguaccugggagccugcauccuaggaaaggggcgugccggauacccuggguccuggggcaccaggcccaagacucuuaaauccuacuuucugaggcugggcgcccaccagugccagcuucaacggugacucagagccugugaagcaaguagaaaccagaagcacgagguuagucucaggagggguuggcuagccucggcgccuggaccugcugaccagggcaccuggcucugagcuuuaagaauccagaauccaggcagggagccccuaggagacauuccaagaucuuuccgcguacccuaacaguaacccaauccaggcgacagguccauuauccucaacacuuggcuccgcccaccaggugguccaccacuucagcuccccgacccucccccacaccuugcacuucccacuccagucuccccaccccaccccaccccaccccacccccaccugugagacauauuuuccuacagcaaccggcucccaagcccuaaaaucgcucuggacaauuaccacuuucuuagauuucaacaaauguccucgugugaaacaccaauccccauuuccgaaagucuaggauugccucccuccucgccacagaccagcugcacccugcgcaacugggcuguuagccaagggugggaacacaggaaccacccagacuuucccuacccaccuucuacuacccucuaggaugcgacugagcuagaagguauaggaaaggagagacaucugcggagagaugcaguuaaccgccccagggaguggaaacuaccccagagccuaagggucagcaugccuuccauuucugcacuggagaggagcccugugguggggagcaggggauacccuugaggagcuagggacuguauaagagugagucuggagcuaaaaagaauguugcgagggcaguagggccucuguucucaucuuuccucgcuguucauucucuuugugucagcuaaccgcaaugauccuuagagucauacccaguuuucuugcuccgcccuugcgaaauuaaagaucagagaauagaaauuuucagaaaaaucuauugcugucuccucccucauucgcucuaaauucuggccccucucugcaguggaugugggagccuggcaucacccccacccccaccccggguuccagcugcagagaaaggcccaauccuacagucugccuucagaauguuuguccuccccgcagggucucucugagccacgcgacuugcuaggggguagauugcaaacagacccguuguuacacaaacugccugugucagccaaggucagcugagccaggaccccagcucugcagacugagggaggcgggguucuccuuaacacagccuccagagacgccacagggucugcguucaggguccauguugugggagaguucagggcucaucaugauaaucagggcaaacacagcaggucuuucgguuaggacugggugaguccacuuuggggcuaaaugaagugucaguuuucuucucaggaacccagagcuauggaaugcaugaguauuuguguguauauauggggguggcggggagggggguugcacgguggcaguggcuuguccccuguagcaccuugaagggccaguucuucaccucaucaggcuuggaaagguggggguggauccuccuguugguggcagaggguugcucuccuucauuuacagagcccucuguaaaugaaaugggggcagggaagggaaaguauaugaaugaggacacagagacucuaaauacacagaagcugagcuggauggcccuuggaugauucuuggagcuagggacaucagaggggaggcaaaacacucccaucucuuccccuucccuucccuucuuucuuucuuccuuucuuucucucuuucuuucuuucuucuuuuuccuuuuuucuuuuuuuugguuuuucgacacaggguuucucuguauaguccuggcuguccuggaacucacucuguagaccaggcuggccucgaacucagaaauccgccugccucugccucccaagugcugagauuaaaggcgugugccaccaugcccagcucccuucccuccuuucaagacagcagaauuuuccuuugaaagagaccuggaaauauuacagagagcagucuggcacaggaaacuuuguccaaaccuaguuucguuuggcuuuucuuuuuuuauuugcauauauuaccugcauguaauaauggguuucacuauguucuggcuuguuuuuuguuuuucucaugguuuuuugagucaggguuucucuguguaguucuggcuguucuggaaugcacucuauagagcagguuggugaguuugaacucagagauccauccccccugccucugccucccaaaaaaggguguacaccaccaugcccugcuauguugcggcucuuucauccauuguacuugcuuuuauuuaaaaaaaaaaguuucuagaaacuaugaaugugcacuuggccuugugugucccccauucuuacuguggagccaugggacaauuagaagaagcugcuguuuccuuuuggcaguugaggaaucugaagccagagccgcuuaagcucagggucacccaguuuuccucuguauccuccucggcugagaaucugcuccuuggguuugagaggggcagggguugugcaaauaaagagaccuaagaguacaagguagguaacuggggcagagagggaagcaaccugcuugccuggucuacccugcaagugggcauggggaauuuaguaacggccagccuaccucacagucucaaacccaguggugagaggccagagugagggaaacugaacgcaccagguaguccgugggggaagcugacccuaagggugcuaggaauguguugcuggaauuuggggaguccugcccaccuacugacucaacaagguggggucauauagccugccucaccuggaucccucucuuuccucuuucaauuuauagccucuuuccuuauuaucaccccaccccuacacuccccccacacacacacacaccaacacacacacaaggccaucaagauggggcugcuccagcugucucauggcagccggugccggagcuaucuguccucucuccccgcaggggugaacaugaugaugaggaagaucgcuguggcugcagccuccaagccagcagucgagaucaaacaggagaaugacacuuucuacaucaaaaccuccaccacugugcgaaccacggagauuaacuucaagaucggggaggaauuugaggagcagaccguggaugggagacccuguaaggugagggacagggagggcccccuccgcgucacagcaccuacuugccacgucuagcuucccuagacucuuugcucucaugaaggagucccuaaggagugcagggugcuggaaaggggucugccucugcucccuuucgcuugcacaggcccuuacugugagcucuuuggucucuggucucuugcagaguuuggugaaaugggagaguggaaacaaaauggugugcgagcagaggcuucugaagggggagggccccaagaccuccuggagccgagaacugaccaaugauggagagcugauccuggugagcccugcccccuccccuccccuggaagaaccccugcugccuucugcguucucugcggggcuccaagcuccugcagauuuaagagcagcuguggccacaccaccccucaaccucccgaugggggcuguuugaaaaugcuaacccuuuugggugcaacaaagaugugccuagaggagcccagaguuuuccagcagacucucccugacugccuauggacuccaggaggaaguggguuucuguuugauccccagcaaugaugccccggcauccuugcaucuguucuugccuguuugggcuuggaaguaaaaacagucgaccucccauccccucccuccuuuaaaacaaaggcgcccggguacuucaccagcuaacuaccucuauccuuacagacaaugacagcagaugacguugugugcaccagggucuacguccgagagugagugccuacggguccaagaacugccugagacgacuuccgugcccgcuacaggacacaaaccucccucccacguccaucuuacaaacuagcucuccccuuacuccugaggguuacugcuuccuccaaggccuuuuguucuuugccuucucuaagccagagaggggcagaagcucagaacccucccaccgccauuugccccucccaggucagcagucccagcuccacaccaggguccuuccuggaagagacugucucucuggccucuacuccuuauccuuguagucugugugauuuagaauauuuauugguuaauuuuauuaaaauguuuuaaaauguaaaau

SEQ ID NO: 1480 - RNA, 12853 nt, Mus musculus
ccuacuucgcuuguccucccucugcccgcugucgcccggaacccgcacagagaaggcagcgggucccgugaccgcgcagagccccccacgggggcggcaagggccggggacggcggggaaggcggggcgcgugggaagaaaggggguuuugugaggcucccggcgagcuggcgccccugucugggucccgcgcgcccggcccugcucgcgcccgcgcauugcgccgcagucucggcugcggcugcgggacgugcggugugcgcggaggggaccucgcaaggugagugcggaggccuggcccuaucggucgcuugcuugcuugcugugugaccuuggguaaguuucuugaccucucugagccaaaggauccgggcgagggcgagagcgggccgcgauacuggcugcugugggcgaccgagacagugacccaccguagcuuccugggguccccaggcacucgggggugcggucggcagcggcgccucucugaaggugggcgcgcagcgcucugugccggcuucggcacccugagccacgcgucugcucgcucacuguccucgccgcgcagccuucaggagccaggggacgucugggcugcggagcgacuaaggaugcccgggcuggagacgacaggggacugcugagcuccgguccuugugguggcuuuccuccgggaagugucacaguagccacucuuggccacuuggaucaaaaauucaugucucagggcagucggauccucuggccucaggcuuccuuccucaucccgugcugccccaacacggguaaaagagguagccacagggccgggcgggcgugugaguagcuccugcucccagccuccccuccucagaacgcuccagcaccuggcuuacuugccagcgguaacccgagugacugcucgcccggcccgcugcacagcacaggccagagcgcugcuuagcaggggagucuguccugggaggaucuaggaggaccgcuuaggcucaggcuagcgacuaugaaggcagaccgagugggagauggagccagugagaauagguauggucgguaggaaaucuugccugacguuguaacugacccccggcugcaucauuagccauguaguccuggguccccgaauacucccaagucugacucuuuacagaguguguucauuaucugugcagcuuuccuuccugagggcacagugaccuggcucccgguuuggcucagaguuagcucuaacccucucuggucauccaccucacuuuccccgugagccuguaugcgcaaugagaucucagaaagagaaacuguuuccagagcugagggccagggcgggggggggggggggacgacuggccucucccuguacccuucuccaguacacuccaaguuguaggcuuucacaaaagaugggugggggaaggagcaacuggauagaggccagacuggcagggacagggucuuugucccagcuggcuucugagccaggagauccggugggaaagcccgugccaggcagaggggaauggcugagagcaaagugggagggagggagggauggagggggcagaggauguugggcaccaggggagcuuccuuacaaguccugguggagaggaagcagagggagaagccgcuguuucagcaggguucagucuaggaggcccuccuggaagaggaaggguuaggaagggaagguuggagcuuuacugugggggaaagaaacuccugguuggcaccugagggcggggagggggguguuugccaagggggugaaguaggaccauaguugcgcucccaaccccaccccugcgucuguggguuugagucuccaaccccuagaggcugccuggaccugcaggugcccaagucccucacacagaaugaugucuuugcaucucaccuacgcaugucuuucauacacaggaacccgucucuaggugacuuauaauuccuaaguauaugcaugcuguuuagggaacagugacaaaaaccucuguauguguucagaacagacucuuuuuuuuuuccugcauguuugacgaguagcugguuuggaugcauagauuuugaauacacgugcacagagagcugauuacgcaguaccaccagccacuguguuacaaguauucgcuggcaucuguuaugugucuguugcuggccuaugcacagggcauuuucugucguagauuauaaauagguaaguagguaauagacaguggcaacuguguguagaugacagcuagacagguagacagacagacagaucacucaagcauacagccccaucaaaaugcguaaggugcuaaugauggugcuuccccccccccccccccaguuaagaagacacagacucagagaggguaaggaacuuggcuuaggucacacagugaguugacugggcacaccucuuggugcuuggagauaggaaucagaaacagaguuaggggugauucuaguaugugcuaccugcauggugggacagagaacggaggaaguccguuccgcagucuaacaacuuuccucuuuccucuucaaguucuuccaucagugugcagaaugauuccacugcuucugucccugcuggccgcucugguccugacccaagccccugccgcccucgcugaugaccugaaagaagacagcucgggugaguaagcauccagaggaccaugucucugcugcaucuuucucaggacagagggcugucucgguuuagccccagcuacaugcuuccagccuaggcacacggaaggagauguggaagugcugugggcaagggcuggagccaacugcaaaauagggaugaauugggaacccuaguaaguaggggagucuugggggucagaguugcaaaggagcacgaggcaggaggcuaaggguagaggaucaaauucaggacccugggcagugcucagcacccugagcugggcagugcaccccaggcgccuuggaucgaggggcggggcuuggagccaagcgcacaggcgcacuacguccugcgucuggcugcagccggcuuugaccccuguccacagaggaucgagccuuccgcgugcgcaucggugccacgcagcugcggggcgugcugggcggugcccuggccaucccaugccacguccaccaccugcggccgccgcacagucgccgggccgcgccggguuuuccccgggucaaguggaccuuccuguccggggaccgggagguagagguacugguggcucgugggcugcgcgucaagguaaacgaagccuaccgguuccgcguggcgcugccugccuaccccgcaucgcucacggaugugucucuaguauugagcgaacugcggcccaaugauuccggggucuaucgcugcgagguccagcacgguaucgacgacagcagugaugcuguggaggucaaggucaaaggugagaggagagugagaucccuagagaaagggaggaaaggacucaggccccccuccccccgcaaggaguugauugugaggcggcuuagcaaacccugcaggggaaaggcacagggugaauagggggccagagauguggggggagacagucccacaagcuguaacaggagcacaaucggacuuuaacuuuugugaacaggaagugacagaagagagggggaggucagugugcuggugguccggccaacucaggaguuauuucuucuccgcaggggucgucuuccucuacagagagggcucugcgcgcuaugcuuucuccuuugcuggagcccaggaagccugcgcucgcauaggagcccgaaucgccaccccggagcagcucuaugcugccuaccucggcggcuaugagcagugugaugcaggcuggcuguccgaccaaacugugaggugggcuggggauguagaccaggaacuccuggucacaucgggaugcuugcuaccuccucccuccaucgaaguuccucaggauucccugccucuggaaagaaaauuggucugcagcucugccugggccuuacuuuccugcauccugacaucacacacacacacacacacacacacacacacacacacacagcagcagcagcagcagcagcagcagcagcagcagcagcaggguugacaugggacagccuucugggguggaagaugccaggcauuagccucuuccucucucuuagguaccccauccagaacccacgagaggccugcucuggagacauggauggcuauccuggcgugcggaacuacggagugguggguccugaugaucucuaugaugucuacuguuaugccgaagaccuaaaugguaauugggagugacaagcccuucugcaacauggcccuugguuucuucuagguccuccacuagacuucacaugucuaagaggacaggcaaauuaggcaggcacuuaacgcacgccuccaaacacugucccagaggcaagccucugagcagaccuagcaaauagcagacagaggggugggggcggggccgggguggggguggugaguuucagcagaguccuguagagcgaggaacuggggccaggcucucuaaguacuaauuuucaucuuggguuucaugcagacuuugguacuaucaggugggcaaggugacccccccacacacaccaggaaugagcuugccuaggaacguuuaaacgucuaggguggaaguacugccaacugccugaugacccagcuccucuuuuacacucaggagaacuguuccuaggcgccccucccagcaagcugacaugggaggaggcucgggacuacugucuggaacguggugcacagaucgcuagcacaggccagcuguacgcagccuggaaugguggccuggacagauguagcccuggcuggcuggcugauggcagcgugcgcuaucccaucaucacacccagccaacgcugugggggcggccugccaggagucaagacccucuuccucuuucccaaccagacuggcuuccccagcaagcagaaccgcuucaaugucuacugcuuccgaggugaguggccucugcagcagucagugccaggccuggaauucaagcccucaccaucuucuuggucauuugcccucaguaaucuguauuagcuuccucaauccuugugccugucagcauauuggccaacagagguagcugacauuuuuuucacuuccaugaaccaacuguucugugcuucagugaacaaaaugcacgugggaguggaacgcuccuuagaauguuccagauccuacagcuuaugggugacaggacuuucaacacugcguguugaggaggggacagagggugguacuaggaagccagaugagugcagacucugagccaagcacuuuguucugaaagaagcaguaagaggcaugacuguggagggacaaggaggggagaugaaggacagauguagguuugcuggucuguggugaccugggcaagggucacuggaacaggucauacaguccugucuguccugccuagagauagcucucugggcuucucuuggcccaacucuacguuggagucauugguucucugcucuguguucccuccccagaggaugagguaauucacucugagccacugagcaucacacccagaaaguggucccuucccuuuccuuagccauagcugagcuccaagcuccucagauagugaccacugagcacucuuccuggggauggagucucuacccuucuccacacaagccuagccugcacgguacagagccugcuccauccacccacucuguauucacacuuaaaggagcagcucacucagccuuucuagacccaucugaaggaaagugagccuccacuucaucucacugcuucucaagugccuuucuauugugcaauguguuuauugccuaugccuauuuucuucagguuucccuagcguucucuauaccauacucagagaaagcuuggccuaaaacuagaaggcacuccauuagcacucgagggaugggugaagcacauuccagggccuguagaggucuagccuagaggcucagacgcagcccacacccugggaggauucaaaugcacacuuagcuucucacuggccuuuuccucuugccacagacucugcccaucccucugcuuccucugaggccucuagcccagccucagauggacuugaggccauugucacagugacagaaaagcuggaggaacugcagcugccucaggaagcgauggagagcgagucucguggggccaucuacuccauccccaucucagaagaugggggaggaggaagcuccaccccagaagacccagcagaggcccccaggacuccgcuagguaacuggaagccuuugccuuggguucucacuaccugagagaaguuggggguaggagggcaagcccaaguggucacuagggucaugacugacauaauucugccuuagguaucucuccuaucacccucccaaauuuuuuauucaaguaaauuccacacccaauucucuuuaacuagagaaacuuguguuuagagggugcucucugggaaggaaauauauuccuuaccccaagauuggaaaauguuggcagacugggagagggagaugcaacagccuuuucugacccaguaagaggcaguuugcagagcccuucaaugcguaggccaggucagaguucuuccagacaggcaaugcaccaggcgcuguaccucucccccuccccuugggccccaccccccuccccuccccuccccuccccuugcuuggucuggggcgcugucccuggugcugaacugucuugcuguggucagaaucggaaacccaauccauugcaccaccuaccgaguccucagaagaggaaggcguagcccuggaggaagaagaaagauucaaagacuuggaggcucuggaggaagagaaggagcaggaggaccuguggguguggcccagagagcucagcagcccucucccuacuggcucagaaacagagcauucacucucccagguguccccaccagcccaggcaguucuacagcugggugccucaccuucuccugggccuccaaggguccguggaccgccugcagagacuuugcuccccccgagggagggaagccccacaucuacuccugguggggcaagagaaguagggggggaaacugggagcccugagcucucugggguuccucgagagagcgaggaggcagggagcuccagcuuggaggauggcccuucccuacuuccagcuacaugggccccugugggucccagggagcuggagacccccucagaagagaagucuggaagaacuguccuggcaggcaccucagugcaggcccagccagugcugcccaccgacagugccagccacgguggaguggcuguggcucccucaucagguaauucugcugaaggcucaaugcccgcuuuucuccuuuuccuccuccuccagcucugggccaccugacacguuggccuuuaauccacccuuuuccccuggacccucugguccuuugcccucguucccuuuucugucucuccccguggaucuuccaucuuggaucuuccauucugucacuuccgucccaguucucugauccucuguccccucccccacccaccacugacccuugggcccucugcuguagcucacaucucacuggccacacagaauguccucaugccucuuccuggugcccucaucagccuugaaggcaggcccauugucugcaguucccucccugggcccuuuguuccaccccuuuaaccaacccccacugauuccagggaagccugagaggccauaccuaccccucaccucuggggaccagaauacucaccccaaagagccuuaagccacuacuucugugaaguauuuuuugacuguuucauggaaaacaaaccuuggaaauaaaucuguauuaaacugcuuuguacccagccguugacaaccucuccaucuccagcuguccuuucugcucaucgcugugucugaaucaggaaucucuguuucccuguacccucuccauccucugugucuccaccugucucuuugccacucuucauuggccaacauccuugcugucacagcaggauggcagcuucuuacugcucccucuaucucuccuugggccauuuacaccuucccuucauacugcugggaccccagacuugacuguacauaucacccaagggaguccuccgucaccugcagaagaaacccacacugcccggguaugauguguagccuacccagguaguuccugcuuggagcugguucucuagcuucccaaggcuuaaacauaucaucuuccucggugcacccagcaagagacaguacuauuaucccugugcccaguguucccucccugcacuaacccugcacuaaugaccccccacucccggagaaauggcuuauguucuucaacccaaaggaccuggcucauucggaacaggguggggugggcagaaagaaaggaacugguuuccaccaucugaaagaaaucuucugucccagaaccauaagguucccauuggaagucuucuccgggaaggcugaggcccucccagguucaccucuccuccauggcucaaguggaauaucaccccuacaucacaaaaagcuugcccauuucagcuauugccuuucugcccacuggccuuggagugaguguaguaaggaagagggaaccccuuagaggucacugaagugucagcccaccuguaaagagagccagaggcccccuggccuacugucagaaggugggaaagaaaugcuuucugguucugugggguagaaaaagaggagggaaaauccaaagugggucccuuauaccgcacugcccagccaagguucaggcacuguagcccacagccagguuggaacuuaaagccaaaagggcaaggacugagcuuaagagucuguccccccaggguuagagggcugcccaggaaggagaggaaacuggagaagcagaaagcaugaggacucccgggggcccaggacucuucacccucagcaccugagaccaacaaccuucacccuacuugaaaaacuguuagcagagggaugcucgacaugauagauguuagcggagggauguucaaaagacugcuuggucaguguaccaauuauagcuggggcacuccagcaaauuuaaucagcccagcuucuccuuccuccuccccugcugcuaccacuggcaugugggcuguguucucagcagccacugcuggggaguagucugagggaccuagucugcucuguugguuaaaggagccauugucucuggucaucuggaccagaaauggaguggaugcugacagcuccuccaguaccuaggcggggcccaggaagaaggcuggagaaggcugccugaggcuggcaggaauucaggucucauaauccacagcccugggcuucuucccuuccuuggccucuucccgcuggcugcucagggcucacacugguggcagucugagccagucaggaacugggaggugagagugaggacaggcccucugaacucggggauggacuggagugauggccagcuccaggcagaacugcuuaccuuccuggucuggaagaugucugggcuggggggcccgggacccuccccuggagagcucacccuuaggcuccuccaccucgcuucucuccccugucaggugacuguauccccagccccugccacaauggugggacaugcuuggaggagaaggaggguuuccgcugccuauguuugccaggcuaugggggggaccugugcgauguuggugaguuuguggaaggacgugggggcagguccaaagccuggagccuaccccaauaugcuaguuucugagguggagggaggucacugguuugggccuugccaugaaugacuucaggcaaguuacauagcuagucucaaccuuccugucacuguucugucuccagagcggggaggaggacaucuucuccagcauggaggacugcacaggccagggguggagagccagcugaccuagccacugcccaagagcccucuaggcucaggccuccuggcugcacuugaguggcucugaguccuccccuccugcugcuaagcagcuggcuaaagaagccaaucuaagaccuggcagcccacccgcuuccuucccugugcuccaggccuucauuucugcagcccuggcugggaggccuuccagggagccugcuacaagcacuuuuccacacgaaggaguugggaggaggcagaaagucagugccgagcgcuaggugcucaucugaccagcaucugcaccccugaggagcaagacuuugucaacgguggguggggccugacuuccugcgcaugcuccaggccaaacccacuccucacccacagcuuccucacucacgccucuucacuccucccucucucucccucuuuccucucucacaccccuuuccccuucccucaucuuuuaccucucacucacccggagaccuguuguggggagauugggcccaugguguccgacauuugcggggcugccuaggcugcggggguggggugugugugugugugugugugugugugugugugugugugugugugucucccugcuuucccggaugcaacuguuucccuaacucugugguagcaagguuugcuccucuucuuucccuuccaaagugcuauucuccaccugcauguccuugcgccauggaugugaagguuacuuacgaaaauagggagacaggcuagagagauggcuccgcgguuaagagcacuggcugcucuuuugaagggcccaggguucaauuuccagcacccacaugacagcucacaaccaucuguaauucccguuccggguugccccucugaugccuucuggccucugaggacgaugcacacaaguggugcacagacacaaauguaugugaaauacauacaacaaaaauucaaagcuuucaaaagaagagaauuuagggagagccuuuaugauagcaaaucugauugucuucccugggggggggggggggagaaagacagaaaaggugggugaacgccguccaucuuuggcugcuuucccagcagaagaggcuaggucugagccaacagccacaaaccagcaagauuuggggagguuuuuggauggacuccccaacaggucaucacuggcccagaaauacugggcuuccugcucacugcaccucuggcuuuucucucuagaucgauaccgggaguaccaguggauugggcucaaugacaggaccaucgagggugacuucuuguggucagauggugccccucuggugaggacugucacugcacuguagucuaggucacuucuugggccuuucugcccucaguaaccgucacugccucuuccucccuuucuggcuguuucguuccccuuuccccuggacccuuucuuuccgcaugcuucuccucucuggcucuugucuccuuccuggagagccccuguucucuuauucccccucccugccugucccagucaccagucccugccccuccauauccugggauaccccccaaguccucccuccaguuuucugggggcauuuccccugguacuuaugggguucaagcgucucaccaccuccuccacucccccuucccagcucuaugaaaacuggaacccugggcagccugacagcuacuuccugucuggggagaacuguguggucaugguguggcaugaccagggacaguggagugaugugcccugcaacuaccaucuauccuacaccugcaagauggggcuuggugagggcugccgagggaaaggguggccgggacugccacgagugagaggagagcaaagcuacccagaagagccugucaggguguaccccagacuguggggggguugacacaccacacugacccccuuuuuuuuuggucaacuguggccaugccuuuccuccccgucaaguuucugggagccaucauccacaaagccaggcucccagcuucuaaauguguaccccuugcaguguccugugggccuccaccacagcuaccccuggcucaaauauuuggucgcccucggcugcgcuacgcgguggauacugugcuucgauaucgaugccgagacgggcuggcucagcgcaaccugccguugauccgcugccaggagaaugggcuuugggaggccccucagauuuccuguguaccccggaggccuguaagugacaggaggaaacagguagggggcaccagcuacuuggcagcccuaggcucaaagacccauuaugccugccauucacugacugagcuuggagugaccacugccucucgcugaggcuaagagaaggaaauaggcuggagcucuggagaccucgugggugcagauggcugagaaccugcaaccacacuugggcuccuaagggcagagcaaguauuuugaaaagggcagggguuaagcagcaaugacccagguuauuaaggaggagcgccgugcagaggauggguguguuugucuuccauagggccgugcucugcgcuccauggacgccccagaaggaccacggggacagcucucgaggcacaggaaggcaccguugacaccgcccuccagucucuagggagccuggaagacugcugcccccagcaggacccucucacaucaacugccagugcucuuccccaugauagggggugacgugagaggggugggacugaaauucagaggacagcgcucgaagggguuucugggaaacacuuggguggcuccgcccccucacacaagggccucagguuuuacccgguaagucccuaagugccucaacugcccucucaugucagcugccuccuugucccucgauuucguuaggggacacugugcuauucguucuugauuuucaaagaguuuuuaggauggaguaccagcaaaaccagguggaaauaaaguugucugaacccaaagu

SEQ ID NO: 1481 - RNA, 2370 nt, Mus musculus
cagaggagagaggagggacgagucuagagcgcuggggccgcgccuccucuggagccggcucauuccuuuucucuaguugcgcauuggguuucuccagaauaggagggcugagcuuggccagcucagaacuaccuuagcugcuagaggagaccucugaggaagacugaggaaagaguacgcugugaaccgccgcugguguguguacucaggcuacucucaacucaggucuccagauccugugaagaggaagcaggugggugcucccggccuagcaucuuccccagagaaguuugcucucaggacuugacucccuuucuguggcuuccgauuuaguggcugugguaaagccaagcguggucccucccaguuuuaccacuagauggucacuuaaguugcuggaaagacugauaggaugcagcugcagagguugagagaggcagggcucccaucgguuucagugacuuucacacagcugcauccaggggccucucuaggcggcugagucuugccacacuaaagggugagucugagaaugagccacaaggacaucacacuuccacucagggacgcuuuaaaaguccccccaugaguuagggugaagguucaaauaggaaaaugagaagggcaaaggggagggucccggggaacaaagagaugugucauuacuaauuagcagcugaaggaaggcggaagguggagagaggaagcuaaaacauagcgggaucucagccuccuggcgcagucgcagucucagucgauguagagaccgcugcccugacagacaggguccucuccaugcagaugcccugugagccuagaagugcuggcugggauucagcgaccuguucuccucucugaucucauuauuuggaacccuugaguaggaguugcccaauaccugcugagaaucuagaacccaaacuagucugugggaggaaagaccagggguggcauggggguguaccuuccugaugucacguucucaccccaaccuagcagagauccagagagaggaccaggagcucuuggggcuguugaagguucaccgacugaauuuugcuuaugaacaaucaugucaacccaccaucugcuugcaacugucaguccacucuuaagucaaauucuugcugaacugccccuguagauaauuuaagaucuugacuucucacccuguuaaccugucuuguucuccugggccucagagcucaguuucugaagcuaggcaggccuucaccuggaaauccuccuggcucagucuccugcauagcugaaguguaccugagacacuauaugcagcuucacuccucaggccuuggcugucuuuccagccuguuggugcacauacccagauucacugaggucagucuuaaacccagaggugaggucugcauguguggugccuucauucucacgcuggauggaaugguuaacagaaacaagcaaaccccaucuuacuucuuuuuuucucuacauucuuccaaacaggaggaaccaaccucagcaaaugggauuguuuauuucacaguggugaagggcggacgcaaugggcaugacagcucacacucuugguugucagcuuagugacaugcaagguuaacuaaacccaagcagcugagcacaccugugaggaauucucuucauccaauccaggaagaccuggcuuugugccuggagcaucccucaugcgacugcauggugggggugggguggggguggggucaguaaagggcuuggaggugaagcacucuggagacaguuucagggauuggcuucugcuguauugcacaugagcagcuguuuaucuuguggaagccuaucggcugugauugguuagcacauuaccucagauuggacucauauugccugggucucugugcagaagaagcacacaaacagacuuggagaaugcagaugcaucagcaggccagcuaccaccuacggaugcuacuucagcauuccguguucugacucucggaauacccaggagcauggugugccaggugucucucuuagaagcagugugcucguaguccgacugccaggucaggcgugcauuuuuuccuacagagacccacccuaaaucugcaucuuuugaagugggaguaucuaccuuaaaucuggaccacaccuucugguggcaaacuccauaaaggacauggaagaaggacgcuuucgcucuuugccugcuugccuugcucuucccucauugcucuuucagccuacguauacugaagaccagcggagacauccaggcucgaggacugaacaaguacuggguucuuggacuuuacuuuggagacagccauugucaaacuagcugaaccacagccuguaagccacucuaauaaaucagauaugauuuacucuuau

SEQ ID NO: 1482 - RNA, 13016 nt, Mus musculus
uguaggguaugauaguguaugcuucugaucugagcacucuugaggcaaagaugccuggauuucugugaguucuaggaaagccagagcuguauuagagaaacccugucucaaaaacaaaacaaagacauuucauguaagucuacauuuucagacuuuuaaaagagacacuccaaauauuccuccauccugauuccucuucccaccauccuuuagcuggugagcugccaggcaccagguuuauacuuuuuggacagcaaguuucacaggggaccauguccacccccucagccaguauagaaugcauuggcucuccucugcagacuggggcuccagagcugcuugcagagugugcagaaacccugcccuaaaccaggcuaucccugaaaaggagucagcugagauccacuucagacccucggucccucuuccgcuucuucuuuuuggcucucuccuuuggguauugccgacuucucucaccugcauccucugcuacccaugucccaccaucaucuuuacugcuuacaucuaaguccuccucacagcacugcugucuuuuccuuuugucuuuucuucugaccuuucucucuccuuuuguuaggucauccuucccuucuuccucuuggguaucuaaguccuccccacacgucccucgcuucuugcugcuucuccuggggucuuugucuccuccacuguugacugccuuuggccggcuugucacaucucuaccuccuucaucacagacucccaucuccccgucuucuucauggcgcugcuuccuccuuuucuucuuuuuccuggaaggcugaucagauugcucugugcucaguucucugggcccacucucuccugcagccucuuccuccucacuuccuauagccguucccugucucucggcuuucugccucuucuucuucuuccugcugucccugaagcuccuguccgugugucccagcagcucgucaccuagacucuuuucaguuguugcagccucuucccccucuuucugcuuccucuucuuuuucuuuuuuugggaaggcucacugucagucagugguugagaggugcccagagccuuugagccuuugagcugagccagaaaggccugcucuugggccuccaggcgagcaagcuuggccuucauggugauaccaauccgggcagcccuaagacagagauaugaugggucuaagucagcaaggguauuacaaagaaaguugggaacagagggagggggcagccaagcuucaaacaugaacuugugaacaacagcaaguauucccuuggaaugaaaauaauugggagguggcacaggcuguccuuaagcaugggcagaaaagaugggaaacccagaagugaccacaacuuacuugugugcuguucgccccucgcaagccuugaguagcaucucaucagucagacuguaagggcagaugacaagucacaaacuuuuuucuuucuuucucuaaaaaauuuuuaucuucacuauuguucaaaaccuggcacuuuuugaagugcuaagauaauacaagaauuaguacaaucuaauuaauuccacaaacaugcaccuacuccucugauaagaaagcauuaggcuuagguucauucucuuaaaaccccaaagcaucucccacaugcucucaguaccaaaauaaagucucacaucuuugggggcgugggcucaugguugucaacaucacugcaguuccccaagucucugucaggcuucuccucacccgagguuaguguggcugucuagaagaaaaggaucauggagacggauaaagccaacuuaauaccauugccaacucuccuccauuucugaaacuccuagggagucacugcccaaggcaugaauuugacagcacccaccauuguuccuugcaaagucaugcagccugcguauuuuaguuugggcaggagaugaugggccacgguuauugggaaguagagcagucagggccucuguggcucacagcaggcuaauuguagaacaagcagggaaaagugcucugaguguucauaguggaguaggugccagaaacugacaauaaagacagcaccccuauccccuguuuaacuagaugcauaaccuauuaugggccauguagcugaaauagauccagguagauagcucagcugguaacaauacuugcuaugcaagcaagaggaccuaagugcaggucuccagcacucacaugaaugcugagcaggcaugcugcucaccuguagucucagcaagcaggcuagcuugguagcuaaacuagacaaacuggcaagcucuggauugaaguaagagacccuagcucaguauauaagguggagaucaaaaagauacccagccuccaucugcacacaugcauccccaagcauaugucaacacauacacacaccaaaaugaaagaaagaaaagaaaaaagaaaaagagaagaagaaaaaaaugaguccaguccagauguaacugccauucauaucgggcaguuauuaugaauguugccugucucacauauaauucaggccaggguuuggggaaugguuucuagaggguguguauguauaaucucaauuugaaagcaagaaaugguuagcagguaaaggguaaaggaagaacaacugacagaggcaagggcaggugggaaaacacagcuucuuaaaggagaaaaaauagaccugcuggcuaguguguacuggucccaaaaagaagugagugagaccugaagcauaaagggccacagacaaucucauuaaaaaggauggagccggacagugguggcacgggccuucaaucccagcgcucaugagacagaggcagguagaucucugaguuugaggccagccuggucuacagagugaacuccagaacagccagggcuacacagaaaaucugucuuaaaaaacaaaaguaagcaaaaaggaucaugauacuauagcugucuuuugcuacuuuguggguucuucuuucuuccacccuucuccacccauuuucuuccauccuuucaaauccccuaacacuagacagaagagaagauaaagaauagaaagaaaaggaaguaauguuauuguuaaagcaugggauuccuugaggcaaguuugaccuucacugacagggcaucugauuccuuuuuccuucuuuguguaugacuacuuaaccaaccacaauaacaacccacaacacccuuccucuggggccuagcauuuauauacccucugaaaaauccccagaauuccaaacaucacagaaucgaagaaacuacuugaugcuggcaaaaccacacccuugcuaaagcaugaggcaaaucauagucagcugcugacugcaaucugaagcagccccccauaucccacaccugagaugaaaacaaaaacauauguccauauuucuguguuuuucaaagaaacugaaguucuuauuacauaauacgauguguuuuagagagaacccuauggaugcuuugaaggucacugacugugguggagagugaggauagaggcagaggcucuuaaagaggcaaggacugcccgaaccgaguagaugucaagauguagaaacugggaggggaugcugugugaagcccugcacacagaaucugugcuacuaacugccggcuucuguucuuuuugccuuuauucaucagcugugggcucuucugaaaaccauuuuuacucuuugguucacauauguaaaauaaggguggaccaggcaaccucacaggacucuccuggcuucuaacucuuuuaaaauuauacaucaacauaucccaccccagcagcuccuaacuaaaugacagcccucccucucacuguacgcugcugcuuccccagcagaugggauuguccaugaaccuuaacauuucagucugggugagggcacgggcacagcaaggcugggcacgggaucucgguguacugggguauccugggaauuaguuggacacacaaugcaguugaucaggacccagggagacagacgggagcaguugagagcuggaucucucacucuauuaccuucacaaacuucugauacagcaagcuggguuuggggugacugcgcuggguggucuccuuggaaagacgucuuaucugcacuccauccuguugggaaauaucggugagagaguggcgugcuguagugcccuaccccaccccaggccugcagguuucuucaauauacccgacaaguucauaccuuccccgaguccacuaccaagcuggcggcagucuuguugaagagaucacuccaccaguggucuguaaauuccuuggcagggucaugucccaccuccaugugaacaguaaguagaagucacagucugagcaccgcccacuggcccucauggguccccucucccauucaugcugaccaccucccagucuuaccccaugguuaucuugcuucagugucaccuugagggccuggguaaugccauucucccuccggcccaggcccuugccuguagaggagagugagugacuuauuuuguagccugaccugagcccucaccaagucuuccugggcuaaccgccauuccuuuacugaucacagaguacacucugaaccuuucagaaaccuaccucucuccauuccuucuaggcuuacucaggaacccgucugagggagaacuaucuuuucuauccccuuguggccuccucuaguuuguccaaccacuugccccucaucccucguuauccaaaaugaggauuucgcccauucuucccuaauccagaugggucagaaaacguaugcuucuaaagguucucuuuagacuaguguccccucuggcugaacuggcauggggcagcagagaguagggagcgggaggauauggaagaacaccuugaguccauccaugcuucagcagcugcucuucagcaaacuucaucccacggcucuugaccucuggggugacacucauggcagggucuguccucagguucucaccagggaaaacauggcacuauccucugaauagggaaagaaaggacuggaggugcaccuuagauagcagggugcuucacuagcacacgcaaagccccaggcuucaaccccagcaucauguaaaauaaggcaugcuggcccacacgcguaaucccagcagauggaauguggaggcaagaggaucagaaguucauaucaucuacaacuauacagagaugguugaagccagccugugcuauaugagacccuaaauaaguaaaaaagaaaggaaggggugguagugugggcuagggcuguccuuaguaugccuuaggagguagaaugcuugccuaacaugugugagguccuggguucaauccccagcauuguguaacuaggugugguacugcaugccuguaauuccaacucuggggaaguggcccccgaaggcucgggacuccaagguugauugaguuuggagcucaggaccagaaugcuuaagacccugucugugccuaaaauacauaaagcuguuuguguaagacguuucuuuuguuaaaaaaacaaacaaacaaacaaaaguuucuguguauguccaaguguauguauaugccuuacaugcaugcaggaaccaguuacaguugugagcugccaugugggugcugggaacuggauccaggcccucugcaagagcaguaagugcucuuaacugaaccaucucuccagccuugaauucuucuugaguccugagagacaccaggaggacgacuguucuuuggagaguccucucucuggucaaaggggccaagacccaacaggaaucaggaugaaggagggguaguguuaauacugauaccuagauguguggcauaagcuacacugaagccuuacgaacgugaaaacuuucauucaaucuugccacccuacucaggugacaaaggaagcugagccuuaaauagcuuagguggugacaguaauaugguugguauuacugucaacauggcaggaauuaccuggauggcaagccuccaguugcaccuauagacuaauuuaguuagccucugaacaggucuaugagagauuagccuguuuaaguuagcugaaguggaaaaaccucaguggcacauucguuauccuugaguccuggacuaaaagaagcuacggccagaaagaugucucaguggguaagggagccuccugucaaaaccgauguuuaguccuagagaccuacuuaaguacuuaguggaaggagaaaacugacuuccaugggcugucuuccacccuuccuacccaugcucauucucucucucucucucucucucccucucccccccuuacacacacacacacacacacacacacacacacaccagcuagacuaagucacacaacuaauguaugaagaauucaaaccaggaagccugugugcagagucuguuuacguugugcaaacaaagcuaagagguguuugguaacuugagcuagagacugguacuuaagagagccuaaagucuacaccuauuguccaacauuugcacugaccuuaugagggagccaaaccuuccgcccacauuacugccuuaucaggcuuucagaagcuuccauuuagaaacugucuagcauaggaaggggcgccuaacagagcacuaaguagagaaagauggcugcuguacacuaucaccucauuguacuucagagacagcccugucaauaggaaucauucucaccuuacaagagagggaaaaaagagccugguuuucuugccucuucaggaaaugcgaauacuagcucugauucuaaguagacaaauuucuucacaguaacucacacauacuucccuuugccccagaauggcauucccugacuuguacacuaaauuuaccuccaaaguguaagauggcacaucacacaagacauugaaaacuuagaccacuaauaucaauuugugcuaagauaauuuguuauggacacaacugcuuuuugguuuuguuuugagauuauguaucccuggcuagucugaaacucucuauguagcuggccucacacucacagagaucugcuugguucugccuaccaagugcugggaucaaaggcgugagccaccacccuggcuauggaaaacuuaaagcugauuagugugacuccuggaguaaaccuugagcuucucaaagaggcagcucuaaaggucaaacucccauuagaucuaaagucugcuagauacccuuuaugaaguccaacacaacuuuaggcaauacucccaaacauuauauauuagguuuaagaauaaggaacaggauuuccaucaagauaagggcuguccaagucuccaaggaauaggccgggaaaagguauucaguagauguaagggacaccuggauguuucuagguguaauaaacagcaaaguaaaauagagaacuuuacaaagcagaaaauaaaaaugcagaaccuggcuugggagcuccuuacuccuagugaguagggaugucagcaucagacagaaggaggcauggcucagcagagaugggcucagaaaccuugcucuguuccucaguaauuccaguacaggcgcuuucaagagcagaaggagacagaauccuuacaagaacacugcagugagugcagaugcccggcuuucuccuggcgcuguuaaaacagcuguaaaaucaugucaagugcacucuugugggcugcaccgcugggaagcacacagcaagugaagcacgcaugcgggagcuucuggacuuaagggaaggucucugaagcauggagcauggauguggaaacucggugggaccagagucuguaggggacuuaaauacagaagccaggcagugugcugaugaugcaggaaucacacaggccaggaccagcgcuuauaacugggaaccugaagagcgucgcucuguccuggucugcuuuucucuccuuuugccugucucucccagaaaacauagauuagccaggucuacaggaccucaugugugguucaggcuccgggagcugggauguccuuucuaucugcuuguauuucuuugugaucagccuucagcccaaaccaccuggcuccacagccccugacucucuuauacuucucccuuagguuucucugccaacgcaggacuaaccacucauccuacccccaguuucucccuuuuguaccguauucugcuacucccugaagugaaugaauggugcuuauuuuucuguuuggcuauuacuguauuucacaguaggacuacucuuugauacugacuguguagaugguaugcuaauuucuaaucauaagucuagaggaaaaagacagcuuagcccuagaauaggcuaggcccuccugaacauuguaaauacuucugaaagaguaaagguguuuuuuaaaaauuuuaaaaaaaauaaaguuuaguugucugaguguuuugccugcauguaaacguaccaugugcacacagugccaccagaagccagaggaggcuguccaaugcucuagaaaugauguuguaaguggcugugagcgaccacgugggugcugagaacuaauacagguccucuggaagagaaauacucuuaaugaccgauccaccucuucuacccacuaaauaaauuccaccaaugaccuaaucccugaugcgcaaaucucaaggaccacaaaacaccaagguaacagaacuccuccaaaagcugaagacaccaggagauaaaaaguggucaagacuuuaggacaagacuucaaagucaccauguaaaaagccaggcaaugucuuuaugaacagcuuugacuuuggacuaugcuuugcaaaaccaagaucaugacuuggccaucuuauaagcaggaaccucuuagaaguccucagaacaaggacaagugggaccagcucuauccugguggguuuguggauuagcugggcacgccuucuuugcugucauucuuugucauaaaguaugggagguggccacauacucugggaugcuuggauggaagaaaagauccucugcccugcuucccucuuuguugaaagacccaguuggcugugccacuacucugccuuucucuucaguuacucccacuuuugccugcaggaaaugccacuguuaggccccuacuucuguuugggauauauuuugagagugucaggauuagcagacuauauacuugaugccuaaaacuguacucauuacccugguaaccaaguaaauccaaauuuauuuauuuugguucuuuguugcccuuucccgaaaauagaauucaggauagcaguauucuucuacguauuaacaguugaaauuuuaaaaaauaaagagaaaaacuguuggaguggcccaucaucuccuggaguuggcccugcugacuuuacuccacuguaauccacugcagggcuggcucugaugguuaagaugaauccgcuucagucugggagaucugagagcaggaugcaccgugugaucagagccuucuaccaagguacauuuccuugggauuaugacuugauaaaaccgagaguaucugcuacaacucuagcuuuuuuaguauaaaagcucaagccaagguaaaugaggaggcccuugggaacauagugacccuuguaccaggcuaggagguuacaagccccugagacugaguguccagaauaccagcaugcagguucuauguugagguggggguuaacuuuuauuuugaucaccuuguagucuuuuaaacccuuggucucugaggccagguccacaucuugccuuccagucauuugccugcccuucugugguaguccuuguguuaagcugguagaauggaaucagucauuaaucuuuguguccugccuuggcuggggccauauaggagcagcuuagcucuaaggcccagagaaccuuuauccucuuucuccuugaaggagagaaauugaacugguaaaaacagcauccucugcagcaugggaagaagaaaauaaaaaucuccuuuccaaaaaaaaaaaaaaaaaaaaccaggcaagguggugugcacauguaacuccgucccaaaaaucaggcgguuaacuccugagcuugaccucuggccucgauaugcacgcacccaccacacacauuuguucacauugacauuucaagcaagcaaacaaacaccccaggggcuggagagauggcuuagugguuaagagcacuggcugcucuuccagaggaccuggguuugauucccagcacccauagcacaacucagaaccuucaguuccaggggauuagguacccccuucuggucuccucagggaaccagucauacauguggcacacagacauacaagcaggcaaaacaccuguauacaagaacucuuuuuugguuuguuuauuuauugaauuaagccacuaaaucuguaguaauuuguuuuguagcaaugaagcuaaugcacaagagaguggcugauaauaggcuauuagaagagaggaaguuauugauaugauguauaaaacaaguuuuggggccuggagagaucacucaaugguuaagagcacuuacugcucuugcagagaacacggguuugguuuucagcaagaacaaggcaguuuacaucuccccacaccucuuagcauccagcaugcauuggauguacauaauacaaguagacaaaaacacuuguauacauuaaauaauaaaugaauuuuaaaaaauuaaauagccaguuauagcacaccuuuaaucccagcaccagggaggcaaaggcaggugaauuucggugaguuuaagaccaaccuggucuacaaagugaguuccaagacagccagagcuguuaaacagagaaacccugacucaaaaaaaaaaaaauaaucaaaauaaaauaauaaaacaguucugccagcccuguauaguagugcacaucuuuaaucucaauacuuaggaaacagacuaagaucucagugagcuggaggccagccacuuuuacauaugucccaggucaguaaagggggcuuuguaaaagccugucucaaauauagauagauagauagauagauagauagauagauagauagauagauagauagauaaucaguucuaucaguuucaaaaugugauccagggcccccuuugggcugggacuuuuccagaggccuaugaugucaacgucuuuucucagaaauccucccacauuauuccucccccccuuuuuuuauuuuuugagacagguuucuuuguguagccuuggcuguccuggaacuagcucuguauacaaggcugaccucaaaggcaugcaccacaaaugccuggcucccucuauuucucaugacugcauagacuguguaguuucccagguaccacaccagugauaacgaugcuuuguuaagggacuaugcucuuguguacucuggugucuaggaauacucuucaauucugcauagcuaaaugccccaaagcucacaaaaccuuauaaaauggaggcaggguguuagcaaucgugacagucgaguuuaggaagaaucacaugucuauccaccuuuccauuaggaaggaugauugcaugaagcccaaaugaaacggaacugugaauacagcaacacaaaaacgggguaaagaaguggucuucuugaccaaaguguggacacuuaaccccuuccuagaaaugggaacaaaacacccauggaaggagcuacagagacaaaauuuggagcugugacaaaaagaugaaccaucuagugauugccauaugcagggauccaucccauaaucagcuuccaaacgcugacaccauugcacacacuagcaaaauuuugcugaaaggacccagauauagcucucucuugugagacuaugccggggccuagcaaacacagaaguggaugcucacagucagcuauuggauggaucacacggcccccaaugcaggagcuagagauauuacccaaggagcuaaagggaucugcaacccuauagguggaacaacaauaugaacuaagcaguacuccggagcucuugucucuagcugcauaugcaucaaaagauggccuagucggccaucacuggaaagagaggcccauuggacuugccaacuuuagaugucccaguacaggggaacgccagggccaaaaagggggaguggguggguagggaauugggggggguggauaugggggaccuuugggauagcauugaaaauguaaacgaggaaaauaccuaauuaaaaaaaaauuaaaaaaaaaaaagaaguggucuucuuggauuuuuuuuguuuuugagggcuuacuaauuagccuggcuagccuggguuacacuggccugccucucucccaggugcuaccuugcuucuugaaauggaaacagaaguaaaauuuagaugcugaggucaccaugcaaauaccacuuauuauaaauaccaaauuauuucugacuauuuuaacaguaagaauaaucauaccccacacuuguagugcauugacucaccacgaaccugcuauuaacugcuucacauggauugucucauugaugccugccaacaucuuauaagaagguauuacuuagccuuaauuuacaaagaagaaaucgaacacugcuaauucgaacaccaaacaacuggcaaguaguggauccaggauugguagugaagcauuucaugagcaacucacugcuuuguaccuuuacagcuucuuucuucugcuguaagccuuccccacauucuauuucucaucacaguaauucaaaaccacacuucccggaaggcggaggcaagcuuuauuucccagcccuugagaaucguucagcguuucuggacugaaaugagugacacaguaggaaucguuuuuuaacgcacuugcaaugggccggcgugggcagacgcagccugaucugcgaaggcugcaaguacacugagacgcggucuccuuuccagccaguuuccagggauguccagagccacccguuugcagcagccuagaggaccagccgccgccuuuuccuccgguuauaaauccaagccccgcagccacagagucagcaggguggaacuacucuccgaucuucgcccuugcucccgccccuggggaaagcaagcuccuuaccgucaguguacaguccucuccguggaagcacgugugacacccgacuugggugcagccaucuucccggaagugaac

SEQ ID NO: 1483 - RNA, 2005 nt, Mus musculus
caugcgccgugcgagcggcgcucugcuagucgaauguccgggcugcggacgcugcuggggcuggggcugcugguugcgggcucgcgccugccacgggucaucagccagcagagugugugucgugcaaggcccaucugguggggaacacagcgccggggcucggagaccauggcgggcgcugcggugaaguacuuaagguacggccgcccucucccgcgggggcggggcagggcaggccgcggccccagcaccccaggggcggacucaggccaggacuucccucagucaggaggaggcucaggccguggaccaagagcuuuuuaacgaguaucaguucagcguggaucaacucauggagcuggccggguugagcugugccacggcuauugccaagguaagcggcacagcgagaaaccucagugaggugcagguggggagguccccggcgguggcgcacacagcggugacugcccucugcacuucugccuucaggcuuauccccccacgucuauguccaagagucccccgacugucuuggucaucuguggccccggaaauaacggaggggaugggcuggucugugcgcgacaccucaaacuuuuuguaaguaugugaacggaguuuuuuguggcaagguaugaagacucgggaucggagauugaauggcuacuuuccuuuucaacuaggguuaccagccaacuaucuauuaccccaaaagaccuaacaagccccucuucacugggcuagugacucagugucagaaaauggacauuccuuuccuuggugaaaugcccccagagguagguggguugaugccuguuucuacaguaaguacugccccuguccugcccuucccauuuucagaucaagcuggccugccuagugucugucugcccuaaaaguguucucugaaaaaaagugguguagaagccccuccagacugugugcuccacgacuuuccaggcacuccuauucugcagccaaacaacucccacaacaugcaucuaacaauaaucuggcccucagggccucauccugaaccuuuucuguagaugcauggauuaaagggugggaagucagaaauuaaaacaaaacaaaaaccagaaagccccagcuuauucuauggaugaagacacugauaugcagaacagaacuagucucuucuggcuuccagugucaggaagccugagacuggcagucaccccuucucaccagugacaggcagguagguacucaggccuggauucagacuguccugaaugagcaacuccucuuuacugugccuuaggaaccaguuauauacaugcuucuguggucagugggugcagggacaggccucccuaggugacagcagcuccugacauccuuuccccuucccucacgcucccagcccaugaugguggacgagcuguaugagcuggugguggacgccaucuucggcuucaguuucaagggugacguucgggagccauuccacagcauccugagugucuugaguggacucacugugcccauugcuagcaucgacauucccucaggugcugagacucagguggcugggagacucgugcucaaaccuggcuaaggcugguacccaggggacugucccacauuagggcuggggagcaaaguucaugcugccuggcccuguggaaaaccagagcccgauaguacaugggacugagggcuuucccucuuccuuaggaccaggccaccuguauguccuuauacuacuuucucucuucaggaugggauguagagaagggaaacccuagcggaauccaaccagacuuacucaucucacugacggcacccaagaagucugcaacucacuuuacuggccgauaucauuaccuugggggucgcuuuguaccaccugcucuagagaagaaguaccagcugaaccugccaucuuacccugacacagagugugucuaccgucuacaguaagggagguggguaggcaggauucucaauaaagacuugguacuuucugucuugaaau

SEQ ID NO: 1484 - RNA, 6293 nt, Mus musculus
gcaggaaaggagucaugugacucugaggcucuuccgcugaguuuaacuagcuguggcuguauguuucgcuguuggggaccucacuggggcuggguccccugugccccuaccccauggcuccuuuugagucuacuuguguguucagcuccauuuggccugcagggagaagagacucgccagguaagggcucuggaacugaaguuauagauguuuccggaaauccuaccuuucuaggaugaccggaaucugggacaacagagggguggaagguggaugcaagagagauaacaacccagagagcucaguguggagucacgagugauuggaagaauuguggaggggucaggcaugacugcguccugcuuucugacgaugucugagccauggcucagccauuguagcccaggaacaggcaaguuuggggacuuaaaagccuuguuagcucugagcccucugaguaauccuggauccacccuauguucucaacccuacaucugccccugauuccaaguuccccucaguuucuacauuucccucuugccugguccucaagagcccuugcauugcccagguccuguccuccaccuacaagcugcagcuuugccugugagcauaccugaucuugcuccuuccgccccacuaccccguguuccagguaucuauggagguuauuuccggcuggccaaauccacagaaccugcuucauauucgggcagugggcagcaacuccacccugcacuauguguggagcagccuggggccuccagcuguggugcugguggccacuaacaccacucagaguguccugagugucaacuggagucuccugcugucucccgauccugcuggggcccugauggugcuccccaagagcagcauacaguuuucuucugcucucgucuucaccagggugagggucugaaggagcccagagagaagaucacaagaagagaguccauccuacccccagggcgagggacggguuuagcccagggugggugaagugaaugcaguuuuggguggggugacugggagggauauucaagagaaagccagagggaggcaagccucuuccacucuacccuguccccagcugcuugaguuugacagcaccaaugcguccgagggggcacagccuccaggaaagccauacccuccguacuccuuggccaaguucuccuggaacaauaucaccaacucauuggaucuugccaaccugagugccgauuuucaaggccgcccuguagaugauccuacuggagcauucgccaauggcagccugaccuucaaggugaggcuauggggaaggaacuggaaaugacugaugagggugggaguaucugucccucaagcuccauucuccccacauggcuuccuucuccuuccaagguccaagccuuuucuagaucuggucgaccugcucagcccccucgccuccugcacacagcagaugucugccaguuagaaguggcccugguuggagcuucuccucguggaaaccauucccuauuuggucuagagguagccaccuugggacagggcccugacugccccucagugaacgaacggaacuccaucgaugaugaauaugcaccugccgucuuccaggucaggucaccagugcgagauagaugggugggaauguaaagugggaucccgcuagcagcccagaaaacccaccaaccacuuauuguuaaaaaagacuguguguuuggguuuuugaaggauuucuuuucauuuuaugugcauguaugucugugaaggugccaaaucccccggaacuagagcuacagucaguugugagccaccgugagggugcugggaauugaacccagguccucuggaaguacagccagugcucuuaacugcuaagccaucucuccagccccagaagacuuguuuuuuauguguguguauuugggugcaugugcauacagguuccuauggaggcaagaagaggguaucagguacccuggagcuggaauuacaaauagcuguaagccuccugguaugggugcugggaacugaauuuggauuuucuacaagagcagcaaguucucagcacugagccaucccuaaagccaccacaacacccauuuuuaaaaggguuuucuguuuguuuguugagacaaggucucccuaaguaucccuggcuggcugaccuagaacucuugcuauggagaccaggcuguccuugaacucagaaagguucaucagccuccugagaggugggauuaaaugcacgcacugccacaucugguccggguuucuuuuuucuuucuuuuuuuuuuuucuuuuuuuuuucugguuuuucgagacaggguuucucuguauagcccugacuguccuggaacucacucuauagacgaggcuggccucaaacucagaaauccgccugccucugccuaccgagugcugggauuaaaggcgugcgccaucacgccuggcuaugguccggauuucuuauuuaacaacacuuuucucuggcuccuuuuaguaugggguugcacuagucuauugccugccaucugugcccuccaaggaagcagacaaaaccagugcuuccaagaucuucagcugggaugcuccuuaacccggggcccagagggagcgagcgcugaacggcugcagcuccguucaugucaguuucucucuguagaggagagacuggaccuccuacaucuagcaugucauuucuacaacuacacuuaguacugaggacucuuggugacuuagugccuguacugcugauaugccuucugggagagcuggggaagcagagguguugguacagguugguccuccucacccugccuccuuugcuugucucuccagcugaaccagcuguuauggggcucuucuccaucuggcuucaugcaauggcgaccaguggcuuucucugaggaggagcgggcccgagaaucagcccuccccugccaggcuuccacucuucacuccaccuuggcaucuucucucccucauucaccaauuguucaagccuucuucgggucccagaacaacuucugugccuucaaucugaccuuuggggcucccacgggcccuggcuacugggaccaauacuaccuuugcugguaagaacuaaggguuuggucaaaguggagaaaggcugagccgcucagccugccuuccuaagcuugcuuuuuaaacccucuugcucuaggucaaugcuucugggcaugggcuucccuccgguggauaucuucucuccacuaguccucggaaucauggcgguagcccugggagccccaggacucauguuccuggggggaggccuauuucugcugcugcgccacaggcgguauucugaguaccaguccauaaacugaaacccacucuccagagggaagggcagugucucagacugucggaggguggggggcccagggucaugaucugcuuuucugcagaaccucagaagccagccucaaccuacuggggugcucccaguaaguuguccuuccaaacccacggagaggccacgcucacggguucccaaacucccguuuccuguggaugaaacuugaaggccuacaugagugacuguuggcugcccuaaggggcaugaaauagacauuucccccauacaagauuuccagucucucuuauuuuuaaaugagauguauguauuuuauuauguauuugugagucuuuuguuuguauggaugugcagugugggaugggggagggcacuagaucccauggaacuguaacccaccagguggguccagggaacugaaccagaguccucugcaagagcagcaaguacucugacuggcugagccagcucuccagccuagauccaaucucuuaaugugugagugcuguugggcugguuugggacgguuucaacaaacaggaagacagagagaggcuuggaaggcaguuaguuucucuuugagggcccgauucuccccaguccuccuuuguaccccuugaugcuaggagguaacuugugccugagggugggggugggggaggagcagaaugaacgagccacaggagccuggcagugauuuauuacauacucacagcuauaugcugggcugagggcgcucugccuuccuagccaccaugugaguucacacccaguucuuuuggagauuuuagcucugugccccgcccccugagagugggacuccuuggaaguuugaauaguggaauguuacagagacccguguagguugggacaggaaagacaacagcuacauauaacagucuugacugaggcaaaagagucuugaggccagugguagcggguccagaaccaggcccccuagaaaggucuucaccaacuaucugacaugacaucaacuucuacccucgggcuaaggcagguuuuccuucuccuuggcgcucacuggcacagacaguucagggugggcuguggcucugcacuccugacccacaggaagcuagggagugagaugaccaucccgccauagcaccugugccauggugggaagcugcccaagaaggaagugugcuucuccagucucgaccuugggcucucauccucuggguuuguaaagcagcggcuaggagagaguaaggguauuuggggccccaguggggaaguagcaagguuccucgcaucaaagguccauugccugggcaaaggccaggccuacaacuguuccagggaagugccgaaagcccccugugcagcucuagguggcucagccccaugagcggggccuguagucggaaacagaccgagcauggucaggguaguccaagcggcucucggaggcagugagcaugcgcucuggcuccaccacaaacauguaauagagguuccacaccagcauggccaagaguggcaggaaagucaggccauagccaaagccucggaaggagcggcccacagcaaaggucaaccaguauaucagccuguggaaacagaacaagagucaagagcggacagugagagacuagacgggaaggguugccagcgccgauacuacuccaaacacccacccaguuuauauguaugucccugauaucugcuuucccacaucucucugaggugagacucucucucuuuuuuuccccccgagacaggguuucucugugaagcccuggcuguccuggaacucacucuguagaccaggcuggccucgaacucagaaauccgccugccucugccuccugagugcugggauuaaaggcgugcaccaucacugccccgcugaagugagacucuuauuccggucuucuacuuacuauuuaaaauuuaaguuggcaaaacuuaauuucaugauuaauuaaauuacaauugaauguucauuuaugugauggagagugaauugaggauucaacuuugauauugucucccccuuuucuauuucccaccuucuccucagcccccacccuaggcauccagugcuacaguuucuugagucaucuguuuuggagauacugacaaaaaguaauguguggugguucagggcuucacagagcuaagcuauaccaccagcuccccuagaccugccuucauccucccaagugaagggguuaacagggccucuaccagcagugcuaccccaguaacugaacagcaucccuaacccggugucuccccuuacucucagcuguuuugcuuguuacuuuuuaguuaguauuugagucagagucucacuauguugcccuggaauggcaacaugugugugugugugugggggggggguccuccugccugaauacagcacuaccggggaccccaggccugcacaccaggcuccauucuaauucuuagcuccacuguguccuguauuuacccuuugcagauaaagaaaccaagauccugcuagguguggugucacaggcuuuuaauccuagcacucaggaaucaaaggcaggcagaucugugaggcugaggccauccugcucuacacaguguguucuuuccaggacagccaggguuauguaaagucccugucccaauacaaaacaaaacaaaaagcucacuuucaauauucaguagucugaggccggaagauugcugagaguuugagaggagacugauugacauauuuucaggccacugugggucugauugagauccugucucaaugagauaaaauaaaauucauugggggcuggagagauggcucagugguuaagagcagugacagcucuuccagaggucaugaguucaaaucccagcaacuacauaguggcucacaaccacccauaauaagaucugaugcccucuucuggagugucugacaacagcuacaguguacuuauauacaguuaauaaauaaauuuua

SEQ ID NO: 1485 - RNA, 6293 nt, Mus musculus
uaaaauuuauuuauuaacuguauauaaguacacuguagcuguugucagacacuccagaagagggcaucagaucuuauuaugggugguugugagccacuauguaguugcugggauuugaacucaugaccucuggaagagcugucacugcucuuaaccacugagccaucucuccagcccccaaugaauuuuauuuuaucucauugagacaggaucucaaucagacccacaguggccugaaaauaugucaaucagucuccucucaaacucucagcaaucuuccggccucagacuacugaauauugaaagugagcuuuuuguuuuguuuuguauugggacagggacuuuacauaacccuggcuguccuggaaagaacacacuguguagagcaggauggccucagccucacagaucugccugccuuugauuccugagugcuaggauuaaaagccugugacaccacaccuagcaggaucuugguuucuuuaucugcaaaggguaaauacaggacacaguggagcuaagaauuagaauggagccuggugugcaggccugggguccccgguagugcuguauucaggcaggaggaccccccccccacacacacacacacauguugccauuccagggcaacauagugagacucugacucaaauacuaacuaaaaaguaacaagcaaaacagcugagaguaaggggagacaccggguuagggaugcuguucaguuacugggguagcacugcugguagaggcccuguuaaccccuucacuugggaggaugaaggcaggucuaggggagcuggugguauagcuuagcucugugaagcccugaaccaccacacauuacuuuuugucaguaucuccaaaacagaugacucaagaaacuguagcacuggaugccuagggugggggcugaggagaaggugggaaauagaaaagggggagacaauaucaaaguugaauccucaauucacucuccaucacauaaaugaacauucaauuguaauuuaauuaaucaugaaauuaaguuuugccaacuuaaauuuuaaauaguaaguagaagaccggaauaagagucucacuucagcggggcagugauggugcacgccuuuaaucccagcacucaggaggcagaggcaggcggauuucugaguucgaggccagccuggucuacagagugaguuccaggacagccagggcuucacagagaaacccugucucggggggaaaaaaagagagagagucucaccucagagagaugugggaaagcagauaucagggacauacauauaaacuggguggguguuuggaguaguaucggcgcuggcaacccuucccgucuagucucucacuguccgcucuugacucuuguucuguuuccacaggcugauauacugguugaccuuugcugugggccgcuccuuccgaggcuuuggcuauggccugacuuuccugccacucuuggccaugcugguguggaaccucuauuacauguuugugguggagccagagcgcaugcucacugccuccgagagccgcuuggacuacccugaccaugcucggucuguuuccgacuacaggccccgcucauggggcugagccaccuagagcugcacagggggcuuucggcacuucccuggaacaguuguaggccuggccuuugcccaggcaauggaccuuugaugcgaggaaccuugcuacuuccccacuggggccccaaauacccuuacucucuccuagccgcugcuuuacaaacccagaggaugagagcccaaggucgagacuggagaagcacacuuccuucuugggcagcuucccaccauggcacaggugcuauggcgggauggucaucucacucccuagcuuccugugggucaggagugcagagccacagcccacccugaacugucugugccagugagcgccaaggagaaggaaaaccugccuuagcccgaggguagaaguugaugucaugucagauaguuggugaagaccuuucuagggggccugguucuggacccgcuaccacuggccucaagacucuuuugccucagucaagacuguuauauguagcuguugucuuuccugucccaaccuacacgggucucuguaacauuccacuauucaaacuuccaaggagucccacucucagggggcggggcacagagcuaaaaucuccaaaagaacugggugugaacucacaugguggcuaggaaggcagagcgcccucagcccagcauauagcugugaguauguaauaaaucacugccaggcuccuguggcucguucauucugcuccucccccacccccacccucaggcacaaguuaccuccuagcaucaagggguacaaaggaggacuggggagaaucgggcccucaaagagaaacuaacugccuuccaagccucucucugucuuccuguuuguugaaaccgucccaaaccagcccaacagcacucacacauuaagagauuggaucuaggcuggagagcuggcucagccagucagaguacuugcugcucuugcagaggacucugguucaguucccuggacccaccugguggguuacaguuccaugggaucuagugcccucccccaucccacacugcacauccauacaaacaaaagacucacaaauacauaauaaaauacauacaucucauuuaaaaauaagagagacuggaaaucuuguaugggggaaaugucuauuucaugccccuuagggcagccaacagucacucauguaggccuucaaguuucauccacaggaaacgggaguuugggaacccgugagcguggccucuccguggguuuggaaggacaacuuacugggagcaccccaguagguugaggcuggcuucugagguucugcagaaaagcagaucaugacccugggccccccacccuccgacagucugagacacugcccuucccucuggagaguggguuucaguuuauggacugguacucagaauaccgccuguggcgcagcagcagaaauaggccuccccccaggaacaugaguccuggggcucccagggcuaccgccaugauuccgaggacuaguggagagaagauauccaccggagggaagcccaugcccagaagcauugaccuagagcaagaggguuuaaaaagcaagcuuaggaaggcaggcugagcggcucagccuuucuccacuuugaccaaacccuuaguucuuaccagcaaagguaguauuggucccaguagccagggcccgugggagccccaaaggucagauugaaggcacagaaguuguucugggacccgaagaaggcuugaacaauuggugaaugagggagagaagaugccaagguggagugaagaguggaagccuggcaggggagggcugauucucgggcccgcuccuccucagagaaagccacuggucgccauugcaugaagccagauggagaagagccccauaacagcugguucagcuggagagacaagcaaaggaggcagggugaggaggaccaaccuguaccaacaccucugcuuccccagcucucccagaaggcauaucagcaguacaggcacuaagucaccaagaguccucaguacuaaguguaguuguagaaaugacaugcuagauguaggagguccagucucuccucuacagagagaaacugacaugaacggagcugcagccguucagcgcucgcucccucugggccccggguuaaggagcaucccagcugaagaucuuggaagcacugguuuugucugcuuccuuggagggcacagauggcaggcaauagacuagugcaaccccauacuaaaaggagccagagaaaaguguuguuaaauaagaaauccggaccauagccaggcgugauggcgcacgccuuuaaucccagcacucgguaggcagaggcaggcggauuucugaguuugaggccagccucgucuauagagugaguuccaggacagucagggcuauacagagaaacccugucucgaaaaaccagaaaaaaaaaagaaaaaaaaaaaagaaagaaaaaagaaacccggaccagauguggcagugcgugcauuuaaucccaccucucaggaggcugaugaaccuuucugaguucaaggacagccuggucuccauagcaagaguucuaggucagccagccagggauacuuagggagaccuugucucaacaaacaaacagaaaacccuuuuaaaaauggguguugugguggcuuuagggauggcucagugcugagaacuugcugcucuuguagaaaauccaaauucaguucccagcacccauaccaggaggcuuacagcuauuuguaauuccagcuccaggguaccugauacccucuucuugccuccauaggaaccuguaugcacaugcacccaaauacacacacauaaaaaacaagucuucuggggcuggagagauggcuuagcaguuaagagcacuggcuguacuuccagaggaccuggguucaauucccagcacccucacgguggcucacaacugacuguagcucuaguuccgggggauuuggcaccuucacagacauacaugcacauaaaaugaaaagaaauccuucaaaaacccaaacacacagucuuuuuuaacaauaagugguugguggguuuucugggcugcuagcgggaucccacuuuacauucccacccaucuaucucgcacuggugaccugaccuggaagacggcaggugcauauucaucaucgauggaguuccguucguucacugaggggcagucagggcccugucccaagguggcuaccucuagaccaaauagggaaugguuuccacgaggagaagcuccaaccagggccacuucuaacuggcagacaucugcugugugcaggaggcgagggggcugagcaggucgaccagaucuagaaaaggcuuggaccuuggaaggagaaggaagccauguggggagaauggagcuugagggacagauacucccacccucaucagucauuuccaguuccuuccccauagccucaccuugaaggucaggcugccauuggcgaaugcuccaguaggaucaucuacagggcggccuugaaaaucggcacucagguuggcaagauccaaugaguuggugauauuguuccaggagaacuuggccaaggaguacggaggguauggcuuuccuggaggcugugcccccucggacgcauuggugcugucaaacucaagcagcuggggacaggguagaguggaagaggcuugccucccucuggcuuucucuugaauaucccucccagucaccccacccaaaacugcauucacuucacccacccugggcuaaacccgucccucgcccuggggguaggauggacucucuucuugugaucuucucucugggcuccuucagacccucacccuggugaagacgagagcagaagaaaacuguaugcugcucuuggggagcaccaucagggccccagcaggaucgggagacagcaggagacuccaguugacacucaggacacucugagugguguuaguggccaccagcaccacagcuggaggccccaggcugcuccacacauagugcaggguggaguugcugcccacugcccgaauaugaagcagguucuguggauuuggccagccggaaauaaccuccauagauaccuggaacacgggguaguggggcggaaggagcaagaucagguaugcucacaggcaaagcugcagcuuguagguggaggacaggaccugggcaaugcaagggcucuugaggaccaggcaagagggaaauguagaaacugaggggaacuuggaaucaggggcagauguaggguugagaacauaggguggauccaggauuacucagagggcucagagcuaacaaggcuuuuaaguccccaaacuugccuguuccugggcuacaauggcugagccauggcucagacaucgucagaaagcaggacgcagucaugccugaccccuccacaauucuuccaaucacucgugacuccacacugagcucucuggguuguuaucucucuugcauccaccuuccaccccucuguugucccagauuccggucauccuagaaagguaggauuuccggaaacaucuauaacuucaguuccagagcccuuaccuggcgagucucuucucccugcaggccaaauggagcugaacacacaaguagacucaaaaggagccaugggguaggggcacaggggacccagccccagugagguccccaacagcgaaacauacagccacagcuaguuaaacucagcggaagagccucagagucacaugacuccuuuccugc

SEQ ID NO: 1486 - RNA, 4130 nt, Mus musculus
uacagacagagagauuccuguggagacuuauuccuggaaagagauuccugcaugcauguuaaaagacuccugaauaaacugcuuugagaagaauguagugucgucguuccuuucugcuggucggaauuggaggcgacaaauuguggcccauauggggauguucagaacucaucgcagucagggcagcuagcugguaagguucccagguaagugggacaauuuaaguucucagauugagacaauaagguucccggucuugggacaaguuaagguuccugguuuugggacaaguugcaccaagcaccaugggaaauucaaccucaggucaaacagugcaccaagcccuuaaggacuugcugaaagugaaaggaaucaggcugaaaaaggagacccuggagaacuuuuuaaaagcaguggaucaggugcuccuugguucccuguaucaggacauuuuacagggcccaguugggaaaaguuagggaaggacuugaaguuugcagaagaacagggaguucucgcuaaagaggugcugccaguguggaagcuaguacgaaauuguaucgaggauaagcaaagauguggaguggaacuccaaaagggcaaugaggcacugaaucaggugagagaggagcaaucccaaaagucagaggcagaaggaaguucuagugauggggauaugucugaggacgaucuggagagcauagcugacagucuagagaaagugaaaauuaagguagaaccuuuggggucagggccgccauguccgccucuguaugccccugagggagcaucggggcguagucugcauucagaaaccuggagggaacugcgagcccagugcuuuccuguauuucaggauacacagggaggucauuaucaugagccgcuugauuggaagauuguucaaagauuaguggaagggguucguacuuacagugucagugcugcuuuuguaagagcgcaauuagagaaccugcacccuucagcaugacuccaagcgauuggcagaauaugggucgugccggcuugucaccaggccaauaucuaggcuggaaggcauuuuucauugaguuuggugccgagcaagcagcgaucaacucuggcaacggccagccagccugggaucaagacaugcugcugggacaagggagauuuguagcagcucaaacuaauuaucccauccaaguguaugucuugacugguuguuggagggcccugacccaguguugguuugggagagagagucuguuuguguguuuccccaggaucaccgacaaccacucugggucccagaacagcugaccggagcaguucagggcaagcagaacgaugaggacguggauguuccuguggcuggaaaugcucccgcuagugagaacugaagagcuacguuagggaauuaugucuguguucccaaaacccgugcgguugacgcauuuggcgcaaguguuuccucgauucuuuacaucuaaugcuucgcuacaauugccuuuuuuaccaugggauggagagauagcuccagugcaugaaucuaugcagcuucagcuaaagggauuguuguguuuucagaugauucaaaauauuucacagaugagugauuguguucagcuguaucuacuaaagcuaaugcuaccuggauuugagggguguggccugccaguauauccaagggcaauggcacuauacccuccuaaccuagaugggcccccuuuuuguaggaguguuggugauucccuuccaccuuggacuggcugucaaucuagaaaaguagcuugggcagugaagaauuauuuuuccuuuuucccuuauauagguacaguccauaauaguuccuuuucaggguauaauuggacauaucaaaauccagcucaaguaggagcuaguaauucuuuuaauguaugguuguuagguggggugaaugguaguugcacugaucuuucccccuuaagcaugguggcgggaggggccuggggcaauacaaauuuuuauuggaaugguucuaguguguuugaaacuucuguauuucaauuugcuggagggaggaauguuucuuuucaggcuacgccuauuuguauguggccuccuuuuguguuuauuguuuauaauguuaguuaugagaauaauguuaauuguaguagugauauuuguuauuauaguaugugcuagaauguaucugaauaucauuuggcuguugugacuaggaugccucgcuuguaccuuggccuguucaagcuccuucugcuaugacuuuguuuagaucuaagagggauuuuuggcguugcugcagccauugucacuuccuuagcaaucucugccaccgcagccacggcugcggccauaucccuuacaaacugcugcggcugugaauaauuuauccgcagguguugcagagguuuuggauugcugacagcugucccccucuugaaagagugggcuggaauugguggacuugcccuguguccgauauuaaucagcauucuggccuucuggugcaccugccgcaugcagagucgucagcgcagagcccaagccuugaugauacaggcuuuugcgggugugaaaacaggacaaucuccucaacuguggcuuggcaugcuagagaaguagucaaugacggguaagacucccugggcgugucaccaaccuaagacagggaucaaaccaauguuguuugucucccgaggacagguaaggggcauugcugcagggggcaaccuaagacaggcauucucucugccaauaaguaaagacagggagaugugaggagcggguguggcagcagucccaagauggcgcccgggacugcagccaagucuuaugacuuucaccugacuuccucauacaccugaaaauaagccacgacaauugugagagcugcgcaggugcaacaugaugcaagaucagaccauaugacaagugaugauucuggccaauggacugcuguuccguggacagggcagauggggcaugguucagagguuauauaagggauugcgauugggggaggagauacagacagagagauuccuguggagagacuuauucuuggagagagacuccugcaugcauguugaaagguuccugaauaaacugcuuugagaagaacauagugucgucguuucuuucugcuggucagaaucagaggcaacaggagggugcagaacagacaagucccacacagcagcuuggugcacaccuagcagacaccaugaggacccucucucugcucacucugcuggcccuggcugcgcucugucucucugaccucacagguauguguccuccugguucauuucuuugggugacuacccuccugaaggucucacaaucugcuuugggauggcagaggggaagggacaacacaugagggagacagcagggaggaaacagaacuaacuacacuguuugcuuuacagaugccacgcccaccggcccugagucugacaaagguacuggcagaaagccuggcagggccucggccuuggcccacacccuguccccuaagcccccaaauccccuugccuucugccuggguguccccacuuuuccuccugaacucagaauuaccugaccuugugugucuucuccacagccuucauguccaagcaggagggcaauaagguagugaacagacuccggcgcuaccuuggguaaguggccagagcccuuagccuuccauauugguagggaggaguuguucugggguagucucuaugacccgcagagggcuacacgugcaggucaauccccagguccaggacccuggagccucuuguacagugugggaagaggauguguguacccuguguauauuaaugccacuguguguugguugauguuacuuuaugcuucucagagcuucaguccccagcccagauccccuggagcccacccgggagcuaugugagcuugacccugcuugugacgagcuaucaaaccaguauggcuuaaagaccgccuacagacgcaucuacgguaucacuauuuaggaccugugcugcccuaaagccaaacucuggcagcucggcuuuggcugcucuccagaacuugauccucccuguccucucucucugcccugcaaguauggaugucacagcagcuccaaaauaaaguucagaugaggaagugcu

SEQ ID NO: 1487 - RNA, 30243 nt, Mus musculus
gcaagcugguggagaggaaagcuggagcugaggaaggccuuuagccccgagccugaucuuuauuuugaucuagucugguguguauuguagaguggugagugcugacacaguccagggagcucgaggcacccaaguggagggaggggaaggugguuuagaacgcugagauagagcgccuccuagauagagccaguuccugcgcacacuacaauuugcuguuggguuggguuccugucuaguguuuagggcuuucuuaugucaccugucagcuauguggccuugagcaaaucaguuaaccuggccaagccucccauucuuuuaucuguaauauggggauaaugguaguugcuugugcuccuaaguuuugauugugaaaggguugccaagccagagcccuguccaggugugaguaugagugcgaauggauuggccccucuccuccugcugcaccuacccuccuggcuggagcagugagaucagcugccuccaauuucauaggaagggcaaagacagccugggggaggggcagcagcuggccccucucugcuaggagccugugguauaggaccagagccuaucugggggucuggcccaccccauccugucuuuugauccucggcgcucagaugccaacuuuuuuguuguuuucuuuguaugugugugugucucugugucucccccaccccacuaaccccucucucucuguuuucgagacauuuuuuuuuuuuuuuccuguguagaccaggcuggccucgaacucagagaucugccugcuucugccuccagaguacugggauuaaaggaguuagccaccauccugucaggagguuguauuuaaaaaaaaaaaaaaaagucggaaaagcaucuggcacuccgacucggggugggggguggggggcagaggcaggcagaucucugaguucgaggccagccuggucuacagccagggcuacacacagagaaacccugucugaaaagacaaaacaacaacaacaacaacaaagauagucguacuuaguuuguguuggccucaguuuaugcaaccacagauggcuuuggguugaucuuucugcuuucaccucccagauaccaggauuucaaaccugugcugggcgacagaagcucauuuugaagacaggaaaaucuuuaucccucagugauauguuccuuaagggaccucuuaagacagguacaaggaauuacuggaaagggauuccaaauguccaggcaacuagugagguuucugucucuguugcauaguauauuggagaguuuugaugagacuucauuuagauuagaggucugcaggcuucacagauaguugucaaucacuuguaaggaccauccuugccccggcccaccuccaccccagucggcuaggaguuugcaucacucuugagacccagugggaacuuuguuguuuuuccggccauuuuucucagccucucagaguuugggguuucuggcauaccaaguauagauaauaaugccuuucucacggugaagauuaaucagaugcaccuccacguggccccggcccugucccugccacgugcagccucuaauagaaugggcgaggucucccacuguaggggcaauaacuaugacccugcacaccugauggccucaccucagcaguguuuggucacagacccugugauccaaggaggaaugacucaaggccagcccucaggaacucacucugaagggauuccuaagcccuucccacccugugagggagcaaaacuggcucuccaguggucggacuccucucucuccuccuacccaggaucauagauagccaaaugcuaacaucucagccuuuacagcccgacgaaccuguauuagaauuccaguuuugcuacuaaccauauacauuagacaagugguucuuagaugggugauggugaugcgguccuccccuagggauaauuggcagugucugaagauguuuucugauuguccuaacuagggacagaagugcucuuggcuuccgucaguaagauucugagaugcugcaaacaucucacucagcacagccucucccaugagagugaauuaucuggcuggaaacagcuauggugccaagguuggcaaguccuaugucacacagauaacuuagaacccugagcuucauucuuaacugcaaaacagaacuaaugauguaucugcuuugugagccauugaagacacacaaauaccugguacccaggaguaggaggcacccauaaacacucccuacauuaguuauuauuagcaugccugugguccucugcugagcccauuccacccaucugggcauagcucuugcuaaggccagugucucuguauuauuguugguuguuuguuuugagauaggguuucacuacauacccuuagcuggcugcaaacucaagaugaccacccaccucugccuccugaaugucauacuccugcccugacacuugcuuuccgucuucuccucugcaagcccugcagagcugaacagcucgagcccuccccuuaggcucagcaucaggucucaccuccaccucccauuucucccauccuguccccuccauucacaccuuucccagggccaggccacagcuucugcugcuucucaguuuggaucucugcacagaguugcccuggcacaggucuagucccugcaccucccacacgggcacuggcagaggugguaaagcguguccuggguguagacaaggcugaguaucugagcugacuuccugcugccuccuuggugucugauuagggcaauggccgacugacaugaagaauagggagcagauuuccaacccaugcaguuugugguccgccuugggacacacaaguguaaagaugauagaggggcuagcuagaugacaaguaaaggucacaggucaacaagcuuggugaccugagcucaguucccagaacacacaugugggcagaagagaaccuacuccacaaagucaugcuuugacuuucugcgugaaaugugugcccauauaugcauagugcucacacacacacacacacacacacacacacacacuuauaaaacaaauuauaggagcugugugugcugggacaugccuuuaaucccagcacucagcaggcaggcagaucucagaauuauaaaacaggcaccaggauguagcuccauuggcugaguacuugccucccaugcacaaaccacaaacccuggguucaaucuccaacauuguauaggccaggcaugguagcauacacuugggaaguagaggcaggaggaucagaaguucaaguccauguacauguauauguauaugcgugucuguuuaccugucugugcacauguaugugugcguguaucugucaaugcacauguauguauaugugugugucugcagacacgucuugcacauguguguggugcuaaggaaugagucccaggccuuucccauguuacacagugcucuacugcugagcuauacuuccaguccaguccaguccagcuccugccucugccucuuaagugcugggauuaaagguauguaccaccacacuuggcuccccaguucauuuuguauguguuuuauucauuauuguaucccuagugccuagaaaaaaacauggcacacaguagguucucaauaaauauuuguucgaacaaguacauucuccaucucugcuggaggcacaucugucucagcccugagcuggccuuuagcagggaacuuucugcacaguguguguuaccuacugucagaacuuccucguagagguggaggaaacugagcccguaagacaugagguaacccacccaagacugacaggccagaugcauuucuuccuuagagggcacagaauagaacuugguguguacacagauacccaaggcucagucccucauguuccucccucauagcacucccaggaggaggaguuagaggcggccaggcacacagagcagcgcccucugguccugacggcaagcaccaaacaaccccucugacuccauguuggauuucaagaagcuccggcccccagacuucuggguuccauguggaacucauuauccaguuuuguguuccaggcugcucuuuaauauacauucuucucgguuuggacccuccccacccuucucugccagugggaagaggcucuugugacaccaagcaggggagugcggcucggcucuggcucuguggcuugguuugcagaacuccacgcccugggagcccaguccccaggucuuugucugccacuuugcucaugugacaguugaccagggaaggcagguguagaguucaugucacaacaaggagaggcaugguugagagcugcucaucuucugucaugccuggccucuccugcucgcucgcgaagcuccuggcauugguuugugcuuucacagaggaaggcagacacuggucuuugggacacagaauuagggauuaggguggaaggacucccucugaagaucagauuuaggacuaaagccaucuugauuguaguggugacacagauacuuugcuaagagcucaguacaguuugggaugaaagcccuccuucguaccuuuuccacaaaaugggggcggguaggauaagaaggguuaaaugugguuuugcuacugaagccaggaagagaagccaggccagggagggauugggggguggguaggaagggcugagacagcgggaacagggaacagcaugagccccacugcucacguuccaccacuggcucacccacccgccucugcuucuugguuaggaaguaggggagggagaagcagaagaaaugguuuuugcuguuguuuugucugggaaguugaauggcaaccacacagcccgagggacuacagggaaaggaagccauguccuagguucccuccccuagaugcauccuggguccucaccacacuggagucacccucacagaaauaagaacucucccagaacccagcgcaguggcaguggcacgugccuuugauuccagcacucugggggcagaggcaggcagaucuuugaguucgaggcuggccugguguacaaaaugaguucuaggacagccagaaguucauagagaaacucugucuugaaaaaacaaagcgccaggcgcacgccuuuaaucccagcacucgggaggcagaggcagguggauuucugaguucaaggccagccuggucuacaaugugaguuccaggacagccagagcuauacagagaaacccugccucgaaaaaccaaaaaaagaaaaaaacaaaaaaacaaaaaaacaaaccccccccccaccaccaacaacaacaacaaaaaaaaaaacaaaaaaaaacaaaaaaagcagcagcaacaacaaaaucucuuaagagucccaacucaagcccacugccuggaccugcaggaacugcaagcuaaucagcaauggacaggggaaagcacauggcaaaaggggaaggaacauggcagaaggggaugccagggccaguaaggcuuaggcuaggguuacaggagaggauuagacagcugaucgggagucuuugauggaggcuggagaccccgggacauggaaccaggggaccagguuacuguauugggagaucaucuagucagggcccacccagaacuggcuagacaggcaugcaguggcugaggaggggguagcuuugcuguucuugcucacaccguuuaagauggaaccaggauggagacccugcauuaacaacccucugaccccguuccucuuuucaggcccuucucgaagccacaaaaaucuggaaccugguguccuggccaugugcugaaugcacgcacagcacagcucugguaucuguuuuaaauuauccauuaaaauaaguacaguccuggaaaaaaauaaguacagucuuggauuugguuggguggagugagcugaagaaaggggcugaaacgagggauuucagcagccccuuuuuccagcugucuagguccaaaugaaaggggaggggggagugggcggggccaacuucuggcuucuauucuuggccuucucuuggggacugaggcuuauuucuuagaucuaaaacccaauguuugguuuuaaagccaaaaauauaagggaagugcauagguuuggguuuuguuuuuuguuuuuucccgagguccuugaucuuugcccccaaauuugagggcauaaaguaaucccucaguuaccuaaaaacacagccauuccuuugccauuccacucuccuggauuggccgcuucugugcgcgggggagaggugacucacuauuacuacugaggaaaggggagccagugguggaaguggggugagucacugaugggcagcagcuucagcccuccccccaacuuccuuggcucucuggggaugccugauccucucccucacuuugcaccuacuuccccuggucccucaccacuacccuuugcccacccacucaaauucuuuggcucugcucuuuacuccagaaggccaaaggcaagcuuagaguugaguaggcaggaaccaacauugugaagccccaggccagaaagggguguucugcagagugaggguuggcaugcuggcuccuccucaccauaccugcccccgccccuuuggguacaggauggcuccuuuaagagcaguggauccacccccuguagaggagggccuauuagagccucugccuggcugucagugacucaguguucgcgggaacgcugccucagccucaacaccagccaacccagaucccgaggugcgccagcgcccagcccagaucuccacgccugccaggagcgagcuucgccggcucgcugucccccugagcagccucuguccuucuguccaagucccgcgcccuucucgggaccccugcccagcgggcagcacugucacccugccggccauggagaccccgucacagcggcgcgccacccgcaguggggcgcaggccagcucuaccccacugucgcccacucggaucacccggcugcaggagaaggaggaccugcaggagcucaaugaccgccuggccguguacaucgaucgcgugcguucccuggagaccgagaacgcggggcugcgccuucgcaucacugagucugaagagguggucagccgagagguguccggcaucaaggcggccuacgaggccgagcugggggaugcccgcaagacccuugauucuguggccaaggagcgcgcccgccuccagcuagagcugagcaaagugcgugaggaguucaaggagcugaaggcucggugagugaggcccggccggccggcaccagggaggcagcagucgccuguaacuggccaucuaguccccucccuccccggaacugccucccgcgggugacuggcagugccaaggguaauagacaugauaggacauagaagggagggggucucugugagagggugggggauauaaagaguggugggggcauugagaccaaguagcguuggugacagggccuaugcugucaaggugggauuuuucagucauuuggagcuugggggaugggcuugaggaagguagaacaggcucuaccaggucuuggaacucccgaacgccgcccgggacacaucagaaugggugaaaggguuuuauuagaacuuucuugguagguuuggcacuuugccaaucuugcccaacguggcucugaacacaugauguccacuaagacauagcgcccacacugacauuuguccagugguacuguaauggaguuaccaaggcugcauagccccuuucucccauggcuguguaagcacggccuucuccugguucuuucuaggagcugagaaugucuggagcuuuuccuagacucucaggcccaccagaagcacaccaggagaucugcucccccgcagcucccacagcccuuggccucccuggucgaggaaugcaagggaggguggggagggagaccgggcacagaagcuaauggcucuggaaauucuguuaugccugagucggggacaccccagucugggcccucucuguuuggugacuuaaggguuuuggaagcucuguccuuuccuugcucagccagcgagccacuuucauuuuucuagucaagccagacuuuacucuggcccauccucugaacuguugaugucuugaucuuacuaaaccucuggaauacaaugacauuuuugaaauccagccguuagggagccucaggccacucccauugcacccaucccuaccccacccuaccccacccuacuuggcuccaccuacuuucuaaaaaggcuuuccaaagccuggaaguuugggcucuugcucccuguacuuccauuucgcucugugucuguggucuuuucuucuauguuguagacccaagacaaagagcuuuggacauuggacgugcgcacugauaccuaaggggcugguagcuuugacuucucuuccucuuuuuccuuuuugcauuaucuucugacaaaacccacuguguaucugugguuggucauucuauuccuuaccagauuccagcccuagguggugaguauggcaagcccauugccucaagugugagcagaggucaugugcacagauggguccagcuuuucuuucugcuaacaggaauuagcugccuuuucauccauccacuagggauaugaacaccuuaucaagaaauacaugaggcaaguuagaggagucccagugaguuaacuaguuagugaucuaaacuaguuaagucagccaccaaagcucuugcagauccugguguagaacuuguauaguagauguggggacagggacaguggaaucuauagcuucuuguucaucuagccaugccagucuccugcccccagugcagcuguccagccugggacaccaggugguguguacacacguuggguaggggcugggugauguguggacuuuuuaaauuuagccaccugccucuauucuccacugaugguaacugaggaggcugggcuuccgggaaggggguggguauacacaccuaggucccugcuggugggguggagcagaggcuaagugccugaccuucuguguccaucauagaagaccacggcugcuaccccuuucuauagcuguugagcucagacugagguggagaaaugcccuggaagucuggggaggaugaaaggcauuguccaguagccccucccaccaggggccggguagggaaaagugaccaguuuaauguuuaauuggagcucagaguucagggucaggcuuggaguuagacagaacugugagacccugugacaaucuguggcauagcucaaguugggucucucaacugcacccacaggccucugcuuuucaagguggauuguaaguuacaaggaggagguggagaagaggggggacaaagccaggcagugguggugcaugccuuuaaucccagcacuugggaggcagaggcaggugaauuucugaguucgaggccagccuggucuacagagugaguuccaggguacacagagaaacccugucugggggggggggaagaggggggaggagacaaaacaacucucuccuucccucuuuccuccucuucucaggagguuuagacaucuaagcugggagaaggggacaguuggaagcgagggaaggcucaccgcaggcuuagggcugggcaagccuuccuccagcuagacagcugcaugaaugacucagacgccaccccuccuacccuaguggcuuuauaagagacaacaggagacagggaguauagacugucugcauaucugcaucggcuauccucucuccacagcauccuggggucccuuuaucgucuccccuaucuugagguuuauuuaagugugugugagaguacacacacaugggccacggugugcacgguaggacacaacuuggggaauuugguucucuccuaucuaauauggggcuugggggucaaacuaugucaucaggcuuggcagcacgcacuguuacccauaaaaccuucuuaccuucuuccuuggaaccucugauaguaauucuagcacacaggaggcagaggcaggaggaucaccagaaguucugguuaggcuagccuagcuuacagaguuaguccaggcuauauuuauaguaagaccucuucucaaacaaaacaaaacaaaacaaaacaaaacaaaacaaaacaaaacaaaaggauacaggcaguacuguaguuacuacccaacucaccacucuuguggaacacucaauacucuucuuugugaggaaugacacaaauggaggucagagggcaacgugcaggaggcggaccucuccuuccacaacacggguggaacucaguugucaggcuuugugucaagggcuuuuacucaccaaggaagcaucugccggcacuccauaaacuaucuuuuauuuuucuccagaucuuuaacauuuuuauguguauaaguauuuugccugcauuuauuuguuuguuuguuuguuuguuuuucgagacaggguuucucuguauagcucuggcuguccuggaacucacuuuguagaccaggcuggccucgaacucagaaauccgccugccuuugccuccugagugcugggauuaacggcgugugccaccacgccuggcucaaauuuuuuauuuugaaacaggaucuuguuuuguagcccuggcuggccuggaacccacuguguauaucaggcuugccucaaacgucugccugccugugcuuuagggguggcggaaauaaagacacgugccaccaugccaugccaucccuaugcauacauuaauuaauuaacuuuuuuuuuuguuuuuugagacaggauuucucuguaguucuggcuguccuggaacucacuuuguagaccaggcuggucucgaacucagaaaucugccugccucugccucccaagugcugggauuaaaggugugcgcaacuacugccuagcuaauuuauuaucuuuugagacugggcuuuucuguguaguuggcuguuuuggaacucacucuguagaucaggcuggccuccaacucagagagauccgcuuuccucugccucccaaauacugggcuuaaaggcgagcgccagcacugcugccugauccacccuacgcuuuuaagaacagauaauuggugcuagagagaugguccaggaguuaugagcacugcugcucuucagaggacuuuauucaguucccagcacucacaggcaauuuaaaacugucugugacuccaguuccagggaaucugauaccuucuuuugguuuucacaugucuauaggcaaccucacaauacauuuuacacacauauacacacaugcacacacacaaauuuuuaauuuuuuuauuaaaaaaugaaagacugguagaauuggaaccaggguucagaacaggcacuauacauaggaauagaauggcaaaaagggauaggacguggcucuguaguacagugucugccuaucaccacacagacagagacacaggcacacccacacauccacacacauauacagagacacagacacacauacaaacacacauaaacacacagacacacaagcacacacacacacagacacacaagcacacacauauagaaacauaccacaagcacacacauacacacacagacacacaagcacacacauacagagacacaccacacacacacacacacacacauacagacacacacacacacauacagacacauacacacacauacagacacacacacacagacacaagcauacacauacagagacacaccacacacacacauacacaagcacacacauacagagacacaccacacacacacauacacacacaagcacacacauacagacacacauacauacacacacacacacacacacacacacacacacacacacacacacacugggcuguagcuaagguucaguuguagagcacucaucuagcaugauugggccugauguucaguuucuaguaccaguuagcuuuggcagcacaagcuuguaauucccagagcuuaagaggcugaggcaggaggaguauggugaauucuaggcuaacccuggcuauauggagacccagagugugaccagagugugcuuccaugagaaacuguuggagugaggcugaucagaaguggggacaauuccugacccacaaugcaguagcaccuuuccccccaagaccuuugugcuccauuguccccugcauuagcggacuucugagacuccagugcagagaagcagggggcugcaggcugaagucaucacagaagcagcacaggcuacggaaggcagagguuugucccacacccugcggggugaaaggucaggacaugagcuucugacuucugguggcuacucuauuaaacuuucucuagcaugaaagacagguuggaaaucuagccaaggcucacuucugcugccuagagauucugaggccaaugacacauuugccuccaucgguaccuggaaagacccagagcccugcuaggcuauauauacaucauugaacaguaacuugggaguguggagauugugccuucagucucaagaccugggguaggaaucggcuaccuagauuggaaggaggcugugcccuugggcagaacuguuaugucaauagagacagggucuuuaaggguaccaggcccuaggugaccccauucacauuccuaauagaaggaaagaagccagugcagcuacacccgggggcugaggaguacuuaaggagcccaagggaaacagaaaagccugccuuuaaucccagcauuugggaggcagagacagguggauuucugaguuugaggccagccuggucuacagagugaguuccaggacagccaggacuacacagagaaauccugucucaaaaaaagaaagagagagagaaagagagagagagagagagagagagagagagagagagagagagagaagaaagaaagaaagaaagaaagaaagaaagaaagaaagaaagaaagaaaggaaggaaggaagaaagaaaaaaagaaagaaagaaagaaaagccauuccccacuaggguccccagacugccuuccccuggccucaaguggucagugacacuccucaguagcucauugucaaggcugaagccugggcagcugggaggacagcugggaggacgcuuucugccuucaccuacagcugugcccucugcucuccuuacagccugccagcccugcccggcucuaacagccauagcuagacaugagacuaucuggagacccagacacuaggaagagucucuucuagucucccuuccuugguccggguaaauaugcugaaggugacccaggccagcucuaacauacauggagacacuggagaaguuacaagaccuguuaucucucaguaagauguuccacuaacaaagugacagagugacagauaguguuaguucauaguuaaaacaguuguggcccucagugucaguggugucccuaucucuagguucacccuugucccuaaaauugcugugugaccuugaauuaaucaacccucucccuuaauuucccuaacaguagaagaaagggaguuaggacagaccugcaccuuggguuucaaagcaguacaaugacccauaaaguaagggaaaguccucuaaacaccacgugagaguaauaaagccaagcacaauaauuggaauauaguuaauagccagugcagguuguuuuuucuuuauuauuauuuuuuauagaacuauuucccacagcagugggauuauaaccaguagucuccuuccggcuucucggaaagcgccugcuggaguugguuaauuauuaugacaccacugucuuggcguaggcuuuguuuucacugcuguugagaaaaugaaguucaucuuagugucugccuaccuucaggacaauagaauagcccuaccguguagcaggauagccgcccguggcaccgacugaccaguuucugggcuggaaggggggcucccaggaaagacaggacugaucuguccgacugccaaggucagcuaucacaugccagaagccagcggguggugcgcagugaccuuaccuaucaccugccccucauauugguguacccagccaauacccugugagucuuggcccuuacaaaucccuuaagaaaagggacaauauuugggaaggggaucacccuaccuuacuguccaguuauaggagaggaagccagaauccugccugccgaagcagggaauaauucaggccugggauccugggcccggaagugggagcugagucauggauggugugcaggguucagaguggaugggagaccaagcgcuugucugcucagugcagaagcugcugaggugggcuuuccuuacaucaagccacagcaagaaugagucuggguuuggugggggauuuagggucaccucagagagcuaauaaccuuuuuuaaaggauaaggcuucuggacagaguggccacgggugaggaagcuuuuggaaagggaaaggcuccuuugccucccugaagaagcucucugccugccaucucugccagccgggaggaccuguugcaucgcaucguuccagguuuagaagugcugugagaccagaaguucaaagcuuuccucugcuuccucuccugacuugggguguggcucagacuuccuccugagacagucaggguuaauaagugugugcuaccagauagaggguggcugauaagucccaagaagucacacagcggagugugacacuuuccgaggagucccucgggucaugcugcuuuguuaggacacccuuaccuuccugcugucucacuuuuaucuguccucaggcccuacccugacaaugcaagcuugacugcuggaauaguaggcuagaaagaagagaaguggaguucagcaggagacuaaagggaaggcaggaguggggaaaagcugcuauuggguaucuaggaccccuauguucuggccucuggcuccaggcuucucuucuguacaaugccacguugauauauccagcagcugugacucaggccuggccucuugccaggcccagugccucugcuggaguagugucuggacaugucaacaggccuccuauccuguucugggcaccagagcccuaccagacucucccucguccuggaauuaagacuugccuuuguuuguggggaaaggcaacugagauccugguugcucuggaagcagaucugaggccugagaucccauuagagucuaggccuguccaguagucuaccagaggaagcugagcuuugccaaccaugggcacacgugccugcguggggaggccugaggugguccagaccguggcacuuacugugugcuuuucuuuuuucuuuuccuucaucccuuccuuuucucuuuucucuuuucucuuuucucuuuccuuccuuccuuccuuccuuccuuccuuccuuccuuccuuccuuccuuguuguugcuguuuugagacaggguuucucuauguagcccuggcuguccuggaacucacucuauauaccagacuggccuugaacacucacagaucuccuccugcuucugccucccaaguggugaaauuaaaggcuugugccaccaccucccagccuuaaccucgugguuuucaaaugacagacauccagaguuucacaggacagguuuggaggacggcucaggaauaccugccuugcccacuucuauccuugcucagcaugccagaguggggcagcccacauccugccagaauuugaagguggucacagaaccacggaacagccaagaaaccaaguagugggcagugguuuucuuggauggcugcagaauccagagcugguguaagcuuugaaaguaguuagggugguagauuccuuaggccuuuguuguuuugauggggucucccagcagcacagagugaggacuucuaaaaggacugacuguguauccccauugcucucugcagcccaugugccuccuacgacuuccuucuuucuccuuccucacauucccgaaccaucuccucccuucucuuuuuguccuggaguuagacccaggacauuacaccccagccucuaggucaguuucuuuacucagugucccugaguguucugaguguacuccggugacuugguggguagguuuguagugucuagggcuuuccugucuacaucugugagagaaagugcagaaauuaguccaaagguuaguccagaagcccugaacacuaaacuuuaagguauuaagaggacguauacaaaaacucaaagaucccgcugguaaaaacugggcugagguggagcucugaacauguggagaacgggcgggcgggguugcugugcuaggccagauauagaaagcuuucuguauuuaauacacaguacaugcaucauucaugucuacauaauuaagauaaaggaagcugcauuguuaaugggaaaaaaaauagggucugggaauguagugugccuagcauuuacgaacuucgggguuuggguuugaucccagcaucucacaaaccacguguaaucccagcacuuggaagguagaggccggaggauccgaaguuuaaggucauucuugacuacuuagcaaauucggggcacccuaggauaccugagacccugucaugaauaaaaauaaauaauaaauaaaccaauaugggucuagguugagcagcagcuugggcaggguagggccggaaguuagccagguagaggguugcagucccaggaggacccuggcugggagcagcaccucaguccccugcccaaccacagggggccaccgggucuuuccggaacuccugagggcgcaaggccuugcucucucuggcccagccauggggaacgcggagggccggugaggcaggcggcaggcgggcgggcggggcgcgggccgucauccccuccugcuccuuauuuuuagcccaguguagagucugggccgccugucccucccccaggacagggggaggaaaugcaggccacucccuccgggcuuaggcuguugcuccgggcaaccaggccaaacaggccgcgcggcuuccauaucuggcgucugagguggcugaggaggaugacucagugggcgggucagcgccuggccccgugcccagcccagcccuucugcuacugcugccuuucuucccuaaagcagcccgggggaccccagccuggccccccaccccucacccgcgucggcuucucacuuaccuuguuccugacugcucugcuccccucccccaugccccuccgugugccaggauugcccaccgggaugaguuaaaccggauacccaacccuucuggccccggccccuggaggcagcagggaugcaaccacuccuuugcucacgcagagcauggcaccgggccuggcacaggguauaggcaggcagggucucacugacccccugagagcacuagaccacuucccgcccccugcccugguauuguggcucugagcaugagucacaggaggagccccgguuacuaccccuucccagcaccccuggucugccccacccagccuuccauaccaacccagcacaaauccagcuuucccacuaccacgcccagugggcuggaacuggaccacaccucuaugcagacacagccagccuccuaggccuguccggugucugcauggccagccaggcugaggucuauaacucuccuaggaaggaaaugguguuugauagaggacagcuauuuaccucaaaauuuuuucucucuuuuaaaaaucuguuuuaaaugauaucaaauaacuguuacaguguuaaacauguacccugcguuacuauacaugaauucuuuucuuuucuuuucuuuucuuuucuuuucuuuucuuuucuuuuccuuuccuuuccuuuccucuuucuuucuuucuuucuuucuuucuuucuuucuuucuuucuuucuuucucuuucuuucuuucuuucuuucuuucuuucuuucuuuuugguuuuucgagacaggguuucucuguauagcccuggaauucacucuguagaucaggcugcucagaaauccgccugccucugccucugcugggauuaaaggcgugcgccaccaugcccggcucuuuucuuucuuuuuuaaagaauaguaugucacuauguaguccuggcuggucuggaacucucuauguagaucaggcuggccuugaacucccugagauacgacugcuucugcuucccaaguguugagacuacaguugaaaucaccauaacauguuuaaaguaugagguuuuuuuuuuuuuaagauuuauuuauuuauuuauuuauuuauuuauuuauuuauuacuuguaaguacacuguagcuucagacauaccagaagagggcaucagaucucauuacgggugguugugagccaccauguguuugcugggaccuucggaagagcagucgggugcucuuacccacugagccaucucaccagccccuaaaguauaaguuuuuaaaaaauguuaaaaaaaaaaaaaaaaaaaaaaaaaaaaaaggaauuucugggcuugguggugcagcuuuaaucccagcagucaggaggcagaggcagacugcucucugaauuagaggccagccugggcugcaaaguuccaggacagccagggcuacacaaagaagauuagagaaagggagagguggcaugcccuaccccccauuucuuagggcgugcuuguggcucugucuauagagucccaaggucugagucaugagcccaugggugauaguggcuucuucccccuagauggggcuccuaaugccugacuaagaaaaccacaaguucuuccuugauaaugugugcuugagguuucccucaacugcaggguaugucuuaguccuuaauggagucucuucagcgcugggcaaagcacuggaagagaccagagggauggaggaacagcccccugaauuuugcucaaggcauaaacacaagcucugcguucugcagggcccuggcuggagcucucaaccccugccuuuucuguaucacacugguaauagcauccaucucugagggcaguuaguucugucaucauuacagugguaccuggcaugcaauaagcucaugacaaguauuugcuauuacagccaacuuccacauaacaauguuucugucaguggcaagucauguaugacgagggucccaaaagcuucucucaucuagugugaucacacugugauguuugcacaaugaugaaacuaguuaauaacuucucacaacacaacuccgugguuaugugacacauggcuagaugaucauaaaaacccagcccugugcauaacuccuggagggacaggacuuuuguacuacuucucaguacagccaaggacaaggggaacccugggaauuccgccucuagugcccaaggagucagggcuaggagguguccucgaggcuaagcauccucagcucagucagagaugaguuuguugaaagggauccacuccugcuccuggcuucuuucugcagucucuccacccacagagcuuaggagggcaguggggggcgggggagagugugagaaugucagcuuagacacugccccuguggcugucugccaugcuccauguuggccacgcaccauccucugugacucaguuuccucaucuguaaaagggggaggucgaaggacucggagcucaccagcagcaccccagccggcuggccuucaggauacagaggcccaucugggaagccgcugccagccuuggagcuggcccaaggagcucggauucugucucugcaacuugcugccugcacccguguuuuuuucuucauuuucuuuccuccccugcagcugucucagcuucggaaaaguucugaagucauggaaaguugggcugugcuucuagccagggcugggccggauggcagccagaaccugagcugggguuugacuuuauuuuuagcuuuucgugcuaagauggaggaggagaaauagucuuugguucuggaagggccucugcaggagaaagacaccguggcauuaaaucguuuguuucuugguguggagggagcaacacacagcuuggggagcagccuccaggccucugcacucuucccugacccucugugguccucccagaccaguacaaccuagguggaggacggaggaggacgagacucucugaaaccuccuuaguuuccaagucuagccuuuucucuacugcugcagguggacugcuaggccuauaacugccuagagacuugguagcaagacaaacauguugacagggcugcucuuccugaagugggccccccugccuuacuugcucaccuaguucccuuuuuaauuuugggauguaucaugcgcaugcagacacgagcaagcgagcgagcgcuggucugcuggagguagaggucggaggacagccucugccgugggucuuuuacccuuccccuugcuugaaacacguuuuuguuuuguuuuguuuuguuuuguuuuguuuuguuuuguuuguuuguuugccgcuguacagccagaauaauugagccacaagccccuggggauguucucuggagcuccugucucaccucagaaacgcugggguuccacaggcagguguuacccuacccagccuuaugcagcuggggauccacacucaggucuucauguuuguguggaaguuccugacccaggaccaucuccccagcccuuaguuuucauuuugcuguggugggcuccucaugauaauccugcagaugcuacuagugccugcccccucccagggucuacugcucccccucccucuaguacuuaugaaaggauuauggcuggaaaguucucaggcuuuccagagauuuuucaggaaauuaggacuucucugcuucucuaguucacuagcagaaagaaucaggaauguuggggaggcagaggcauucccgggugguagagacuaacuaaauagcuuugucuacuuuaaggguaggguguggcuccagacuggaaccccaugggucuggaguccugggauagacaucuggaacagaugccagaaagccaagcaguagggaggauuuagucuacugucggggaucugagggaggauuccucuguuguguggggaucagaggucuuaagacuaaaucccaggaagagaaaggucucauauacuucccuuauccuugucccuggucucccuagggagacguuuccccucaaagucccacauaggcaaaagggaugaaacuaauuugaaacuccaacuggagauggggcggcagugugugugggagggggagccuuggggugugcguggccaagacacucagucugucagcuccagggagggaagcaagcugaauggggaaacggguggagugcagggaggaaaagguuaaggcccugugugggaagggguaggagacaaaggugcccugucuauuuuagagggaauaggaggcaaagagagccaggcauucauaucaucugaucuagcuucgccauuggccccaggcacguucuugggcccugagucaugggaaggguagagaagaaggggcuuuugggaaaucucagggguggugagaacccagccucagaaacugguggaugccaacaauccuaauguaaugaugcccucuucugacagcugcggggaccgcagagaggucccaucccagaugcacuccugaaaccugcuuuucuuuuucuagcaacaccaagaaggagggggacuuguuggcugcgcaggcccggcucaaggaccucgaggcucuucucaacuccaaggaagcugcccugagcacugcucucagugagaagcgcacauuggagggcgagcuccaugaccugcgggggcagguagccaagguaggccgcuguccugugaccccagugaccccaccugguccgacauaucauucggucccauuugccugcucaccuucacuucuccagucuagaacacugcucauccuaaagcaacccacagcccaguucugguuccccuccuccugucucccuagacagcuccaagcacuucagaggagagcuguccacugaggccauaacagaguuggguuuuuuuuguuuguuuguuuuguuuuuaaaaagauuuauuuauuuuauguauaugaguacacuguagcugucuucagacacaccagaagaggacaucagauccccauuacagaugauugugagccaccaugugguugaugggaauugaacucaggaccuugaggaagagcagucaaugcucuuaaccacugagccaucucuccagcccccauaacagagugcugauagcuaauuauaccuaggugugcugccugugugugcaguguccgcuacuuuccaagcucuccucucugcaacucugcucucucaugcugcucaggagugaagaaguuagggacacaguucccugcucuccucccuccccagcucuuccaggccugcaguugcccaagaugaacaccuuagcuuggugcuuccccuggaaaccauucuccagggcaguuaagggucucuccuccuggucuaacccuugccugcggguccuacucccuccuccugcacaccacaccccagcagcacuucagcuccagcaagaccugucuuccugacaguuaaggaugaugucuguaccugaccugccacugcagccacucaugucccuucccagccuccacucacaugcccuucccaggucuucccacccccacccccaugcuuuguucccaucuuccugcuccugcugcagucuauguggaccuccuucauaguaacugcugcuccaagagagggagauccugcacaggggaauuuacuauuaauuuuaaauucuuuguuuuuucacuuuuuuuuuucuuuugugggccccugacaugccccagcacacauguuaagaccaggggacaacuugcaggaaccuguccucuccuucugccauguaggcucuaaggauggagcucagguuguccgggccuaauggcaugcgcccucaccugcugggccaucuuacaggcccucacccuugauuucuuagugccauggguagaauguggguguccuuucuuccccccgugggcacugaaggccuucccugccucuagacccugccucuagauggggacagccaucaccucuccuuuggcauuuccugaacccccucccaccucuccaugaacuuggcuuucucccucucagcuugaggcggcccugggagaggcuaagaagcagcuucaggaugagaugcugaggcgaguggaugcugagaacaggcuacagacgcugaaggaggagcuugacuuccagaagaacauuuacagcgagguaagcgucccgcuguacaggucuuucuuacuguggacagcugggaggggucaccuaauaaugccaggcuaagcgagggcugcccgugccuggccgguggaguuacgacuucuggucucagcuucuaaggaaccauugcgauguucuaaucuaagugucuccccuuaacccuuucaggaacugcgugagaccaagcgccggcaugagacgcggcuuguggagaucgauaacgggaagcagcgagaguuugagagccggcuggcagaugcccugcaggagcugcgggcucagcaugaggaccagguggaacaguauaagaaggagcuagaaaagacauacuccgccaaggugcuggccucauccuguccucucccuggugcugcccuggggacgggugggugguggcagggggccagggaugccuuccucaggcccccagcuccagguuccugcucucauaacugugugcucccugcagcuggauaaugccaggcagucugcugagaggaacagcaaccucgugggggcugcccaugaggaacugcagcagucucgaauccgcauugacagccucucggcccagcucagccagcuccaaaagcaggugacccucaguuuaccccucccaccuuggcucuggucuaagcagauacugcagaagcccacugagaagggggugggggagggacuccaggaccacaugcuaugguucugaaucugaugccugucuggcuuuccagggcucuccuuuagcuagcccugauccucagagccucuauuuuacugugcaugaaggguuuuucauguuucuucugugccugccggagacugaaccagaggccucuugcuugguagauaggugcuuucucacugaguuacaaacccagccgcauucccuacuuggagauagagcuucccuuggacuggacauguagcucaguugguacagugcuugcuuauuauacacgauggccuggcuucuauccccaggaccacagggaacuggguggugcaugccuuuuaucucagguugaaguaucagagauucaaggucacccuuaacuauacagcaaguuugagaccagccuagacuaccagaccuuaucucaaaaaagaaagaaaagaagccagguuguaauagcacaggccuuuaaucccagcacucgggaggcagaggcaggaggauuucugaguucgaggccagccuggucuacaaagugaguuccaggacagccagggcuauacagagaaacccugucuugaaaaaccaaaaaccaaaccaaaccaaaauaccacaaacaaacaaacaaacaacacauaaauaaaaauccuuaaaaaaaaaaguggaaaaugaugaacauucuuguccuccgggacucccaggucugucaugacacugcagugugaaauguuacuugugucgauauuauuugucacaauagcuacacuauuugugacaaaagaagaugggggucuagccucggaaugagagguuucagacagacauuaggaagggcuuccuggucacuggauaaggccaugguggcucuagagagagccuacagauccugagugucccucugccugccccugugccccucccucuucaucgacaucagcccuugggagcucaucagacccuuugucuuccccgccccaguuggcagccaaggaggcaaagcugcgugaccuggaggacucgcuggcccgugagcgcgauaccagccggcgccugcuggcugagaaagagcgagagauggcggagaugcgggcgaggaugcagcagcagcuggacgaguaccaggagcugcuggacaucaagcuggcccuggacauggagauccaugccuaucgaaagcugcuggagggcgaggaggagaggugaacuaggaggggucuacagaacuugucaggggccucuggccgcaacuaccaugacuaaccccgcaccgugucuccaccuuccccaggcugcgccugucccccagcccuaccucgcagcgcagccguggccgcgccuccucccacucaucccagucucaggguggaggcagcgucaccaaaaagcgcaagcuggagucuuccgagagccggagcagcuucucgcagcaugcucgcacuagcgggcguguggcgguagaggaagucgaugaagagggaaaguucgugcggcugcgcaacaaguccaacgaggugggccugugaaccaggguggucuuuucaguggcugggaguucuugguucucguggagcaucugucucccuaucugagaauuuggagugugugguaguccugucaucuuuaaauuguugggaagaugcaugauauagggaugggugacccuugagccaauagucuagguuugaaugccagagguagugguggcaagccugucuuucuuuucuuuuucuuuuucuuuuucuuuuucuuuuucucuuucuucucucuuuuuuuuuuuuccgauggggucuugcccagguuggcuuugaucucccuagauuaagcuguuccccugccucagccuccauaguagcuggaacugcaggcgcacacuggcgcccagccuaccuaagcuccugagugagauaauccaagagucgguugaacucccuguccuccuuccuccuuccuccuuccuccacccuacuucaggaccaguccaugggcaacuggcagaucaggcgucagaauggugacgauccuuugaugaccuaucgcuucccaccgaaguucacccuaaaggcugggcagguggugacggugaguggaagggcacuugggacucuggcuggaguggagaaguuggccucaggacaggagcauuaaaaauaagcacaucucuuaaaccaucuuuucccagaucugggcuucaggagcuggggccacccauagccccccuacugacuugguguggaaggcgcagaacaccuggggcugugggagcagccuucgcaccgcucucaucaacuccacuggagaagugaguauguugcagccgguagcuugcuggacaaggcucccccugguggccauaaugggaacuagcuaccuccaacccaagggaaccugccuuggguuuaggaucgcuuuccugagcccaagucccacccaguaagcaagccagaagucuccccaguagaauaauggguggaagucagccagugaguguuaauagcagacuccagcuuacagagcaccgagcucucaguuguguccuuuuugcgcgugcgugcgcgcgugugcacaugugcauguguuuauccuuaguccccagcaucagagguuggacaagguuguauaaaggcccgggacaguucuaagugguuacuauggguagacaggcugcacagcccucacccccugacucuugggccugggcuuauguccccacaggaaguggccaugcgcaagcuggugcgcucacugaccaugguugaggacaaugaggaugacgacgaggauggagaagagcuccuccaucaccaccgugugaguggcagccgccgcugaggcccagcccacaaggguagcccugccagccuagggcagcucucccaccuccaugccaaagucuuuucauuaaagaauguuuuggaaugccacuugcugcccuggccuuucuucucucuccucccucuaccuugaacagggaacccaggugucugguaaggaagggaguggggacuugcugaugccauggauacuccacgguggcaguggacaggguucuggauuuguguccugggaaggggcugggaggacagagguggccccagcccugccucucuuccucacucccauugcaugcacacuucucuccucucuccuuccacccuauugcaugcuucuccucagauuucccugcaacaauguucucuuuccuuccuguccccucacaaauuaagucucuccaucuuugcucuuccucuugauugccccauaagugucuaagauucaggagagaguuaaagccacagcucuuuauuucgaaggcuuccuggcuauuucccccaucaugcccuuccucccagccacaggucucccaaguccccaucacuugguugucuggguacagacagaggucaccuuccugcccaauggccaggaagcuccaagagcccacagccuaggugccgguccuaagaagucagucccaaacucgcugucccuccugagccuugucucccuucccaggguucccacugcagcggcucgggggaccccgcugaguacaaccugcgcucacgcaccgugcugugcgggacgugugggcagccugcugacaaggcugccgguggagcgggagcccaggugggcggauccaucuccucuggcucuucugccuccagugucacagucacucgaagcuuccgcaguguggggggcaguggggguggcagcuucggggacaaccuagucacccgcuccuaccuccugggcaacuccaguccccggagccaggugagucaucucugcccuacagcaggacacugcucacugagcagcagggcagggcagcccaagggaguggggucccccuccuugcagucccucuugcauccugccccuccugucugaaccccagacucgaggucagggcaaggcccagagugugaggguuggggagacaacccccuuuggggucagggagggagaggaagggccagccacugcugcucacaccucugccuucucuucucucuuagagcucccagaacugcagcaucauguaaucugggaccugccaggcagggcugggggcagaggccaccugcuccccccucaccacaugccaccuccugucugcuccuuaggagagcaggccugaagccaaagaaaaauuuauccccugccuuugguuuuuuuuuuuuuucuucuauuuuuuuuuucuuuuucuaagagaaguuauuuucuacagugguuuuauacugaaggaaaaacucaagcaaaaaaaaaaaaaaucuuuaucucaauccuaaguccuuccccuuucuuuccuuguaucugccuuaaaaccaaagggcuucucuaggagcccagggaaaggacugcuuuuuauagagucuagauuuuuguccugcugccuuggcuuuacccucaucccaggacccugugacaauggugccugagaggcaggcauggaguucucuucaccagccuccuccaacagcuggcccacugccacgccagcugcagagaaauggggcgcagagaggaugacugagaaggucaagccccuccccggcacuacacgaggccgaggcuccucugccugccuuaccuucuuccugcccuucccuagccuggggcgaguggauucccagaggcaaaucugccgugcuugcuuuuucuauauuuuauuuagacaagagaugggaaugacggggaaggagaagggaagaucaguuugagccuaccuuuucccagcuucugagccuggugggcucugucucaaugauggagggcaaugucaagugggauacagggaagagugggggacgaaggcucccagagauggggagaaccugcuggggcuggugagaagucuagaggugcggcgauugguggcuacagcaaacacuaaggaacccuucaccccauuucccaucugcaccucugcucuccccuccaaaucaauacacuaguuguuuccaucccagaugcuguggugucucuuuguugggugugauguguguuuucaggggcagacacaugcacacagaggugccacacauucacuauauauucacuacccagcuauaaagguguguaugagggagacuucuagaaaggucagcauauguggggugagcgagggguguccuuccuaucccucauccauccagcaccuuuuaaaaggggccagcaauccacaugugcaucagacacaggagcacagagagacggaggguagaguaggggccagaaguagcagagcuucccuugcugccccuguagucgcagggcucuggaugcugugauugccucuguaggccgagauacucuuaggaaaggaaagaaaaggugggguguggugaguuugaggcuaaucugguauucacaagacccuguuucaaaagucuuucuuggagcccagcaguggugaugcacgccuuuaaucccagcauuugggaggcagaagcaggcagauuucugaguucgaggccagccugcucuacagagugaguuccaggacagucagggcuacauagagaaacccugucucaagaaaccaaaccaaaacuaaacaaaagucuuuuccugggagaagagcugggcguucagucaaaagugauugagggcuggagcaaugacucugaaaugaagagaaccugaguuggguucccagccccccagucaaguagcucccacugccuguaacuccagcucgaggacauacaacaugucuccagaaugccaagucuauguacuucacauaugagcacccaccccacacacauguacacccgaauucacauccacacacaaucaaaccuuuuuaaaucauugaaccagucaugcuauugcaugccuuuaauuccagcacuccagagucagguggaucucugaguucaaggccagccuguuuuacauaacaaguuccagcaaccagggcuuuauaggagagacccugucucaaaaacaaaacaaaaaaaucacaacaacaaaaacaaaacaagaaacaaaacccaaagugauugaguccaagagaugucuucauugguagagacacgugcuaaaccuaaaccccaccccugagacacgcaugguggaaggagagagcuaauuccugcacgugaucuucugaccuccauguugccauaugcagugugauuccauucuuggggagauugaacaaauuacuuauuuuuaaaacgaaagagagagagagaacccagcugccacucuucaacugacuuaccagaaggaaaaagaaaacugguucuccucuacccuguuauaaaaaccaacccuaccaacugaauguuccuccauucuagaucccaugugucucucuauccauccuccugaccucucacucuaugguuuuuuucccuguguucacucccugucaacugguugcuugcucca

SEQ ID NO: 1488 - RNA, 1384 nt, Mus musculus
gggaggaccuaccauuucugaaggcucucuucuuacaucuucagacuuuauauccaaccauacaguauuauuucauuacauguauucagugcuuguguguaccauauccugagucgagaucugagauucuccuuuuuaauaauauguuuauuuuacauacauuuuacuugggauguguaucuguguaaggguugucagaugcucuggaacuaaaauuacaagacaguugugagcugccaugugggagcugggaauugaagccagguccgcuggaagaacaguugguguucuuuuuuuuuuuuuuuuuguauuuuucccugagacggggugucucuguauagcccuggcuguccaccugccucugccucccaagcgcugggauuaaaggugugcaccaccacugcccguccagucggugcucuuaacugcugagccaacucugucuagccuagagguucucucccucuaucaugaagguucuagggaacucaaggccuccggcuuggcagcaagcaccuuuaucuguugagccaucucaccugaccuuucgaaugauucaaucuucauaauuccauggaaauguaauuucuaccaguucuugacauaagaaaccugaggcucagugauguuaaauaauuuucccagguuacacagcugcuaaguggaaacugcacagagagagagagagagagagagagagagagagagagagagagagagagacacuccugguuccccagaggugggcagugacauuaagggcuuggagacuuccaaggggugaguaguuuggggaggcuuccuggcugagguggguccguuggcaucauuaaaaaagaaauaagguucgugggaagggagagacuugggaguguuucuggagguugugugggaaguaacuagggaggcuugcgaguuaggcauucuggagagcaauggguacguguggccaccagguggcgccgcaggacuccuuugccucccauuggucuggagggccagggcucaagucugacuccuuguggacccggugcuccaugcucagcccugcacaguucaggcacccagccggcccuccgguuuuuggcauggcaucuaacacguggaagacaggaaaucuugauaccagucuauuccagauucagaauggaaacccaaaauagagccccccuccccaaacagcauacucugccuuccuguccugugccuuccugagucccuuagagauacuguuuagggaaauuguuaaggauacaagcauugugugcagcuggcugugucugcauggaaauaauaauuaccuaauaaagauguaaaaguuuucauccggugaccauugauugaagauuuguugugcacauugcucuaggcacugggggggggu

SEQ ID NO: 1489 - RNA, 8663 nt, Mus musculus
cuuaaguaauaauacuuuuaauaaaauuaacuucucaauagcacauuuaauacauuaacccucccccuucuugguuucucugcauugugugcaacaucacuuugacuugauuaauucaugggucuguuuuauuucccaccuuuacuuugcauuugaaaucuuccuuggugauuuguaugagucacuggaugccucaaauuaagucugaccacgauccuacucuacuuucuacaguggagagaccaucuucccugccccagggcugucuccacccaaccacucgacccucugagcacucacccucgagcaugcuagggaaauccuccccauucccagaugcuaccaucuccaacuacugaggguccuagggcaaaaagggcagggggacuucuagucucuagauggggugagaagaguaaacugcggagagggagaaguguuugggcucuagggucaagaaguggcaaugucaaucacuggugucccgcuugcuuaagcuaaagccaagaggccucucccauucccgaucugauugcuagcuggggcugauggaaagaaggcaagugcuuaaaaaugccuauuucucacaugcaaagccaggcuuccggauuucuguggggaagaugaugugauguggcccuaaugggugauucuuaucugaacacagcugggagcugugacacaaggguugcacagaggccacccaaguuccugcacuuuuaucuguucuugggggugggauggggugggggaguucucccaggcucauaaggacaauacuugcacucuacuuccugagucggaagucuuucguggaauguuaacuucuuugagacuccaugaagccaggaguaguggugcgaaccuuguaggcccagcaacuaaaggcagcaagauggcugcuaguuuaaggccagacugagcuacagacccugugucaaaaaacaacaaaugaacaaaauccccacuacagaugugaagggaaacagcgcuagaaacugcaaugccgcucucauacugcaugggugcuggaggcuaagcugaucagcaguugcuggcucauucacagaauagcuccaccuggcucuugaacccacugguagcaagauggaccgaggugacuucaaggacuuccucaggguggccugggaggguuggacauuaggaguaggggcuuccuaacagauggccaggcucagccgagcugcacugagcuucggaugaccaguguguacccuugcaaagacccugggacagagccucuccuguacuuaucccacacuuaaacccaaggauucucagaaucaaccccagcagacuggaagcucccaaucucagcuagcagccugcucuagcccuguccccagggauagggcagcucagccacuggccucuauucuuuuucuucccccauacuuuuauacauucuaccgggcucaggggcccacaaugcuacuaaacuuuaagcuaucuugaguaucgucuacuaaguaacuaguaauucuuuuucuuucucuaggauuauaugaaauaaauuugaauuauuuuguaguauucucuucuuuuaaaccccucgguuuuucuuucucauuuuuuuuuuuaauuuuuugguuaaaaaaaaucuauuucucuuaaaucucacaccucugaggguuucagucggccaacuaggccucaguucugguuuucccuccugacugccccuggcacaggguaggggaaggagggacacuccaggacccucaguccuuagucccaaagcugcuuccuuucugguuaaucccuuccuuuguuuggcucugccggcuccccugagggggagggggaggggagcccacagaaugaaauccaaucuacuggugggggccccagaagggaccaacucccuauccccucuccaccauccaccccaggaugcucccccaagaaaagcaaaugacauuucuccccaaaaagaagugggggaaaaaaaagaacauaaacccgaacauauauuaaaaacuuuuuuuaagauuuaacucugaauacaaauguauuuuuuuucuucucucccuacauauauucuaaaccuucuaaaguuuuuuuuuuuaaggaucacuuuaucauaaaauaaaauauccuuuucauauaauaaauuaccuaauaaaaagucuuuuuuucauauuagcccagguucuuugcuacauuuauacgguaauaaaugccuuuauuaaaauagaauauuaaauuauaaagaacugcuuuuuuuucuuuuuuugcuauuuuuguuuccucuccucuguuggucgcccaucucacucccccauugcuuuguuuugcugcucgcucacuuuugcgcuuguuucuaggaaaggcucacucagcaagggugggauuggaucuguggagccccuaguguaacagucuuuugccuuuguggguaaggaguggagagggggaggggacugacagacagacaucccuucuucccaccccccucccauccccugccccugggcaacccagggugcccauuugguuugguuucuauuguacagacaucucaagauggcucacauugauggaaaggagggaagcugccacaggccaguuuucugggcugugaccuccuuccucuccccucccaggcugguggucuggaggggaaggcugaggagaggcaaguuaauucacaagaggcaggagagagagagaccucccucugcccucaucccacauccuuuccccauccaggaagagugggacuccugagcuagagcucagaauaucccacccaauuauauacaagcaucuccugggccuccuggucacccauccucuccuggcccgaccagcggaacccgggagaguaggaggcugcugacagacacaagugagcaagaggaguagugaaggggugcuagaccuaucacaauaccugauuccuguaacaggcuccaccgcaccccaauccugcuuugcccuggccugaccccucaccaaagaucuggccucucuccucagccaguggguaagacagagaauucaugauuuguggcuaauaaggacucaauaaugguucagcuaggugcagagagaggucggggguaggccacugcaggugagggggaggggagcccguccagacacaucucucuugccccaggacuuuuccuacuuuuggcuuucccuugccuugggcagaagacccaggauaagaugcucccuaaguauaaugcccauagaugauaaaggcaggguuccaaccuuucauguaccccauuacuaguuucccgucucaaacugauucuuuggaggagugggggaaaagggcuguccucuacaugaagaggaacuggaggugggggcuaucaaaacacucuccagacuucucucccaagaaaaugauauccccaaagcugggcuagaagagguaagaggauggaaagaaacauguggcugggggcugagggagagggggacagaauagggaaaacaacaacaacaacaacagaaaccaaagggcagauccagaaacaaacaaacaaaaaaaaauugggggaaaagccaagcaaacaauugaagggggaagagaagccccuuuccagaucucuagcccagcuuuguaagauggguaaguugugagcccuuuaucgacauccuccaucacccuggaagaucuaugcagaucuuuaauaggcccccaucucccuauacuguugggaacucaggauaugagugagugagugagugugugugugugugugugugugugugugugugugggcuaaagggucauguuaggagaugggaggucaggaccagagggcuagcgaaucaggaagagcaccucuaacuacagauggcaagucucccuguucuuaccccuccagagaaggggcaaaaugacauguggauagggagaagggaaaggucaggauguguguccugguggccacuucuggcuaaacaaaagcuucucuuagcugcuuccagauuuaaggguguguugagguaucagaguuguaacucuaguaaaacuuauggccccucccaaaggguaaccagaggcucugaaaauggccccgcccccagccacucaggccuccuuguccccaccccagcgagugaauauuuccaagcaccuugcccuguagucacugauuuuucaaaaagcccuacagguccagggcagcacccgagggagcgggcccaggagaccagggacauggagcuuaggaaaauauucggauggcuuguguggcggugauguggcagacaggacacucuggguccguccucucgcagaugcguacugcacacuccaugcagaaaagguuguguccacagggcaccagggcugcugucacuucacucucaaagcacaccaugcagucccgcccgcugccggggcuccgcagcccgccuguccccaguuuagagaaacccugcaguggcucuccggguggccuccgagggagcccggucagcugcucuggccccgcagagguggcaggagagcgaugcgcgccuggggggcccgcgcgugccuuggcugaagaggaggaggaggaggcagaggagaagagcaccgaggugggcguggcauucuccugacccgcccacagcggggggcuugucucugccacgccauaguacacguccugcuugcccacaccguagcccggaaacagauauccgcuguagccaaaguccccgcccugcucgcuuaggcgcggggccucaaaggccgaguccacgccgcauucgccuaugcagcccaggcuguucugccugaagguggagagcggcuuacagccuggagcaugcacccgccaggcgucugaguagcggcuguccaaggcagcgucagggcugccagccaggaagucgccgucgcuguuguauucaagaaucuugccggugcgcacagcgaugugcgucucgaucuccucccgcgcacgcuccacguugcccggugcgccgguuaucucaaacacggggucgcggucccggcugggagugaugauguacguguuggucugcugcuggaugcguuugauggucgcucccuuggggcccaccaccagucccaccacgcgguaggguacucguacacggauggucacuuggccuggcagagcaggggccacgccaaaggcggcgccagacuuguugcgugaggcucuuaucauggagaagugcucagcugcagagaugaucucccgccgggcuguggccacgucuucccgccucccagucaccaugaacacuggcuccucaccucgcacaggugucuugauguagguguugguuuuggcccucagagccuuaaucuugcagccuggacagaguggggaaaaauuuuacaggacaaaggaguuuguaccuucccccagaaucccagcuucccgaaaauccuucaguugauccagugacaccuucaagaccacaaauacaaccuaccccccaauuugaccaauugaaugcacuaguuuguccuguguuccauuuggggccuuccagauacacuccucugagaccccccuccuucagagccuuugagagaagaagcggcuaacucaaaaccucacaaacucuucccuuagcaccugccggcacguccacucccuccaucucaccuuccucucagugacugcucauggucuuugcucaaagcuccaaugcacucauuaacccagucuacucaugugacuuccauucauuaaaagagucuguccucuagcucacccagggacauuggcuacugugugcugcgaccuccccaggcccuccuagcaucccuagaaguagagaccaaaaucagagaaacacuaaaccaggggcagcaggagggagguggggagaccacauaaucucugugcuucuccacaccauaaagcauuagcagccccugauucagugugggggguggggguggggcucaaggggucagaaucucagggagaaguaggaagacaguaucauccagaggaccuaaggccuguccucuuguccucuuguccucuuguccucccugccugacgcccagggcaggacugagauguccuggagguugaggagaggggaacugagcauuucuggaccccagcuccugcuuugaaggaggaucagguuagagcugggaggcugggagaggcaggaagagaaagaaaagcgagacaaagagaagaggagggggaaagcaggaaugcccgucagaaaagucugcagaccucaggcuggguggacuugccuggcuuuacagagccucugugucuuagcccuccuucagaguucaggggccuuggggccuaaggcaaugagagugccuucauccaagcaauacuguaggguggagcagaacaccucuucacauguccacaggcucucuccaucucacuuuagcccagcgcacagacuguacauuaguacacacccacaccuuugccccacucucacaggcagaaucccugaguuccucaggcacaucucagugcugcgugcccuuccucauguacccauccaaagccauaaggcugcuccuguaacugccccaauugcaggccucuggugagcuugcuuguucuuucuccuccuuccuccauucccaaagugucuuuucuaacccuaaugaauuggugggacucaguggguuaggaauguaccuaacauauaguaggaaggaaaaauguaacccccauuucuuuucagaccuguuggcagauaagaaguccuacuuguugccaagcccacagccuugcugcuuuaauaucuggaugguggcuugguuccugaggcuuggaggauagaagaacaauacuuucugccaccucuguuuauuaugugccaccccgaugggcaccuagguucuggcuccuaaguuuugaauccaaaaacuaacuucauagggaguuaggugucuuugggagaucuggaguuuggaaggacaaacccaagggagaaagccugaggccgggcuguacagaacguaucagccucagcaucuuggguucugcaacccugaagaagcuuccguagaaguagaggucaaagucagagagggagcagcagcacgagggaggugaaaggacuuccaucugcuuacagaauggggaagggagaacuucuguucucugacaauauucuacuaggacaagcucuacuuuuaugaugguuagacacauuugugaaggaagcagaagaguaaaggaccccauuaaauccuggugccuuccacgaccucacccaaguaaaguuauuaauauccccacccaacaccaggcucugaaucuccaggguuugacaaggaggggaaauccaacuuucuaaaccagaaacccccaagagauugagggagggggcgcugugcaggggaggggcaaguuccccuccuccacuccaaauccuccagccccaacacugggauggaugaaguggaauaugugguaggggccccagccugccuccccuccacugccaggaacuggccuucuucuuuacucccgcggaaugcagccccuccauuguuccccaccgugggacagcuccuccccccacuccaccucccagcccagccccuuugccauauccaaaucccgccccccccccacaagaagcuaggaggggaagggucccuaagauccagguuguucaauuuggguccuuaccaacacucccacccauccagggaugcugggcugggagggugugguaacauacuccauuggcuuaauucaacaccccucccagcacacccagacacgcaccccccccccauauuccaaguggagguuucuguccugucccccuucaccgacaugcccuuccuggccugucccaugaauucacucagagacuucucugcagaccccuagcuccaggccguggccagcccagaacaaaagcaagacggaggaggagaggcccacgccaagacugguacuuccucagaaauuccccuccccaaacacaggggcccuccaacuucgguguguaagcgaccaagggaccccucuuugccaagggcucccucaucaccucuccccagacugggacccuccccugggccacacccccuuucauuccuacacucagcccaacaaagaggcagcucuucagucgggcuucguggacuaggucucccucagaguccccaacuccaacagcagaaggucccaggagugcccccuccccaguauacaagcagaaacuagaguaggggcucccaaguaauugcacauuccgucaguccuuccagccaggagccgacacccccuccgcacagacccugggauugggaggcagcucccccuccccuuuccucucccaguuccaggauauuucuuugucuacgggcggagccccaggggaggaagggucccgagagucgucccgacuagggguagcagggaacuuuguggcacuuggaaucugggcagggggcggggcccccuuugucgggaagggacagagccagaggcgcgcaaagaaggaagcgaugaacuuuccgugccggggacagcaagcccccacuccaacccucgcaguguccagacgcccgcuuaccuugccugcccacgaucucggccacgugcucggaggugggcacgggaacgcacuccgugguguugcugcugcccuucagucgcagcucggccucuuuguagagcgcgcagagcuug

SEQ ID NO: 1490 - RNA, 4774 nt, Mus musculus
caaaauccccacuacagaugugaagggaaacagcgcuagaaacugcaaugccgcucucauacugcaugggugcuggaggcuaagcugaucagcaguugcuggcucauucacagaauagcuccaccuggcucuugaacccacugguagcaagauggaccgaggugacuucaaggacuuccucaggguggccugggaggguuggacauuaggaguaggggcuuccuaacagauggccaggcucagccgagcugcacugagcuucggaugaccaguguguacccuugcaaagacccugggacagagccucuccuguacuuaucccacacuuaaacccaaggauucucagaaucaaccccagcagacuggaagcucccaaucucagcuagcagccugcucuagcccuguccccagggauagggcagcucagccacuggccucuauucuuuuucuucccccauacuuuuauacauucuaccgggcucaggggcccacaaugcuacuaaacuuuaagcuaucuugaguaucgucuacuaaguaacuaguaauucuuuuucuuucucuaggauuauaugaaauaaauuugaauuauuuuguaguauucucuucuuuuaaaccccucgguuuuucuuucucauuuuuuuuuuuaauuuuuugguuaaaaaaaaucuauuucucuuaaaucucacaccucugaggguuucagucggccaacuaggccucaguucugguuuucccuccugacugccccuggcacaggguaggggaaggagggacacuccaggacccucaguccuuagucccaaagcugcuuccuuucugguuaaucccuuccuuuguuuggcucugccggcuccccugagggggagggggaggggagcccacagaaugaaauccaaucuacuggugggggccccagaagggaccaacucccuauccccucuccaccauccaccccaggaugcucccccaagaaaagcaaaugacauuucuccccaaaaagaagugggggaaaaaaaagaacauaaacccgaacauauauuaaaaacuuuuuuuaagauuuaacucugaauacaaauguauuuuuuuucuucucucccuacauauauucuaaaccuucuaaaguuuuuuuuuuuaaggaucacuuuaucauaaaauaaaauauccuuuucauauaauaaauuaccuaauaaaaagucuuuuuuucauauuagcccagguucuuugcuacauuuauacgguaauaaaugccuuuauuaaaauagaauauuaaauuauaaagaacugcuuuuuuuucuuuuuuugcuauuuuuguuuccucuccucuguuggucgcccaucucacucccccauugcuuuguuuugcugcucgcucacuuuugcgcuuguuucuaggaaaggcucacucagcaagggugggauuggaucuguggagccccuaguguaacagucuuuugccuuuguggguaaggaguggagagggggaggggacugacagacagacaucccuucuucccaccccccucccauccccugccccugggcaacccagggugcccauuugguuugguuucuauuguacagacaucucaagauggcucacauugauggaaaggagggaagcugccacaggccaguuuucugggcugugaccuccuuccucuccccucccaggcugguggucuggaggggaaggcugaggagaggcaaguuaauucacaagaggcaggagagagagagaccucccucugcccucaucccacauccuuuccccauccaggaagagugggacuccugagcuagagcucagaauaucccacccaauuauauacaagcaucuccugggccuccuggucacccauccucuccuggcccgaccagcggaacccgggagaguaggaggcugcugacagacacaagugagcaagaggaguagugaaggggugcuagaccuaucacaauaccugauuccuguaacaggcuccaccgcaccccaauccugcuuugcccuggccugaccccucaccaaagaucuggccucucuccucagccaguggguaagacagagaauucaugauuuguggcuaauaaggacucaauaaugguucagcuaggugcagagagaggucggggguaggccacugcaggugagggggaggggagcccguccagacacaucucucuugccccaggacuuuuccuacuuuuggcuuucccuugccuugggcagaagacccaggauaagaugcucccuaaguauaaugcccauagaugauaaaggcaggguuccaaccuuucauguaccccauuacuaguuucccgucucaaacugauucuuuggaggagugggggaaaagggcuguccucuacaugaagaggaacuggaggugggggcuaucaaaacacucuccagacuucucucccaagaaaaugauauccccaaagcugggcuagaagagguaagaggauggaaagaaacauguggcugggggcugagggagagggggacagaauagggaaaacaacaacaacaacaacagaaaccaaagggcagauccagaaacaaacaaacaaaaaaaaauugggggaaaagccaagcaaacaauugaagggggaagagaagccccuuuccagaucucuagcccagcuuuguaagauggguaaguugugagcccuuuaucgacauccuccaucacccuggaagaucuaugcagaucuuuaauaggcccccaucucccuauacuguugggaacucaggauaugagugagugagugagugugugugugugugugugugugugugugugugugggcuaaagggucauguuaggagaugggaggucaggaccagagggcuagcgaaucaggaagagcaccucuaacuacagauggcaagucucccuguucuuaccccuccagagaaggggcaaaaugacauguggauagggagaagggaaaggucaggauguguguccugguggccacuucuggcuaaacaaaagcuucucuuagcugcuuccagauuuaaggguguguugagguaucagaguuguaacucuaguaaaacuuauggccccucccaaaggguaaccagaggcucugaaaauggccccgcccccagccacucaggccuccuuguccccaccccagcgagugaauauuuccaagcaccuugcccuguagucacugauuuuucaaaaagcccuacagguccagggcagcacccgagggagcgggcccaggagaccagggacauggagcuuaggaaaauauucggauggcuuguguggcggugauguggcagacaggacacucuggguccguccucucgcagaugcguacugcacacuccaugcagaaaagguuguguccacagggcaccagggcugcugucacuucacucucaaagcacaccaugcagucccgcccgcugccggggcuccgcagcccgccuguccccaguuuagagaaacccugcaguggcucuccggguggccuccgagggagcccggucagcugcucuggccccgcagagguggcaggagagcgaugcgcgccuggggggcccgcgcgugccuuggcugaagaggaggaggaggaggcagaggagaagagcaccgaggugggcguggcauucuccugacccgcccacagcggggggcuugucucugccacgccauaguacacguccugcuugcccacaccguagcccggaaacagauauccgcuguagccaaaguccccgcccugcucgcuuaggcgcggggccucaaaggccgaguccacgccgcauucgccuaugcagcccaggcuguucugccugaagguggagagcggcuuacagccuggagcaugcacccgccaggcgucugaguagcggcuguccaaggcagcgucagggcugccagccaggaagucgccgucgcuguuguauucaagaaucuugccggugcgcacagcgaugugcgucucgaucuccucccgcgcacgcuccacguugcccggugcgccgguuaucucaaacacggggucgcggucccggcugggagugaugauguacguguuggucugcugcuggaugcguuugauggucgcucccuuggggcccaccaccagucccaccacgcgguaggguacucguacacggauggucacuuggccuggcagagcaggggccacgccaaaggcggcgccagacuuguugcgugaggcucuuaucauggagaagugcucagcugcagagaugaucucccgccgggcuguggccacgucuucccgccucccagucaccaugaacacuggcuccucaccucgcacaggugucuugauguagguguugguuuuggcccucagagccuuaaucuugcagccuggacagaguggggaaaaauuuuacaggacaaaggaguuuguaccuucccccagaaucccagcuucccgaaaauccuucaguugauccagugacaccuucaagaccacaaauacaaccuaccccccaauuugaccaauugaaugcacuaguuuguccuguguuccauuuggggccuuccagauacacuccucugagaccccccuccuucagagccuuugagagaagaagcggcuaacucaaaaccucacaaacucuucccuuagcaccugccggcacguccacucccuccaucucaccuuccucucagugacugcucauggucuuugcucaaagcuccaaugcacucauuaacccagucuacucaugugacuuccauucauuaaaagagucuguccucuagcucac

SEQ ID NO: 1491 - RNA, 12550 nt, Mus musculus
cacaucgguauggcauuuguuuuuauuagaaaauucauuugguaagugccccuaauccaggcagggccuguguagcccccauaauccucuacccucuugagaggagcugccaggggaugggggugucagacaguauccaaagggccccuccuggaccccaaagaguucacauugcuaauaauauaccaacagcaccuuggugggacccucaagcccugaagcuguggcuaagggcuguccugucuauauggcuucagugacaacggggaggcccucuccaacuuccaggccugccccucgcauucugguugaguucgggguaagauucaggacaaaauagccacgggccaagggccaagagaacacuuuugacacccucuggagucuagaaaaaaccugguuucuugggagagaagggccgaggaaacugcauucaguucuucuuggguuugggaguaucguacuuccucuugcuggaauaccacaggagcagggggaugccuauggagggcaaggucaugaccccaaaggcugcccaguccagcuguggaggaaaacaaggucuugcuuaggagucuggguacagaugcaggagggaaaaggaagaagggaauggucuggaagagaagggagcagcagggcccaggauguaagcaggacuuugccagccucucccucagacaaaauggcucucuacgacuagucuccuuuucaagcugugcagccaagccucauuucacccaaauucuagauaguguuugagaagggggaugcccuaaggggggaugucuccaccuuggcuucauacuucaccuuccaucuuuguuaaacacuugucauuccuggcucacaccaggccuugagucaaucugagcuguucucagucucuccucccucagcuccucuuugccuggcuaauccucucuggacuuacagucuggacaggcggugcugauuaagccccgccaggguccaguguaaggcccgacugaccagagcauccccuuccacgccuuacugaggcccuuagggaccaucaggggaauuuuguugcuccugcaucucugcagccaagcagguuguaaacugacuaaaugguugcugaugaacccccucauauuucugccuucauuucccaggaagugcugggauagaacccaaggcccagagcacgcagggcagacaaacagagcuacagccucagccccccaggccaucugaugggauggacugugucucauuuggagcucugggugaauuaaauucucucauucaguguauagucagcucugaaaaauucucuccaagcuccagcugggcuggugcuguguaacacucaacuaucccaaaacuuggcgaccuccacugaaucuauuaaggccuccaagugacacagaacucuaagucaggcaucuuucuacuaaaggcugagcagagggaaaguccagguuuguggcgauggcaaauacuagaaaugcuuacaaaauggggggagaaucuccugucaaacucccgcugagcgaggauuccucccuguccaggggcgcugguggagccaaucuggaaaagaaaaaagcuauuaaggcaagcuucaaagucaccuuguccgagaccuggcuguuucagcugacacaucucucagcaucagaggcagucaccaacacacaggcaacagugcuuaaaggacagagcugcagcccagcugaggccugggcucugaacaucaguauuaggaaaagaagagaaaaaagcagagggauggcuccccaacacccacaacuccaguuccagggaaucuaaucccuucugauuccuucaggcacuaggcacacauguaguacacacacauacaaguaggcaaagcugucauauccacaaauaaaucuaaaaagaaaaaaaaacaaaaaauaaaaaacuuaagcuuuuaaauuagauagaugaagcaaggggacacauauccuuaaucucagcacaugggaggcagaggcagacaggucucuaaauuagaggccagccuggucuacagacugaguuuuaggacagacagggcuacacagagaaaccguaucuuaaaaaacaaaaauaaauaaacaagcauuuaaaaaucagagagaugacucccuuuagcauucuguaaaguagaucaggagccaggagagcugaagucucacacagugggacucaccacacagugcgugucuguuaaacagcucaggccagcuacguaacucaacccaaaacucaacccaccagacauaggccacuccugucuauaagacaaggugcauaaagaagcuacaaguccuccgcagucauuuacuuauuccucaagagaaaacccccuuuucuacuucacagggcugaccaaggcucagcugaaggacuaagaagcgcccugacuauguuaaagccccacccaaugcacuuuagcagagcagggcugggagagcuucacauuccuuugcuuucaagaggggccaagaguuuggagcucaaugcaaacaacucuguucucagauggcaggugagccuuugauuuuugugucuguuaacccaccaaguaccagguaaugcugggcacaggagcucauacucgcaaucccagcacgugggugacugaggccggaagaucaggaguucaagaccggccucauucauauauugagaguuugagauaggccagccugggcuacaggagaaucugucucaaacuaagcuuaaaaaaaaaaaaaaugauucagccaggccgugguggugcaugccuuuaaucccuggugcagcuaccgguucugaaacguuaugauuggacccagacuuccuuaggaccagugaggcaaaggacacugucaaugagacaaaaaggccaccaacagguugaggaaggauuuuuaccaauccuaaauccaauaggggacuaauauccaauauauacaaagaacucaagaagcuagacuccagaaauucaaauaaccccauuaaaaaauauuuagcacagagguaaacaaagaauucucaacugaggaauaccaaguggcugagaagcacaugaaaaaauguucagcauccuuaaucaucagggaaaugcaaaucaaaacaacccugagauuccaccucacaccagucagaauggcuaagaucaaaaauucaggugacagcagaugcuggcgaggauguggaaaaagaggaacacuccuccauuguuggugggauugcaagauuguacuaccacucuggaaaucagucuggcgguuccucagaaaauuggacauaguacuacuggaggauccagcaauaccucuccugggcauauacccagacgauguuccaacuuguaauaggaacacaggcuccacuauguucauagcagccuuauuuauaauagccagaagcuggaaagaacccagaugucccucaacagaagaauggauacagaaaaugugguacauuuauacaguggaguacuacucagcaauuaaaaacaaugaauuuaugaaauucuuagguaaauggauggaucuggaggauauaauccugagugagguaacccaaucacaaaagaacucacaugauacguacucacugauaaguggguauuagcccagaaacuuagaauacccaagauucaauuugcaaaacacauaaaacucaagaagaaggaagaucgaaguguggaaacuucgucccuccuuagaauggggaacaaaauacccauggaaagaguuacagagacaaaguuucaagcugagauggaaggauggaccauccagagacugccccaccuagggaucuaucccauaaucagccaccaaacccagacacuauugcauaugccagcaaaauuuugcugacaggacccugauauagcugucucuugugaggcuacgucagugccuggcaaauauagaaguggaugcucacagucagcuauuggauggaacacaggguccccaauggaggagcuagagaaaguaaccaaggagcugaaggggucugcaacccuauaggaagaacuacaguaucaacuaaccaguacccccagagcuccugucucuagcugcguauguagcagaagauggccucuucggccaucauugggaggagaggccuuuggucuugugaaggucauaugccccaguacaggggaaugccagggccaggaagugggagugggugaguuggggaggagggcagggagaggguauaggggacuuuccagauagcauuugaaauauaaaugaagaaaauaucuaauaaaaaauuugacagugucuuuugccuuccauaggcccaguccagguauauaguuaaccugucuuagcagcuaagguggaaauuuuugcaagaguuuguaaggagagacagccaggggaucugcugccuacuggcuucuauggauaaccaacauacacacacacacacacacacacacacacacacacaaaaucacauacauaaaaaucaacccauacauucuaagaagaaacaaggguauuuuuaagggaacuagagccccacccagcucggguuuggagaacuuaccacaacagguccauccuccugggccagguaaguaaucguggcagaagugaaguugaaguagccagcuuugagaggacgcaggacaacugugugggagacauugcuagcgcuggcccaaggguuaaggaugaagaagagaugccggaagccuaguguggugguguagucauuuaaucccugugcccaggaggcaaaggugggcagguucugugaguuucagaacacucagggcuacacagaaacccugucucagaaacacaaugaaacaaagcaguaacaaccuuuccauccuguucaugccgaccaugugcacucuuugaaauuuagcauauggcauaauacacuaauaauauauauaauaugaugggaguagaccuggguccucugaaagagcaacaagugcucuuaacugcugagccaucuuucuagagauacacaaacaugucggggcuagcuuucugcgcuguauauuccgaagcugaguucugggcuccagcccugacugcaaccuggucuuggagcauuguguuaaacuguguucugugagaaugcuccccaaaaucccuaaugggcuaacaaaaggcuaaagccugugacugaggaggagagagaggaaggugggacuggagauggaguaaggggggcucagguagggcccacgagaggaaggagagacuagugaaugucaccacgaggcaggaugagccaggagcacaaggcaagagaagccgagcaagccucagcuggcaagugauugggcaucucguuauuaauuuccuagccagguuaaaaaaaaguucagaaucugcucaguacagugccagcagacuguaaauaaaauaccaaguuucuucguguuuauuccggagcugaaaagaaugggguagagaccccuccauaaaaguaauaaaauacacaugccuuuaaacaacuuagaaaaucuuucacugguuguuuuuccuuuuguugguuuguuucugugcgugugcguguguguguugagacacagguaaucccagauguugggauuaaaggcaugcaccaccugugcauauuuucuguuuuugagauggggucucacuguauauagcuggcuggcagaccagguugguucuugaucuagagugcuaggauuaaacaugugcaccaucaugccuggaaagauuuuacuuauuuauauuugguuuguuuguuuauuuuuggguuuuucgaggcaggguuucucuguauagcccuggcuauccuggaacucacuuuguagaccaggcuggccucgaacucagaaauccaccugccucugccucccaagugcugggauuaaaggcgugcgccaccacugcccggcuuuauuuauauuuggguguguguuccaugaguuuaugugcacgcgcacauguaugucagugccuaggcauguuggaaaaggaccuggaguccuuggagaggaguuacagaugguugugagcugucugacaagaguguugggaaccagccuugugucucccuccuguaagaacacaagugcucuuccccacagaaaaaaaaucaccccaguccaugacagaacuucuuaaaaguauaguacacaggauaaaaacagaagcagcaaacacaaauacaaagagacuauuuacccucauaggaaaaauguagccaggcagugguggagcacgccuuuaaucccagcacuugggaggcagaggcaggcagauuucugaguucgaggccagccuggucuauagagugaguucuaggacagccagggcuauacagagaaacagguagcugaagggaaagcccagaggguuaggaacacuuccuauuccuuggaguuugguuccgaguacauaggacagaacuuccuguaaucacagcuccaaggcaucugaugucuucuugccuacacacacacacacacagaaaaucuaaauauacuuuaauacacaaagcagagaggggagaacuaauuauguaauucaacaguuaaaaauaacugucacgggcuggugagauggcucaguggguaagagcacccgacugcucuuccgaagguccagaguucggaucccagcaaccacaagguggcucacaaccauccccaacaagaucugacucccucuucuggugugucugaagacagcuucaguguacuuacauauaauaauaaauaaaucuuuaaaaaaaaaaaaauaacugucacagugcagugguggcgcacaccuuugaucccaguacuugggaggcacaugcagguggaucucugugaguuuugaggacagccuggucuacacagcaaguuucaggacagccuggauuaugcaggaaaauccugccuugaaaaaccaaaacaacaacaauaauaguaauaauaauaaaaauaaaauaagaauaaauaauaauaacuuucaagucagaaagcagacacuaagagaagaugcuaacguguuacccggggucuccauggugacaccccacugaaucugcuuugagagcaccugagguauagagcacuucuuacccaaugugugugaauacccaggucugucuccagcagugcaaagaaaaaaagcacauucaauauccauucauagccacagauaccuuuauaugccugcaucucccuaauggagcuugggagauacagacagccuuacagccugaaggaagaaggcacacucacucagcugauacuucauccuccccagauauaugacaagaaacagaccacacauccagucuguuugcagcccccuugauguuuuccaggcaauguuccucccccagcccucaccacccauuaaaaaaaaggauacggggcaauccggucccauuugacauugagcauaccggagacaaugccgaagucuucuggagggaaggaaucgucagauaauuccacaucuaaugcagcgcuggaaagcagaggaaauaaagagugagggacagggcuggcgagauggcucagcaguuaagagcuccgacugcucugccgaagguccugaguucaaaucccagcaaccacaugguagcucacaaccaucuguaaugaaaucugaugcccucuucuggagugucugaagacagcuauaguguacuuacauauaguaaauaagagugagggacauaaaacuaagggaacugacuggaaaauccaccugcuggucaaaagaaacccccauaguaaguugggccuguuuugaagaauccagaucaaggccuggauucuguugcucagaagugaauugccaaagguaaucuugcucuaauucuagacaggggaaguaagauauaaauggaaaaauauauaaaaggaaagaacaacaaaaaagugcucauaggagccagcagugguggcccaugccuuuaaucccagcacucgggaagcagugugagagacagacagaugucugugaguuugaggccagccuggucuaagaguggacucuucgacagccaguuaagaaacucggccuugaaaaacaacaaacaacaaaaaaagugauuguaagugaaagaagaaagcugggaguccgcacccgagguaagaggacagauguacacucugugucugcauuuccuuuuucacaagcugaauuuaucccugccuuugaaagccuucugagaccccaaagugguuucuuguaauucaccuaaggaugucuucaccuucaaaaagcacccgacaaagguaagcccucuaguauauucauucauucauucauucacucacucacacacugcacucgauacuggaggacuccaaaagagaauucacuccccaacaaaacguucucuaugcccacguggaaacucggaauucagaaggaagcuggcgaacucuaggccguuaccuggagccgacguuguagauguuauacugcagggucaggucccucccuuccacagcguaucuguugagcaaugauuuggaggccaaaagccuggcuccuucuucugcuugacugacggcuaacagagccaacaccacaaccgccagcagccucaucuuuggaaaaaagcaaagugagcaaucgacccaagcaugggaaacacugccagccaggcagccugugcggcgccacacuccagccccgccgccagguccgcagccgcgagcccaagccacagcaguguguaccgcgcugccggccaggcggggucagcggggaccccagcgcucuugcgucucccagacucaccgugagcaccccaaacgccucccugggccacagacaaccggaaaacaacgucagccuccgaaagaccggaaacggaucugaccggaaacccugaugucccuuccugugccuuauggauguuguaguucugaaacaagccccaccuuccccuuuauggcggcugauaccccaaaggaguugaguuaccuagaguccuugacucuuuccuguguguccuccaauuucuucucauuaaugcuuaccccauggaaaaccccucuguuuaaacuaaaacgaaauaagcugcauaggcacaauuucaaaguucaaagagucgccgacuuuguuuuaaggcugaaguagcugauauagccuuuccuugaauucuuagauuuccaagcugcuagucacugccuuauguaauuagcacuuuauagagacuucagacaacuaguaaacagggccagagagaccccucggcagguaaaggcacuugccaccaugccugcccaccugaguuugaauccuuggacccauuuaauagggcaccgacaaguucuccucugaacucuacaugugcacacacacaugugcauaaacacaugaacauguaaacaugcuuauagcacaugugcaggagaguucuuccacaucccuucuguagcacucuuacauccaggauggguuuacucugcaccugcucugugcucuggcacuacuauagaugcugguggggugaugagagaaccuucucccacugcgccuggcucuccugggacagacacccuaugcuucuuuuuuuucuucuuuuuuugagacuggccuagaacucacaagagaucccuuggcuucuauugucuaagugaaacuaggauuaaaggcaugugucaccaugccuguuguguuuauaaaaagauaaggagaggaaauguguuugguggaugugugguaaggugugggguuagggaaugccaccgcgggcucaugcugaggcaucccuuccccccacccccagggacuagccacaggacaguauaguauagaauaguuuauucagggcaugggaagaggagcugagaguuaggagagagagagagagagggagaaguagaggcuggccaucagcucauggaaagaaagaguggagagagagagagagaaagagagagacagagacagagagagagagaaagagagagagagaggaggggcaagcagccccuuuuauagugagucaggcacaccuggcuguugccagguaacugugggguggagcuuaaacaaaaugcuaacaaugccuaacccuuugauugaccuaccccccauuuuuuguggggaggggguucuuuauauaccugaacucuauguagaucaggcuggucuugaacucugagauccacuugcuucugccuucuggugcugggauuaaaggugugcgccauggcugccuggcuugauugacuucuuacaacuauuuacuuuuuuuuuagaauacuuuauuauuauguguuugaguguuuugccugcauguacauaugugcaccauguguaugcccagugcucgaggaggucagaaaagacagcuaucaccugagcuaggaaaaaauccaauugcacuuccugcuuccacguguucgcucuuuugagcucggucucuuggucaagaauacagggugaagcccugucucucaaaaaaacaaaaaccaaacugugaugguuuguauauccuuggaccagggaguggcaccaucugaagguguggccuuguuggaauagguaugaccugguuggaaugggugugucacuguggguguggguauaagauccucacccuaguucccuggaagucagucuuccacucgaagccuuuggaugaagacauagaacucucagcuccuccugugccaggccugccuggauacugccaugcucccaccuugaugauaauggacugaaccucugaaccuguaagccagccccaauuaaauguuguuuuuuuauaagacuugccuuggucaucgugucuggucacagcaguaaaacccuaacuaagacacaaaccaaacagaauaaagugugcuuuguccagacucuucaguuggaauggugaucuuuuucuuugaagacccaaacuucuuauuuuugguuuuucuguguagccuuggcugucuggaacuugcccuggagaccaggcuggccucaaauauacaaagaucuaccugccuaugccuuucaaguaucuaaacucuucuucuuuuuuuccuuucuuccuuuccaaaaaaaaagaaagaaaaaagaaaagaaaagaauuuugccuuauuguggauuacaaauuacuccugaaaaaauacaaagaagagauucuauuuuuuuuuguuuuguuuuuuguuuuguuuuguuuuguuuuguuuuguuuuugagauaugguuucucugugcaguccuggcuguccuggaacucacucuauagaccaggcuggccucgaacucagaauuccaccugcugccucaccuugcuucuccugucccagcgguggcccgggcggccagcgcgagcagcggggaccauguuccgacgcaagcucacggcccuggauuaccacaaccccucaggcuucaaaugcaaagaugaaacagaauuuagaaacuuuaacguuuggcuugaagaccagaaaaucagacacuacaagauugaagacagagguaacuugagaaacauccacagcagugacuggcccaaguucuuugaaaaguaucucaaagauguuaacuguccuuucaagauucaggaucagcaagaagcaauugacuggcuucuugguuuagcuguuagacuugaauauggagauaacgcugaaaaauacaaggacuuaguaccugauaacaggaaaaauacugacaaugcagcuaaaaaugcagagccacugaucaacuuggauguaaauaauccugauuuuaaggcgggugucauggcucuggcuaaccuccuucagauucagcaucaugaugacuacuugguaaugcuuaaggcaauucgcauuuugguucaggaacgucuaacacaggaugcaguugcuaaagcaaaucaaacaaaagagggcuuaccuguugcuuuagggaaacauauucuuggcuuugacacaggcgaugcaguucuuaaugaagcugcucagauccugcgguugcugcacauagaagagcucagagagcuacagacaaaaauuaaugaagccauaguagccguccaggccaucauugcugauccaaagacagaccacagacuggggaaaguugggagaugagcacaugaggaugucagcuucucaccugccuagugaugggaaccauuacaccagcaugugcuuggaaaucagaugucacacuuggaagggagaaccccaggagauugaccauguucuagagauuuaccaccgcugcuuuuucuuuaauaaaguuggggaaguaaaaggcuaaaaaaaaaaaaaaaaaaaagaauuccaccugcuucugccucccaagcgcugggauuaaaagcgugcgccaccacugcccagccaaaccuuuauauuuaagauaagccuuuaaagcacuagagcugggcagagaucuacccuagaaguuauuaguauuucuuccuuaucaaucauccagaacuugcuauguucugccugggauuuuuuuccuccaauuggucagcgcucauggccauguuuucaugauuaaccuaccgcaugguggcuucucuucucucccacuucuccucucuccuccuggucuuuggccucagaccccaagccagggagccaaaacccugccuaucucucuucugcccag

SEQ ID NO: 1492 - RNA, 1322 nt, Mus musculus
uccaccugcugccucaccuugcuucuccugucccagcgguggcccgggcggccagcgcgagcagcggggaccauguuccgacgcaagcucacggcccuggauuaccacaaccccucaggcuucaaaugcaaagaugaaacagaauuuagaaacuuuaacguuuggcuugaagaccagaaaaucagacacuacaagauugaagacagagguaacuugagaaacauccacagcagugacuggcccaaguucuuugaaaaguaucucaaagauguuaacuguccuuucaagauucaggaucagcaagaagcaauugacuggcuucuugguuuagcuguuagacuugaauauggagauaacgcugaaaaauacaaggacuuaguaccugauaacaggaaaaauacugacaaugcagcuaaaaaugcagagccacugaucaacuuggauguaaauaauccugauuuuaaggcgggugucauggcucuggcuaaccuccuucagauucagcaucaugaugacuacuugguaaugcuuaaggcaauucgcauuuugguucaggaacgucuaacacaggaugcaguugcuaaagcaaaucaaacaaaagagggcuuaccuguugcuuuagggaaacauauucuuggcuuugacacaggcgaugcaguucuuaaugaagcugcucagauccugcgguugcugcacauagaagagcucagagagcuacagacaaaaauuaaugaagccauaguagccguccaggccaucauugcugauccaaagacagaccacagacuggggaaaguugggagaugagcacaugaggaugucagcuucucaccugccuagugaugggaaccauuacaccagcaugugcuuggaaaucagaugucacacuuggaagggagaaccccaggagauugaccauguucuagagauuuaccaccgcugcuuuuucuuuaauaaaguuggggaaguaaaaggcuaaaaaaaaaaaaaaaaaaaagaauuccaccugcuucugccucccaagcgcugggauuaaaagcgugcgccaccacugcccagccaaaccuuuauauuuaagauaagccuuuaaagcacuagagcugggcagagaucuacccuagaaguuauuaguauuucuuccuuaucaaucauccagaacuugcuauguucugccugggauuuuuuuccuccaauuggucagcgcucauggccauguuuucaugauuaaccuaccgcaugguggcuucucuucucucccacuucuccucucuccuccuggucuuuggccucagaccccaagccagggagccaaaacccugccu

SEQ ID NO: 1493 - RNA, 4607 nt, Mus musculus
gguggggauuauuuccacucuccuaucuccguggacaccugccaucccuucggucuguuuucuuuuccagcuucccuuccuuaucucuucccugucucucugcagugguaaacagcuggaagaggacucggggaccugggcaggcuccucccugcgacggaccuucagcuuccucuugggcaugaccggcagggacaagguaggagucagccugggaaacagaggcauagagccacuauccuucucuuccucccugcccaccccuccccaaagcuccuguuagagacucaggcccucacuguaagauguaccuucaaagcucugagugucccaguaaaucagccuuucucuguuccccuccucuccagcuuagcagauagcugcugcagacagcuggaagagggaagggggcaggagcugagaaacgacccagggaugccucauuuaaggccacccauagcuaaaaggugggcaacagaaaucuugcccauuggacauaagaaugauaauuacagcagugccuuucccuuauucagaggguguuagacuuuuccaagugcuuuuacacucguaauuuuauggguggauacagcaacugagggguugaaagaggaccacaggcagagugggagcuucaaggugugugauuaguguauguagcacauguguggccaugugccuucggaugccaggaagugaaggugucccaaucucuccucugucauuaccacuuggcccugggaagcagggagcuuuggcugcagccucaaccuuccauuuucuuucuuuuuagacucuuugcuguuuugaaacaaggucucccucuguagcucagacuccccuggaacucacuaugauguaacccagcuagcggccucagcugugccucuccuccuggcucagccuccagagugcugaaaguccagauucuaccaaugagacaucacacuuggccuuauucauucauuugauuguuuguuuguuuguuguuuuugagauaugguuucacauagcucaggcuacccuuaaauuauggaguugaagaugaccuugaacucuugauucuucuguuucuaucucaagugcuaggauuccuggcaugcaccaccacaccuagcaaugguggccucuucucuccuucucucccucccuucuucucucccuccccccuuccugauuuccucccuuccucccucccuucuuuccugauuucuucccucccucccucccucccucccucccucccucccucccucccuucccuucccuucuucccuucuccccuucuuucuucuucuggcaaugacuucccagccugguugaccauccugccccaagcauucugagcacuggggcugcaggcuccacuuacugcaacacaaaaagccacucuccuuucccucugguaugcaugugguuuccacccuaagguuaccucugagcaccgagagaaaccuggaggagacaccauucuauucaucuggcagaaucauggggacuccugagucagguuguugcaagugcaaaggcagggcccuucuggaggccagacuccgaaggccggcaggauuccuucccuauaggugggcagggaagggaaagguguaagcagauccauugcugggacucuuugcagagagggaguuggagcugauggagacauguggcauacacaucacaaucuuaaaaccccuggauaugggggaggcagacagggucaggaaucagacugcuagaagacaaagcaagcaggaagcccuuaggagccaagucucccuccccgcaggacacaggcucugucacacugcauuugcucacccuuggccuagcagcccugcaggagauugaguaaccugaagaaggggaaccuggguagaggcuccggagcauggagagggaacaagaagagcgagccgagcguaggucagcauauuguccugcuccuuggccuguguucacagggccucuaggcccgacugucucuguaucucucccucugucuucucuauacccuuacuugaaugugugugccuacaucauguucccuuucucccuguucccagcuuggguaccagugcugcacacugcuagggauggagaggaggagggagcuugguucucccugcuugacugacauccuauagguggccaaacuccuagugcucaucuuguacuucuuagaauagcuccggcagagauaagggauggugauacauuaaucaccauuucacagacaagauaaccuagaggcugggcuacuuagagguguagcaaucauguuaaguggcgggugucucucucaguaaaccccaaagccuuucuucacagcucuugcuaggaagccacuguggucauguacaccuuagacauucccaagucaaguucaaggcucaaguuaaugagaagaaggcugauuuguggacuguugugugccuggaucuagacagcuaggaacacucuugguuccuccgauggcccuuuggaaaccagacccuuccccucuaguugucuauggcaaugguaccuccccccacccccccuuuucaaguugaaugagccaaagaaaguacuggcuacuuuuagauacuggcagagguuuuuaaauuuuuuuuauauauuaaaaacaauuucucaaagaugucacugguaggauuacgggggugggggcuagaaugaagggguuuggggaaagggaagacccccagaagaaaggagaauguucauuguuccagaggcuccagagaacagaaauggagucaagcugaagacauagagcacucaauacaguuuuaaagguuugguuuugcagggcagacaagggagaggugagcagguggagcagacagcgagcugaggcuggggaaacacaguaaaaggcuagaggaggaggucacccucuucuuccauagaccuuccacaugggcuuuacguacugaccagacccucaaaagagucugggggaaaccuagauuuacuaguuacucaagaguuuggcuuauaacaauuucuaguucaggccuuagagaaaauugaggucucugccccccccccccccaaaccaggcagcucauucugaccucuagcugauuguuaguacauuucucagcuuuggcuggucacucaagcggggcaagucuggaggcucagagccaauaggaacauggcagguccugaggccuuccuaggauuccuucagagaaaacagaauuggucugggaaaguccuuucugccucaucuggccagccugaacuggacauuguuucuuuuucccuggccuuuacuauauaaggacccugaacaggagaaugggcacaaaaggugagggaguuccuaggcaggagauaggucagaggagcagagugggaggggagcagagccggggugaggagcugaggagcccaaccagcacagcggguggaugaggcagccgagcccaaauuagagacugaggcuaaaauuggcacucuaggagugcagggcugggcuggaaaccugcagcccuaacaccacccucccugccccgcuaccgagaagaacagagcagaagcuggugacaguggcugggccucaucucccucccucuuucuuuuuucuuucuuucuuuuuuuuuucgguguuuugagacaggguuucucuguguagcccuggcuguccuggaacucacucuguagaccaggcuggccuugaacucagaaaucucccugccucugugcaacaccacgccuagccaucucccucccucauuaccacacacuuuugggacuagauuagguaguacccuaaauuuuuacaaaacuuugccccagggugcucagguuuuuacagagaaaucggagaccuugauagguggaaacggagcagacuggagaauuuccccaguggcaggaaacucagguugacucaaaggguccagagaaaugaaaacccacccacacuccucagcaagcucaaacguuuccagacagggccaaguuguuucuauagucuccuguggcagagaaaacuggugucaggacacaaggaaggauuuccucagcuagccucaggaaagguggagccuucucaccuucacugccaaaguaauuggcagagguggggcugagaaggauggucagagugugguccacaaggcccagaggggugagaagcugggcggggggugggggggggugaggggaaaacccucucuuguggacuccuagcuuuuggaaaggaguccccuucuucacucuuuugggggagugaagccuguuaacgaugaagcuucuaguuccccuuucauugcccccucccucuugucauaccaguccaacauuguaaaagcggucuguguacucaagccuguuugaugagugagcccuuauggcuaggucucccaguuaccgauaaggugauagaauccccuuagggucuuuaaagagugaaguuacccggaaugggcgccgguguuuuucaaggacagccgagcuaagggaggucgcugaggucagagaguguuccuaagcgcuaaagggaaaagggauccucgaaccugucccaaggaccccuguccagcagacugcagcgauacuaaccccggcgucccguccggugcgcggguaccccg

SEQ ID NO: 1494 - RNA, 8895 nt, Mus musculus
acaguucucggguuuuggcuuuauugaguagagucacuguacaaagccauuucuaagaguuuagagaauacaccaggagucagaaagucugaccuggaucuacucuggaguuccccagugcauuucuucuuuaaaaucuguuugacuuaaguuuguccugggccuauggcaugccucuuucuuuggaucauuguggacucuucagggauucuuaagggacuguaaccaguguccccucagugauaagaugguacauucucaaagaggagugggaggccucucaacucagcuguuucucucaguucugaaaguagugggcggcuaaggaagccgggguuuguuguaggacaccgaauggccugaagcagccaaggacuguuccuguuccugccaugagggaggucccgaaucuaagcugaagaagagcaaaaggagaaauugucacugcagcagcaaggugagaaaggcgcuugauguggggacugcccaggccucgaugucacugcagaugcuggggcuuuguuggcauggggcugggggcucacacccuccuaccucugcucugccagcugggagugaaggugugugccaacacuccucauaggugcuguucugcuacuacagguuggugucuuuuugaauuuauaaagugaucauauacaucagauuauaugcaauacacagaugugcacauacauaaaauaaauggacccuucuacaaaaucuaaaauggagccagaugccuggccuguaaacuccgcaugagaaggagguaaaagcaggaagaucagaaguucuaggucauacucagcuacaucacaauugugagggcagccugggaugguaacacccucucucaaagccaaaggacaugggcggauuuuuccuuuuguugucaugguuugucuuguuguuuggucuugagacagugacuuguuacauaacccagcuugaccccaaacucaccauccuucugucuguaucuuuugaguuuuaggacuauggacauaaaucccacacucaauuuauguguagcugagaucaaacccagggcuccuuuuaugguaggcaagcacuccaccgauugagcuacaucuucagcuuuagauuuuuuugccuuuuuuucugaggugauguugguugcuuuuaaauuuuuaagauaaagccucauguagcccuugcuguauugaccauguagugagccuuggacuccugccuccacugcuuaagugcugggauuacaguugggugucucuguauauccuugacuguccuggaauuuacucuauagaccaggcuagugucuaacucacagagauccaucugcuucugccucccaggucuuggaauuaaagguaugcuccccaacuuccuaucuggauuuuccuuuuuaaacaaucuaugaccuacggccauaccacccugaaugcacucgaucuugucuggucuuggaagcuaagcagggcgaggccugguuaguauuugaaugggagaccaccugggaauacugggugcuguaggcuuuuuuuuuuuuuuuuuuuaaggaaaaaaaaaacagucuuugauuugaauaugguguucacaucuugggagacagagaccaggggcugggaaacaaacacuguauagcauggagcgaacauaaagccucagucucagaacacuggugguuggagggauagugcagcaguuaagaacacuggcuggccuuccaaaggccguugcuucuuuucccugcaccuacacggcagcucacaacugucuauaacuccaguucuaggggauccagugcuuuccucuggacucagcaccauaggcacauggugcacagacaugaauaugcauaaaaauaugcauaaaaugaauaugcacagccaugauaugcauaaaaugaauaaaacuaaugcuucuagaaauggagaguaaaacuguaguuaaaguacuuccuuauagacuuguuauugucuggggacauccucuaugaagucugcuucugugugauaucauuguggguaggcccuacaauugucuccuuagguuucccuuucuuuucaucaaauaaaccugugagcaaaacggaguaaagauaacuuuggaucuucacagugaguugauuaguaucacaaauggaguccucauuagaaacagacuccuacuauuuaaaagcaugcuggcugacuugcugagcaccagcagaggccuugccuuggggaggccugagacauaggaaggucagggcauuuuuaaccuagagucgcccuugcaggucugugacagcaaacccuacaagagcaaggagcccccugaguuggugggcaguggcccccuccacgaggccaguacugugccuggcaguaaggaagcagggcaaggcaaggacauguuagaagaggaaauccuggaggagcaggagaacauggaggugacccagaguaagacugccaggaccacgcgaaagggagaggcaccugcuccagguaagugacugaccacgcuacggcugcugcuccugccuucuuugcuuuuccccacacugcagcaagcuaugucagcugcucuaacagcuuugcaguggugggcgugccacgcugucguggacagacuaugugacucccuuucccacucccaucucucacacgcauggucuacacagugaguuccagacuagccagagcuacauagugggacccugucucaaaaauaacaauaaaacagauuccuagagucuuucccuacgcuuguguaaucaauauucuaccaacccuggccuccuuugaguggcuccauucucuccagcagccuuucuacuggaacuacauuguuguagcuccccagggcugugguucccagugcauacucugaucccauauuccuucuaagcagggucaacaauagggaguacuuugcuguguccugcagaagugacucccauggagcugcuguuggagggcccagcgcucugcucagcagagacuccucggcuuccuccucagacuggagcuguagucugcucugucaggagaaaccaggcugggccugaaguugucuccugccucagcacauccuccuuaccuccugaagagggggaggaccaaagggcugcugcgaacucagagacuauugcaccccaccgagaagcaucagaaacugagagacugccggaaacuguggagcacucugcuccccucccaaguccuguuucuacaaggaccagagacacggggagaagacacauuugugggaaagcaggcagucagaguuggcucaucgagagcagagcugaggcagaggcagcccauguggcggccccuaucugugaaaagucaucaggagcuagggccucagaggcugcucccaaaacugccagagagguccuggcugaagacagugggacacaaggcaugggcccagaaggggcgcuaccaaaagccucagaagccaccgucugugccaacaacagcaaggucagcuccacuggggagaagguggugcuuuggacaagguagguauagauggguuguaguugcagaauuuaauacagauugaaaagcuuggagcuaaccauccugccugcauuacagggaagcagaccgagugauucucaccaugugccaggagcagggagcacagccucacaccuucagugucauuucucagcagcugggaaauaagaccccuguugagguaaggugggaggggcaggugaugauggggacagaggugagcggaugggaccagccggggucacggucaaucauggcagcaacuuuaaagagugcucugaaaaaggcucgaccugccaggugcuaggguuucuuuggagacagcauuuucacugugucuggaaagccuagaacaauguaggucagguggucucaacuugaacucagagauccaucuggcucagccuccuuauugcuggaauuaaagguacacacauacuguauaugugugugugugugugugugugugugugugugugugugugugugugugugcaugcgugugcgcgguucucuuuccuauacauaagacucagcccuggucucccucccccugcacccccccccccccccccccggcugcccaccugccuguccacuguaagagcauggcccucuuccuguccuagguuucccaccgcuuccgagagcucaugcagcucuuucacacggccugcgaggccagcucugaggacgaggacgaugcuaccagcaccagcaacgcagaccagcucucugaccacggggaccugcugucagaagaggagcuagacgagugacaucugccaggacccacccuacagccaucagcacuggagauagggcgcgccucacucguggagaccuugaggacagagcaagaauggagauggcucuacagcucaucucucaggggcguuggugaagacccuacaagcccaaucuaucuguacauagcacugagggagcucggggcuugccucggagucugguggucucaguguuuuuaaauguacaaaugcguaugucauguaacaggucccuacacacuggguuccugcacggcagcuuuuauuauaaauucucucccacuacccuccccuggacuucaguucgagagacugucacccuccugguaacacugggccaaccuguguaacucgugcagcaucucuuccaugucauccugcuccacgccagcguccaugaagcuagcccagcgccgcaggucaagucugcugagcucuucagccaagucucccagcguacggugcaaggaugaaguugaacgcaaggccccaaacacagggaugcucuguacugcugcggagggaaagaagagggacgcugagugggagguacagcggugacucgugugcugucccuucugugugcuccccaggggcucguagucaaggagaggaacacugaacugugaacuuuguuuucuuugcacuuuuaauccuccuggaaaaaacuguaaaaagaaaagaguaaaacuguuccuauguagcucaaguguucguuuucuucauguccuaccugcgcccuuggggguacuguccauggccagcccuuucugacugaagcuugagaagaaguguggguauggaggagccacuuugcagggagucagcagcagaugugacgaacugcagacagagaggugaugagcaggggccagggcugcaagggcugggggaagggcaggugcauauggaccgaccucaagacucuaggaugcugcugcuguaaguacugggccaagacuucuucuccagaggcgcaugcguggagagcagagggcagaggugucccuggguugagcuuacugcaaggaaaaaaccgcauuuaccuuuggcugcacgaauguaagcuaagauucauacauucuuggaccaucaagugaacugguccagagcuuuuuuuuucuggguaagguguccaugguagcaggaaaagggugucagaaagcgugcuagggaaacaaagacaugcccaguacuuacaggggccuggaagacccagcagucuuuaccugguguggcuagcucugucuaugccucugagcaccacagacugggcaaagcaccgauguccagcagaauccccgcaugccgacagggagguccaugggguggcuucuccaagcugcgucaggaugucaggaagggacuggccucgaaccagugggaaggggaugauugcuucugcugucaccaccuaaacaccgggagggagcagguuacaaaggguuuucugagcuuuggguuagccccucacacagcuccuuaccuuuuucccagagaaacuuagcacaucagccaagugagccaugguaaccauugaggagcgcaggcgauagggaacagucaccguguccagcgcugucgccaggauggcgcuacaguggaagggcagaguggccugucaagugggacaggaggggaacacugugucuucuggguguggaaaauagguggaggcagaacaugaaggacagacauccagggaaggaaaccagacuguccuuaaauaggaaaaacgugagcggcuaaggggccaaguccaugcuggaaacccacuuugcuguuaugaaggccuccccaguacugcaugugcuaggcaacacacagccacagggaguugggggcaagagaaacacagaacagacgccacaggcugagcuugagccuuacaucauaauguagggaagggaaguugacaggcggcuugggucgcaggcccagguucccuccaagggauaagggacagacgaaggagcuguauccagucaggugcaccagaccaaaugccguguuuaagagacgauagauguuuuucugaggcuccugguaauagaaacgggaguggcuugcaucaggcaacuugcacagugggauccucuuuucccaaccucuacugcucgcucuuccagcuuccacucaccccaagacuguaggggcccgggagcaggccccagguuaggacuccccgcccugcauacucgucuuguaguagcucugcaguuuuagcaccuacuccagagaagccaucgugcaggucacacaggagcuggaagcccuggagacaaaugaagaccaaaauaugggggcgggggcuuuaggacgaggagacuuuguaccccaacaucauccaccuugccacacagcuaccugcaaguagucacauuccuccacauagaaguguagucuguccuccagcucuuccaaguaccugggcuccuucaggacacucuccccuuggccaaaagccuccagccggccugucucccugccaaaaucaccacgauaagagacucagcccugcacucaacuccucagucugcuguucuggagggcaggugagaugggcccuagccuuauccaguguuggggugaccuaagcuuugccucacagccgccgcagcccccauacccaucauggugguacuuguggaucacacagaugcuccguggauggagauggacucugaggaagucugaccagacuuugaugcuguucucuguggggauaaaggauuuuggaaucuguagcagggaugacuagugggaggaugcagccgaugcgauggaccgucccccaagcugcuccucuguccaguguccagcaucaagugcuaucucaccuuugccauuuuggauauucugaaucaguuuggcccuccaggcaccgucacuacuccgcacucccugggaggggugagaagauuuuaguuccagguuguuuucguccgccaugggcguauccuuacuuauguguaucugcguguaucuuuaagguuaugugcaccacgugccugagguacccaaagccagaagaggguguuagaaccccagggacugaaguuacagcugugagcugccugauguggacccugggaacucaaugcagaguucuggaagaacagguccgacucuuaaccucugagccaguuucuggguucccgccaguucagagacaacggugcuuuuuccaaaaacacuacucuauggcauuuacagugacuagacaccuuuuacugugcaucggagagccacugugcuuguagcagguuuaaagguuugggacagagccccaccccucgucaucaccucugcacucagaaggcccuggagguuuggguucuuugguugggcgucaucucugugugugcugagcuuccccugccugaaagaguaagaguaagcagaguucuccagccgucuauguacacacagugggccaugcucacaggagcgguacuuaccacgcuacugcagccucuagcugucggucucuguagagguuaccuucuucuuuuagaguguucagacuaccugcccagaaaugaaaggcaagguuaaaccuagggggucaugugaucaagacuaaacugaucaccugucagggaauaugguguggcaguuccucucuaccuagaugaggugucccuuuguagcccugaguaguuuccaacaauacagacaaauugguuuugaacucagagcuucuaccugccuuggcugggauuaagggcgugcccaacuacauggcacuuggauauacauuagaugggacagggaauauggaauccauccuucucucaaaagcugugguccagccgggcaguggugguuuacgccuuuaaucccagcacuagggaggcagaggcaggcggauuucugaguucgaggccagccuggucuacaaagugaguuccaggacagccagggcuauacagagaaacccugucucgaaaacaaacaaacaaaaaaacaaaacaagcugugguccgucuguaggugugagugcaagcagcuuaacauuauacugacaauuccagagccagauccugaaguaaacuugccuuuucgacaucgucggggguugugcccgauccgguaucugaagugaacugaugcuagggcccucgcacgccacacgggaaaacuuggcugagcccaccaucgccucaccuuucagauccauuaggaugagucgaggcguauagguuuccuggccaugcaguguccggccuguucuguacaagacgucggggcacagcucgccuggcgacucuucguccucggccaugcgucccagcgcagcauccuguaggggucacagggcugagcggagggggaagaggggcagggccgguacugucugcggggaacgccgggcugccgcuaggugccugaccugcugguuccaccagugcgcccccacgaaacccgcgaaaugucccaacugcagcgugagcaccucgcgggccccgcccgccauaccgccgcugcucuugggcacuccacugccgccgcgggcccaucagccggagggggcggcucccgcgcgagcacgugcuuucccguuggccucccgauucguuggucuccgaggccgcagcuca

SEQ ID NO: 1495 - RNA, 8895 nt, Mus musculus
ugagcugcggccucggagaccaacgaaucgggaggccaacgggaaagcacgugcucgcgcgggagccgcccccuccggcugaugggcccgcggcggcaguggagugcccaagagcagcggcgguauggcgggcggggcccgcgaggugcucacgcugcaguugggacauuucgcggguuucgugggggcgcacugguggaaccagcaggucaggcaccuagcggcagcccggcguuccccgcagacaguaccggcccugccccucuucccccuccgcucagcccugugaccccuacaggaugcugcgcugggacgcauggccgaggacgaagagucgccaggcgagcugugccccgacgucuuguacagaacaggccggacacugcauggccaggaaaccuauacgccucgacucauccuaauggaucugaaaggugaggcgauggugggcucagccaaguuuucccguguggcgugcgagggcccuagcaucaguucacuucagauaccggaucgggcacaacccccgacgaugucgaaaaggcaaguuuacuucaggaucuggcucuggaauugucaguauaauguuaagcugcuugcacucacaccuacagacggaccacagcuuguuuuguuuuuuuguuuguuuguuuucgagacaggguuucucuguauagcccuggcuguccuggaacucacuuuguagaccaggcuggccucgaacucagaaauccgccugccucugccucccuagugcugggauuaaaggcguaaaccaccacugcccggcuggaccacagcuuuugagagaaggauggauuccauauucccugucccaucuaauguauauccaagugccauguaguugggcacgcccuuaaucccagccaaggcagguagaagcucugaguucaaaaccaauuugucuguauuguuggaaacuacucagggcuacaaagggacaccucaucuagguagagaggaacugccacaccauauucccugacaggugaucaguuuagucuugaucacaugacccccuagguuuaaccuugccuuucauuucugggcagguagucugaacacucuaaaagaagaagguaaccucuacagagaccgacagcuagaggcugcaguagcgugguaaguaccgcuccugugagcauggcccacuguguguacauagacggcuggagaacucugcuuacucuuacucuuucaggcaggggaagcucagcacacacagagaugacgcccaaccaaagaacccaaaccuccagggccuucugagugcagaggugaugacgagggguggggcucugucccaaaccuuuaaaccugcuacaagcacaguggcucuccgaugcacaguaaaaggugucuagucacuguaaaugccauagaguaguguuuuuggaaaaagcaccguugucucugaacuggcgggaacccagaaacuggcucagagguuaagagucggaccuguucuuccagaacucugcauugaguucccaggguccacaucaggcagcucacagcuguaacuucagucccugggguucuaacacccucuucuggcuuuggguaccucaggcacguggugcacauaaccuuaaagauacacgcagauacacauaaguaaggauacgcccauggcggacgaaaacaaccuggaacuaaaaucuucucaccccucccagggagugcggaguagugacggugccuggagggccaaacugauucagaauauccaaaauggcaaaggugagauagcacuugaugcuggacacuggacagaggagcagcuugggggacgguccaucgcaucggcugcauccucccacuagucaucccugcuacagauuccaaaauccuuuauccccacagagaacagcaucaaagucuggucagacuuccucagaguccaucuccauccacggagcaucugugugauccacaaguaccaccaugauggguaugggggcugcggcggcugugaggcaaagcuuaggucaccccaacacuggauaaggcuagggcccaucucaccugcccuccagaacagcagacugaggaguugagugcagggcugagucucuuaucguggugauuuuggcagggagacaggccggcuggaggcuuuuggccaaggggagaguguccugaaggagcccagguacuuggaagagcuggaggacagacuacacuucuauguggaggaaugugacuacuugcagguagcuguguggcaagguggaugauguugggguacaaagucuccucguccuaaagcccccgcccccauauuuuggucuucauuugucuccagggcuuccagcuccugugugaccugcacgauggcuucucuggaguaggugcuaaaacugcagagcuacuacaagacgaguaugcagggcggggaguccuaaccuggggccugcucccgggccccuacagucuuggggugaguggaagcuggaagagcgagcaguagagguugggaaaagaggaucccacugugcaaguugccugaugcaagccacucccguuucuauuaccaggagccucagaaaaacaucuaucgucucuuaaacacggcauuuggucuggugcaccugacuggauacagcuccuucgucugucccuuaucccuuggagggaaccugggccugcgacccaagccgccugucaacuucccuucccuacauuaugauguaaggcucaagcucagccuguggcgucuguucuguguuucucuugcccccaacucccuguggcuguguguugccuagcacaugcaguacuggggaggccuucauaacagcaaaguggguuuccagcauggacuuggccccuuagccgcucacguuuuuccuauuuaaggacagucugguuuccuucccuggaugucuguccuucauguucugccuccaccuauuuuccacacccagaagacacaguguuccccuccugucccacuugacaggccacucugcccuuccacuguagcgccauccuggcgacagcgcuggacacggugacuguucccuaucgccugcgcuccucaaugguuaccauggcucacuuggcugaugugcuaaguuucucugggaaaaagguaaggagcugugugaggggcuaacccaaagcucagaaaacccuuuguaaccugcucccucccgguguuuagguggugacagcagaagcaaucauccccuucccacugguucgaggccagucccuuccugacauccugacgcagcuuggagaagccaccccauggaccucccugucggcaugcggggauucugcuggacaucggugcuuugcccagucuguggugcucagaggcauagacagagcuagccacaccagguaaagacugcugggucuuccaggccccuguaaguacugggcaugucuuuguuucccuagcacgcuuucugacacccuuuuccugcuaccauggacaccuuacccagaaaaaaaaagcucuggaccaguucacuugaugguccaagaauguaugaaucuuagcuuacauucgugcagccaaagguaaaugcgguuuuuuccuugcaguaagcucaacccagggacaccucugcccucugcucuccacgcaugcgccucuggagaagaagucuuggcccaguacuuacagcagcagcauccuagagucuugaggucgguccauaugcaccugcccuucccccagcccuugcagcccuggccccugcucaucaccucucugucugcaguucgucacaucugcugcugacucccugcaaaguggcuccuccauacccacacuucuucucaagcuucagucagaaagggcuggccauggacaguacccccaagggcgcagguaggacaugaagaaaacgaacacuugagcuacauaggaacaguuuuacucuuuucuuuuuacaguuuuuuccaggaggauuaaaagugcaaagaaaacaaaguucacaguucaguguuccucuccuugacuacgagccccuggggagcacacagaagggacagcacacgagucaccgcuguaccucccacucagcgucccucuucuuucccuccgcagcaguacagagcaucccuguguuuggggccuugcguucaacuucauccuugcaccguacgcugggagacuuggcugaagagcucagcagacuugaccugcggcgcugggcuagcuucauggacgcuggcguggagcaggaugacauggaagagaugcugcacgaguuacacagguuggcccaguguuaccaggagggugacagucucucgaacugaaguccaggggaggguagugggagagaauuuauaauaaaagcugccgugcaggaacccaguguguagggaccuguuacaugacauacgcauuuguacauuuaaaaacacugagaccaccagacuccgaggcaagccccgagcucccucagugcuauguacagauagauugggcuuguagggucuucaccaacgccccugagagaugagcuguagagccaucuccauucuugcucuguccucaaggucuccacgagugaggcgcgcccuaucuccagugcugauggcuguaggguggguccuggcagaugucacucgucuagcuccucuucugacagcagguccccguggucagagagcuggucugcguugcuggugcugguagcaucguccucguccucagagcuggccucgcaggccgugugaaagagcugcaugagcucucggaagcggugggaaaccuaggacaggaagagggccaugcucuuacaguggacaggcaggugggcagccgggggggggggggggggggugcagggggagggagaccagggcugagucuuauguauaggaaagagaaccgcgcacacgcaugcacacacacacacacacacacacacacacacacacacacacacacacacauauacaguauguguguaccuuuaauuccagcaauaaggaggcugagccagauggaucucugaguucaaguugagaccaccugaccuacauuguucuaggcuuuccagacacagugaaaaugcugucuccaaagaaacccuagcaccuggcaggucgagccuuuuucagagcacucuuuaaaguugcugccaugauugaccgugaccccggcuggucccauccgcucaccucuguccccaucaucaccugccccucccaccuuaccucaacaggggucuuauuucccagcugcugagaaaugacacugaaggugugaggcugugcucccugcuccuggcacauggugagaaucacucggucugcuucccuguaaugcaggcaggaugguuagcuccaagcuuuucaaucuguauuaaauucugcaacuacaacccaucuauaccuaccuuguccaaagcaccaccuucuccccaguggagcugaccuugcuguuguuggcacagacgguggcuucugaggcuuuugguagcgccccuucugggcccaugccuugugucccacugucuucagccaggaccucucuggcaguuuugggagcagccucugaggcccuagcuccugaugacuuuucacagauaggggccgccacaugggcugccucugccucagcucugcucucgaugagccaacucugacugccugcuuucccacaaaugugucuucuccccgugucucugguccuuguagaaacaggacuugggaggggagcagagugcuccacaguuuccggcagucucucaguuucugaugcuucucgguggggugcaauagucucugaguucgcagcagcccuuugguccucccccucuucaggagguaaggaggaugugcugaggcaggagacaacuucaggcccagccugguuucuccugacagagcagacuacagcuccagucugaggaggaagccgaggagucucugcugagcagagcgcugggcccuccaacagcagcuccaugggagucacuucugcaggacacagcaaaguacucccuauuguugacccugcuuagaaggaauaugggaucagaguaugcacugggaaccacagcccuggggagcuacaacaauguaguuccaguagaaaggcugcuggagagaauggagccacucaaaggaggccaggguugguagaauauugauuacacaagcguagggaaagacucuaggaaucuguuuuauuguuauuuuugagacagggucccacuauguagcucuggcuagucuggaacucacuguguagaccaugcgugugagagaugggagugggaaagggagucacauagucuguccacgacagcguggcacgcccaccacugcaaagcuguuagagcagcugacauagcuugcugcaguguggggaaaagcaaagaaggcaggagcagcagccguagcguggucagucacuuaccuggagcaggugccucucccuuucgcgugguccuggcagucuuacucugggucaccuccauguucuccugcuccuccaggauuuccucuucuaacauguccuugccuugcccugcuuccuuacugccaggcacaguacuggccucguggagggggccacugcccaccaacucagggggcuccuugcucuuguaggguuugcugucacagaccugcaagggcgacucuagguuaaaaaugcccugaccuuccuaugucucaggccuccccaaggcaaggccucugcuggugcucagcaagucagccagcaugcuuuuaaauaguaggagucuguuucuaaugaggacuccauuugugauacuaaucaacucacugugaagauccaaaguuaucuuuacuccguuuugcucacagguuuauuugaugaaaagaaagggaaaccuaaggagacaauuguagggccuacccacaaugauaucacacagaagcagacuucauagaggauguccccagacaauaacaagucuauaaggaaguacuuuaacuacaguuuuacucuccauuucuagaagcauuaguuuuauucauuuuaugcauaucauggcugugcauauucauuuuaugcauauuuuuaugcauauucaugucugugcaccaugugccuauggugcugaguccagaggaaagcacuggauccccuagaacuggaguuauagacaguugugagcugccguguaggugcagggaaaagaagcaacggccuuuggaaggccagccaguguucuuaacugcugcacuaucccuccaaccaccaguguucugagacugaggcuuuauguucgcuccaugcuauacaguguuuguuucccagccccuggucucugucucccaagaugugaacaccauauucaaaucaaagacuguuuuuuuuuuccuuaaaaaaaaaaaaaaaaaaagccuacagcacccaguauucccagguggucucccauucaaauacuaaccaggccucgcccugcuuagcuuccaagaccagacaagaucgagugcauucagggugguauggccguaggucauagauuguuuaaaaaggaaaauccagauaggaaguuggggagcauaccuuuaauuccaagaccugggaggcagaagcagauggaucucugugaguuagacacuagccuggucuauagaguaaauuccaggacagucaaggauauacagagacacccaacuguaaucccagcacuuaagcaguggaggcaggaguccaaggcucacuacauggucaauacagcaagggcuacaugaggcuuuaucuuaaaaauuuaaaagcaaccaacaucaccucagaaaaaaaggcaaaaaaaucuaaagcugaagauguagcucaaucgguggagugcuugccuaccauaaaaggagcccuggguuugaucucagcuacacauaaauugagugugggauuuauguccauaguccuaaaacucaaaagauacagacagaaggauggugaguuuggggucaagcuggguuauguaacaagucacugucucaagaccaaacaacaagacaaaccaugacaacaaaaggaaaaauccgcccauguccuuuggcuuugagagaggguguuaccaucccaggcugcccucacaauugugauguagcugaguaugaccuagaacuucugaucuuccugcuuuuaccuccuucucaugcggaguuuacaggccaggcaucuggcuccauuuuagauuuuguagaaggguccauuuauuuuauguaugugcacaucuguguauugcauauaaucugauguauaugaucacuuuauaaauucaaaaagacaccaaccuguaguagcagaacagcaccuaugaggaguguuggcacacaccuucacucccagcuggcagagcagagguaggagggugugagcccccagccccaugccaacaaagccccagcaucugcagugacaucgaggccugggcaguccccacaucaagcgccuuucucaccuugcugcugcagugacaauuucuccuuuugcucuucuucagcuuagauucgggaccucccucauggcaggaacaggaacaguccuuggcugcuucaggccauucgguguccuacaacaaaccccggcuuccuuagccgcccacuacuuucagaacugagagaaacagcugaguugagaggccucccacuccucuuugagaauguaccaucuuaucacugaggggacacugguuacagucccuuaagaaucccugaagaguccacaaugauccaaagaaagaggcaugccauaggcccaggacaaacuuaagucaaacagauuuuaaagaagaaaugcacuggggaacuccagaguagauccaggucagacuuucugacuccugguguauucucuaaacucuuagaaauggcuuuguacagugacucuacucaauaaagccaaaacccgagaacugu

SEQ ID NO: 1496 - RNA, 129304 nt, Mus musculus
cggcgucgcgguggcccgucccaggagguccgcgccuagguaccuucgcucgcucuucaaaacauuccggucaccguggccagccucgucugcgcgggcgugcccgcuucuccccggccccagcaggggcgcgcaauggaacgucccgcgggggggauugugggaggcgcacguucgaggggugggggcgaaggcggcggcagccguggcugccguugguagccgugggggcggggaagagagggaggcgagccgaggaggagaaggaggaggaggaggaggaggagggaggaggcucgggcucgcgccaaggaagguacgcgugagggccgagagggagucgggagcgcgcgagccggaggccccagagcgagcgcgucggugcuggcggcgcggggcggccggaggcggugguuggagggcgcagcucgcgaccaguccggacccacucggaagcgugcgggcgggcgugcgcgcugcgcggccggagucgggugagggagggagggagggagggagggagggcggcggggagagcgcgcggagggaggagugggaggcgggagggggggcacgcggcgcccuucgcuggcucgcucgcucccucccuccccagagccgccgccgccgccgccgcugccgccgccgcugccgcucccgccgccauuuuggguucgcuuugcggaggggggagacgaucccggucucgguugccggacccgccuucucucgguuuccccuuucccgaccuacgccuuuggcuucuccucucucgcguuuccgccgguccgcuuacccgcuggccgccuccugacaagcgggaaggguuacaguguggagccagggaagccgaggcgccaggcugccacccucucucucuccacuugccugcacucggcgcucucggccucgcacggugaguagugcggugugagcaggccuuugaaggccccaaguagucucuccuuggcuacccgggauccgcugucacccccccggaccuggaccuccgggagagcggggugaggaugggggaagggagagcagggauagggauccugagcuuaccgggaagucccucuaggcggggugacggggugucccugaccagcgggcucuugguuugggggagggggacgggaaaguaagcgaguggaggcggagucgcuugugccccugacagguuaguuuguguaguaggcccgauuggagcaucccccaagauccaguuuaugucuguuuaaguaagggacaaaaguagcaagggagaugaucuucagcggguaguuuaccuguacaagaucugugguguucucgaaaggcggaaauauaugcagacaugacauagugaucugaguguuaauaaguuuaauaaaugucacugguuaguuucuacuuggaaagaaauguuuugggucuugaagaccagauggucuguugguuuauagcugcucuguuuauauguguauaauucgaggauggagaguguucaggaagaguuugccugcauuuggggaaguucccuuuguaaguuagcuuauuuaaaaacaaaugcugggacauguguucucuaggucgauaaaugugcauguauuuuagcauuaguaugauuaguaugauaauacagaaugcaugcuaagaucaggaaggggagaaacuugacauagucugugccuuugaauagagucaguuguguaaauaugaaagccagaccaacauccucagagugaucgcuauuaggcugagaauaaggggagauguuuuugaccguguggauuuauaguagugcauaaaguuuuuauauucagaguacucuuucaguucguaauccuaaaacuguaaaaauuauaggagaauaggaaaucccggcauaaagagguacuuuuccaaggucauguguuaaauuaguggcaauguugagauauuuugauuacuaauuuaguaauguauuguccauauuaucauagugccucaggagauuguuauugccaaauacaaguguauuuugaaaguagguaaauaugauugguuagauuaugcuugggagaacuuaaaagugucaaacauguauagaauauacacuguccuauaugagauagguauuuguaauuuuguuguguuuacaaagcaagcagaccacuucugacagcuuaguauguaugaaaguuccaauguguugcugggcagugguggcacauguuucuaauuccagcacuugggaggcagaggcagguggauuucugaguucgaggccagccuggucuacagaguugguuccaggacagccaggucuacagggagaaacccugucucccaaaaccaaauaaauaaauaaauaaauaaauaaauaaaaaguuaaacugcuuccacagccuacuuuguaucuguauagcuguuguuuguugcugguuggguuuuuugugugugugugugugggggggguggggggucagggggagggucagggggaauagauuaacccugcuagcaggcauucuaccaaagagccacacucguauuugggcagcuugacuuuauuucugccagugacaggaucuuuucggacucauccaacaaaauaauugauuccugucuugggguaagaauuaucaagaucuguugauuagguuguuggaauagauagggaugcauaagaggggaguugugaacauacagagagcaaauaaaucuguggaacugaaaccaccaacccuuuuuaaaaaaccagucugaauguggcacacacuugcaauccaagcauuccggaggcugaggcaggaggcgccugagcucaagcuucacauuaaguuuaaggucagccccugguuacaggaggccugggguccacucuagcuccaggguaucuggcacccuuuuccagucucugcugaugacuacacacuacacacacacacacacacacacacacacacacacacacacacccuuuuccagucucugcugaugacuacacacuacacacacacacacacacacacacacacacacacacacacacgagagagagagagagagagagagagagagagagagagagaauaugaauuuaaaagcuacuuaauuuagaaagaaucuaggcagauggacacaagaguagcaucauccaacaggugguauguuuguaauuagaguauaucuucuuugacauuuuccuuuuguuuugaaaaagggucuuacucucuauauagcccagacuagcccaggacccauuauguggcccaggcuggccucaaauuugaggcuuguaauguucuuaacauagcuuucugggguuacagucaugagccaacugccuggaugcuuuggcaguuucuuuuggcauuuaugaguaaacuguuuuugggaucuguaaauuauugauaugugccuuuggauauuggaacgucuuggcuggacuguaggaauucuucgaaaggcuaauuuuguaggacagauccccacuuggaaaacgaggaaaggaucuuugaacuaacucgacuguacuauugggauguuuccuagucuagaggauauauauauauguauauguauauauccauauccauccugagaaucggaagaaauagagaccuuacguuuaguguguagaugagcaggcuggcucagacagagaccucuggauggcuccggccugagugcugggguaagagcaugcaucacugugcccagcuacuaugugugcuuucaggagcuucaguugugguagaguaacaccaauuuguucagagggucuuguuuuaaaugcccacuuuuuucuugaauuguguuuggguguaaauguauuuaaguuugaaggugaaugcuggagcagaccuugugugucaucaggagaacuugacaggcauggugacucaucagcacauuuagaaaagccuaggcaggaaggaagauuagugugaauucaaggccauccuggacuacauagugaguucuaggcuagccuaagcuguagagugagacuuucaaaacaccagaaagggaaaagaaauuuauuuucucaaaauguauuucugcaguuaguaaauaauuguggacuauguuugauaaggauauagucucauuuuugagaaauagugucuuuuucuguguuguauguuaacacagauaauucaucuuccugauucuuuuugauuuuuguuuaguuauaagcacauuucauuauuccuacauggagaacacuuaagaugaaugguauuuagugucuguuguucuagauauuugaauccauaugagucuaugacuugcauaauauuggggacucucagacuaguaugaaucgagauuuuacaacuuguaaaggguuuuugauaauauuuauuauuuuaauuaauaauuuauuauuuauuaccuguaugugcuugauaugugucuggguaugcuugucaugguacacauguggaagucaggacaacuuuguggaguuggucaucucuccaucuuuguguaguuucugaucagaaucaggucaguagguuucugaagcacauauauuuacugaguuacauuguuggucuuguucauuacuaggaggcuauaaaaugcauauacuauauguaagguuauauacuuaaaauccuuucaggggcuaaagaaauggccauuaguuaagagcacuuacugcuuuuguaaaagacuagguuugguccucaaguacucaaauggcagcucacaaguacccauaacuauaguuccaagggauccaacgcuuucucugcaaguucuuggaugaaugugguagacauaaacucauuuugguacaaucauauacucauaaaaguaaaaaaaaaaauuuuuuuaaagugccuucauguugcaccggugugguggagcaagccuuuaaucccaguagcuugcuuuguuuuuugaaaaagggguuucacgaguccaggauacuacuguuuaccugaaggaaauuucuguaaaaaggucuugaugacauuuggggguauauaaaaaugaaaaaaaaaauccuucuggaugugaaauucaggaaucauuugacaguuacccaugaaaccacuauuugaaauuaaaaaaaaaauauuguacuuuuaaaaaaguagaaguuuaagaaagguuuauuuugggacuggagagauggcucagcgguuaagaucacugacugcucuuccaaaggucccaaguucaaaucucagcaaccacaugguggcucacaaccaucuguaaugagaucugacgcccuugucuggugugucugaagacagcuacagugaacuuacauauaauaaauaaaccuuuaaaaaaaaaggcuuauuuuggacaagguauuuuaacaggauagacugugggggucuuagugcuuugaguguuuugucuuuuuuauuuuuuagacuuauuuuauuuuaugcauauguuuuauguauaugcauguguaccaugugugugucugguaucuguggaggugagaagagggacuuggaucuugagaacauacaguuguuggcuacuacgugagugcugagcacaguauacgcauuaauagauauuuaucuuuccaucccuuuuuuguauuagaauggccucuguaaaacuuugugaaaaguuuaguguucucuccaaugcuuaaugaguauguccaugguguugcuuuguuauauaugccauaugccugcauauauaggcauaagcuuauauuuuucacauaagcauguguuuuauccuuuguguauuucacauacuucaaaauuaauuaauuuuuuugaggcaguaucccacauaauagccuaggcuauccuggaauucacuauguagcucagacuaggcucaaacucaugaaagucaucuugccucagccuccuagguccaggagguagaggcccaagccaacaugagcuauguaugugggaggaucacuuaagcccaugaguuagaggucagccuagguagcauuuugugaucuugucucaaaaacaaaacaaaacaaauacuucaagauuucucucucuuucucucuuucucucucucucccucucucucucucucucucucucucucucacacacacacacacacacacacacacacacacagaggggggcacggggagagaggggcuuaaauucuuauggaagaguaauagaaaaaaccuagaccauccaauuaaaguguggcuggguuacaugguaagacccuguuucaaacaaaccaaaaccagaaguagaaaaggauaauguccuguuuuuacauugugaacuugcagauaucuugcagggcauuggcuucacaguauuaacaguuccauugucgcuaagguuuccucugugcuuugcuaauaaagacauggccacuuccauuccugcccauuuguuugugcauaguggagaagucugaccguguauauaguuguguauauaguugcaguuuccaaaaaacaaaacaaaacaaaacuucauauugcuauuugaauuaaguauguuggucuaaauauuuuaagggauuuuuaaagauacuuauuuuugcacauggaagcaagagagacagagacagagagaugagagacugagagagauuacauugaggggccaggagaggguauuagauccccuggaacuggagauaaagguggaucaaacaacccaaccugguacuggcaacgaaacucugguccucuacaagaguagcaagugcucuuaacugcugaguauuuuaaaaacauacugugucagccuucaaaaagaaugagauagauucucuaaaccuuguuaccacaaaaaaggaaaaugugcauugcaguuguuuauuauugcuuuuauauaugcugcuaguucuuacaauuuuucuggguuagcuguaauuuuuuuuuuuuuuuuuuuuuuuuuuuuuugguuuauucgagacaggguuucuuuguccuggaacucacucuguagaccaggcuggccuugaacucagaaaucagccugccucugccucccaagugcugggauuaaaggcaugcgccaccaugcccggcuagcuguaauuuuuuuuuguuuguguuuucauuugcauauauguaucuguguguucuugugaguagaaaugggagaagacuuuaagugucauuccuucucaguugcuguuuaucugauauuugaaauagagucucuuacuggcuuguggcucaacuaguaggcuaggugguagcuccagcuauguauauccuaacugagaucauaagcaagcaccacacuggcauuuuuuuacauugguccuggggcucagagucagggcuucacacuuacaaggcaagaacuuuaucagcugaacuaccaccccacuccuguuuguuucuuuguaugaaaauaguagccuuucugcuugucauccuaauaauuaccuggaaaaguaaggucuccuguaacuuagguuggauugcgaccuugaacuucuagucugccugacucuuaaaccuuccaagugccaggauuauaggcauaugcuaagccugccucggaaauucuuuuuuuuuguuuuuguuaacugagucauuagaauuguuauuuuagaguuguauuucugucauuguauuuuauauguuugaagaaucuaugaauuuuauuuuuaguauuuauuacuuuuacucuuaauuuuuuuucaguuuaaagaaguuuuauuuauguguauaguuuuuuuuuuuuuuuuuggcugcauguuugucuuuaucauuuguauaucaggugccuauguggacagaaguggagguucaguucccuggaauuggaguuagagaugguuaugagccaccuuguggguacugggaacugcagucuucuggaagaagaacauccauuucuccagccccugcucuuucauucguauauugaaaacuaaccuccauagauagauuuauauaacucuuaagauauucuuuuuaaugaucauuagaauuaauuuacgugugcugacuccugguaaucuauguugucacuagggaaccccucuaacaacgaaagugaccagagagugccaucacugauuuuauauguucucauauuagucagaaaagcuuguuggcucuuaacagauuuauaagcuacaaguaacauguugauacuuuucaauuguuuuagucauacugacaaaauguuaaaaacauuuucuaguggaauccaucaccacaaagaaauggguuggauuggagacauugaacaagagcagaauuguucagucccaaggcaucuugcuauuuacaagaaugaaauccauauugguuugauuuuugaaguucugaugaugaacacuauguauggguaguugggaaauuguacuuuuggauuuguuuccuacuuuagaacccaugugguguucaucaugagcagaagcaagacggugacagcaaaggcugcucuuaagcugagagaauguucugagaauagacacucuaaauagucacucuuaagagauuauucaauuaucuaauuauguuuuauuuuauuuugaaauugggucucauucuuaguuuaaguuggccugaaacucacuauuuaacucagcuuugucuuaaacuugauccuucugccucaaccucuugaauucuagauuauauuuauuuguuaucauacuuagccguuuguuuguuuguuuguuuguuuguuuuugagauggugucuugccguuuugcucagggugauugguuaaaaauacaucucucuaagauggcugacaauuauagcugagaugaacacaaguucuacuaacagcauuucauucuuguuuuuuguuuuuacaaugacacuuguuuuuuacuuaguguauguuugugugcaugcucacacacuuggaaugcacagaguuagucagagcuaacucuaagaagucagaucucguagguuuucaggauuggcugcaagguccuuuccccucugcgccaucucaaccacuuggguuuccaucucuugauagugucagauguuuuagacccauaguaaauaaggcaugaguuguugacuuaauauuuggcucuauguuuuguccuguuuucuguaccugauaccuagucauucuuagccaguuuuguuugucucaaggaggacugugugccaauuauaaguuaguuuuguuuuggcuucucaguguaaaugguauuauuugaaauuuggacaggacauuuuuaagguuuccuaguucuuuacugcugaaaugagaacuccagaguuuaaguauuuucugacuaacuccaacaaggcaaaauggaaacaaaauuaaaagauuaucucugaaaagaaaaaaugaagaauuaauguuugaaaaauagggcucaaagggauugaaucaguuguguagaaccaggugaacauuauauguuuucagagaagaucuaaagauacaaaucuuaaacaaguagagauuucauauccaacuaaaugauaaacacagguuggaaaguuaaugcaaagauaaaaauaaugagcaauuuuuucaaugaagaaacuuaaucuauuuauuuuuguaugcauauguuuaauuuugaggaaggaaaagucaagucauaauagaacaagguuaagauuuugauuaacaagguuuuuugcuuuucuuuuguguguguguguguguguguuuuuuuuuuuuuuuuugguuuuauuuuuuaaagauuuauuuauuuauuuauuuauuuuauguauaugaguacacuguagcuguacugaugguugugagccaccaugugguugcugggauuugaacucaggaccuuuggaagagccgcugagccaucucuccagcccagucuuauuuuuuuguuguuuauuugugguuuuuugguuuuucgagacaggguuucuuuguguaggcuguucugaaacuuacucuguagaccaggcugaccuuguacucugagaucgucugccucugccuccccaguacugugauuaaaggugugugccaccacuuccaagcaaccaguauuucuuaaaugcuccuucuaugucaguuaaaaauaacuuuuuauaucaguuaauugggcuggauguaggggcacaugcccuggcacuuggagcagagguauguagcucucugaguuugaggccagccuggucuacaugguuccaggacagccagggcuacauagugagauucugucucaaaaaaauauaguggggggaggggggguuaggggccuggagaggauggccagugguuaagaacacccagguucaauuuccaggaucccaauugcaacuccaguuccagggcucugacuccaucacacagauuuacauucaggcaaaauaccagugcacauaaaauaaauuuuuaaaaagacaguuaauuguuagauaaugucauauaauauauuucuaaaguuuacauuguuaaucuguuaguguuaaaaacaaaagaacaccauaauggagaacuagaaagauggcuuagugguuaagaggugcacuuggacuuucagagcauccagguuagauucucagcacccguauggcaucucacaacccucugcaucaucugaccugcucauauggugccuagacauguauaaaggcagaacacauauauacacaaaacaaaagcugggugugauggcacaggccuuugggaggcacaagaccuccgaguucaaggcuagacuggucuacaaagagcgucccagaccugccagaucuucauaaagagaaccugucucaaaucagauaaaagcaacuaagcagggcuagagaggugacucaggaguuaggagcucauagugccauagcagggcuugacuccaagcacccuuguuggacaucauggaguuauauguuuguaacuccaggcuagcuagcccuugaauuucugauuuuccuguuucagacucgcaucucaccuuagaaguaguuuauauuggggguacagccagaguuacauagugagagccugucucaaaaaaaaaaaaaaaaggugugggacaggggauggggggcugccuccaguaggcuggaauuuugaugagccagcgagcugggcuuggugauacacaacuuuaauuccagcauucuggagacagagguaguugaaccucugaguucgaggucaacauacauagcaaguucuaggguagucaaggauauauaguuugaucuuguuuuuguuuuuuuguuugguuguuugguuuuuaagugggcuugugagauggcucagccgguaaaggugcugacugccaaucugaguaucugcgauaaggucgauuucugggacccacagaccugauucccuaagguuguccuccauccugcacauacaaacucuaaaaggcaggucuuucagugaguuuuaacugcuuugaguuugcuugauaaaauuuaauaagcacagucauugccauuuggugacagauaauuacuuguuuuacuauuuuuuuuuuuuuaaagauuuauuuauuuauuauauguaaguacacuguagcugucuucagacacuccagaagagggcaucagaucucauuacgggugguugugagccaccaugugguugcugggauuugaacuuuggaccuucggaagagcagucgggugcucuuacccacugagccaucucaccagccccguuuuacuauuuuuuuaaaauuuuguuuuggcuuuucuuuuuugagacaacguuccucaggccuugaaaauauucaggggcaaacuuguuuguugguacacuuucacacucagguacaacaccuaguccaccucucuccucauuugcaugcauacauuuaauggaacuaugaaugguuagagaaauaccaggaagguuaauaggauuccaaauguagcagagaggaguaaaaaucaggucugaaaacuauuuaaaggcaauaugacgcaucuaagaaaaaccaggccaaccugucugauccuuaaaugguagacuugacucuuauuggcuauaaagccugucuuuucaucuaaaaacggaagccauaguaagcaccucauggugauagacuugaguuagaugugugaagcauuaguauagagcuuugcauagaguaaaagcuuagugaaacauuagggacuuuaauuguaaguuaaaaauguuaaacuuacuaucaagacucauguaguacuuauaaaauuuaugauaaaguuuuacauuccuuugcuaaauuguguucuaucaaaguaugguuauuuccaucccauuccugguaguaguaaugggaucuaagcaguaaguggucuuccacauauaguuaaauugugauuuuguaccagagaccaaagcauugcuugccugucuuccuccuccucucacucccuucuucccucccucccuguacugggguugacccuuguccaugauaggcaaaugcuguacuaacucauacccacagccucauaacacuguauuaauauguauucauguguucauuaaugcauguuugugugagaguguacauuauuugaagacaaauccacugagcugugucguuggccuuuuuauuuuaucagaucuauuguuuguuacuuguauaugggauuauuguggcaguaagccgaggaauucacuugagagaagaaauaggguaugauugugaagagcaaguuugaguuuuuuccauucagacauuuuacuuauauguagaggagguaguuuuuuguuuuuucucuuucauguagcccagguuugccuugaauuugcuauauaugaccuagaacucuccugcucuccuuccuaaguguuagaauugcagaaguauuucacuguaugcaguuauuguuuuguuuuuguauguggugguagggauuaagucuagguuuucauaugugcccuaguuggaaaugguaacuuuauguugcuuuccuagauauuuaguggcacguugccaaauagacagcaaauaacauuuguaaauuauuauggugauuucaaaaaauucauaaauaauucuaccauauugucagauuaucauauauuguaguuacauaaauguguauccuacuaauguaauuaauuuuccaauuuguucauaauguuauaaacauaaaugguauauggguucuaugccaugaagcuaguguugacuuuuuucuguuuauugggguaggguagucuuaugugugccaggcugucccacuccaaggaugaccuugaacuuuuuuuuuuuuuuaaaacauguuuauuuauuuauuuauuaauuauauauaaguacacuggagcugucuucagacacaccagaagagggcaucagaucucauuacagaugguugugagccaccaugugguugcugggauuugaacucaggaccuuuggaagagcagucagugcucuuaacugcugagccaucucaccagcccaaccuugaacuucugauuguccugcccccaccuucccagagcugggguagaauccaggauuugauauguauuaggcaagcacucuaucagcugacccauauccuuuuuacuucuuuucaguuucacuaguuuguucuggauuguuccagagauuugaacauguaaaccacaaaaguacauuuaaaaugaauguugaauuugcuucuuuaagcagaaaggcaacaguucuuaaaucuuuauuuuucuuuguaacuauauuuuaaauuaaauaugcuauagaaggaaacagaauauguuauacauaacuuggcacucuaauucuggauagaaacaucccccaaaccgaaaaaaugccauuuacaagccguauuacuucagacauucaaaacagcaugccuguuguagcuguaguggucaguucuucggagguugaaggagaaggaucacaaguucaaggccaauaauaaaaugcugucaaaacaguaacaacaaaaacucugcagcccauggucuagaacauuugaugccagaaguuuugauugggggcuguugguuuuauuuauuuauuuauuuauuuauuuuaacuuucagauaguauaauauugauugaaugaaccaacacugauuuguuagaagcuuuugggaaaguacucuuuuaucaaacuuuaauauuucuguauuauugaacauaauucauagaaauucugguaauuaaaacuaaaaucaaauuuaguucuaguuuugucauugcuaaauugaguggaaaaacuuguuuuucaugguucugaaucuaccacaaaaaccaguagaacuuuauguuuuauauggagagaaagcauguuacagaaccacaaacacucuuaaaguauaaaacauuuuacacugauaaaaaauuguuugaaggauaagguuucuuuuucaggauuggaggccuggaucuuuagucagucauauguuuuguuguuguuuucuuccuguuuauuguuuuguuuuugagacaaagucucacuaaacugucccuucuggcugugaacuuggaaguucugcuucaaagcucucagguuugggcauuauaugcaugcaucauuucguacagcuauguuuuugccauuacucaggcaaaaacucauacucauacucaggguccugcucaugccagacaaaugauacaaaugauacagauuaagcugcucugccagauagauauaugacaucaaaacaagccugucaguccucaagaagacugaauuauuugggucugagagaugacaaaaaguuaagagcuuuuuguucuugcagaggacucaggugagauuccaagcacccacauugugaccggagaucauuuguaauuccaguucuagaggauugucuuugaugaguaccaggcucacaaccaucugccauugggucccuugcccuuuucugguaugucugaagacagcaacaguauacuuacauacauaaaauaaauaaaucuauuuuuaaaaaugcuugaacacugaaauugacaaaaagcuuaaaauaauucauuuuuaaucaaaugaauuuuguuuaaaaauguggaaaauacauuucuuuaaaauugaauuuucacaccaggcauagugaugcucauuguaaccucagcauucuggaggcugaagaaggagggcuuugagcuuuauaggcagaaacagauuaaaauaacagauuuauuucuagguuguauuuggguuuggacaucaguugcagaagcuuccugguugguuuguaaugguuuuuagucuggguuucucuaugcagaccuggcuguccuggaacuugcuuuguaggcaggauagucuugaauuuacagaugcaccugccucugccucugaaguguugggauuaaagaugagcaccaccgugcuaggcaaagauccgucuuagcuguauaacaaguucaaggcuaucuuggguuacaugagauccuuugucaaaaaagaacaagauacacacacacauacacagagagagagagagagagagagagagagagagagagagagagagagagagagagagagagagagaggaggaagaggaaagagaaagaaggaucucccugaaccagccucaaacuugcgauccuuuugucuuagcuccugaagagcugugauuuaggaauggaccuccaggcucagcuggaacagugauuugugcuguaguauuguggcuuacucauaucuacagaacaaugaaaggaaauaugacauuuuaagugaauuuacaaguaaaugauuuguauguauucuaaagacauuguaauuuaacugauacgcauauaaaacuguuagauauauauacacauauauauguauguauaaacgauaugugugugugaguucugcuguccuuauugcuccuuucuuauauguuaauuucugauaaauuuuuguuaugaucuauccugcagggaaagagaugcugguugcaaguuuuggaaaacccuauuuuuuuauggaacaguguucuguaaaaguuuuguaagaucccuuggcaauaacacacuugugauggacccuaggaauacugcuauguuaggauuggguucugauuccgaaggauuuucaagaaagaguccuucuaccaucaauccuggcacucuggccagcaaaagagaagcagagauagagggugccacagaagaagaggauccucgcaagcggaaucgagaaaggggcacagaagcaggaaaggaggauggcucgacggaugcacagcaacaguuuucagugaaagaaacaaacuuuucagagggaaacuuaaaauugaaaauuggccuucaggcaaagagaacuaaaaagccuccaaagaacuuggagaacuaugugugucgaccugccauaaagacaaccaucaagcacucaaggaaagcacuuaaaagugggaagaugacagaugagaagaaugagcacugcccuucaaaaugggugagugaacuuugcaacaggacagucauugucaauacuuggauuucucugcuaaucuuuaucuauacuagguacaaaucccagaagugugauucuaaucuuuaguuguuucuaaaugggcuauaagggaugcuaaaagcauaguuaauauaucucugucuauauuuugaaauuacucaguuugugaguaugugugugggugccacauccugcaccuggaggucagaggacaacuugggugucaauucucuccuuccaccuccacaugguuucuggggaucgaacucagggcaggcuuucaagauaagcgccuuuaccagcugagucaucuuacagguacauauguguaucuguaguauuauuuguaaaauuaugaugucuuaauaggggcauacucaaauuguugcuccuaaugugacauuggaaaaaaaccuuggagguuauuuuuuggaaauuuaaauuuuugaaucuugccuuucuauuuccaauaaugaagggaugaacauaguaacagaaaguaaacugaggcucagaaauagaagguuaucauaacaccuuucuuuuaacaugguuggaaggauguaauucacuuucuaagacauucgcauaaggcacacugcagaucaacaguccuagcuucucuggaaaccagugcaggauauccucacucaaagcaacauacaaacaaaaaaguaccuagcugccucuacacacucuugguaguguguaggguucuggggucccuguccacuucgccacagggcauggcaggacacggggaguugaccaugcuguugcuggacagguguugggcugaagggcggccccaggacacuggggguggguaagcaauccaaggugcuagacagcuggagcuggcuuggugguccgcaaggcuggagccaucugguucucaggcucuugggcauccaggugcugguggaagcuauggggagaguccuuggcuuggugguuggcuuggacuugggcuugguggcugcuguggcugggagugcagagaguccuucuaagggagauuagaugguggcucuguaggcaaaggccuuuuccauggcaccccaugcagauccaggugaaaagaggcaguccgugguuuuaaggcauuuauugucauggcagaaaguggauguaaauccauauggcacuucucagggugggccugagguuagauaccuuuugcagggaggaaugucugggaaggagaguuuauuggcuccaggccuucagguaccucauuaaaauggagaucugucuugagccuauggucauguccucuacauguggaggggcuuggggccuugcccuuacaugacugauguccacaaaucuauggagggcugcagcuaguaauagggccuggugcccaccuaccaucccuucaaggucucugggguuucuagccuuagcucugcugggagccaagcuauuuuucaggucccacaguagugcacccaguuauuugggaggcagaaacaaguggauggaucucugaguuugaggccagcuuggcuuauauggagaguuccacgacggcuaguacuacuacauagugagacauugucccauaaauaaauaaauaaauaaauaaauaaauaaauaaauaaauaaauauggcaugugccuguugcccacaaaagccagaauuaaguaaguguuggauucccuggaaaauugggguugcagacaguuuggaaccucgaguguguguguguguguguguguguguguguguguguguauguauguauguguauaugccgugcguguguguguguguguguguguguguguauguauguguauaugccacaguauguggaugugguuguugcuucuggggauugaauuugguucucaagcuugcuggcaaguacccucccccaaaaagucaucuugccaacucuuugguuguuuaguuuucuuuagauauuacuaucuaaaguaguugauaaauaauuugccauguguguaguuuucaacucauaaauuguuuugggagcuuggauauaguucaguuuguaaaguaguucuguagcaugcaugaaacuuguaugcaauccucagcauugaauacaaaaaauuuuaaauuauuuuuauucauaacugcucuuacuauuugagccuaggcucaccucagacuugcuguauauaccaggcucuccucacacucaagauccugcauuagccuucuuggagcuaugauuguaggcaugguaagcauguaucucugugcauagcaucagucuuuacuugugguaucuggauuugauacaucauuugaaaaacuuucuguuuuuacuuauuuguuggcaguuuuauacauguauagaauauauuaucacauccauucccagcucuaccuuccacuucaacacauguucuuucuacuuuuauuucucccccuucuucugguuucuuugcaugugccuaugguguaaauguccuugcaggccagaggugugggaucucccuggaguuggaguuaaaggugguuguguucaccccaugugaguccugggaacugaacuuggauauucugaaagaggaaguauuguguucuuaacuggugagacauuucccuaggauccuccaaccccuuuuuuaagauacugagaguaaaacuguuucucugauuucuuucuuagagugguggugguugauauauacgaaggcuauugcacacacacacacacacacacauauauauguauauauauacacacacacacacauauguauuuauguauauauacauacauauauauaugcacacacauacauauauauauauauacauauacauauuuagcuuaaggugucuaagaguucugauugaggcuuuaaagauucuuugguauauagucauaccaucuucacacagagauacuuugacuuuccuguuuguauuccuuuuauuugcuugucuuacugcucuaagaccuccuaguaguggaaaaaguggacauccuugucuuaauccuaauuuuaguagaaaugcuguucaaguccccgcccccuuuaauauauaauguuggcuauaguuugucauuuacagcuuuuacuagguuuagaaauauuccuucuauuaaaaguuucccucucccucccuccgucuucagcacucccgaguccccccuagaucucauuaugcagaccuggcuggccuggaacucuauauaggcugccguuuaauucacagagauccaccucccucugcuuucugaguacugggauuaaaggcauauaccacagugcccaaauucuucagaacuuuuaccaugaaaaguuacugcauuuugucaaguuuuuuaauguaucuauugagauggcuaugugauuucaauuuuauauauauaugaugaaugaaugaggauuuauuuauuuauuuuauguaugugaguacauuguugcugucuucagacacuccagaagagggagucagaucucguuacagaugguugugagccaccaugugguugcugggauuugaacucuggaccuucggaagagcagucgggugcucuuacccacugagccauaucaccagcccucuaccuuguuaaguaaccaauuuuucugucuuuuauuuuuauuuuuuauuuauuuauuuauuuuaagcaccaacuuuuguuccuuaucuuuuuaaaagagccaguuuuuuuuucuuuuuuuuuuaauacguauuuucuucaauuacauuuccaaugcuaucccaaaaguccccaccccccacacuccccuacccacccauucccauuuuuuggcccuggcauuccccuguacuggggcauauaacguuugccugaccaaugggccucucuuuccagugauggccgacuaggucaucuuuugauacauaugcagcuagagucaagagcugugggguacugguuaguucauaauguuguuccuccaauaggguugcagaucucuuuagcuccuuggauacuuucucuagcuccuccauugggggcccugugauccauccaauaguugacugugagcauccacuucuguguuugcuaggccccggccuagucucacaagggacagcuauaucaccguccuugcaacaaaggcuugcuaguguaugcaauggugucaucgcuuguaggcuaauuaugggauggaucccuggauauggcagucucuagauggaccauccuuuugucucagcuccaaacuuugucucuguaacuccuuccaugggugauuguuuccaauucuaagaaugagcaaaguguccacauuuuggucuucguucuucuucagaaaaaauauggaacgcuucacgaauuugcgugucauccuugcgcaggggccaugcuaaucuucucuguaucauuccaauuuuaguauaugugcugccgaagcgagcacaagagccaguuuuuuuguuucauuuuuuaguguauauugcuuguguuuguuagauuccauuuuguuaauuuaugcccuaaucuuaaugauuuccaucuuucuacuguucagggguuucacuuguuuuucuuuuaacuuagcccuaagguauaucauuaaauuuugcugauuucucugugguguuuguauguauguuaauauaaacauuuaaagcuccaaacuuucacuuuauaacuguuuuucucauacccugucagagcugguguauuguggguuuguuuguuuguuugcaauuuuuaauaaaaguuucuucuugauuucuagaaggaccuauucauuauucaguaguuuauuguuuaggcucaguaaguucgugucugcucuaggauuuuucuuucucgguugugcugugggaccuaagaucugaucugauuuagagaaaguugugguggcuucugagaagaaugugcugugcaggguuugagagggauggaugcucuccaggcaggcgucugcugggaucauuugauuuaggaugucauuuaacucagauguuucucugcuuauuuuuuguuguaagcaccugucaauuggugagaguuggguauuaaagucacccacugccauugugcuggaugaaccuguggcuuuacuugugcugucauuuguguuaugagacugggugcaccuguguuugcagcauauuuguuuggaaucuuaauguuccuuuugauggaauguucucuuaaucagucuguuuugucugacaccugcuucauuuccaggucuacuugccuggaacaccuuuucuaucuuuccacaggagauaguguccgucuuuugugguaauauacauuucuuagagcaguugacagucuaccaaucucuuucuuuugauuggggaguuaaaagcauuaaucuccagaguuauugaaaaguguguguuggugccuaucauuuaguugauuuuguauuguuuggucuuuuuucuucuuccuucucgcugaacuauuauacuagcaugauucuuuccuguggcuucguagauggauuugguuuucuuuccagucuaaaggauuccuucaaguauuuucuguagagcuuucuuuaaccuguuuuuuuuuuuuuaauggaauguuuuuauuuuucuuuccaguuaugacagguaguuuugcugaguauaguaguagcuuggguuggcgguugucuuucauaacuucagaacaucugugcaggucuccuggcauuuacagcuucugcucacuagucugaaugggcaugguguaugggccauuguaacaugaccagggagguacuuuucugggguguuaguguccugaaugccuccugcaucuggauuggcaucucucuccuaacucugagaaauaauuuguucuccauuucuaaaaaaaauguuuuccacgccuuuaaaagcagcuucuucuccuauaccuauuacccauagacguggucaucucagcgugucacaggccuugacauucccacuccuauucauuuucucucucccacgcugcccguccgucuuugagaugcucacaugaggaugacuuugaguaaaaguuccaaacaguacuaugaagauaauugauauuuaggcuuuaaaaugcugcagguuagaauuccuuaucaaagaccacauuuaaaaauaaauugacuugaguucuagaaacuguaaaagauaaaaaguuuucuauugucuauaauuuuaaaaacugcauagaucuucauagaauuggcuguacaagaguauuccucuugcacagcauuccuuuuuacuucauaugcagcuguuauaggauuuacuuguuaaagcacuacaaggaaucucugugaggaaguguagucucugcagccucaguguugugugugggucugguggggauaggaagacuuggugaguccuucucugcucucugcuuuggacccuugcauuccuuccuucuaguccaguguauauagaaauuuuuuucuucacucucuuuauuuuggcauuuauggagagagagagagagagagagggagagagaaagagagagagagagagagagagagaguguguguuagggaauagcugucacauuaaaacaaaauugaaacuucugaauaccaucuucaacaaaauugcuaaauuuccuuuagaucuuuauccauuucuugguuauaugggcaagggcugcagaauucuacagaagagauuagauuauaaguggauacauauaaaccaaaguagggaacauaguaccuuuaacuuuuaagcucuuuugcuuaggauugagcaauuaugacaggaauuauuaaacaaguaggaaauuuccuaaguauacuuaguaguaauuuugagcauugagaauuaaacuacccaaauuuaagaagcaaauuuaaguuuacuaaguugagagacuagaaagauggcucacugguuaagaguacuuuccgcucuuguagaggacccagguuugguucucauuauccacauggcagcuuacaaccaucugcccuccaguauccucuuuugaucucuguggauauccuauacacaucaauauauauacacacauauacaggguaguacucauacagauaaaauaaauaaaauuuuaaauaaaaagauuaaugaauaacugcauuucaaaaaauguaaaaguacaaguugguaugccaaagaaagggaaugugggagggaggcaagcauaaacuuaaauauauucccucacccucucuuguccuuaagucucugccucuguuguacauauuucuguuuugaaacuauacuguaagauucuauuuauuuuucucuuuucaauuuuacauuucauugucaacaucccuccucuuccucuuugucuagaacaaguuauuuguuggccuguguuuggucaauggccgucacgucuauucacuggugaauaggauguuacucaugaaauaguuguuugguuuccuaguucauuuuucuuggcuuuuaacagcugaggcaucucuccaguccuuaguguucuuagauuguagaauggguaggaaggcugggugugcucuaauugucaucuguucucuuaugcacagaaugagguuugaggacugaaugguuuguuucauuguuguucuugauaauggaugucaucauugaaccaaacugucagaaggcauagcuugggaauugagccuaaaaaucauucuuuuaacucaauaauucacaugcuuauuuuuauaguuuucuaaucauauuucuuauuuuaaugauuuguaagucauuccagagcugcucacauacagauuacuagauuacuuaguaagugcaauuacuaauuaauuuugaaauauagcugcaugaaauuaaaugaagauuucugagagaguccagaauuaaaugccuguauagcaaaaccuagaacuugugugugugugugugugugugugugugugugugugcauguguguauguguuuaaggguacacgugccacaacuuauggagagcuaucagaggacaacauuguggagugcuaucagagggcaacauuguggagucaguucucuccuugaagcuuuaaguucuacagauagaacuuggaucauaagcaaguugcugagccugaagccugggagcuuuuguggaaugugacauguagagagagagucaugguagaauauauaaugaaacacaaguuguuuccuaucugaucacuaggcacgaggggcuaugggguuccuaugaguaagagauuuauuaagaagguuauuaaugccauagucagacaugcagcaugguaguaacucuuaggagaauucagacucaaaguugagagccccuucuggauuucaaaagggagagagaaguuccacacacaugcuuguauggagguggagaaauggcucaguaguuaaaaguauuugcugcucuuccagagcaugguuucucagcacccauguuugaugcuuuguaacuaacugccuguagccaugguaccuggcuucuuuuucuggccuccacaggcccuguagucauuuguacaaaccaacacauacauaauacacauaaauaaaaauauuuuuuuuaaaaaagugaaaugugcuuguaauccggcugacucugauuccugugcagaaggcaaaggauucuuucucaaaaucuacauugugaggaaggagugugugagcucagaguguggggaaaguaggcaggcaggaagggccacuuuaguuaauacauguguauuauaaggggcaugauacaccucugagaacuugaagucuacuaguauugugcuuauagacaaaaucaguuaugaggauggagacagaaagagguuccugcauuugggcauggcccaagugguccugagccuaaaccuaacaggcagaaaggguaucuuaguuacuguucuguugcugugaauuuggacuaugaccaagaaaacucagaaaagaaagcagggacuuucuuuuaauuaauuggggacugcuuacauuuucuucagaggcuuaguuaauuaucaucauggcagggagcauggcagcaguuagacaaauguggugcuggagaaguagcugagaacuacauucucauuugcaggcagagaagcagagaaagagagacuggaucuaguauggguuuuugaaaccucaaagcucacguucagugacacacaccuccuaauccgucucaaacagugccauucccugauaaguauguuuucuaauguaugagucaaugguggucauuuuuauucauaccgccgcauagguauuuauagagcaacauuccaaaagacuagauuaaaccagaaauguguucuugaggucauuuuaauguugggaauaguuauaaauggaaucuaaggcaagauugauaguuuucaaguuaaaagaauuuacugcuauaccagaaaacuagaguucagauuccagaacccacaucaggauccaaggaaucugaaauucacuuuuggccuuuguggccaucuucacacaaauuuuaagaauaaauaaauaaauaaagccagguauggagacaaauccauuaugcuaggaagagcuuaaguuucaggccagccuggauuacacauacauacauacauacauacauacauacacacacacacacacacacacacacacacacacacacacacccugucucagcagaggugagaagaaaucuuauacauuucuuuaaguuuaagcaagaaaaacuugcuguugaaguuacuaauacauaauuuauauauuguuauugauauuuuuauauuguaguguuuucugaagaaauuaaauuuccuuugcuaguuuuggcuugcucuucuuuagacaggguuagaaaaguacauuauaaagcacguaagauggcacaguauauacaaaggcacuugugaguugagcuccauuuccuggaaccuacauaaugguagaaaacucacuccacaaaauuguucucuggccuccacaaaugcacauguucccaugaacuugauugucuuagguagaugcuauucugaucuauauauccagcucugcucuuuucuuaacuugccaaauuuauuuaguuucgaaugauauuaacaugguuucuuacuuaucacuaucucuaacaguauuucaaaaguauuuucuuccucuguuuguguguauguguaggcaugcuugccugggcauacucuucaaagucgaaaguuauugaguguggucuucuauugcucuaacuggaacuggaacuuagagcaagugccuacgguugccugucugccuuuugugcucaauuacagauguacaucuagauuuacauaaguguugaaaucugaauuuaggucuugauguuugugugguaaacauuccauucucugaaauaucucccaaguuuuuucuuuuuuguuuugugaaauauggcagccgggcgugguggugcaugccuuuaaucccagcacucgggaggcagaggcaggcggauuucugaguucgaguucaaggccagccuggucuacaaagugaguuccaggacagccagggcuauacagagaaacccagucucgaaaaaccaaaaaaaaaaaaaaauuauggccucaccuguagccuuaggauuaauuaaaaugcauagcaaucuuccugccuugacuucccauaugccagauuaucggaauuauuauuauacccaacucaaaauacuuuuuaauacuaucuuacugauuuucaaagaaaucaaauacaaugccagacgguggugcaccuuuaaucccagcacuugggauguagacacaggugcuucucugaguuugaggacagccuggucuacagaguggguuccaggacugccugggugacacagagauacccugucagucaggaggacaccuccuucucccucccccaaagaaaucaaacaaacaagcaaacaaacaacagauacacauacaaaaugacaguauucucaaucacauuuuaaaaaaagauuuaucuaucuaucuaucuaucuaucuaucuauuuauuuauuuauuuauuauauguaaguacacuguagcuauuuucagacacuccagaagagggcaucagaucuaauuacagaugguugugagccaccaugugguugcugggauuugaacucaggaccuuuggaagaacagucagugcucuuaaacgcugagccaucucuccagccuucucaaucacauuuuaaaauaaucuucuuuuuuuagguuuuuuuuuuuaauaaaugcaugcuuguaaucaaguaauuaucaugccaucacuaacaagcacagugauauauggaguaacaagcacugucauauauggagcgagguucucucuucaguuucuuuuuggaggcauuuagagcuaugaguuuucaucuuaccacugcuuucauugugucccauaaguuuugguuaugauaugucuucauuuuuauuaaauucuaaaaagccuuuaauuucuuuauuucuuccuugaccaaguuaucauugaguagagcguuguucagcuuccauguauauguguguuuucugauguuuuuguugauauuuaagaccaaccuuagucuguggugaucugauagggugcauggaauuauuucaaucuucuuguaucuauugaggccuauuuugugaccauuuauauggucgguuuuagagaagguacugugaagugcugagaagaagguauauuuuuuugcuuuaggaugaaauauucuauaaaugucuguuaguuccauuugguucauaacuucuguuaguuucacugugucucuguuuaguuuuuguuuccaugaucugucuguuuauugaugagagugggguguugaagucucccacuauuauuguguggggugcgauaugugcuuugagcuuuaguaaagucuuuuuuuuuuucuuuucuuuuuucuuuuuuucuuuuuuuaaaugaauguggcugcccuugcauuuggagcauagauguucagaauugagaguucaucucaguagauuuuuccuuugcccagugugaaguguccuucuuuaucucucuugaugacuuugcauugaaaguugauuuuauuugauauuagaauggcuacuccagcuuguuucuugggaccauuugcuuggaaaauuguuuucaaaccuuuuacucugagguagugucugucuuuuucacugaggugcauuuccuguaugcagcaaaaugcugggucauguuuauguauccagucuguuagucuaugucuuuuggggagaauucaguccauugauguuaaggaaaagugaucguaacuuccuauuaauuuuuguuguuagagguggaauuauguuuguguggcugucuucuuuuggguuugaugaaagaugacuuucuugcuuuuucuaggguguaguuucccuccucaugcugcuguuuuccaucuauuauccuuuguagggcuggauuuauggaaagauacuguguaaaguugauuuugucaugaaauauuuugguuucucugucuaugauaauugagaguuuugcuggguauaguaacuugggcuggcauuuguguucucuuagugucuguaugacaucugcccagggucuucuggcuuucauagucucuggugagaagucuggcguaguucugauaggucugccuuuauauguuacuugaccuuuuccccuuacugcucauaauauucuuucuuuguuuagugcauuugauguuuugauuauuaugugacagaaggaauuucuuuucugguccagucuauuuggaguucuguaggcuucuuguauguacaugggcaucucuuucuuuagguuagggaaguuuucuucuauaauuuuguugaagauauuuacuggcccuuuaaguugggaaucuucauucucuucuaaacccauuauccuuagguuucaucuucucauuguguccuggauauccuggauguuuuggguuaagagcuuuuuguuuuugcauuuucuuugacuguugugucaauguuuucugugguaucuucugcaccugagauucucucuucuaucucuuguauucuguuggugaugcuugcaucuaugacuccugaucucuuuacuagguuuucuuacuccaggguugucucccuuugugguuucuuuauuguuucuauuucuacuuuuagauccuggaugguuuuguucaauuccuucacuuguuugguuguguuuuucuguaauucuuuaaaggauuuuuguguuuccucuuuaagggcuucuagcugauuaccuguguucuccuguauuucuuuaagggaguuauuuauguccuucuuaaaguccucuuucaucaugaaaugugauuuuagaucugaaucuugcuuuuccugugugaugguguauccaggacuugcuauggagaaucggguucuuaugaugccaaguaaccuugguuucuguugcuuauguuuuuaugcuugccucccaccaucugauuaucucuagugcuaccugcccucacuaucucugauuggagcuguccuuccugugauucugguuguaucagaacuccucaaaguucagcugucucugugauucugggauccuggguaugucagagcuccugggagucaagcugccucugggacccugagaucuuggugugaccaaacuccugggauccugugguccuggacguguuagagugcuugggaguggagcuuccuuuggguguugugguuccugcccaaggucugcuuagggcaccagcccauaccagaaggcuuuucagauuuugugugugugugugugugugugugugugugugugugugugugugugcuuuauuauacauguauucuauuucguuuacucauuuggauuguuccaaaguuuugcuauuaaaguuggugaugcagggcucagcuggugaaggcacuuuuggugcuaagcauguaaaccugaguucaaacauuagagaccauguagugaaaggagagagccaguuucuucaaguuguccuuccacagacauacacaguaaauaaauaauaaaguaaaaacagcccacauucgugucauuagucagaaguaagauaaaguauauuaauuuacuaugucaaaaaucaugaaaauguaucuaaaauaaguauguagguuuauaugauugacaaucaacaaagaaaauaucuuagccagaagucuugauaaauaaauggcgauaauuccauaggagacugaaagaggcagaacacugaggauuugaggccagcaugacuauagaguuaaggccuuucucaaaaaagaaaaaagaaacaauauugauagcauuugauguaacaguacaucaacuaacaaaaaaugacauuaguauacuuugguuuuguuuuauacucacuugggucugucugucugucugaguauguuguuaucugugcuccaguauguggguggaggucugaggacaacuugccaaguugaugccuucuucuacuuuguuauuuuucuagggauuuaaguucagguugucaagcuuggugucaagcacguuuacaucuugccaguuaguuugauuuuuuguuguuguuguauugauuuggcuuuuucauauguucuuacuguauaccucagucuacccuugaacucauguuauaccuccuucugaguccaaacucauaguaguacucuuggcucagccucccaaguauugagguuauaggcauguaccacuaugcuccaccuaacacuaauuuucuuaaaaguauuuuccugaggcuagagagacggcucaguguugaaagugcuugcugcucucccagaguacauuaguuuguuucccagcaccuacauuggguggcucacaacggcuuguaagucaugcuccagggaaucuucuggcuucugugaguacuuguacaugagugauucauguacacacagacacacacacacacacacuaaauccaacaaaaaauauuuugcugcauaugauauguaguuaauuuguuagauuauaauggguaguuaaaaguuugcuuucucugaaacauuuuucuuguucaaauuuuaggacucuucaaaauuguucaagaaagcaggugacgcuacagccaucgacugccaagccgaagaaagcauccaucuucauucacagggggaaaguaauccuuugucuaagaagcuuucuccaguacauucacaaauggcagauuacauuagugcagcaccaucucuuguuggcagucgagauccugauauaaaggacagagcauuacuuaauggaggaacuaguguaacagaaaaguuggcacagcucauugcuaccuguccuccuuccaagucuuccaaggcaaaaccgaagaaguuaggaacuggcacuacaguuggauugguuagcaaggacuugaucaggaaaccagguguuggcucuauagcuggaauaauucauaaagacuuaauuaaaaagccagcucuuagcacagcaguuggguugguaacuaaagauccagggaaaaagccuauguucaaugcagcaguaggccugaucaauaaggacucugugaaaaaauugggaacuggcacuacagccguauucauuaauaaagacuuaggcaaaaagccaggggcuaucacuacaguuggacugcugagcaaagaaucaggaaagaagcuaggcauugguauuguuccagggcuagugaauaaagagucuggcaagaaauuaggacuuggcaccguaguuggacugguuaauaaagaguugggaaagaaacugaguucuacaguuggccuaguggccaaggauguuacgaagaagauuguagcaagcucagcaaugggauugguuaauaaggacauuggaaagaaauuauuaaauuguccuauggcaggacaacugggcaguaaagaugccuuaaaccuuaaaucugaagcacugcuccccacucaggaacaacuuaaggcuuccuguagugcaaacauaaguaaucaugacagucaagaacuuccugagucucugaaagacagugcuaccggcaaagcuuuugagaagaguguuaugcggcauaguaaagaaagcauguuggaaaaauuuucaguccgaaaagaaauuacuaauuuggagaaagaaauguuuaaugaaggaacaugcauucagcaagacaauuucucaucuagugaaaggggagccuuugaaaccucaaaacaugaaaagcagccuccuguguauugcacuucuccugacuuucaaauaggaggugccucugaugccucuacagcuaaaucucccuucagugcaguaggcgaaagcaaccuuccuuccucgucaccuacuguaucuguuaauccuguaaccaggagucccccugaagcuucuucacaguugguuccaaacccauuacuuuuaaauucuacagcagaacaaauggaagaaaucucugaaucuauuggaaagagccaguuuacugcugaaaguacccacuugaauguuggucacagaucauuaggucauagcuuaaguauugaguguaaaggaauugauaaagaacuaaaugaaucaaaaaauacacaucuagauauuccuagaauaaguucuuccuugggaaaaaagccaaguuugacuucugacucugguauucaugcaauuacuccuuccguuguuaauuuuacuaguuuguuuaguaacaaaccuuuuuuaaagcuuggugcagucacugcaccagacaaacacugccagguugcugaaagccuaagcucgaguuuccaguccaaaccauugaaaaaaagaaaaggaagaaaaccucgguggacuaaagugguggcaagaagcacaugccggucuccaaaaggacuagacuuagaaagaucagagcuuuuuaagaauguuucuuguagcucacuaucaaauaguucugagccagcgaaguuuaugaaaacuaucggagcaucaucauucgucgaucaugacuuccuuaaacgccgauugccaaaguugaguaagucuucagcuccaucucuugcucuuuuaaccgacagcgagaaaccaucucauaagucuuuuauuacucacaaacuguccuccaguaugugugucacuagcgaucuuuugucggauauuuauaagcccaagagaggaagaccuaaauccaaggaaaugccucagcuagaagguccaccuaaaaggacuuuaaaaauaccugccucuaaaguuuuuucuuuacagucuaaagaagagcaagaacccccaauuuuacaaccagaaauugaaauuccuuccuucaagcaaaguuugucuguaucuccuuuuccaaaaaaaagaggcaggccuaagaggcagaugaggucuccagugaagaugaaacccccuguccugucaguggcuccauuuguugccacugaaaguccaaguaagcucgagucugaaagugagaaccauagaaguagcagugacuuuuuugagagugaggaccagcuucaggacacagacgacuuagaugacagucacaggcaaagugucuguaguaugagugaccuugagauggaaccagauaaaaaaauuagcaagcgaaacaauggacaauuaaugaaaacaauuauccgaaaaauaaauaaaaugaagacuuuaaagagaaaaaaacuguugaaucagauucuuucgaguucuguagaaucaaguaauaaaggaaaagugcaguccaagcuucacaauacagucucaagucuugcugccacauuuggcucuaaauuggggcaacaaaucaaugucagcaagaaaggaaccauuuacauagggaagagaagggggcggaaaccaaaaaccgucuuaaauggccugcuuucugguagcccugccagccuugcugugcuugaacaaacagcucagcaggcagcugggucagcauuaggacagauccuccccccuuuacugccaucaccugcuaguagcucugagauccuuccaucaccuauuugcucucagucuucugggacuaguggaggucagagcccuguuaguagugacgcaggcuuuguugaaccuagcucagugccauauuugcaugugcacuccagacagggcaguaugauucagacucuugcaaugaagaaggcuuccaagggcagaaggcggcucucuccuccuacuuuguugccaaauucuccuucucauuugagugaacucacaucccugaaagaagccacuccuuccccaguuagugagucucauagugacgagaccauucccagugacaguggcauugggacagauaauaauagcacaucagacagggcagagaaguuuuguggacagaaaaagaggagacauucuuuugagcacauuucucugauucccccugaaacuucuaccguccuaaacagucucaaagaaaaacacaaacacaaauguaagcgcaggagucacgauuaccucagcuaugacaagaugaaaagacagaagcgaaaacggaaaaagaaauauccccagcuucgaaauaggcaggauccagacuucaucgcagaacuagaggagcugauaagucgucuaagugagauucggaucacccaucgaagccaucauuuuauuccccgagaccuccugccaacuauuuuucgaaucaacuuuaauaguuucuauacacauccuucuuuucccuuagacccauugcacuacauucggaaaccugacuuaaaaaagaaacgagggaggcccccuaagaugagggaggcaauggcagaaaugccuuuuaugcacagccuuaguuuuccuuuaucuaguacuggauuuuauccuucuuauggcaugccuuacucucccucaccccuuacagcugcuccaauaggauuaggguauuauggaagguauccccccacucuuuauccaccgccaccaucuccuucauucaccacuccacugccaccucccuccuauaugcaugcuggucauuuauugcucaauccuaccaaauaucauaagaaaaagcauaagcugcuuagacaggaggcuuuucuuacaaccagcaggaccccucuccuuuccaugagcaccuaccccagcguaccuccagagauggcuuaugguuggaugguggagcacaaacacagacaccgucacaaacacagagagcaccguucugaacagccccagguuuccauggauaguggcucuuccagauccgucuuggagucuuugaaacguuaccgauuugguaaggauacuguuggagaucgauauaagcauaaggaaaagcacaggugucacauguccugcccucaucucucuccuucaaagaacuuaauaaacagagaagaacaguggguuucucgagagccuucagaaucaaguucuuuagccuugggauugcaaacaccuuuacaaauugacugcucagaaaguucucccaguuugucccuuggaggauuuacucccaauucugagccagccagcagugaugaacauaugaaccuuuuuacaagugcaauaggcagcugcagaguuucaaacccuaacuccaguugccggaagaaauuaacugacagcccugggcucuuuccuguacaagauacugcacuaaaucggccucacagaaaggaaccauuaccuuccagugaaagggcaauacagucguuggcagguaaguggguuauuuuguugucuauuauuuguguuccaauaauaaauuauuuucccacugguuucuggauucuuauauugaccuuuuaaauaaguuuauuaauuuuuguuuuuauaaauauauuuugaaaucuccaaauuuuuauuuuacuuuuauuuaagaaauaagguaagugauauauuuguauuaaugucugucuguguaucucuaucaauuauuuuuuuagguaucauuuaaaaaaaguggaaaccaagagaaaugcuccaauuuccuugcacaaaagcuugugcuugguucuuucagugagaacugguaaugaugcuuguuagcuguagcuagcuguaguuaguguaugcuaguugagugguuacagauacuucugugguacacaaacuucccaugucucggugaugauuuaccacugaacacuuuucaggacugagauuugacugaauauucagagaggcuuuaugucccagaguacuuuuagguaucuccauaaaaguuauuucaguuagauacaaaaagacaugaaacauaauaaguaguucauuuguugguccuagaaaaaugguuuuugagaauagagaagguggagauaaaacugaaaucauugcuuauucaaauaaaggauauuccuaacuuauuacuagugauuacuagacucuuucaaaggcuaguauuuuagcuguaaagugugaugcugugucugauuucccagagauaacucaggcagaaguguuacagaguugcgugugacuguagugcucaccacagugagcaaagaguuguucauuuauuuauuccuuuaaauaaauaaaaauuuguauauuagaaccuucagagacaaguagauauuuuucuaauuuucuuuauucaugaacuuugaaaaaucaaaauuaugucuuaguggaaaagauagauuuacuucuuuuuuguuuuguuuuguuuuguuuguuguuuuuguuuuuugagacaggguuucucucuguagcccuggcuguccuggaacucgcucuguagaccaggcuuggccuccaacucagaaaucuaucugucucugcuuccagagugcugggauuaaaggugugcgccaccaccacccggcuagauuuacuucuuuuaaaaauguagacuaggggcaggaggaaaaaaaguagaauaaaagggagucuggaaaaaauggcucggugcuuacagacauacauagugacucuguuguaacuccaguuccggguaugcgguagccucuucucuaggcuccaggcaugcagaucaugcacagacccuucaugcaggcaaaacacuuaaacuccauuaaaauaaaauaaaaaauuuuuucguuuuuguuuuuuaguuugagugagauagagacucucuaaacagcauggcuguccuacaacuuucuguguagaccaggcugacccuaaacucacagagaguccacuuugcucugccuccugaguucugggaucagaggcaugugcuaccacacccuaacuaaaauauuucuucuuguuuuuuauuccuuaggcagggucucacuguguagaccuggugguccuaaaacccacuauguaucauugaacucacagagaacccacccuuuguuucuugcugagauuaaagauguaucccaugcuggacccccucccccccuuuuuuuuauguaacccucaagauuuuuguuuguuuguuucuuucuuuguuuuuaauaucuuuuuagguuucucuguuguaccaccacuaugccccaauauucuguuuggauguggagagaaaaacuucuguuauuauuuugacagauuuuuuuuuauacaaauauuuaaccgaugccaguuuuugaauuaucaaguauuugccagguguuauaauuuggggcccuuguuuuucuguugaagaaaggaauaaauaacaaaaauuguaucagguuuccuuaauuguaaaguuaauggcuuggugguacauguccuacccuguaauuucaguauuugggaaacagaagcagaaagauuacuucaaacugaaggcuagccuggucuugguagcaaauuccaggcccagcaggacuuuguguugugguaugaaccuaucuugaaccaggaaaaaaaaguguuugguuuuuuuuuguuuuuuuggggguguucgauuuuguuguuguuguuguuuagaugauaaaauguacaaaagagggaguauaggauucuuugaaaugaggagacgaauuuaaagaaugaccuccugaggaaaagacuuaaauaggauacgcagcaugugcaacaguuacugggagaaacagaauccuguagauuuauuuauucauuaauuuuuucauucauuuauugaauuccagaaacaugagcacugcucuagcuauugacaugcaguaguaagcaaagaucugaugucugacuccuuaucuuucucaguguugugaugucagaugauagaguuggauaagcaaguacauaaugauguaacugagagagcuguugugugguuaguauuauagaauaauuagaagaagaggugggagagaguuaauuaccuacagaguuaacacagccuaaggauaaaagaguuggcaugagaaauguagggcgaaaaggauauuuugaacauccugaacuggaaaggaacacacauacauuguagaagaaguacaauaauucaagaagagauuuuugagagaugugugggacuaagagugacuuugggaggcaggggcucaguggcagaguacuuucuuagcuuggguaaaggucucgacucuuugccugaaaguuaagauuuaaaggagaaggauaaucaguccuugcagugacaaggacagcaauguggaaauaguagauuaacaaagggaaucauauccucuguuugcaucccuguacagcagagucuugcaagguagagagcuaggacuacuuaggagaagaaaaggcuaaagcacgugguguacuuauuugggggcauuuaguugaauggucaugagaugaagugaaauuaaguauuacacagaggagaauauuagagauaguaaauagauuuagcaagcuggagagauggcucagugguuaacaacacuggcaacuucuguagaggcccagaguuuaguuuccagcaccuagcuuuuagcauacagcuguaacucaaguucuagaagaucugauggcauucuuuucugacuuugggugccaugcauccauguggugcaucuacgugcaauacgugcaaacacucauacacacaaaauaaauacauauuuuuuaaaaacuaaaagaaaaagcugagugguagugguacauaucuuuaaucccagcacuugggaggcagagacuuaccagaggcaggcagaccucuguaaguuugaggccagccuggucuacauagugaguuccaggacagccaaggcuacacaguguaacccuguguucacaaaacaaaaacaaacaaaacaaaauagcuuuagcuuucuaucuuacaagacauggaucuauaucuuaaagagaaguuaagcuaugggauagagggcagagauacaacccuauauugcugucuacaacagucugaguaguuauuuuuauaaaaccuuuucaacgucuuguuuguuauguuuuuaaaaaaggguuuguacugcaauccucccccuugugagugagauuauauugguagguagguggcuguaaaggugccuugaaugggguccaauccaauacgguguaaaaccuuacauaggucacaaaguuuucauaaaguaguuaagacauuuuuuuuuaaauaaauggaaucuuuuugugagaugucuagaaaauuaugggcuuuuaacuaagaaagaaagcuauaugcuuaggccuuacucacaauucauuacuauuuugacaguuauuugaaguaccuauauauaaaagaaauguggccuccauuucaaauccuguuaauguguuagaauucuugacucuuggcugguccuaagaugagcuucuucccuucccccgugcucuuaccugucugucuauccugucucagaaucuaugugagagggugcaccuaaugaugagugcuguacaguagccauguuagaacgacacacggacugaagagauggcucagugguuaagagcacuuguuguugcagagaaccuaaguuauauccccagcacccccaugguggcucacaaacaucugugacuccuguuccagggacuccaauacccuccucugaccuucuuagguuucaggcacacgugugauauacagacacagaugaggaaaacacucauaaaccugggggccagggugggggagacaguuugcaacacuaagaagauaggcaagaaaaugugaggucaugcuuagcuacauagcaaauagcaagacugcauaacaaguucuugucucaaagaccugauuggguggaaggguuguccaaacauaggugaaggggcuagagagaugccuuauucuuaauagaccuaaaacccauccaagugugguggcaugugccuguaaucacagcuaaagauuggaggagaccuagaccaaucccuggcauucauugcccagccaaucuagccaguccaugaacuccauguucaauuaagagacccugucucaagaaauaagguagagaggugcuggcaaaaucguacaguccugugauacuugcugccaaaucugaugaccugaguucaauuccuggaccccacauugugaaaggagaaaacugaaguccugugagugcaccuauauaggcuguggcaugcuucccacuucaggauauguggugaggucagaggacaacuugugagaguaaguucuuuccuucuaauguguguucuaggaucagauuugguaguaagcaccauucuaugcuucagcaucagccuccgagguuucuuaacuuuauugucaagcuuacccaguacuagccauauguggaguaugcacaagccuauaaucuaagcacccuggaggcaagggacagagggaccuauagaucagccugggcuuuaucaguuauauugucucaguuugagagcaaucuguugaguuucugcaggcugaagaauaaauggaaagugaaaaaaauguaaauaagaaaagcugaauugggguuggcgagaugguucagagaguaagaguauuggcugcucuccugaaggcccugaguucaaaucccagcauccacaugguggcucacaaccacccguggugagauccagugcccucuucuggaacaucugaagacagcuacaguguacuaauaaauaaaucuuuuuuuaaaaaaagagaagagauggguuguacuaauuaggaugcuugcacacaccuuuaaucacagcacuauggaaucagaggcagucggaucucuguaacuuugaagcuacacuggucuacauagcaagcuuuaguucugccaggauuacauagacuaugacucaaaaaaauuaguuuaucccucuaaaucaugcuuuaacacuuucauagcaauucuaauggguuuguuuacuguuuuugugcguucguguuugugugugugugauuuuuuuuuguuuguuuguuugugguuacuuuuguugguagucuauucuugaauuguaaagguuuuuaaaacagcauuguuuuaaauugaucuccaagguuuaucguuguuuuccuuauauaacuuaaaguucauuauguugaaaugccccccucacaguguuaaaaaucaucaccuuugaaauauuauauuugugacacaauuuucuuuuuuuugguuuuuuuuuuuuuuuuuuuuuuuugguuuuuuagagacaggguuucucuguguagcccuggcuguccuggaacucacuuuguagaccaggcuggccucgaacucagaaauccgccugccuuugcuuccagagugcugggauuaaaggcgugcgccaccaccgccuugugugacacaacuuucaguggcaagacuuggaacaauucaagucacuaaauaaugcuaauaauguuguguagaaccuuaaaauaaauacacaauuguuaaugcugauccaacuaaaugauuggcuaaauaaaugaaaggacacaaguucuauacagagcaacuugaagugaugcaugaagauuuuccccuuucaagggguggaauuucuuuuuuaucuuuuuuuaauguguauaugguguuuugcuugcaugugucugaaacacauauaguguccugucuccuucaaggccagaagaggcuguuagauccucuggaacugggauuacagaugguuuuuaacuggccuacauguaggagcuggaaaaggagccugaaaccucugcaaaagcagccagugcacuuaagcacugagccaucucuccagcccugggacuccuugcauguuaacugcacguacugacuuauuuucaaagaauagacuggggagaugacacauaguaacgaaggcuaagguuaacuuaaccugugaguaggcaaagugauuguauauucccugacaugcugcaaguagggagcuccgggcaucagaucuccaggugauugugagccagcugacaugagugcugggaagugaauagaggcccucugaaagaacacuaagugcccucaacccucagccacuccuccacccccuaacagguucacuuuuaauuucccuuuuuaucuuauguguauggguauuuugccugcauguacgucugcaucacuugcauucagaggcauguagaggguaucagauccacagauaauuacaacuuauaggugauuaugaacuacuguguagguguugggacuugaaccuggguccucuggagggugcucuuaaucccugaauuaucucuccagaccuaauuuagggauuucuuuguugagacaggguuuuucugcaaggauuuggcuguucuagaacucacuauuuagaucaggcuggccucaaacacagagaucugccugccuuugucuccaagagcugugauugaagguguguaucagaaugacaagcagcuuuuuuuguuuuuuggguuuuuuuuuucuuuuuuguuuguuuguuuaaaggcagauuuuguaauauagcucagccuggcuucaaacucaggguccccugccucagccucugaaugcugggauuaugggagugugccuccaaaacuuuagguacaugcuaucaaacugagcuugucuguaguauauuuagcucauagccagcugugcguggcagaacauucuguuuucaaaguggacaaggaagaguggaugguggaacaguaugaaugauugaccgcauguaaacauuacauguuauacuucaggcauuccacuauuuugucccuccugaaaaaaucaaaugacuuaguuuuuguuuguuuuggaauaacucugaagacacauugguuuugucugucugucucucccucucccuucuuccucccccucccucugucccuuucucccucucucucuuauuuuaaagcauacuuaguuuuguuuccuuuuuuuaccugaaggggauaaacaucaguugaugaaaauauccugguuuugacacuuucucuagaguuuuauuggagauacacccauaaguaaaguauaagcaugcagagguaaggguuuaaaauagauugugaugguucugggagguuuccagagaauuccauuuuaaugugaucuaacuugggaauuguagggaauuuucuaauuagaggaaggaaauacacuuuguuugggguucuguuguuuguuuuuagcuuaaaaacgaccagcacagacucugaacccuuccuuccugcagugcauuuaacugaugagguauauggacuauggucagaaacaacugcuuuuauuaagagccagcuuuuuugucacuuuucaacuugacaagaaacuuuuaaugcuguucaagagauucagaacauaaauccaggaccaaacaaaacaaaacaaaaccuuuagcaacaucuucaaauauuggagaugaagaaauagcucaacaguuaaaaugccagagcugacaugaauguaaggcugacauagcagccugccuauaauucuagccuuagcagguagagauggggagucuccaagcaaucugacaagcaaaacugucaguaucaacaagcuuuugguuugauuaaggagucccuacuucaguuacuaauguugauuagcaauugggaaugaguccuaacaucaaccucagucagacaucccaguguacaccuacaggcauguaugcccacacaugcuaaccaguacacauaugcacacuacacacacuuaaaacuaaaaugugugcagugcuuuaauuguauugagaagaagugauuuguuauaaaucuaguaugaaauacuguuuugaaauaagucuauauuuuuuuuaacucacuaauaagcaucauuuuaaaucuagcacauucuuccaugguuagcccaaagauauuucuagcauuggaaacaucagacauuuugcucauuuaaauaauuuccuauuuauuagaguguuuacuguuaaauuccaaguaagguauauaugacauguaguauauaaauuuguaaaaagccuuuaauauaaauuuagaccgaagguuccagauuuucuuguuuguuuguuuguuuguuuguuuguuuugagucaagagucucacuauguaguucuggcuaccuaguaauucaccguguagaccaggguagcuugccucuaccuccugagugcuggaauuaaagguagaugccaucuugccuguugacuguguucuuuucuaauucauauuuagcaucauuaaaguugauguuuuaguguggaaugguuagggccucagugaaguaguagguuggaucuuuauuuuauacuguuuuauguuuauuuucugagaggagaauuuaacuauauccuugcuuuuuggccaaucuaccuaucucugacuaucauaugcuagaauuaaaguuuugggccaccgugcauagcuauuuuuuaaaauuauuuuuauauuuuuauucaagucugaaugagaauguaugucuuuguguauguccacauacauaugaauauaucuuugcuuacauuugggaaugguggagcucaccuuuaaucccaguacaugcaggcuggagagauggcucagcgauuaagaacacugacugcucuuccaaagauccugaguucaaaucccagcaaucacaugguggcucacaacuauucguaaugagaucugaugcccucuucuggugugucuaaagacagcuacaguguacuuacauauaauaaauaaauaaaucuuuaaaaaaaaauccaguacuugaaaggcagugagcaacagguggaucuacaaagcaaguuccaggacagccagggcuacauagaaaaacccuguccuuaaaaaaacuggggguagggguaggguguaugcccuaauaugugugugaagauaagucaaaaaauucugagaguccauucucucugguguggcuucagggaucaggcuugcucagcaaauacuuugaauuuguuuagagucaacucauuggacuguguguucauguuuucuuugugauuuuucuaccuuucuacauacagagacacuuagcaccaacggcaguuuucucuauugauuguaauaacuucaacaguuugacucuuugcuuauacccagauaucugaaaauaguauucauuuuuauaguagaugugaucaauauuuucauaaguaauaaaucaaccuuagaacagcuuuuuagucuucaguuauuucuguggauuguauaagauuagauuuucuuaagacauuuuaucagccuguaugccagucaugaguaacucauuuccagaacauuuuuuuucuuauuucuuuuuuuaauauuauuuuuuaauuuaauuuuuacacuuaguauuucacuuccugauccccaaccacacuccaacuguuccacaucccgcaucucuuccccuucccaucccaucuccauguagauaucccacccaccaccccaccugaccucuaaacuccauggggccuccagucucuuggggguuaggugcaucaucucugaaugaacacagagccagaaguccucuucuguauguguguuggggcccucauaucagcugguguaggcugucuguuugguggcccaguguuugagagaucuuggggguccagauuaauugagacugcuggucuuccuacaggauugcccuucaccucaacuucuuucagccuucccuaauucaacaacaggggucggcugcuucugucuaucaguugagugcaaauaucugcaucugacucuuuuagcugcuuguugggucuuucagaggguagucaugauagauccccuuuugugagagcuccuagcgucaguaauagugucaggccuugggaccuccccuugaacuggaucccauuuugggccggucacuggaccuucuuuuccucuggcuccucuccauuucuaucccuguaauuccuucagacagguacaauuaugggucagagaugugacugugggauggcaaccuaauuccucacuugauguccugucuuccugcuggaggucggcucuauaaguucccucacacuacucuugggcauuucaucuaauccugaauccugagauucucuuaccucccaggucucuggugcauucugggguauccccccaaccuccuauuuccuuaggauuccuguuuacauucugcuggcccucggggcuucaguccuuuucucucacccaauaccagaucagguuccccacucugccccacuccccccacaucccauccacuuuauauauuuauauauuuauguaugugaguacacagcugcucucuucagaugcaccagaagaagucuuuggaucccauuacagaugguugugaccuaccaugugguugcuaggaauugaacucgggacuucuggaaguguagucagugcucuuaaccacugagccaccucuccagccuguaaaauuggauuauuauaccuaauccagggaguucuuuuuuucccuuuucaauuuucuggcauuuuaccccauauacuuuguauguacaaucuauaccagcuuucccuuuuguuuaaauugauacaaauaucuuuucaaggccuugucuuauaaguuaucauauaauggacaaaugaaauucagaaagccuauaauuaaaaaggcuuuuccacauauuuuuaguucuuauaucccuguuuguauuauccuaguuugugauaacuugaguuucccuccuugguaguacucuuccuucguuacacaaaugccuuauuaccagcaaauauugagaaucgacucccagcuaugcagguccaucucuaaguucaaggcccaccugaucuacagaacaaguuuucaggaccaguaaggcuauaacauagagaaauucuguuucgagaaacaaaauaaaaaacaaaacaaagaauugacucccaacaauuaccauaccuuuaguauuaaaaguccaguauauuuaagcacaucuucuuuguuucuguguaauuauugcuuuacucguuguguauguaguuucuaaauuucuaggcuguggucugggugcugacacccaguaauguuucuaaccaaaaauucaaugaacugaaaauuuuccaucuauauuccuuauuuccuaagguauuucauuauguguuuguuuuuuuuuuuuuccauuuuuuauuagguauuuagcucuuuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuuaaauagaaaugggaaauuacggaaaauuaugaucucuacuuuuuuguuguuguugucugucucucugucucuccuuuuucuguguguguguguguguguguguguguguguguguguguguguguguguguguguuugaggcaguaucagauuuuccugaacuuaaauccauagcaacacauuauucugugaggaauggaaucuuugcacaucuuagcuggcaaaucuuacuuuaccguaaaugaaacagguaauauuucuuccaagcuagguacagcaacaaaguaguuaccccccuuagaaaacgacuaugaauuagaagaacccaaaaaauaaguagagaaagcagaaaauugcuuuguccuuugucagagaacaggacagacacccagacaccugauuccagucccucuguuggugcaucugguguuguugcugugguuuagaucaucccccacucccaucccuagagaagccaaggugagauuggaaggcuaauuucagaugccuuucuagccgucuugcaaggccucgccugcccuagguauacuuguuuaggaggacaucuuuaauuguauucgcuugguauguuuaaagugaauguuuaauaacugcaaguuggcuucagcucccucguuggccauaagugucuguucuucaauagugaauguugacuuaaaugugucaguuacauauuuauuuaacaucuaaaaauuauuucacaauaauguugauuguaguguagugguacacaagacccugugcucgauaauugacauucucuccccaagaaagagauagcccaugaccaauauuaggacccucuucauauguaauauucacuaacauuuauaagccacaguagauuuuguaagguaauauuaguauuacaguauuccauuuugggacgcaacacagcccugugauuuagaguaacuuuaauaagccagacuuagguauguuuauuugccuucauccugauccuuaauuugcuaaagaaugaagaaucaaaccuagguugcuuuucuccauaauccauauaguuaacaauguccuguguucuacucuguacuucauuuugucuuauauuugaaaauacagauaagauggguuucugcuagaauagacaugugaguucucucugaauauucucuuauucuucccugauuacccagcugcauaauaaaacuuaaggcaguauuuuuauggauuucacaugacuuaagccaauuuuaaaauacucuguacaucuuuaacagguugcuacuucuugcuuauaaguuguaacauugcuuuccagucuuaaaucuuuuuacuuuacaucauugaacacuguuuuuucacuguuccucuuacuguuucuauuagcacuguuuuuggucauaucucagggauacaauacaacuuuauucucuaaauugcacuauuguuaacagcucuacucuaugaaaagggauucgagcauacuuuuaaaagugaaaaaugaaagccuuccugaauuuuuuacuccauucuucuguuaaauccuaauaguacgcugcugguguccauuacuuucagaaaaugaaaaauggcucagaagcuaagugagcuaagccaucucucucucaauuguuucaguuucucaggaauugcuguacagugcugccaauaacgaucuccggggaucugaccccccauuccaccucccacugccucuucagcagcuccagaggccaccaaaagaaggagcuuugaagaaagugccuguucccucuuuuacccugaggugggugaggccaggcagggugauucucaggauauccugaugaucaaagguauaguugaagagugucuugaagaugaccaagacauuuggggaaaguuaacagauagccuagaaacugaaguuagaacccaagaacagaaggcacaaaugucaucugagauguagugcauggugacauguauaaccuucaaucaguucucagagggcagacuagugagcucuucuuuacaccuccuuccucccaccuccauaguaucaauccagacaccaggcuuggaaaauacacccaauagcuguaguuuauaacugagagaagacuucauuaagagccuucuuaaaccaaccccauuuauucccuggcacuuaaucuccacugcuugcucagucaucaggaaugaugauagagcucaaugaugucucagcuucucggccacugcuguuuucugucuugucugcaggucuggguaggaagaauguaucuaucugguccguauaugaaauguuccguguuaauucuuuuuucauugaugccuugaccuucuucaguguuuuauuauagcauacuguuuagcucuguagagaacucuuuaugugaaccacacuccauggggauuuacuguacugcuaguuuucaaaucccuuuuguaucucuuugaaauucaagacuaaacaaucuuuauucuugaguagaucuuacaucagccaucacuguauuuuagaaguaaggugcacuguuuacaacaucauuuuccccaguaucugacaucucaucuugaauggcaaguuagacaucuuaccuagucaguacugccaguagccuacuaagagaauaacugcaguggugugacuuaagaaacuguuuaaaacaaaaacaaaguucauaaucugcauuuucuccuagaaaaagggaaaucauagaaacuuagcuccagucguuucuucugguacuguacuguuguugagagauuaaaucuugucuucacuagagaguggauccugaacgcucuccucucaagccuuugcucucuugccuucugugccuccaguuguauguugaagcuuauuuuacagacauuuuaaaaagugaaugcuucuaaaucuuuggcaaauacaaaaucaauauguauuuucagcagcuguccuuuuagguuauuagggaagagguacuaaaaacaauuuuuuuugcaggaaaauaauaauuucugaacaucauuuucuccugagcaagagauguacuaaauuaugcugcauaaauuuggaguuuuugcuaaaauuaaaagauuuuuugaagggaaauugaauguuuuuaugagguaaccuuaaguguauaccauuaaagauguauuccacaaauaagcuaguaaccaguucuucuugaauuuucuauagaagagaacagaaaguaaaaauuaauuugcaaauuauauaaaauggacuugagacccaaccaccuaccuuuuuaucugaauucauuaaaagagaugccuaaguuggauaugacuuucccacaucaguuauuucucaauuaguuguauuauguuuuguuuguugauuuauauuguucauuuuaauauaaaauaacaguuagacuugauuuucauaagcaaauacuuuaauauuucauagugaugguacauaaaacuaaaucgcuauuuuuauuuuaccuuuaaaacuaguuuucucucugcuaauauacaaauuuuaugauauuuuggaaauucuguuagcaacaucaagcaugguuuauccuccaccgcuuuuuauugugagcugacccaucauguauuacagggaacagcagugacagcagcuaaaggucacuguugugacacagcaugcuuucgcacuuacguagucgggaauggucauccuaugauuucuuuuucuuucuucccagguucccagucagcuuccgauaaaccuucccagcgaucaucagaaagcacaaauuguagcccuacucguaaaaggucuucaucugagaguacuucuucaacaggugagugcuauuguuuuaccagauuuucaaaauaguuuccuaucugggauuugagauuaacaaaucuguaaagcaaacuaaaguggccuugucaucucaguaucacugauaauguauacugaaaaaauucaauaguuuuacuuucaaaaaagaaaugugagggcacugaagcaauggcuuagcaguuaagagcauguacucuuucugcagaggaccugaccauggggagcugacuccauuggccucuguagggcucugcaucugugcacauacucagacuuaacaugcauacgcauuuuuuuuuuuuacuugacuugauguaaaagaguguauucuguaauauauggcuugaagcccuuuaauaaauuuuuauugucaguuacauuguuacaugccuauaaucugagcaguugggagguagaaguagaauuaggaguuuaaggucacccauuaaauaguuaaagauaaaugucccauuaaguacuuaauuaaaaaauauaaagugagcugguaaucccagcacuggagagagugaggcaagaaauacugccaugaguuuggggccagcuuugcaagacccugucugaaauauacauacgauaauaauuauaagguccaaaaauguugaucaguugauagagugcuuuucuaguaugcaugcacaaaacccugguuucuuucuccagcacagcccuauauguaguacaugucuaggcucuacucucaaaagaauaauuagaaaacauugcuggaaaauauuucauuguuuaaaacgugauuuuccaaaccaaccuauaugugcaguguuaaauugcuuugaaugacaggcugauucuaaaauauauuucauuguauuuuuaaaauguagagugauaaggauuucacaguggcacaucuauuuaguuacauugcuguguuuuuacauguuacccugugucugugcuuacaaaugcccauacauaucauguugcaugagaaccuacguuaaaucaccagugacacacaaagcagaagacguauauaucagacguaaaauacuagagcaguuucauucuuuuagaaacaaaauuugaagauguauguauggcuuaauguaaaccauagccuggggagauggcucagggaguaaagugccugcacacagcacaaagcccugaguuggugccucagcacccaugcaaaggccacguauagcaaacaugucaacuuggacuccagagcuaaagguguggagacagaccaguuuauucagguugaugaauucuagguucagugcaagacccuguuucaaaaaaagugaagauggaaaaagacacccaacauugugcucuggccucuucaaagauauaccuauauacauguaccugcauguaugugugcauauacuaccuacacaaacauguacauacagcauacauacccacaaaaagacaguugaaauuagugaaagaauagacagucagcuccugggccugaacagcuccauaacaagucagucuggaccaccuguccucagaaggucaauuaaccaaguaauagggagaagcagaaaaggaauauuuauccucuguaccuauacuaagugaggcacaaacagguccuuuauuuauuuauuuauuauauuauauuauauuauauuauauuauauuauauuauauuauuuguguggcaagggcacaggacagaggucaaaggacgauuuauaagucaguaauaccuuuucacguuguggguuccagggaugaaacucaggucaugaggccugguagcaaguuccuuuacccacugagcuaucuggauuacccuauacauugccuuuugauucauuucugguuagaguguuguugguauuauggacggguuguucagcuguuuguuuuaagacccaagguuuuauuguauaguugaggauggccuagaaucauuguauagcucagccugggauagaaauuaaagaaguccugucucaaccucagaaguaggaggacugcagugugagcuagcucuccuguccuuucagcauguuccucacaaacaugaagacaagucuucuuaacucagaugucagcuaccuggcuuuaugaagggagaggacuguauuccauggaaaguuuaacuugauauagguuucuaugaaaauuuuaaaaccauaaaacuaaaaaaaucuucuugaccuuggaauagacaaagauuuccuuuacauccccaagacagaauuucucugugcaguccuggcuguccuagaacuuguacuguagaccaggauggccuuuaacucacagagauccgccugccucugccucuugagugcugggacugcuccaaggugugcucuacuaccacccagccaagacuucugagccaggcaggaggcuaggguaaaaggagcacuuugaguuuaagaccagccuggaguacauagggagguccaguacuuugcacaguauuaugacauaugcguauaaucccagcacuggggucuagagauaguuucaauuuggaaccagccuuuaauauauucguaauagggagggagggagggagggaaguaacauuauuuuagugggucauggaugugauucauaccugaaauuucaaugcuacuuaagccuauguucucugcuucucuagaggcugauacaugcccugaccauuuaggaccuuaagcuuaagccuauguaacuggggacaaauaaguaaaagaauaacauuuucuucaccaguuuaaaaacgaaacauuuucuuuuuguuauugguuaaggcugauaguccuagcacuagagaggauaaagcaggcagauaacuacuauuucuuagcuagucugggcuagccuggcauugauacccccuuaacgccccccccuaaaaaaaaaaaaaacagguuggugugcuacuugcaugccuguagcucugucagauggaagguagauagaugcaggaguucaaagccagucugggcuacaugagacccuaaaaacagggagcugaauuguaggaagcagagagagagagaaagacagacaggagaaaaguauauguuagccaaaggaagaggagggagaggagaaaauaaaaaguacaagcaaagcugguugacagagcauaagaagaagaaagcaagcuggccuuggaucccagcacucaggaggaggaggcaagugaauguucaggaguggggccaccuggguuaaauaauaagacucuguuucauuuuaagagaaaaaaaaaaaagauuuggauauaagcaaggaaaauagggaaggaugagauaguucauuaaaagcacaugcuacuaagccuaaagacuuaugauauaagaccccccccacacuugauaacgaggcacccuggccucuccauacaugagcuauugcacaaauacuuuguccacacuaaguuaaauuuuauaccccauaauuuucuguuuuuauucaaucaaucaauuuguuuaauuuuuuuccagauaggauuucucugcauagucuuggcugucccagauugaucucauacucacagagauuuuccugccucugcuuccugagugcugggacuaaaggcgugugccaccaccaccacccggcuaaucuauuuaaaacauacauggauguguucuccccccucauuaaaucaguuaguucucuuucucuagagaacccuaacuaauacagggauaaacuuguuagcccuuuauuauagcucugauuauuaaaccaagcuugggcugaagagauggccccgccggugagcagaugcugcuugauccuggcaaccugggcucagcccccaaguccacaucaaaguggaggaagugcugaggacagaaagucguccugugaucuccaugcaugcacuguuccauguacacacgcacaucauguauacaaaaugaaacagaaguucuuuuaaaaagagaaucuccuacgggcaugcucaaccccuucagaacaccgcccuugucagccugacaaacaaacauccacuuuuaagcuguaacuuccaacccucguucauacacucucaggaugugaaauguacucaguccaacuuuuaaaaucuccaucccuagaaaaguucuuugucuuggagcuagagaaaugacuuagugguucaccacauuuaauguuuuuaaaaaagauauauguuugguuccaauuaaaaauaauaagauggcuaucucaugagaaaccccaagauuagcauccuuccuccuuccccucacuccccacacaaauguaaguuuggauucacaugaacauauagacaaacaaaagccacagguauaugacuuaauucuaggacauaggcagcuaagggaggaggauaaccuuuacagugaauuccaggucagccuggaagcaguacaacaccuuguuuaaaaacacuagagccgggcgugguggcgcacguuuuuaaucccagcauucgggaggcagaggcaggcggauuucugaguucagccuggucuaaaaagugagucccaggacagccagggcuacacagggaaauccugucucggaaagaaaaaaaagaaaaaaaaaaaaaaaaaaacacuagagaaggaagggaaagaacccaucuugcucaggauuuagcugaaugguaaacaucuugcuucaaaugggcaagccucugaauuucaucuucagugcucagaaagaaagacaaguuuggaucuuuauccagucucuguuuagcccuuaauauuuaucuuuugucaguauagaaaggcaugguacacacuuguaauuacagcauguggggacauugacacgaggaauuuaagaugauccacuaauagagugucuucaaacuugguagacuuaaggccaucuugagcuccagaaaacccaucuuaacaaaguaaauacgaacuggaagauggguugguaguuagagcuccgcugcucaccagcuucagcgguccugacucccucuucuggcuccaugggcaacuguaugaacaugcgauacacauauauauaagucaaaauaaagauuuaauuaauaaaguuaaaagcugguuuguuuguuugguuuuguuuuuguuuuuuuacauauaauccuagcauucaagaggcagaggcaaggcagauuagucauuaguuaguucaagaccaguuugauuugcauagugaauucugagcuggcggaggcuuccaagcacaaccuugucucaaaaggcugagaagcaaacauaaagagacaaaguaauuuagauuacgaagugaccaaauuuuugucugugugugcuguguugucucuuuuagugaauggaguuccuuccagaagucccagauugguugcuucuauggaugauucuguagacagucuguugcagcggauaguacaucacgaugagcaagaguccauggagaaaaacggugaugcuuccauuacaacugugucugcaccaccuucuuccaguccaggccauagcuacagcaaggagcgagccuuagguaaaucagacagccuucuagugccugcagucccgaaugacucuugcaguaauaucccacuucuuucugaaaagucagcaaguagguguuccccccaucacaucaagagaaguguaguugaagcuaugcaacgccaagcucggaaaaugugcaauuaugacaaaaucuuggccaccaagaaaaaccuggaccauguuaauaaaauuuuaaaagccaaaaaacuucaaaggcaggccaggacaggaaacaauuuugugaaacgcagaccaggucgaccucggaaaugcccccuccaagcaguggugucaaugcaagccuuccaggccgcccaguuugucagcccggaauugaaugaaggcgaagacaugucccugcaccuaaguccagacacagucacugaugugaucgaggcugugguucagagugugaaccucacuucagaacauaagaagggggugaagaggaaaaauuggcuguuagaagaacagacuaggaaaaagcagaagacaguaccagaggaagaagagcaagaaaacaauaaaagguaauaucuuucuuaaaauauuaugaucugaauaacaguaguuaacgucuuuauuuuaugacuuauuuuucuugugugagcgcaugcaugcuauggcagguguaggguaaccccaaggacaacucauggggccucugccagcuugugggucccagcaucaaacucggcccauugggcuuggcagcaagcaucuuuccuggugaccuaucucccuaaccccagccugagugucucugaacuguaauuuauuuauguagccaaaucuuaaaaccugguuuuuacgaugggaagacgguuugggugagguacuugggcaugccagugacuccaggcugaaagggagugaucuggaguuggaaggacaaucuaagcuguacuaacaguguaucguaagccaccugauaaagguggccaaaaagcaaacauacaugcaugcaugcauacauacauacauacauacauacauacauacauacauauguacauacacacacacauauaguaaaagaacuuaaagauucaaaauacaaaacuccuuuuaggaaaugaauuuaaaagucugcugugacacagggccaaagaaaaaaaagaaaagaaaaauuuuugaggcauuuucuucguagccugacuggccuagaauguaaacuagcuuugcucucauaaaugucagccuaagaugugaguaugugccacuauacccagcuucaauccauugaucaguuccuccaucccuucuuuccuguccuccccuccuccauucucacacucacugugggggguggggguguuauuuuguuuucugcucuacaguuuggauauuguugagacaggaucuaauaacuccauguacccccuuuugccuccuaacccccuaaaaccuaacauccugcuuucuguuuuaugauuuuuggcuacucuuaaguccugcuuauuacugaaaucauauaguauaugucuauuuguggcugguuuauuucacugaauacggugugcucaaagggaguugcuacagagccuccguaaagacucuugggucuguuuccuuuucugaguccugacuuuuccacucguuuucuuuuguauaaugccagagccuaaaaauauguuuucucugguacaguccacuccucugaaucugccuugcuuuugacaugaauugggcauaacuuaaaaaggccuggcuugcuuuccuccucuucuccaucuccuuucuccaggcagcuguggaaauguguggcuuagcugcccugcaaguuuucucuuuucuuuuuaacauuuuuggaaaauuuuucuuuagucaguuauuauggcauaggcuuuucaucucagcacucaggagguagaaacaagagggaucucugaguuuaagccaggcugguagauauagcuagugccagggaagcuaggacuacagagagacccuugucucaggauuaauaaauugguuaguuguugagguuuggucuuugacuguguaguguaaugcuaacugugggcccccuagaccugguugcccccaaguuauuuccgauugguauauaaagaugccagcaucuaguacaugaucugguuuuaggguucccaggcuggcugggcuggaggaaaucacggggagggaggagauaaggaggaagaaaaaguugccaugguuaggaguuguaaaaacauggcucugaaauuaagagcagcccagaugaaacauaguaaauaauaacucaggguuauugauaaaaaagagacuuuaauagcauaaaggguagauaucggcccagcucucguguaaggcuuuuuguaaauauaaagguuguaugugucuuuuuuuuuuugguuuuucgaaacaggguuucucuguauagcccuggcuguccuggaacucacuuuguagaccaggcuggccucgaacucagaaauccgccugccucugccucccaagugcuggaauuaaaggcgugugccaccaccacccagcuuguauauauaugucuuuuauccacucaaaguugggguagaaaccccaguuugggauuaaaaauucuaaaauaauuaguaaauuaacgauuuuuuauauguaugaguauuugccuacauguauggcugugcagcauuuguaugcugguguucacagagaccaaaagaauguaucagauccccuggaaguagagucccauucaugcaugagugcugagacuucgaccuaggcccucuagaagcagccagugcucuucaccacugagcuucucuuuaguuucugaauguuucuuuuuauguccaggaaggucauuauuucauaaaauaucaaaacaacaacugugaaaggaaaaaagaguugguucucuccuuccaucauguggguucuaggaacugaacucaaggcagcuuggcagcaacuaccuuuccucacuaaaccauaucccuagucucauaguuuauuuuuguuugguucauguuugguuuguuuguugggagggugggagguugugguugggguaaguuuuugguuuugguauuuguuuuugugacagggucucacuacauaucccaaucuggucuggaaccugauauguagaucaaugugaccuacaauuuacagagaucuggcuaccucugcugggauuaaagggaauguaccacaaugccuggauugacaauuucuggauguacaauuuuuuuccuuuaaaaauuuuaaauuagauguaugcauuucaucugugagugcuuugccugccuauauguaugugccacuacaugcaggcuugguauccuuggaggucagacaaguucccuuagaaauggaauuaaagcggguuaaaccaccauuugucugaaagaaauugguuccucucugagaacaagugcucuuaaccacugagccaucucuccauccccaaauuuaacucaugguuguugguguuuuuguuguuguuguuguuuucauggauguuuugucugaauguaucuauguguaccacauauaugccugauacucauggaggccagaaaaugucagaucucauggggcuggagcuaaaaacaguuguaaacugcccugugaguuacaggaaucaucaaaugugggaccuuuagaaaaauagccagaccuuuuaacuucugagcuguuucuccagcuccugaaaaauugucugauacuuauaaggucuguuuuauuuuccaagagauuuaaagguaacaugaaaggggaguaguguuuguguguguguguguguguguguguguguguguguguguguguauuuucuaucauguguguguguugaacauaguagcccuaagaagguagcagaugacuuggacuuagaguuagauaguuggaagcuaccauauggauucuauugcuggaaagucgaaccuuugucaucuggaagaacagcacgugcucuucccccaaugagccauguuuccagccccuaaguguuuuuguuuuaugaaaucucaaaagcagcaaccauaagaguaaacauuguuauucuggauuguaaguuuggauuucuauauaccaaaaagcauccugacaaguaaaacauaacuccacuaugguaggguguauuuacaagacaugcuguucauaauuuacugguauccagaauagauaaagagagaaaacaguuggucuauggauguaaucucacacucaugauguacacaggaggauuuuugggguuuuguuguuguuuuaauuaccugugucacuauguacauuugaauauagguacccacagaggccagaagagagugucggcugccuucggcugaacuuagaaucaguugugaguugcuugacauguuacugagaacugaauucagaucuucuaaaaagcuguuugaacucuaaacugcugagccauuuuuacaacugaguaugagaacuauugcaaguuguaaugagaguucaggcagaguuacaaagcaagacugcaucguaaagccaaaaaauacaaccuaagaaacaagacauggcuaugcucaaaaguuugagauuagccucaccuguauaauaaguucagaguuagccuguagugcaugggggaaacacccacacucagguccuguagcucagcugaaggagguuugccuaacauggguuagaucucuagcaccacauaaaacuggcaugaugguguagucuuguaaauuccagcucuaagaagggcuaugcaggaagauccagaauguuagaucauccuuggauguguagcaaggucaagaccagugugaucugagaaaacaaaaagcaagcacgcaaacaacaauaacaaaaccccaaaacuuagaagggauguauuucaaugauagagcucuuaaguuucaugcuacagacccuguguucaauccccaggcccccuucacuccagaauaagacaguucucagaccuugauguccucacauagcagagucacuauauuacuuacaauuggauguuagagcaggacuggaaucaguuuggcucuacaugaugaagaaaagauaacaauccaguccauaguguuagggccaagucaaagaccaacaagguuacuuaaaauauccauccuagggcuggagcaaguggggccagagcaagcggggcgggaggugggggguguggaaaaaaacccguccuggaccucacagcuaauuuaauggcauuccagauacaggcauuugucuuugauucuguuguuuuauuuguuugucuucauaggcagggucucacugcauuguuugauuugacuuugaccuugcuuucauaguauugacaggccuugaauucaccauccuuucugccuuagccucuagcaucuauuuuccuuuccuuucuuuuuauugcuuuuguuuuuugcugggguuguuucagauuuucuuuuauuuuugcauuucuuuuuaguuuuagaugaugggucuucacacaugcuaaguaccuacucuucuucugaguuacauccuccauucggacauguucauugcuaacaaacuccaaacagauuugauguauauguuccaugagcaacacuugaaauauuacuacuaugaagaauucauauaugucacaugauaucagaaaacauuugcuuuguuuuauauauauauauauauauauauauauauauauauauauauauauauauacacacacacauacauacacacacacacacacacacacacaucaugugguugcugggaauuugaauucaggaccucugcucacucuggucugccccacuccacuugcuccagcccugcucagcccggccuaaagauuuauuuauuacuauauuuacacuguagcuaucuucagacacuccagaagagggcaucagaucucauuacagaugguugugagccaccaugugguugcugggauuugaacucaggaccuucagaagagcagucagugcucuuaaccuuugagccaucucuccagccccaaaacauuuguuuuuuuuuaggcaggagaaugaaauguagucacaugaaaacauuuggauuguaaggguagcaguuaaaacaaucccuucuaacauaaugagaugaauccuguauaugcacaacuuguuuaacauuugaaauaaauguacaguaauagguuaaagaagaaaauuauauuaauagauauaggaacaucauuugacaaaauauaaauuguauuuacaacuuuaaaaaaggggguuaaguagcuauuacucaagcucuggggcauccaguguuuaugcauuugcaggcacauuauuuaaaaguaaaauauuuuuagugaaaaaucaacucuacagcaaagcuggaaauggugacccaacccuguaaucccagcaccguaacagguacuguucugaguucugggccaaccugagcuucagaaugagacucugucucaaaaaaaaaaaaaagucuaguaauagagacugaggacauggccccugggucugggaacugaguucagaucccacaagacccacauaaauucuagauagacaugacagcccaccuguauuuccagucacagagguggagacaagggauccuaggagcaagcuggcgagcucuagucaccauuucaucguuuuguggguuagauugagaguuuaucagauaagguagaaaagcaauugagcaugauucauccugucucccucgaaacccugaucugcacgcacacacucccauucucaugcuuguacacauacaccacacacacacacacacacacacacacacacacacacacacauauaaaaggaagaggaguuacacaagucaaacuuuguuggugguuggaaagcuaaauacuauucagaugucauaacuuucuaauguucuauauagauuuggggaacuauccaucaaagucccaaugacacuuuauaaaaauagaaaaguguagcuugguugguaggcuguucuuauaaucccagacuucaagaagcugaggcaaguguauugcuaugcguuccaggccaccuuggaguauagagugacacccuguuucauauggauggauggauggauggauggauggauggauggauggauggauggauggauggaugagcgagcaaacaacaaaaucaacauggcagugaacauaccuuccaaaacauuugagauaaacuauuuggucaguuacuauaaaggauuucuaaaacucaguaagauaaagaaaacacagggaauugaccaagaaacuguauagacauuuucucagagaguauauaaaaauauacacucaguauaaauaauaaacucauaaagaaguccuaguacucuguagccauuauaauucauaguaaggauaagggauggaaaaauaaaggagaauuuaugaacuauauggagauacccuaggugucuacucaagaaguagagugaccuuaaauaccaguauuuauaaugcauuuuaacauuagacaaaggcaaacaccaaaguuuaucuguagauaagugguaguuuuacaucuaaugacuuacuauuuggccuuaacaauaagacuuuuuagaaaacuacuucuguuguauguuguacacaugggcuuauccugucagaguagucacaaguccuagggcaacucugcguugucauuucccuuucuggagaucaaacuuaggugucaggcuugcauagcuggugauuuaccuccugagccaucuugcuguagugcuuucaauaugcuuggcccagggaauggcacuauuaggagguguggucuaauaguguguggaggaaguaugucacuguagauacgggcaaugagacccuccuccagcaccaugccugccuagauacuaccauguuuucugccauaauaauaauggacugacccacaguacuguaagccagccucaaugaaacguugucugauauagaaguugcugugaucauggugucucuucacaucagugaaucccuaacuaaaacacugguccuagauaaacuuuuaaaaagaugaaauacaagugaaauaagcugaacgaucccaagcauuccauguagcaccuguguuguagauguuguaguguucaugacugggcuccauaacucucuacuuugaucaguuguggguuucuguaauguuugguugcaaagagaacuugucuugguggcaggugagaguuacacuuacauggggauaugaaguagaaacuuaagaguucuuuguaaggucgguuguguuggaugguguuuugcugggacaaacacgugaaggaauguuuuccugaaguggacacagguaagaagcuaagacagacuuugaacaaagcagacagagggaaaaaggauguucugcuaaagcaagcauauaaaaggacacgugaugaaggauucuuuguuaacaacacacguuuugaucuuccuuacacuguguaguugagcuccuuuuguugggacuccauagagagaaacacuauaaaacuucugguggugggcuggagagauggcucagugguuaagagcaccgacuguucuuccagagguccugaguuugauucccagcaaacacaugguggcucacagccaucuguaaugggaucugaugcccucuucuggugugucugaagacaguguacucauauacagaauauguauaaaucuuuaagaaaaaaaaaauccaacuuuugguggugugcugcgguuucuugccucuucuguuucugcugcugauagcugaacugccgauuucuaaacaacagaugggaguuguuccaaagaaccuuucuaaacagguccacuuuccccauaccuuuuuuucccccacuaccuuuggugggccucaaaggagguuaaaguguuuaaaaaccacuauuaaauauauguuuugaauuauauuacagguauaggguaaauaguuaaaguguagauagggauucugcugguuuaguaaagcagcaguuguagaauuuccuccaagaaccuuacuuaauuaucccuggauaauaggcuaauacucauccagugccagacaugauuuccuagaucuuacagggucucauaagagagcuguugguuaccaccaagauaagugugccacgcuuguacccucaugguugugcuagauugguugucaacguggcucacaggcaucagagcugguugauugcuucccuccuuuggaagcuugcaugguugucugaucccaacauggaaagaggaaggaaggacggacgggagggagauacuaauauggaagaggaguacaaaauugcuuuaacuuuaaagcaauucucuuaaguaacuaagauuuuuauuuuaaaaaucuugcagaucauguaucaaaaguaacagagccaaagucuguauguuucagugagccuucuguuuacuagaguagcuauguuuuacacuuuuguuuuuuuggagagggguggagaagugguaacccuggcuguccuggaacucacuuuguagaucagacuggcuuugagcucacagagaucuaucugccucuguuucccaaguucuaggauuaaauaaagacgugugccaccacugcucuguggauuuuuccacuuuugcuaucaaguauauuuuuauguacuuaucaaccaucaccccucccccaaaacacugaaacuaaaaaaguuaaguuuauaucuucuuucauaacucaguuguccaugaccucccuucagcccuuuuuccuccaaguauucaccauuuuucuucucugaauacuguagcacauguacauuuguauacauauaaacuuauaugguuuaugauucucauaugaggaagaacaucaucuuaauauuguacauucuaauaacaugcaauuuuaaaaucauacaguaauuacacuuuucuuuaaugcuuaauaauauaccauuuuauauauguaccaguuuuuuguuuuuuguuuuuuguuuugguuuuuugagacaggguuucucuguguagcccuggcuguccuggaacucacuuuguagaccaggcuggccucgaacucggaaauccgccugccucugcuucccgagugcugggauuaaaggcgugcgccaccacgcccggcuuguguaccaguuuuuccuuauccauuuauuugcuaucggccagcauuggaaagagcagcaauaagcauggaaugcagugucuugggcuuuucuucaguuggagggagacuuguggcuccaguucuaugucacuacuuguaaugagugccuuuaaauuacuuaucuguacuuaauugugauggaaagaaaugcauuuagaaauucuuuuguuucuuuucaguuaccuagcuuuuuacguuauaagauuuauuuauuuauuuuuuguuuagcagugucuuaauauguagcccuugcuguccuuuaacucacucuguagaccaugcuagccuugaacucacagagauuggccuaccucucucccaagaacugggauuaaaggcaugccacugcgccuggccagaucauaaauuuucauaguaaucucuaauaacauucuuuauuuuauuggagccuuuguaauggcauucuuuuguuaauuuguguucucugugugucucugucucucucucugacugucucucagauuagcuaagaauuuguuaaucucaaucuuccaauaaacccacuccuuugcugauucuuaaucuuuaucauuaauuucuucucuuaccuucauuauuuuucacugucuacucuguuuaggauucacuacuuguuuuuuaagccccuugaauuacaucaucaaguuguuugauaucucaaaaaacacuuuauuuuguauggguguuucaucuguauauauguguacacacacacauacauaucauguguaugccugguaccuauaggggccagagagugauguugucagagucccucagacuaaaguuacaaaugauuggaaucugccaugugggugcgggcauuugaaccuagaucuucugcaagaaccgcuaguguucuuauguucuaacccaugucuccaaucccucucagauuuuuaaauaugagcacuucauugcuaugcacuuucuuuucaggacugcuuugacugcaugacagaaguucuguuaauuuguguuuuauuaaaauuugucucuaggaaauuuuuaauuuccucugauuucuugaccuguuauuuauucauacaaauguguuguuuggucuucaaauauuuuuaugguuucuguaguuggucuuauuguugguuccuauuuuaucacauggucucauauacauggggaauugcuugucucacuauuuuuguauuuguugagauuugacuauuauuauguguuugguuugggaagaggcuccauguacagcugagaaaauugugucuucccuaucuguugggugguauagucucuaucugaaaaccccagugguucucagccugugggucucgaccccuuugggguugcacaucagguauuuauacuaugauucuuauugguagcagaaguacugaagcuacaacagauuauuguuacggcuuggggucagcacaccagaaagaaugguauuaaagggcugcacagcauugggagccuugagaaccacugauguuuaguauguuuagugcaaauguuccuuuacuugguuuuaguuuggaaaacuuaaaccugagaacacaguauugaagucccaugcuauuauugugucaggaccuagguggucuuuuauguuuucugguuuguuuuaugaucuuaggggcucccauauuuauuacuugaauuuuuuuaauuaauuguuccuuuuaucaaauuguaaugucucuuuuaaucucuucugguaguuuugguuuguaguuugcuuucucugauauaagaaugccugacugguauuguuuucuauuugcuugacaguuuguuuuucauccuuugauauuaaccuuuuuucauauauuuacuggcuaaguauauuucuugggaacuauuuagucuauguaaccagccucuggguaugcauuguacaugaguuccuguggaggccagagagguuguuggcucuucuugaggugcaauugcagguagcuacugaccagaggaccaaacucuugacccuguccuagagcaaaaaguguuauuuuaaaaguucaaaagaaaaguagucaguccuaucuguuugggucuguuucuucacucuucuuuucuuuuaccugcauucuuuccuuuacauagaaccacauugucuggauugcuguuuuauuauuuuauugucuuuguuuuguguagcuggucuuuuuacuacuuuauggguucuuuucccaccccuuuuuccucuccucaccccacccccaguuuuacccucuaucacuagauagcagaggaaaaaaaggaugagagggcuagagagaaagaucugaaucuaacuucuuucuucuuguuucuucauugagcacaauuacuaaaaaacugcaaucaacacccuugaacaaccaccaaccacaaauucugccucucggagcucugaaauuuauauaccuucugaaauguacccagaauuccaaacgucacacaauugcagaaacucucugcagcuggcaaaaccaugccucuguuagagcacaaggcaaaccauagucagcugcugcuaagcagccccauaccccacaccuggauuaaaacaaaaacaaaauauuucugugcuuuguaaagaaaccaaaauuccagaauucuaauuacaguuuuauguauguauuuauguguggauacauguguaggguauauucuuaaguaugcauguacagacauacauucuuaaguacacaugugcagaaaccaguggucagugucgggugucuuaauugcacucuccuuaguuuuuaagacaguaggaucucucacuggacguggucuuugcugauucggcuagagacuuuggccagcaagccuuaggguuuacuccucuccccagugcuggaaguaaaaaaagguguguuguuguuguuguuuuacuuaggugcugagaacucuguuccucaugcuuacauggaacaacuuaaccaauugagcagucuuuccaacuuuuauuauuuuuauuauguauauauguguuggaucuucuagagcuggaguuacaggcaguuguaagcuacucuguagcgccucuucuuuuuucuuuuugcuccucguuucuuuuuuuuuuuuuuuuuaagauuuauauguaaguacacuguagcugucuucagacacuccagaagagugucagaucucauuauggaugguugugagcuaccaugugguugcugggaauugaacucaggaccuucagaagagcagucagugcucuuaaccacugagccaucucuccagcucugcucuucauuucuuaagagucagucuuuuuuaaucucaauuuuuugcacuggcuaaagacauuuacagugauguaaauguucaugagacaagcauuuguuuuagcccuuacauuaauaaaaccacuuaagucuuuaaguuuuuugugagaggcaaauagaauaucugggaaacuuuuggaugacuaguuacuuagguaccauuuuguagcuauguuuugcuucuacuuuauaaccuuuucagcuuuuaguggugcuaacaugaauaagcauaugccugccccaucuuuguuggaaccaaaaauaccuuuuuuguuguuguuguugugauaggguuuuguuuuguugcuguuuacuuuucagacagggucucaaacuuggauucagguuagccucaaauucucaacaaacauuguaucucaacucacagauucugagaguacagauugcauggccgcuauacugauuucccucaccuuguugguaguuuuucuucccaucuucacuauguagcccugaacuacaacugaaacuugcuauguagagucagcuggucucaaacucagagauccuccugccccacaucuggaguacuggguuuaaagguguaugcugcauuguuaccucuccucauuuagauuucuuuaugguaggaguggggguggcuuguuugcauaugugggagugcucauguaugcacauacaugugaaagccagagaucagccucagguuucuuucacugggagccaucacuuguuuuauugagacaaguacccagggacuuagcacuuaggugaagcugacuggccagaaagcccggaacuuaccugcuucuguuucugccccucuaguguuaugaguacaagcauguauugccaauacuuuuacaugaauucugugugucaaacacaguuucucgugcaugcauggcaagcauuuuguauaccaucucccuugcccuagaucucuuaaauguuauucauuauaucaaauaugauagcaucauuuuguuuguuucucauauaaccaguggugcauugaacuaaugaugcuuugaacuuacaggccccuuuaguuuugccuuugcuaacaccugacucaucucuaaugcaugugaguuugauggauuuugguugauugguuuguuugagaugggguccuacguaucucaggguggccuugaacuuucuguuuaguucagauaaccuugaaauucuugagccccugccucuucuaacugucuuguuguuuguuuuuucauuauugacuuucaguaaauuuguuaugauuuuccuuguuuuauuugaguagaucuuucucaugauaucuuagguucuuguuguuaaaaacaacaacaacaacaaaaccuaaaaaacaagcugggcacuugggaggcagaggcagauggauuucugaguucgaggacagacagggcuacacagagaaauccugucucgggaaaaaacaaaaacaaaaaaaaacaaguuuauacuuucauaaaaauuugaaugguuuuuuuauccauagucucaaguccauuuuuaguguguuguuaacuuuuuggaaaaagucucaguaagcuguccaagcuagccuugaacuugacaucucucugccucagccuagguaguaguauuguucauagauuugugcauuugaagauuguuguuguucagacacagacacagccugugcuaggcuaccuucaaacguauaacucgagggugcugagauuacacgugugagccuuuacaccugacugcacugauuuugguuuucugguucagggugaucuugaauuuccugugcuggcugccaagaaugacugaacuccugauccuucaguuuaucucauguccaucaguguuuugccugcaugugugucugugugagggugucagauccccuggaacuggaguuacagacaguugugaacugacgugugggugcuggaaauuaaacuggggaccuauggaagaacagccacuuaaccacugagccaucucuucagcccugcuucaacuucuaagcaguagaaugaaaggcacugaucaccacacucaugugccuuuauguuucuuucuuuugagacagggucuuaguauguagcucugucuaaccuagaacucagugguauuagacauuagacauuagaaguaagcaucaacaugcuugaaccauggcuguaauaucaguacaugggaaugggaggcacaagacucuaccaaaaauauauauauguauauauaucauauauauguauauauaucacauauauguauuauauaaaauaugaaauauaauuauauauaaaauauuuauguuuauaaguaaauaauauaaguauauauaauuauuuuucacaauaacaucuccagacacuuuuucuagcuuuauagaaacaccaguugaaauucccaguccucuugaaacgccugcugaaccuucugaaccugaaaauaccuugcaaccugugcuggcucucaucccacgagaaaagaaggccccacguccuccaaagaagaaauaccagagagcugggcuguauucugauguuuacaaaacaauagaguaaguaguagugacuguaaacuuauauuuucuaauaccuguuauccauccauaauuuuuaaagauuuauuuauguauuuauuuuauguauaugaguacacuacagcuauauagaugguugugagccuucaugugguuguugggaauugaauuuuuaggaccucugcucacuucagucagccccgcuugcucaguccuguuugcacuggccuaaauauguuauuauaaauagguacacgcagaagagggcaucagaucucauuauggguaguugugagucaccauguaguugcugggauuugaacucagaaccuugggaaaagcaaucagugcucuuacccugcuaagccaucucgccagcccuccauauuuuuuuaaaaagguaaaaaaugaaucacauuuauaugugcauucacauauacacauauuauauauaaucuaauauacaguauauauguaauauauuuuauauguauagcacucucagguaccauuguauucucuagacugaugaugcugcacuagguuagaagguuacaauuaucauucuuaauguuuagccuccccuaagauccauucuguaguuuguauucuaauuauuccuuugcuguuuaaaaguaagaaagaauaccaggugugaugcuguucaccuguaauccaagcagagacaggaagauugucacuguucaagggcaucauucugugcguaccugccagacuccauagggagacauuucucagaaagggaaggaaauugaauaacacugucuguucagauaaauguauuuggaguuuuuuugcuuacauaauuugucaaauaaacuuuccugcauuguuugaagaacuuuauaaauccuugguacagcuugauaagcacuccuuuguuacuucacugccauggagucgagcacuggcaguguagaccagccauccagcucugcccugagaucacagcuguguauccuaauuaggaagcuuugggcuggcucuugguaaauaccuuaagcugaaaacccaggucugacugauaucuagugcuucauaccugaauauuguugggcuugucuauaauccacucaggaucagcagagcaagcagugagagccaccucaaguacauagagagcuauaccugccugaccugucuuuuaagaagggggggcaguagggagggagggaggaugguaauuuuuaaacaccaagagguguucaugguaaaguuaagaacuagccuugugucaaaggacugggauuguaggcaugggcugccacagcuggccugaacucaguuuucaggauguuuuuuaagaaaaaaaaaagugaaacagucauuaagacaaucaggagguucaggaguauuuuuaaaguuuucuuuaauaccaucacucgagaggcauaggcaguuugaaaaguauaaaacugaaagauuagacuuaagagcccaaggcuugguuacugucuucauagagcacuuguccagcacaguccugcucuuuccagucucuuuuuuuuuuugacccacgaaaauuuuccccaagaaaaaguuagauggccccaucuauauacacauacaauauauacacauacaauagguaucugugagaaaugugaaaaugccaagcugaaccuuucucuggguaguaagaaaguuuauuggggaucaaaucacaaagacugucucgggaacagaaaacagcaacugggcagcaaaguccucguguuuuauaagauagucggcaaggugcaggcuacuuugauuaauuuaauuaauuaauuaauuaauugagcccgagauggucuuuaccugagguagaugaccguuauggguaggggagauaaggaagguagugcuuuuccugguaagcaggauuuugagacucccgagggauuauguuuaggcuuuuguucacaauauugucuccagcacugcuauuuuauaagcccacuuugaaccaaacaguauauuaacccaacauuuacugauaaucauaaagaaauucacuuuaaaauucucuuccauccagguuguuagugaugcucaccuuuaauuccagcacuucagugaugaaggcaggcagaucucuugguucaaagccagccuggucuacagagugaauuccaggacagccagcuauugcuauacagagaaauucagucuuuaaacacacacacacaaaugaaucagagauggcauaguacuuagcacuuugugauccugcagaggacuccaguuucagcgaauccauuacccgauucuggccucuacaagcaccaaccauacacgugacaacugaacucauacaagcaaaacacauauaaaauaaacccuuuuuuuuguuuguuuucuuuugucugauaugacuguaugagugcaggugaccaugugcauguguggagaugaggcugagaugugacuucucuucuuccaccauggacuccaugacugcagaccuucuuaccuauacagccagggcuguuauuaaacaaauaagauaaaaucagaucugauaaucaaaaucuuuuuuuuuuuuuuaaauuuagacaguaguaaagaaccucucagaggggauuuccugaauuuacaguuuauuuauuuauuuuuauuucuguguauucacaggugcuugcagguaccugacaauaccucagaggccauagauccucuccagcugcagauauugguucuggggacugaacccagguucucuuuagagaaaacaggcaaugcuauuaacugcugagguuuuguuugguuuuguuuugguuuuguuuuuuguuuuuuggucuuucgagacaggguuucucugucucaacccuggcuguccuggaacucacucuguagaccaggcuggccucaaacucagaaauccaccugccucugccucccgagugcugagacuaaaggcuugcgucaccacugcccggcuaacugcugagguuuuuaaguauaguuuuuagauuaacguuuuucuuuguacucauuuauugaaaugggcuugcacacauacauacugaggacaaaggacaguguugaaaaguugauucuuucaacaguagaguucccagggcucuaucucagauggucauucucuguggcaagggcuguuagccauugagccaucuuaccagauuucauuuauugucauuuggccucaggaagaaauuugauuggcuuuguuucuuauucauuuucucaucacagcccaaagagccgauuaauccaauuaaagaaagaaaaguuggaguauacuccaggagagcacgaguauggguuguucccagcgcccauucauguuggugaguaaucagcccgcagcacuuacugguaagaagagauugugcauucugaacuuaggaaaggaccuguauucucuguugugcuggguucaaauucuucaaaaucuugacaaggauuauggggauuuaguucagcugguagaguguuugccugacaagaaggaagccuggauuggauccccaguacugcaggaaccaggggcaggacuaggcaaacaauguccaugucauuuuggcacucaaaggugaaggcaggaagcucugaagcucagagacauccacagcuacacagugauuuagagacguccaggauugaucuauacaccaauccugguuuucuuguuuuuaaaauguguauuagcuaaguaaugggcauuagaacuuauuauuauuuuuuuaaacguaugugaguucacucucgaugucuucagacacaccagaacaggguuuuggaucccauuaaagauggcuaugagccaccaugugguugcugggaauugaacucagaaccucugcaagaguagccagugcucuuaaccucugaggcuucucuccacacacaccccauaccuccaaaugagaaucuuaaguagguucucaugggacacauuuugaacugaaauugaucaaagacauucuuuagaggggucuuacuuuuuauuguuuguuuauuuauuugggaguuuuauuuuuguuauuuuaagaugaagucuuagcugagcagugguggcccauguguuaucaucccagcacucaggaggcacaggcaggugaguuaaaggccagccuggucuacauagcaaguuccaauauagccagagcuacacagagaaacuccgucucaagaaaaaaaaaagauaaagucuuauauaauuuagaccagcuucaacuucauauaaccuugaacuccucuucccccugacuuugucuccaaauucugguguauauaagugugcacaccacacucagccuucaucucaguuuuuagaaauuaauugcuaucuauggcuucaaggaaaagaucuguaaucaaggaaaggaauacagauggucuuaguuucuuuuucugcugcugugaaaaguauccuaggaaaggcagcacaagaagaaaggguucauaggcucacggucuuuccugggguccguccaccaguaccaggauaucagggcagcaggagcuuggagccacugaucacauuguuccauaguaccagugcuuguaguugcucagcuugcuugcaaucguuuuauagucuaggauccuuugcuuaggaauuagucccacccacaauuaagguuggucuucucacauuaaaguuguauaaucaagacaaucccaauggcccaaucccauugaaaaaugaaaugaaaaugaauguugauaucauaacucuaucacuugucaccuugguauuuuacacacaucauuuuuaaacuaucucuuguucauuggcuuauuaccauauuauaauauaaaauacauucaauccaacuuuagaagaccaugaaguuuuuaaaacuuuuagcacauuaaaagucaguuucaagcuaggcagugguggcuccaugccuuuaaucccaguacuugggaggcagaggcaggcagauuucugaguucgaggcuagccuggucuacagagugaguuccaggacagccagggcuauacagagaaacccugucuugaaaaaaaaaaaaaaccuaaaaaauaaaaauaaauaaauaaaagucaguuucuagucaggaauggcgcaugccuuuuauucuagcuguugggaagaagaggcaaguggguaucugugaagucaaagccagcgagugcuauauaguguaacuucaucucaaaaaagaaaagaauaaagucaguuucuuuaccuaugaauuaaaaaaaaaaaaacaguuuacauauuuccaacauuaacagcacauuccuguuuuaagaggaaagaauuuaagcauaacaaggaacaaucaaacaagcaaauaaaaucuagcagaguaaaaacuaagucuuauaacuccuuaucugucauuuggggcucaugggcagagccaacuccucaucuuuacuauagcaccuauugggauucuuuucuagacuagcuccguuccaugcccacuccucugcauacugaauauuccaugguccagguauuuccaauuuuccuggaaccuccauuucaauuuaggcuuugccuucacagcuugaagcacuggcccuccagugcccccuugcaagaaugccaacccuacugcacauucccuggccacagcuacucucugaaaucacacagaaaacuccaugacuccuuaagucuuucuuacuuucuuaccagcaaauugacaacagugcauaagucuucuagcuacuugacaucucgccuggcccccuugugccagcuuuugucagcuuuuaugugccauccuuagguaccugcuuuuuguuuaaguuugguuguuguuguuauuauuaugucugagaauuuuuuucuacacuugucugugcacucagugaaugaccuauaaaggccagaagaugucagauuucccuaguacuaaggcagcuacagaugauugugagcuaccaugugauugcugagaaucgaacuagggucuucugccaguggucucaaccacuaagacaucaguuuuuugcugcauuucaacauauauauguccugugggugcgggcaugcaugugugugcuguguauguuugugugaaggaaguucauccuacagcauguauauggaggucaaaggauaacuuugucaaguugguuaucucuuuccacauuuauauuagcuccagggaucaaacucuggucaucgaguuuacacaacaaguacuuagaccuauauaagccaucuuaccugcucugggccaaugcuuuggaggaggacaaggaauuccuucagcaguugucuguuucauuguaggcagccuuccuucaaaugagcucgcaucuucucaagauguagccucugggcaggugcauuuuacccucaggacaccuccuguugucccagugcaacugcacagcuucccacaguggugccauacucuggaccaauuguaguugcuugagaaacaccagccugaauucccuccugucuugaaauuuccucugccaagcaguuuauucuacuauuuaacucaacuuuuucagauucucagauuagaaagaauuaaggcagauucuugacggaacauuacauaaaugguccuuuucuuauggauuccuugauccacucuuaaaccuuaugaacuaggccucuacuuaaaacuuucucucaguauucugucuucaaaguucccaccugaauaaguaaacucugcuccagcaugccagggcucgucuacaguccagccagauaguaguucuaaugucugagaaccacaccaucggggauaucacaguagcugccccucucaaguaccaggguuuuugugguuuugauuuuuuguuuuguuguuuuucacugaguuucaaaagugauugguuggccauuucuggcucuuuaacuguucauaguuuccccuuacuuuccuuuucccuccacagcagcaguuugcaacuucugggucucagcucauuugagggucacauaucagauauuccacauaucagauauuuauguuaugagccauaauaguagcaaaauuauaguuaagaaguagcaaugaaacaauuuuauaguuggggucaccacaacaugagaaacuguauuacaggucucagcaucaggaagugugagaaccacugcucuacagucuauaacaguaguaauaucuacuguauucggcccugcaaagaagucuacaguaccuuuuauugcaacguauagguaauccuuucaaaugaacgauauccuuauuuacuauagugaagauuugaccuacaagcucuucacgaggacaaucacaucuccguuuuuuacuuuuaauuauuuacuuauauucuguguaugccuauguggguuuaugugagccacuuguauaaggugccuguggaaaucaaagauuaucagaucuccugaaacuuauagaagauuuuauaacaccugauaauggugcuuggagccaaaccugcaucuucuggaagaacaauaaguguucuuaacugcugagccaucuuuaucucccaaacagugauagucuaugaccauuguuuuuccuuuguuuugagguagggacucacacugcaguucugguuguccuggaauucaguaggaaucugacugccucugccuccgaagagcugagauuaaaaggcuuguguaccacaaccauugcuaauuuaagauacuuccccucaccucuaguccuugaacaucuagggcuucacugucugacuccauuucagcugagccaucacugcucugcuuuccaucucauucugagagcaauuguacucuguucuggcuacugaaggcuuugccaccugcguaaacguugaacacuuguugcaagcgcaagaauucaguccucaagcuuggugagguagccaucaucuaguucauagccuaauuuuuuuuaacuugauuuauuuaaaauaugaaugcucugcugcauauacauccucaggccagaagagggcaucagaucccauuauggaugguugugagccaccaugugguugcugggaauuaaacucaggaccucuggaagaguaguuagugcucuuaaccgcugagccaucucuccagcccaguacauuucuuuagauucuuggaagcaaaucauuggagcgcagucagagcucuugacugcugagccccucaucuccuaauuuuuaauggcucaguucauacucaguuguggugaaaggucuuucauguagguaauuuuagcacugacagucacacagaccuuuuuuuuuuuucucaguugucaucauugcaugcauuagacaaagaggaaugugaguauugcuaggaaugccucgagucaguccugguaucuugauccuaggaaaauguuagaugggaccugugaucagaguucugguuugaaggucaauuggcauacaugugaaugaauccuuaccuauaaggaaaaacuuuuucuuaaagaaguucaaaaccuuucuguuuaaucuuuguauuuucuagagaaaacauguauugcaggcaaaaaauagaauaaacuguucucauaaaaaguuuguucucugugucucaaaaaaaaaaaaaaaaaaaaaaaaaaaaacagacaaacaaaagaguaauaccacgcaugguggcucuugcccuuaaucccagcaguguaugcgguucaaagccaaccuggucuacauaguaaguuccuguacagucaggaauacauacaggaacaagacucaguucccuucucuaaggaucagucuagacuauuacauuuguuuucuuucaguauuaagagucugcagaagcuggguggugguggugguagugcacaucuuuaaucccagcacucaggagguagaggcauaaagaucucugugaguuucaggacagccaggacuacacaagaggaacucugucuccaaaagaaaaaaagagagagaaaggaaggaaaaaaaagaagugaaaaaagaaaauaauaguucaaggugcaggaaaauguuacuagcaucuuaaaucuauuuauauauacuuuuucccuaccuugaguagccuggccucaaacucaaggagcucugccugccccugccucugccuccucagugcugugacuaaagugggguguuugugucuauaugugaguauauuacguguucagcagccagaaagggaugucagauucucugaagcuggaguuacauauaauuguaugggugcucagauccaaguucaggagcuuuagagacuaguaugcagucuuaagccugagcccuuucuucauauauauaauaugucagaggccaucguucaggagcugcuucuccuuccaccaugaauuugagauccaggcucaagguauuuuaccugcugagccauuucaugggugacauguauucuucaguuauguaaauucaaguaugccccuuuucuuuuguuuauuuuuuauuauuuaauuuuguaugugggaauauauguuucacagugcugcaugaaagcaaaagagcaaucguagaaguucaguuucuuucuuccagcauguuugcuccagggauagaauucaguuagucaagcuugauagcagauaacuuuuuauccaugagccagccuggguuucuguacccuucccccuuuaguauuuuuagauuuuuguuguuguuacguguaugaguguauuuuuuuuaaagacuuauuuauuuauuauauguaaguacaucauagcugucuucagacauuccagaagacggugucagagcucauuacagaugguugugagccaccaugugguugcuugggauuuaagcucaagaccuucggaagagcagucggugcucuuaacugcugagccaucucuccagccccguguaugaguguauuaccuacaugaauuuaugugcauucugguguaccuacugccugcagaggucagaagagggcaucaggucccucugacagaugcccuguccuccacaagagcagcaagagcucuugaccccugaccuucucgucagcccuuagccccuuuguagcauuuaucugauuuuuuuagaggugauaaguuuaaaauauauuuugugugugacuauuugcucucuuuguauggacugcguaucagaguaguuguugaaauugacagugucuuuuaauuucaggaaaguaucucagacagaagagaauugacuuccagcuucccuaugauauucucuggcaguggaaacacaaucagguacaaaggguuuuaccagguuuucuuuuuaaaugauaaggguuagggaauaggaaggaaaaguuuguuuccucugguuccaugugaugaaaucuuagaauauauugggaaccguccuuauaaaagguuagagacuaagaaaaaugaauuuguguacauauuuaaugugcaaagccuuuauucacacuucagaauuaccguaaguuccuguuucaaugggcaaccuuuuguucuuauugcuuugguagcaaagaguuugcgcuauaagaauucuauuucggggcuggugagauagauggcucaguggguaagagcacccgacugcucuuccaaaggucugaaguucaaaucccagcaaccacaugguggcucacauacacccguaaugagaucugaugcccucuucuggugcgucugaagacagcuacaguguacuuacauguaauaaauaagcaaauaaauaaauaaauaaauaaauaaauaaauaaauaaauaaaaguguuugugcaccaaaaagaaaaagaauucuauuucaugcaggucuuaggagaauguagaugaacugccaacaacacuuaaaaaagaauccucaggccuuaaauuuaguuaaagguucaaggcccuauuuuuacaacaaccauagggggauaggaguauucauaccaaugaaauaaauagcagauuuuucagcuuagcuaaaauacugucaaaguuauccuuggguguaguggugacagcuccucaugcagucaggaggcagaggcagagguuucugugagcuccaggccaacuagagcuacauagccuccaaacaaaaguuaacgcuggaaaaccaaagccaguucagucuccucugccuccucuucucugauggucucugaauucuuaaagaguauuaauacggggggaggggaagggguauagagaugaaauauaaaagaguggauuauuguaucuccuuuuagacuagaaagcaacaacaagucucaaauguagagagaaucucuuguguacuguauggaagugucaccugucaauaaaaagcugauggcccauuagcugaggcaggaaauagagggugggacagagagagagaagaaucuggaaaagaaucaagauggagagauucaucccugacugugaggaagacaggcacacgaaacugugacagccgagaggccaguuuacucuuccuaucuucauacaauugcuuauaaacaaacguuacauguguuugggguuacaggguuuugugcuuugggggaggggucaugcugaggcuugagcaugcaugcugccuuuacguuaccugugcuuccaaccccuucccuugucauaggagcaaauagaaucuuaaguuaugcaagugaauaauagcuuuggucuucagagugcuuuuuuagauuguuauccagcaacaaaagaaaaaaauugaaagugcauugcuguaagucagauguucuuaaacacaccuguaaucccaucacucgggaagggacacauaagagccaaaaguuuacauacaaaacgucagguaauccaaggcuggagaugguggcucaaaagauuaugucacuuuuuguaaaccaguuaguacuuauuaauucuaauucucugucacccuuuauuuaugaggaugaaauaaaaaagaucacucuguauuuuccucagucauagucaggucagaaaaucucagaaguauuuacuguguggcuuacauuaagcucacagugaccuccuacccaaggguuauagagggggccauuauacccagcagccugcagauauuguuguaugaacagaagacauuuccuguauuucuaggaauugaugccacacugucauuugaagcaaaaugcuuuaucaauauuuuuuuucuucuagcuauacaaaaagccagaugucccccuguauaaaaaaauccguucaagugaguaacuuagauguuuuuuccaccuucaaaacaucaauguuccuccugucuugacacuugaaagcuaauucuguauguucaaaaacuuuuauuuucuaucuucuaagaugucuauguugaugucaaaccacuuucugguuaugaggcuaccaccuguaauuguaagaagccagaugacgacaccaggaagggcuguggggaugacugccuaaauagguacuguaacugacuucucuaaagcuacauucugaggacuguguauguguucaauaugaccuuucccuccucuccauagaguacacugauacuagcagacugaaaacagugucagaaagaaucuuguguaccuaaauuuaaaaucuucuuacuauugaagagacguaggaauggucaauuuugugcuaccuuccccugggggaaguuuccgaggaugauaugagauguuguaaccuacuaauaugcaaaauauuuucuguuuauuuuguuaguugauuuuuguuuacuuucuugagacaugauugcucuguguggcagcccugguugugcuggaacuuucuuuguagacuaggcuggccugaaacuugugagaucugccugacucuaccucccaaguucagggauaaaaggugccaccaucacaugguuaacaagcaagguguuaagugccuuccuagcuuucaacauuugauagggacaguccaaaggaaaggcacucuauccaaggaaagcuaugcuaagaaacuauuagcauguguaagcauacacauggucaguggucacugaugcugugacaggguaagaauaucaucagaagcaugucugugcuggguugacucacuuggagauaguggcuauuuuuagugggaucuauguuuucuguuguuuuuuguuuguuuguuuguuuuuguuuuuguuuuuuguuuuuucaagacaggguuucucuguauagcccuggcuguccuggagcucacuuuguagaccaggcuggccucgaacucagaaauccgccugccucugccucccgagugcugggguuaaaggugugugccaccacgcccggcuguuuucuguugucuuaaaucucugcucuucccacuuagccucccaagugcugaaauuuuaaacauacucuaccaggcauaaaauggaaaugccuaauuaaaaagggaaagaggaaagauagaauuuguggauuuuaguaaugcauaugaauuuacagaaaauaaagaauccuaauauuccagguguggaagcgcauacacguauaaucuuagcacucgaagagcuaagacaacaggaaccacacaaacuuuaggcuauccuguucuacaaaguaaguucugggccagcuguggcuacauagcuaauuccugucugaaaaaaaccagacauaccaguauccuuuacaucaugacgauugccagagguaaaugcuucuguaguccuccagugcccugucagcugcagagcuugguuggcacaugccagguggggaccuuuccuggcuuagucuacuguaaaugcauaugacguaguuuauacauaaauguaguuuuauuauugguaauaauguugguguaggcaaugagguuuuuaggaaagaauacuuuacucgugucuguguuuguguguguguguguguguaaguuuauguacaugacaugcaugcaagaagaguugaauuacaggugguugucagccucccugugucuccuggcaacugaaucccuguccuugaaaagagcaucaagcaagugcucuuaacuacugagggaauauuuuucuagccccauuaucaguauuuuuuugguacugacuuuucacucacaaauauucugauauuuuuauuuuauuuuugagacagggaauuacuaucuuauagcuuggcugagcuaguacuaugugcccaaacuggacucaaacgcaaaacaaucuuuuugucuaagcuuuuaaccugucuuguuuuuuuguuguuuuguuuuuaugagacaagguuucucuguguagcccugacuauccucuaacuuguuguauauauaaagcuggccuccugccucuuccucccaaaugcugggacuaaaguuguguaucaccaccuggcuugcuuuuauuuauuuguuuguuuguuuguuuauuuauuuauuuauuuugugguuuugugugugcgugugugugugugugugugugugugcgcgcgcaugaaaguuuuaugcuuugugauaauaaucaugcccagcuacuuacagacauuuuaaauuuauccauaucacuuugaugacuuucugucaucugucaaguuaauaggccaaaauuggccucuucuguuuuugucaacuaaucucuuuucagugucucacuauuacaaauguccagggagccaagaugugguggugcacaccuuuccuuccaauacucgggaggcagaggcagguggauuucugaguucgaggccagccugaucuacagagugaguuccaggacagccaaggcuacuuggagaaacccugucucaaaaaggaaaaaaagagucauuauuggagcuggcucggagguuaagagcccagaauuucagccccaguaguuucugacuucuauggacaacaggcaggcacauuguuuacaugcaaauuacccauaaauauaaaauaaauaaaacaucuuuuacagugauuuuuaaauugucucuaauaagcuugaaaugugcugaacacccguguguacccuugcacuucugaggcacaggcaaaagacugcauuggaaucugacauuuuauauauauauaucagaagccagccauacauacauuuugaauuuuuuuaaaaaagauuuauuuauuauauguaaguacacuguagcugucuucagacacaccagaagagugucagaucucauuauggaugguuaugagccaccaugugguugcugggauuugaacucaggaccuucagaagagcagucagugcucuuaaccgcugagccaucucaccagcccacauuuugaauuuuuaugauaaguaaauuuuacagagcagugauggucauuaauccuaccacuuggaagcauaggcagguagaucucugaguuggaggccaauguggucuacaaagcaaguucuaggacagccauggcuacacagagaaacccugucuccaaaaaaauaaaaagcaaguaaaauuuaaaacuaugugaaauauuuuuauacaauuguggcgauuuuaauuuuucaaauuaauuuuuauuuaugugugugggguuuugucuacauguccguaugcacacuacaugcuugccuggugcuccuguaggcuggaagaggguguguaauguccuggaacuggaggccugguugucugcaggagcagccagugcucauaacuacugagccaucuuuccagccccauaauuguagcuucuuaggauugacuuugguuuaucugucuuacuuauugcccuuacguuuugagaauuugcuuugguuaguuagguuuugucuacuguucaucuuuuauauuuuguuggcuuuuugcaguuuucuuaaccuuagagcauagaaaagagggagccaagcugggaagauccugagcuguccaaguaacauuaaaaaauaagauaggaccaaguugccuuaagauguaaccacaaaacugacaugugaccauucgccauuucaaaugguuauuuucuaucacuuuuguuggcauggguauuuucuuuuucacauuagacugacaccuauauauucaguacuaacaagcugacuuaacaacccaaaaaaaaaaaaaaaacccaagcuacaaugcucacaaauaauguuauguuaggcugcucacuacaaagaaaucuagaguacagaugacaaaaugaagaaugucauaaguucacaaauguguaagaaaaaaaucaauuguauggcuuaauagauuuuucaaauaacccauuauaaagucuccauuagauggaacugucuaacguguugauuugucaucccccccccacacauaauauauuuauuuauuuuggggggacuucacaucauacacuccuaucacauucacuucccaguccuucccuguccucucacacacauacaccuuuguuacccucuccuccaccacaagaaagauguccaguuuuuguugucuguagugccuuugcuuuauguuuucacauuuuuuaauuuguguaaauacuugguaggagagcaggaaucuuguuuuguuugauuguuugguugauuuuuuuuuuuuuugagacagguuuucuauguagccaugacugucuuagaacaugcucuggaggccaggcuggcuuugaguucacagauauccaccugccucuaacuccagagugcugggguugaagguauauucuaccaugcccaacaauagcaggaaucuuuuuuuuuuuaaagauuuauuuauuuauuauauguaaguacacuguagcugucuucagacacuccagaagagggugucagaucuuguuaaggaugguugugagccaccaugugguugcugggauuugaacucuggaccuucggaauagcagucgggugcucuuacccacugagccaucucaccagcccaauagcaggaaucuuaaaguguccacaaaauuaaaaauuuuagacuguguagcccgggcugaccuagaauucaagcuaucugccagucucugccuccugagugcugacauuaagaaaauaugugaccugccagcaggaucagucaucacauaguugaauuguauuuguuuucaaauuguccuguaagaagugugguucaggacaguucuucuaaauagauaauggacuuuugaggcugaggagauggugcagaauguaaagaagcugcugccaauccugucgaccuaaguucugucccuggacucacaugguaaacggagagaaaccaacuccugaaagugauguagaccacgacacgcacuccggguguguguguguguaugugugugugucuuugagucuaugucuguacugugugucuccaucauacacagauaaguacauagauuuuaacuagaguugauuuguuauaauguuuuguuuugaaacaagaucucacuuuguagcuuuggcugucuuugaacucacagccaccucccucugccucugggugcuaggauuaaagaccuucauaaccacaucuguccuuaagugaguuuuuuuuaauuuauuauuuuauuuaauguauaugaguacacugucgcugucuucagacacaccagaagaagguaccagagcccauuacagauguuugagagccaccaugugguugcuggguauugaaccaggaccucuggaagagcagacagugcuuuuaaccacugagccaucucuccaaccccuuacaugagcuuuuauaacuaucucacaucaauauuuugaaauauuguuauuaaguuucaaaguaaagcucucaauaucauucuucauaauucauuauuccuuuccaguuuaaaaacugccuuaaaacugugagcuuuguugucuuugaacagguacuaccuaaaguguauuugcuccaaacaagaguggcaagguaauaucaaaagggacagguaauuaaagaaaaaagauaaaccugagugguaguggcacaggccuuuuauccuagcacucaagaggcacagguaggagggucuugugaguuugaggccaacauaguugacauagugagcuccaguucagccaaggcuacacagugaaaccauguagccaauaaguaaauacauuguuaacaaaaggaagcuuuuucuaacuuuauauacccuggaaaauacuguguguguguguguguguguguguguguguguguguguguguguguguguguguguguguuauaaagacuuaauuucuguacaauuuuuccuuuuaaaauguuuuuccaguuacauuuguuguuaguauauauacuauauuguguauguuucugucucccucugugugcaugaaugugugaaugaauacacugaagaacccagaaaaguuuuucaguccccuagaacuugaauuauagaugguauauaagccuccuagaaagcaaacucaggcccucugggagagcacuaaaugcucuuaaccacugaaccaucuccccagccccaccuaagugugcauuucaaugccauauaugauaaugcucuguaaaggugaaagaugccucacuuaguaaagugcauguugugcaagcacuagaaccugaguucaaaucccaguaccuccauaaaugcccaugucuugugucugugacucucuaacguggugguggugauggugguggugucagugguagugguggugguggcaacgauggcagggugaucacauucucagagcuuacugacaaguaagagcuuacuuacccaaaucuagccaaucugguucucugguuucaguaagggauccugucucaaaaauaauuggagggcaguauacauacacauacagugacacacaguacacacacacacacacacacacagucuuaaaaauaaaaagauccagaaauuuugaaagagcaugugauacggaucuaaaauugcagcaacuaaggaggcagagaaaggaggaucucaaauucauggccagccugggcuacacagugugaauucaggccagucugcacugucuucugugacccaaucccacacccuuccgaaaguuagauacuguuacuguucuguacgaugugcagggauagcauguggaguugauucugucaucuauauaucaaacucggaucaccaagccuacacugcaaguaccuuuaucuuagacgucuuacccucuuguguuuucauaaaacacaucaagaaguuauauaaacacuuguucauuuguuauguucaaguuuuuguuguuguuguugggccucauuuacuugccuguaauuccagcacucaggacaguaaguuaagaucaaaaguaguggcugaaaagaugguucagugguugaggguacuuguugcuuuugcagcggagcagaguucaguucccagcaccuaugugguaguuaacaaacauccauaaauccaguuccaaaagauccaaauggcuucuucugauuucuacaugaacaacuccucacaugguacacauccauaaaugcaagcaaaacacucaaauccagaauaagauacacacuucaggggcuaaguaugguggcacacaccuuuauucccugcgcucaggaggcaggggcagguggaucccugugaguuucaggccagccuggucuacaaauaaguccaaggacagccaggacuacauagaaauccuguuucaaaaaacaaaagaaagaaaagaaaacaacaaaaaggcuagcauaucuacagccauaccacccucaugugcccagucuccugagacaaacuagaggaucaugaguuuuauauggcaguaaaguguugucuguguucucacucuaaaauuaagaaaguuaacuuuagccgagcaugguggcgcacgccuuuagucccagcacuugggaggcagaggcaggcagauuucugaguucaaggccagccuggucuacagagugaguuccaggacagccaggucuauacagagaaacccugucucagaaaaaaagaaaagaaagaaagaaagaaagaaagaaagaaagaaagaaagaaagaaagaaagaaagcaagcaagcaaacuagcuaacuuuagaauuagguacauuagguaucguucuuaucuuuagauauuuaccuacucugggcaaaauuguuucauuaauuaaauuuuaaaauaauuugaauauauaaaauggauacaguaaaaauguacuguguaaacugauuacaauuauuacuuucuagaaugaucuuugcugaguguuccccuaacacuugccccuguggugagcagugcuguaaccagaggauacagaggcaugagugggugcagugucuggaacgauuucgagcugaggaaaaagguuggggaauuagaaccaaagaaccccuaaaagcuggccaguucaucauugaauaccuaggggaaguugucagcgaacaagaauucagguaaauaaugauauuucaauacaaugaugaaucugcaaggugaaacuagagaaucaaaaauagaaacuuuaauguuauuuuaaucacuaauuaguaacucagcauugauggugaaaguagcugccuuucaauuuaaucaguaauuggcuuucaauuauuucucuucuucaggaacaggaugauugagcaauaucauaaucacagugaccacuacuguuuaaaccuggauagcggaauggugauugacaguuaccgcaugggaaaugaggccagauucaucaaccacagcugugacccaaauugugaaaugcagaaaugguaagaaagcaugaaaccgugaaucggaaaccuauaauuauaccagauccuucaggcagaguaacuuuugcuguuuuguuuuuuuuuuuggggggggggggugguccuuacuucuuuuacagcaagcauggaaacacugacccuaguaguuacugaauacuuacugggugcuagauaacuacaugugccauuuuauucagccauuauacugaaaacuuacuacccaucuaguggauuugucaaaaaaacaaaaacaaaaaaacaaacugugaaaugugagauuccuucacuuaaauggucaaaucuaauugagaaagaaaagaaucaaagaaucacuaaagauagagaaaugguuagcaguuaaaaacacacacuguuuuuacagaggucaugaauuuuaauaaaguguaauucccauacauaaaaauacauagguuuuauguaugggguuuuuuuuguuuguuuuuguuuuuuguuuuuucaagacaggguuucucuguauagcccugucugucccggaacucacucuguagaccaggcuggccuugaacucgaacucagaaauccgccugccucugccuccugagugcugggauuaaaggugugcaccaccacacccggcugaguauuuauuaauuuuuaaccaguauauuuauccaccaaauuuacaccccugugaaaacaaaacauagaaaacauuucuggaaguugagagacuggagauggagcacuuacccagcaagcacagaaacucaucccuaccucugccaagugaaaaucaggccugccuucccagagcugaggcacauagccucagccagccugcucugcagcaugagucccaggccagccagagcuacagaguggguccauaucucaaaacaaauaaaccaaacuaggcgcucacuauauaguacuagcuggccuggagcucauggacaucuguuccaggcuguugucagauauaaaacaauucuccugcuucugcuaccaagugucaaaauugcaagucugaguuacaauacccagcuuacccuucuccucccacagccagccuccccaucuuccaaaacaaauuuugaucuaguuucuauuauaaucugcuuuaggggauuugaagagcuaaagaagacaucaguuuucuugccuccacaaagaacauacacaacacagacauauacuccacacauaugcacacaucuauaauccuagcucuugagaaucuuaaagccugagaauauugagauuaaggccagccggcuggacuacauagugaaacucugucuuauuuauuuauucauucauucauucauucaauggcugacgagaugguucaguuaagagcauaacuaccugucacuccagcuccacaguaucuggcuucucuucuagccuccagaguaccagguaugcaaacagugcacauacuacaugcaagccuucgcacauaaaauaaaagaaauaaauuggaggggcaccuagguguagugaugcaugccuuuaaucucagaaaucuaguagacuuuuugugaguuacaggccagccagagcuguguagugaggcacacaaaaaaacaaaacaagacuacucagcuaguaaauaaagaugcuuuccaccaaaccaaacacccugagguuugguccauguuaacauggaucuacccacaugguaaaaacaagaaccagcuccuagaaguugucccuaccuccauauguaugcgcacacauauacauauaacacauauaaguguuugaaaaauaaaaaugagaugaccuggauaugagaguugacaccuuuuuuucuuguuugaugauaucuggucucacuuuguaaguguaccuauccugggacuucccguguaaaccagccuguccuacaauuugccgagauuccucugccucugccuccugaauccuagaauuaaaaaugugucaugaauuaauagauucgucuuaaaaauucaauuuuuuuuuuuuuuugguucuucaagacagaguuuuccuuugaagccacucuuugaacucacucugccuugaacucucauauagaaaaaguuagagaaaaggguaaauucuuucaaaaacacauuuuccuaaaaaucacauaacuggaaacccugaacauaauccccaagaaauggaguagaaauaaaaccauacaccaaaggaaccggaggcccauguuucacuaaugacuuagacuuacuuuacuuuguuuaauucgugaguuuuucuuuguuuuugagauaggauuccccguagcccagacuggcuuaagccucucauuuaccugaagacaaggaacuugauguguguguuuacuucuuucucaguauguguaugugugugcugaugacagagcaccuguggcuaucauggcaccccucaguagacauuauuucucuccuucaugugagucuuagagacuccagucaacaggcuugguagcaauugccucuacccacugagccaucuugccaaucugacuuucagcuucuugauccuccugugaauaauucaaugucaaguuggguauaggagacaauugcucaaaaaugggaguagcaggacuauucuuaaaaucuagggcuaucgucauggugagguaacuuaugggauaaaggcaccugcggccugaccugaggaucugcauucaaucccuaggaccuaaauuguggaaggagaguaucagcucccugaaguuauccucugagcucuuccuugccccuccccaacacacacacauucaauaaaacugaaaauaaauaacaaugugaaagacagccauugucaacaagucuaauguucugcuauacugaaaggccucacuaaaugauguggugagaaaaggagaaauaaaauaggauuggcagaccugugagcucagcagcuuggguggguuucuugggaaagcacugucucagacccacaccagcacaguagauaagaaauagucaagggcugagacacaguucguucccucaggacagugcuuaccuaggcuggacacugguacaauagucucagcccucgggaugugcaggccugaggauuagaaauuccaaguuggagcuggagagauagcucagcgcucagcuguugaggcucuuccaggggucuggggcguaaaucccagcacccacauaacagcucacaacuguuuguaacuccuaaaucugacauucccacauauacauacaugcaggcaaaauacuagugcaaguaaaauaaagguaaauaaauuuuaaaaauuguuuaaaauaguuccaagucauuccccaguccugaggccacccugaacuacagggaccaugacucagaacaagguuucacucaugugggugugacaguacauggcuuuugaucccagucugaugagagacaaggcucgagaguugaaagccauggggcuagagcgagccauugcucagugguuaagaacauuggcucuucuuccaaaugaccugcguuugauucccagcauccauguggugacucacaacuacuuguaacuacagucccaaggaaucuggcccccucuucuagccucagcaggcagcaaaacacccauauacauaaaaaacauaauuuauuugaaagaggaggggggaagaacuaaagagauagcucagugguuaagagcacuggcugcuuuuccaaaggaccggagucaaguuccagaagccgcuugucaacugacagcugucuguaccucuaguuccagaggaucugacaccuucacacagucacacauguagucaaaacaccaggacacauaaaaauaaauccucuauauacagagaauugaaagccagcaucaucuaaaugaaacccuguccaaagugaugucacgugugccuuccuacagagcacauagagaggacagcaggagauaagcuauagccacugagccaugguucgcucuagccccauggcuuucaacucucgagccuugucucucaucagacugggaucaaaagccauguacacucuagcaguucaucaaugggguagaugauggagugggccaauucgaagcccuggaucugggccugagagguaucugaccuggucagcccaccaucucucaugcucugcagccccacacccaggcccagcucuacccugcugcccaggugaugugcagggucugcucucccaaauguugcauccagugagggacauggucaguucucccacucuuagaaucccagggcuagcucucccaucugccaaaagugagggcagggaaggagggugucucucccuccucaucaauaacaucagccagcaggcaagaggcagggcugccucucacgcucucacacccauaacccuagcaacccuggucagcuauacugugcugcccaagugaggugcaggggaugcucuucuaagugcuacaccuggugaaggcagggccagcucuucugcucugugaccccagguccaggucucccaccugcuguagauggugaggaaggauggggaagaggguaucuuucccucauccaagcugccacagggagauaagugguagaucaagcucucccacacacguauccucaggcucugcucaccugcugcuccugcaaugugcaggcugcucucauaaguccuacagcuagcuagggucagggucagggauccugcacucauaccucuagagccagcucucccacaaugcccaggugaggagaguggccagcucugcauagcccucagacacuaacaagaccacuguuggcaguucagaccagagaugucuggcuggcuuucugugucaacagaccacugcucccagaugugcccuuugaugacagcaaaggccaggucccaaccauggucucagguggcaucacuggcuacucaugcaaggcugcuccucacuaccuguaaguguccaguucugccucucuuaguugugacuacauccuuauuucucuuucucuuccauuucucaaccauucacuugcuccucuuaaaggcuccugaguucucugucuggguccaucacagaaguggucucagacaugcaaggcccugcucaugcauuauggcaccaggcaggggacaucucaagcauggucuguacccccagaccaguguggcacaagacggguucgucucaggcuagccccaucgggcucaucugagauacaguccucuccuugccugcccaaguggcugucugucuugggcucacucacaccuggggccucuggucccaggcagagcucuucuagucuccagcuugcuuguccugggggcccuuucaggucugccuggugggggagucucaggcuagcucccuggcucuguacugguaguggucucuggcucacuuuuuucagggaauuaggcuacuaaucauucagauguucacaggucagaauacugggcagacauagccucucuucucucugccaccuacugacucacaugugacacggcagccaugucugcaacaccucuagggacaggaaauuucaaaucuuauaaaagacucccagguaagacagugcuuggaauagagacugaguacauagauuccagacaguuuaauacugucaugugcuucaugacgagcugcuauucaauaaagaugguuuuccaacuuuguucuguccuaauccacauguaacagcaaguuuccagaaagaugcacagcauguuuucuuggauguaggguagguacauagaauagguacggauaaccucaaaaagaaaugucuaaagccugucuauaaucagacagggcagaaggaucaccaugauuuugagcccagacuggccuauguaguaagacugucucaaguacucaagggugggauagauuaauuucuaaucuaacuuccucaaauacacuaagaagacccuaaguuugaucucaggccuucucucagugaagauuacuauuguuguggugaagcaccauaaccagaagcacuguggggaggaaaggguuuauuccucucacagcuacauguggcaggucaucaucaaaagcagugagggcagaaaagugugcagggcaggaaccuagaggcaggagcugaugcagaggccauggagggcacugcuuacuccccaagcuuuucucuagaaaaaagcucagccugcuguuuuuauagaacccaggacuacuaguccagggguagcaccacccacaaugaguuggguccuccccauaguuacuaauuaaaaagugcccugcaggcuugcccacagccugaucuuagggaggcauuuucuuuucuuuucuuuucuuuucuuuucuuuucucuucuuuucuuuucuuuuuuuuaaagauuuauuuauuauuauucauuaguacacuguagcugucuucagaugcaccagaagagggugucagaucucauuacggaugguugugagccaccaugugguugcugggauuugaacucaggaccuucggaagagcagucagugcucuuaaccgcugagccaucucgccagccuccaggaggcauuuucuuucuuucuuucuuuucuuuuuuuuuuuuuuuuuuagguauuuuccucauuuacauuuucaaugcuaucccaaaggucccccauacccaccccccuaauccccuacccacccacucccccuugaggcauuuucuuaauugaggcucccucuucuuaaaagacuuuagcuucugucuaguuagcauaaaacuauccagcaaaccccugcaaacagagguaguucuggucaucaaagaauacuaguagggggcucaguagucuagauacucuuccagagaccuuaguucauuucucagcacccccauggcaacucacaacuaucuguagcuccaauuccaagggauccagcaccuucacacagacauacaugcaagcaaaacaccuacucacacaaaauaaaaauaaaucauguuuuuuaaaaaggguaaggaagaauacuugcuacucuuucagagccaccuacaugguaguuuauaauagucuguaaguccaguuccaaggaacaccuuugcuagccuccacaggcacuuguacaaacauagcauccauuuauacagauacacuuaaaaagcaaaaaacaaaacaaaacaacaacaacaaaauuuuaaguucagauuugaagaaugcaagaugauggucugcuaguauacaccuguaaucucaguacuuacaagccugaagcaagaugugcaaguuccagauucccaauaaaccaaguuacuaggugggggguggggaguggcuaacucagcagacgggaggugucuguaaagugcuuccagucagagccuacauuuaaccccuacuacacaugugaaagcugagcaccagugaccaugguggcauuuaccuuuuauccuagcacucaagaggcaaagaaaggcagguaucugugauggugaggccacucuagucuaccuaaagaauucaaggaaacuaggacuacaaacaagauccuguuuggaauaggaguggggguguuaugagggaaggagggugcucucuggaagggcaaacauagugaugcauguuuauaaucccaccacugggcagguuaaagcaggagggugcuucacuaugaauuugaggcucuguaaaaagacaagggacuagagauacagaucagcuauaagaggguuagcuaacauguacagaagccuggcucuguucagucaccaauaccaaauaaauccugugugauaacaugggccagucaucuuaguacccaggagguggaagcaggaagaucaaggguucaaggucauccuucgcuauuucuugacuuugggucaacauaagcugcuacgugagaccaugccaaauaaugauaauaagcugggguggcccucaagacagaaacugacuggucucucuguuuuaggccagccagcgcugcacagugagacuugucuuuggaagggacuuggggcagggauucuguacaaggcccuggcugaacucacaaagaucugucugcuucucugcuccugagugcuggaauuaaaggcuugauggcaguugauucucuuaaaaaaggacaggaaagucaggcagugguggcacaugccuuuaaucccagcacuugggaggcagagguaggcaaauuucugaguucgaggccagccuggucuacagagugaguuccaggacagccagagcuacacagagaaacccugucucgaaaaaacaaacaaacaaaaaaaaggacaggaaauaaaaggaaaaagcaaggcugaggugugauggugggcuguuuaccuaucaugcuaugauaagacaccuguuaucuugcuuaucuugugaugagaaaucccaacuuuuaauucuguucuuuauauucuaaauaggucuguuaauggaguguaccguauuggacuguaugcacuuaaggauaugccagcugggacagagcuuaccuaugauuacaacuuucauuccuucaauguagaaaaacagguaaggauuaaaauucaagagggagcccuugagagccauacugagaaagucugcucuucgcucuuuuaauaugugggucucaccgucucagagugcugaaaaccacugcacccugcugucauucuucagucauguccuuuugugucacuacgcuuaaguuuagucuuuucauuuuuugguuucaguuuucgagagagggucuugcuauagaacuugcuauauaaaccaggcugguuucauauugauugguuuugaucgguuugaucaguuggcuaauuaguuuguaacagaaaccuuagguauccugacuugcuucuagagugcugaguucauaggccugugucaucacuucacuguuagagucaguuccgcccucccuguccucucagccuccucuucuuucgguuugguuuauuugaggcaggcuuuucucugauagccucuguuguaaggugaacuccagaucuuccugccuucaucuaccaagugcugagacguaagccaccagaauagacuucaguuaauuacuugcauguuugcaguuaaugucuuaacucaggcuuaacuuugggggucuaacugcucagacaauuggaacuugugaugagaaauguacaagauuaaaaaaauccucuuuguuuacagcaacuuuguaaaugugguuuugagaagugucgaggaaucauuggaggcaagagucaacggaugaacggacucccuagccauaaagguagccagucuucaagcacgcauagaaagucugcacgggcgaaagagaagcggaaguccaagcacaagcugaagaaaaggguaaaccaagaccucacggcuucccuaaaggcugcucucagcccccuucagacacuggaacaagagucaccacagacuuuugucuuaacccuaccuuuauaacuucagagaugaugucugauagauucuccuuuuucucccuguguucuccccccacaugaauuuuuagaaaggccaucccucugaagagcccagugaaaacaucaacaccccaacaagauugacuccacaguuacagaugaagccaauguccaacagagagagguaauacuuaauacuucauuaaaaaacagugaaagcaggccgggcaugguguguguguguguguguguguguguguguguguguguguguguguguguguguguguacgcgcgcgugcauauacuucauuaaaaaacagugaaagcaggccgggcaugguggcacacgccuuuaaucucaccacucaggaggcagaggcaggcagauuucugaguucgaguucaaggccagccuggucuacaaagugaguuccaggacagccagggcuacacagagaaacccugucuugaaaaaaaaaaaaaaccagugaaagcauugaagaggcaacagagauaguucuucagugguuagaguaugcacgcaguaacuaacaauugucuuaaccuaguuccaaaaguuccaaggcccucuucugaccuccaugagcacugcauauauguguuacacauauguacaugcagaugaaaaacucaaagaaauaaauaaaaauagguccuggcacuugggagccagagacuggcagauaucugugaauuccagaccugccugguauaaauagaaagucccaaggucagucagagguauagugagacugugucucaaaauaaauuuaugaauaaauaaauauuuuuuaaaaccacacaauauguacaaauagcugcauguucugguauacuuauuuauucucaggacuuggaagccugagacuagaagguuacaagauuuuuuuuuuguuuuguuuuuuuguuuuucgagacaggguuucucuguguagcccuggcuguccuggaucucacuuuguagaccaggcuggccucaaacucagaaaucugccugccucugccucccgagugcugggacuaaaggcgugcaccaccaaugcccaacuagguuacaagauuuagauuuguauaaacauuccauaaaucucugcucuucuugccagauguuuguagauaauauaggaaaaugguguuuggccuuuuacaagucucacucuguagcccaggcaggcuuucaagucugaaccuucucuguuacccuccugacugcugagaugacccaguucugcaacugucugcccuauucacuguugagcccaccuacgauaccucuuggcagcaguuaggaguguagacauggaauaaagucuuagggauugguaaggaucacuguccucguuuccuucaggaacuucgugcuaaagcaccauguguucuuggugcgaaacugggaaaagauccaucagaagcaggaggaggugaagcacacccgugacauccacucagcaucgcuguacacccgcuggaacggccucugucgggacgacgggaacauuaagucugguaaagcagggggaagcuugauauuuguuguuguuuugucuuaggagacaggguuucacuguguagccuuggcuggccugggaacucuguagaccaggcuggccugggacucacagauaccuaccuacuucugcuucacaagugcugggauuaaaaucuucaccaccauugccugacuggaaagacugcaugaugauauccuguuguagcuccccugguuuuuuuuuaaugugugugcaagugucagggcacgugugccacucacaugugaagacuaagacuccuuuuauuuguguggaccagaucaaaugaugccaaaugcauuauggggaggaaaaaaaaaacaccauaacuauaaauucaaauacuuuucucccauauucaaaugaguacuguauauauagaagcaucuagauuacuuuuuaagugacuguuagaauaaacagcuuucauuguuugcgauaguauccagaacagaugagauaaugaucugucugucucucucugucuaucugucccucucucugugucugucugucugucugucuuugugugccuuugaggcugggucuuacuguguaacucugguacucacuguauagaccaggcuguuguuguuuuguuuugucuuacuuuguuuuguuuuuugagacaggaauucucuguuuagcccuggcuauucuaggaauucaggguguagacuggucuagccuugaacucaacaacaauccacuugccucugucucagaagugcucagauuaaaguuguaacuaaaccuggaucaugaaaugguccaaaugagguguuuaguacaggcugugguaaugccugccugugaugauagcgcucagaggggaaacaggaagaccuagagcucaaggccaguuccaugccccagaguguccacacagauccugucuuauuccaauaaagagaggaauaagaaagauaaaaugaguaaagguaugaaggaaggaaauagucacaauuuagaauaaaauuugaaucuucuauuccuuaucuucccagaagauacugaaauguauccaugaaggcuggagagacagugguaaaagcacuggcuguuccuccagaggaccgaagguccauucccaucauugcuauagcagcuuacagccuucuggaacuacagucccaggggguccaguacccucuuccugcccuucaugggcacagcauguaggcauagauacgcauacacaaauaaacagaauuagauauauaugaguauuuaaaaaaauaaguaaaauaagaaggaaagagagaaagccgggcgugguggcgcacgccuuuaaucccagcacucgggaggcagaggcagguggaucucugaguucuaggccagccuguucuacagagugaguuccaggacagccagggcuauacagagaaacccugucucgaaaaaccccaaaaaaaaaaaaaaaggaggaaagagagaagcuagacauaauggcacucucuaaagucaccauuggcuuuacagugcauuggaggcuagccugagguagcuaaugaaauacuacacuguuuaaaaaagaaaaaaaaaaaagagccaggcaaaucaaaugacuuaaugaaacuuaucugagcacugagagaauaagacaggcaguuugaaacuacccugagccgcagacugagccuuugucucacaugaauaaacuacucauccuccccaacccucauccucuucuuuuuuuuuuuuuaagauuuauauauuuuauguaugugaguacacugcagcugaaggcaucagaucccauuacagaugguugugagccaccauguaguugcugggaauugaacucgggaccucuggaagagcagucagugcuccugacugcugaaccaucucuccagccccauaaaguauuuugguucuuguuuuggacuuaaugaaagggguguuuuuauauauauauauacauacacacacacacacacacacauauauauaucaagcuauuguugaacuugcuguauagcucaggauggccuaaaacacucauuccuccuuccaggccuccauaaugcuggaauauagguaugcuaacuugcuugccuuuugguaaaauguuguuguuauuuagagaagagggacgugacacuuggagauuuggcacagggugaauguggaggcuggaggacagcuuacaggaggcuguucucuuucgaucgcauggguccugugguuccaacucagggcauuagucucugcaccaagcauauuugccuauuuagcagucucuccagcccagagaaaauuggauuuucccagaauuuuaaauccuuucagcaauuugguaguuagaaucucuuugaaguuacaaaccaaacagauaagaucuaauauacacauacgguguugccauauucuugacuucuuacucaaagaauuaaaggcucacguggauuuucaaaaguagcagcuuacucaaagcaaaugauaaaauaggugagauuacuaucaagcgugccaucaggcuucucaaguagaacgugcucaggugcucagucagcuguggaccuccuucuuagauaucaugagauacaagaguuuggcugugagcaucagaguuugaggacauauuuuagcagacagaucaaaguauauaaccauuuuuuuaucauaugccccuuccuguaauacaucuuauuuuaauccugcacgccuuccauugugcauaggcauaauaugguaaauagggauuuccccccaaaaauucacuuuaagaauacauuuuguauuaacugugcgugcauucaaaacuaguuuaggccagcucagccugcuuacucauaaauggaguacaauuuuuaaaaauuuaaguuagauguuuuuuaauggaaagacaaacuuauuccauuguucaaagaguggguguuuaugccaguagggguccuaccuuacaaggugcuagcugaguuauucagagaggggugugcaagaguuaauaugagcaguuaagugucucaagcuagcugggcaguggugucgcaugccuuuaaucccagcauuugggaggcagaggcagguggauuucugaguucaaggccagccuggucuacagagugaguuccaggacagccaggaaaacaaaaacaaaaaaacaagugucucaggcuacugcuuuuuagaagacgguguguguguaugcaacaaaaggaguuccaaauuacuaaccaauucccugugauugcuugcuucuacacuaaauaggugaauguaaaaagcauuauuucagccucaugugauggcacauucuuauaaucccaguauucagaaaacugaagcagaacacagccaaaguuauauagugcuaggccuguccuuaaaugaauuaacacacucucucuccucucucucucucucucucucucuuucucucucucucucucucucucucucucucucucucucucucucucuccaaccaucauccugcucacauucauuuugauaauauauuuagcagcagugcaagaccauaagcaagagugcugucuuacucaugaacucaucuacaaauguuuacauuuaaguguauaaaucuaaaggaagacauuacauaccgugaagcuggaguuagaggugguugugacccaccugauaugggaaacucaaguccucaccaagagcaguacacacucuuaacugcugagugacuguuaaagaaaaaacaguguauuugcaaggagggcugaggugggucaggcucacuuugaacugcacauauacagcuacugcacuguguagcauuuacagaaacacaguguuuucuggauuuucucuagggggagagaagcaacuaucugcccacuaauucuacuuaauauccucaaggaaaaaggaaaaaaaaaaaaaaccgcaggagucaacuggaaaagaaaaggauauaucaaaaucuucauuuccuagaauugcuuuucaccuucuccuuacagaugucuucaugacccaguucucugcccugcagacagcuagaucuguucgaacaagacgcuuggcagcugcagaggaaaaccuggaaguggcucgggcagcgcgccuagcacagaucuucaaagagaucugugauggcaucaucuccuacagagguacgcaugucacucuuccccaagagcaagaacccacgaacaagcagcaucgugggaggauaaaguuaggagauggacucaacauuugucucuaaauuaauuuuagguuauuguuuguuuuauguguggggaggguuugccugcgacagaagagagaaaaggacaucagauccccugaaacuggauuuauagaugcuugugagcugcccugugugugcuggucuuggaagaccagcuaguucucccaacuguugagucucuucauccccucuucuauuucucuaaaacaauuguguguugggagggaggguguuugucuauguggaugcagugcucauggaggucagaagagggcaccagaucaccuggagccagagugaacaggcuaacauggguaguaggaauugaacucagucuucucuuuuguuuuuuguuuuuguuuuuguucuucgagacaggguuucucuguguagcccuggcuguccuggaacccacucugcagaccaggcuggccucaaacucagaaauccgccuucuucugccuccugagugcugggauuaaagguguacaccaccucauccggccgaacucaaucuucucuuaauucagucaaguuaucuuaacugcucaacuuccugccccucauucuaccugucgacagagauaaagaauuauagagcaaauaaccucuagucuugaacauaucaauuugaguuuaucauuuauaauuaaguaauauauuuuuaaguaacuuuuuagcuaaaggauaguaauuuccauggaugagauaauacuacaguuuuaaaauuacaaguguaguagcauaugccuuucccagcacuaggagaguuguuaugagcaugagccacauaaagaaagguacaggccaguuggaacuacauagugagacccugucuccaaaacaaaacagagcagccagcacuccuaaccguaagcccaugagccaccucucagauaccugcugccucugccuccugagugcuaggguuaauaugcugccacucccggcacauuaaucuuguuaauuguguacaagacauggcacguguaucuucauggaccaugaagggaugaagagaugacuugguaaagucuguuucuucugcuuuuuugugaguucuaagaauagauugccaggcguaccugagaaaauuaaaacagggcauuagaucuccuggaagucgaguuaaugaugauugugaaccgccauaugggugcuggaaauccaaccacaguccucuguaagagcaacaaaugcugcucuuaacagcuaagucaucauuccagccaccauuguagcuauaugugucugcauguugguauauauaccugaguacaggugccuguggacucaaguaauaucaagucuccuaaaacuacuuucuggaggaugugagccaucauacgcagacacauagcucagugauugugagcacuggcugcucuuccagagacucggguucgguucccaacacccacauggcuccucacaacccuugguaaaaccaguucaagaaagaagagcuguagaaaaggcugagcaguuaagcgcacuggcuguucuuccagagaauccacuuccagugcccagugcccacaugcaguuccaggggaucugacaggcucacacagacacgacagugcacagcggguggaaaaacacagggcucuaagaaaugcacaaauauguauucaggcuaaacauccauagauagauagauagauagauagauagauagauagauagauagagauaauuaaaugauaauaaauuuuaauuuuuuagaaaaaaaucauguaaaauaaaauuaaaaaaccuuuccuuuuuauuuuaagauuuuuuuuuuuauuuuauaugcauuaguguuuugcccacauguaugucugugugaggaugucagauccccuggaacuggagcugcagacaguuaaagcuaccaugugggugcuggggauugaacccagauggucuggaacccccugugcucuuagcuguugaaccaucucucuagccccuaccuuuccuuuuacaagacaugucuuuugagcacagucaugaaugaacaagcaacuauaaauuagggcuaaauauuuuagugguauaaguaacuuucugaucagaaaauuagguguguuuaaaaaugaaagauuuuuggguuuacauaauagcucaguggauaauggugcuugccaccaagccugacaacuagaguuugccucuuccugaccaugcaugcaccacugcauucauagguuggcacacauacaugcauacgaaauaaauguuuuguuuuuacuaaauaauaaggacccuggguuugauuucccaacauucacaaagcaguuuacaacugucuguaacuucauuuccagggacucugauguccuccuuuaacuuucagaaacaucaagcacacaugugguacacagauacacauggaggcaaaacaccuagacacauaaaaggaaauaaaauuuuaaaaagagacauaaacuaugaaacugggugaaacauuuuguuauguuuguagcuuuuucaaauuaauuuuuauuuaugugggggguggggguugucuacacuacaugcuugccuggugcuccuguaggcuggaagaggguguguaauguccuggaacuggaggccugguugucugcaggagcugccagugcucauaacuacugagccaucuuuccagccccauaauuguagcuucuuaggauugacuuugguuuaucugucuuacuuauugcccacguuuugagaauuugcuuugguuaguuagauuuugucuacucuucaucuuuuauauuuuguuggcuuuuuguaguuuucuuuuucuuuuuuaaaauuguuuuauuuauuuacauuccuuccuuaaccccaagaauauaauaaggagggagccaagcuggaggcaagccucacuggcaagacccugagcaguccuuacaacaucaaaaaauaaaauggacggagagauggcaaaucuuuaaaaaaaaauguuacuuuagguguaaguuuugucaccccuuugauccccacacuuaggagacagagcagguggacaaaguucaagaguuccaggaaaagcaggcuucacagagaagcccugucucagaaacaacuaacaaugggggggugggguugcccauugugguucuuuagucccagcauuuaggaggcagaggccaguggaccuuuguggguuugaggucagccugcugucaaagcauuccccaggccagccaaggcugcauagugacagggucucagugugucucuggaagguggagcuucccuuucucccacgcccaguuggucugacucacauggagggagcuacucucaggucacugcuuuccgucacugcacaggacaccaucagaaaugagaucgcaaaugagaaaagucccucacugaaugcuauguguaucaacauaacugaaugaaaaaaauuaaauucuagaaaauauuuacuaaauuacuucuuauuuggaauucagucaaauccacaccaacagaaauaucaauuacaaacaauuaugagaggcuguggauguggaaaucuuuuuguuguaaaaagauuuaucaucccagugcacguagguggugcacuuucaugcccaucaaaacaaauaaauauuuaaaauaaagaaaugcuggagagauggcucauugguuaagagcacucacugucuguucuucagaggaaccagguucaauucccaccacccacauagcacugucuguaauuccaguugcaugggaucugcaaccucacacagauaaauaugaaagcaaaacaccaguacauacaaauuaaagaagauuugucacccuauaacaggauuaguacaagaaugagaaacucaaauuucucuuugcuugcauaguccuuuaaagcuagcaggcauaugagcagaagcaagaauguucccuaaauacccuagcuauuucaauaguuacagcucacauucuucaugagaaacuauuuuuauuuacuaucacuguguuauauuuuaaauaugcacuauauccgucauaauccucaauuuuuaaauuauuguuuguuauuggggguuagguuuuugacugucaagccucagaauaguuacuuuuccccacuccaaguuucaguguggaguuuucuaguuuuuuuaguucaaagaccuuuaggaucuagaacaauggcuuaguauuauuaagaguacuguguguuccuauagagaauacagguugaauccccagccuguaugauggcucacagcugccagugauuggcauucaguuaucugguccucucuggucucuagaggcaccaugcacacgugugguacacaaacguacauacagcuaaaacacccauacacauaaaauguuauuuuucaaguacacugugcugcuggggaggugacugaauggugcagaacacuggcugucuuugacaagacucagguucaauucccagcacccacauggcauugcaucacacauguggagcaccgcauauaugugcggacaugaagcuaggcaaacacucauuuacauaaaaauaauuaguaucuccacaaagaaaagagaggguguucauaggcuggagccgcccacugcauguacaggcucucaguucuauccccagcaccccuuuaaaaaaggauuuuuuuuuucuucuuugaaacaguguaagccagccaaacugucaacaucgucagccucuggaguucugggauuacaggcagggaccaucacgguuagccaagaaaaauaaaaguuuaauaaaagaaugcaagcaagcugugcugguagacaguaaguccagguacccuuuucaccaugugcuguagagcagcuaaacuacagagcacacccuccaucucaagugauagcaagagagagagagagggagagagacagacagacagacauugagacugagguucccccuugucuuuuaaacacguguacuaaaccuuguguucuucugcagauucuucccagcaaacccuugcagcuccacuuuugaaucuucccccaaagaaaaaguacguguacuuuucugacagccuuguagagcucagaaaagaagccagugcaccaacuaacggcuugcucuguguuccagaaaugcugacuauuaugagaagaucucugacccccuggaucucagcaccauagagaagcagauccucauuggguauuacaaaacaguggaggcuuucgaugcugacaugcuuaaggucuuucggaaugcugagguauuuacucacuuaauauacaaauguaagaaaucugcucggaugagauuuauuuuaucuacucuugggaaaggcaguaauuuucuuuucauuacuacauuuguuuauuugguuuaauuguguacguuguguaguguugaguuuagcuacaccacuuugugcucccagcgggucacacucccagccaccugccagagcccucuggauucgagaaugaaacacacacacgcacacacacacacaaccacacaucaauuaaauuugacuuacugugacuaccucaaaugcugggcacucuuaaaccuucggccagcaaaugcaaaugcuccccuccgguauuucugagacuccugaaccuuccccugcuaccuuaggcccagucacagaaguggccagugacuacuuaccagaauucucacauggcugguuggcuccugcagcuccuccuucucccccagucauagcaauugaccuuccucacuucuaguuccuaggccacacaaauccaaagguccugccucagucuaccugcccaaccauuggccauuggcucuuuauugauugaugauaaaccaauuggagacaaggaccuuugguguuuagacacacagauucccgauuuugggggcuggauuaauucaaagcuaaauuagagcacauccguagcaauguuguauguauauauauauauauacaugucauaacaugcaugugaaggccuaaguucuguccuccuggcuuaugggucccuagggucaaagucagguugucagaauuagcagcaaguaccuuuacuuggugagccaucucaucagccugacaguaauuuuauuuuuucuaucaguguauauaaucaaaaauauucuggggggaaaaaaagucaggcauggugguacacgccuuuaaucucagcacuugggaggcagagacaggcgaauuucugaguuugaggccagccuggucuacagagugaguuccaggacagccagagcuacacagagaaacccuaucucaaaaaaccaaaaauaaauaaauaaauaaauaaauaaauaaauaaaauuauucugaccaaguauagugguauauaucuuuaauuucagcacuugggagacagauguagauaggaugaguucaaaggcagccuggucuacauagaguuccuuccauugaacccaucuuggacgaguggcaggugguuucucgguuagcaagauagcucuucagguaaaaguucuuacuaugcaauucuagcaaccugaauuuauucccagagcucacaguguaauaauguuggaagaggggauuuuacucugcuaggucauuaucugaccucuguaugcaugccauggcauguauaugcccacauggcaauaauaauuuuuuaaucaaaaauucguucagucaguaaaaguacucaguauuguacaagcaugaugacguaaguuaucucaaaacauguaugaaauuaccagguaaggccggauguagagucacacaucuuuaaucucaguccaugcaccagcacaaaacauucugcaguggaugauugagucauuucucagaaacaguauaaucuuuguaaaccccuaauuuugcccugaacuuuuauauuauguaaauauuuuaccaauguauugugugucuggcauugcuuuguucaugaaaauaaguauauaugaagccaagcuuagugagucauuccugaaaucacuuaagccugaagcaagaagguaaggucaaguuuuagcccauaccagacuguauaagaagacccugccuccaaaaacaagccuagaguauuacuguguaguaaccaggaaaggaaaugcucugguguaaagagaggcugaaagacagaauaagaaagggucuuaaagagguaagagauuacugaguggcgaucuugaauuacagcauaguuucuguuaacccagcucccacagacauuuacuaugugcuccaagcauuugcaagacaaagguaaauggaaaauuucuacaacacauuaugcuugcaacauuaauuaaaauuuaaugaucacuguguauuugaucuuaugggauaguaaggcucuugacagaauaucaauaacaaagcaauagagaaaaacgaaacauauaaauucuaauuuuaauucauuauaguucaauuuguuagccaaaauggaauaauaaagaaaaucaugcugccucugcagguuuauuuuuaaaccaaaaggagaaaagcaaaaaugauuucuuuuguuuucuucagaaguacuaugggcguaaauccccaauugggagagauguuugccgcuuacgaaaggccuauuacagcgcccggcaugaagcuucggcucagaucgaugagauugugggagaaacggccagugaggccgacagcagcgagaccucagucuccgagaaggagagcgggcacgagaaggaugaugauguuauccgcugcaucugcggccucuauaaagaugaaggccucaugauccagugugacaagugcauggugagugccagggcgcggcgcaggggcuuaggccagcgucuguuuguccucuacuguucaccauacugccuuccuccuccuuuaucuuccauuugcaacaacuuccuuuccucuuccuucugcccacuuuaacuacguuucucacaaaagcugcacauagaaggguagcauuugaccuugugcuuucccuugaagucaugaaguggcacacgguguaacgcauggaagcaggcagguucagugcauauaaguuuguccacagagggcuccuacugcaagacucggccugaacucaguguguaguguccuccauuccuguacgcuuguuguuugguaugauaauggagcugugaacaguaugucugguuauugagaggauaacgccaaguaaacccaagaggcaaucuuuacgggaauaaagacagucccaguggcugcagcauaaauaguguuacaucacaagugauaauuuaguaguauauucaucuucauuuuuccuccucaccucccauuuuguuuguccagaucuauauauuaaaauugauuuuuauaauuauauucaaacauuguguuuuccucuuauuuuucucauuuauuucuaauucagucauaaccuucugguauaauuccucuuuuaccuugcccugucugcugcuuuauugauaucaccaguauuauuaguucucaggacuugucuaaguguaagugccuugucaagugugccugucucauagguguggcagcacugcgacugcaugggugugaacacggauguggagcacuaccuuugugagcagugugacccucggccuguggacaggguaagcugaaccauaguuaagaaauaaaauacuucagauccaugaaagaaauaguacuguauagagccaggcaguaguggcacauaccuuaaucucagcacucugaagacaggcaggcugaucccugaggugaaggcuagccuggucuucagagcuaguuccaagauagcagggccuacuacacagagaaaccaucuggaggguggagggguagaagguggaggugguuacuauauaaaauugagauucauuuuguuuuauucuauuuuugaaguagaagcucacaguguagcccagacuagcuccaaauucaccaucuucuuuccuuaaccucucagugguagagauagaguucuaagugccauuucuaucagguaguguuuuguugaaaacaacccuugugggcuagagagauggcucagcgguuaagagcacugacugcucuuccaaagguccugaguucaaaucccagcaucuacaugguggcucacaacuaucuuuaaugagaucugacacccucuucuaguguaucugaagacagcuacaguguacuuacauauaauaaauaaauaaaucuuugaaaggaaggaagaagagaaaagaaaaagaaaagaaaaaacaacaaccuuugcccucagucuuacuuacugaaguaagagucagugacuugaccaaguuggguggguucuuagcgagguccugcuguauuuguguauaugaucuuaggcugcuagauuggcucugugguuaaaagcucuugcuacuaagccucucaacuugaguccaaucccagauccacaagguagaaagagagaacugcuauuguccucugacuccacgcgugugccaugccaagcaagugcccucacacacaugcauguacagaaacaguaaguguguauguaugaucuugauuaagucacccccauaacauaaaggauuuaggcaacauuucuuuuuuuuguuuugguggggggagguuuuguuuguuuuugggggguuuuuuuguuuguuuguucauuuuguuuuguuuucuuuuuugguuuuuuuuuuuuuugguuuuuuuuuguuguuguuguuuuuucaaaacaggguuucucuguguggcccuggcuauucuggaacuuacucuguagaccaggcuggccucaaacucagaaaucugccugccucugccucccgagugcugggauuaaaggugugcgccaccaguacccauccuuuuuuugguuuuucgagacaggguuucucuguguagcccuggcuguccugaagcacacucuguagaccaggcuggccucaaacucagaaaccugucuuaggcagcauuucuuaaccauagugauguugucauauuacacuggaaaauuuacugugagggaugcacuuuagaguuuggcuucccuggccuugaacaguacacaccuguuccaggugggcuccagacaaaacugucaugagaaguccccauugcacacauuuucagaugcugcugagauuucacaacagucucagaacuaaugcaucauagagcaucgucucagacacuggacuugucagccuugucaucuacuuuaauuucucugcauuuaaagacuagagguuuccaucuuuuuuauacauguaugguauaaaaaaugacuuuuuaaaguauuggaucggaaauuuuaauucuuuuccucucuuggauugagaucauuaggccaaauguaauacuuuccccauugacuuucugcucuuaucaggagguacccaugaucccuaggccccacuaugcccagcccggcugugucuacuucaucuguuuacuccgagaugacuugcugcuucgucaggguaaggaaaagggcucaaacuccucccgcaucccguccccccacccccccccauuucgugugcgugcuugugugugugugugugcgcgcgcgcgcgcgugcgugugugcacuuugcaugcuuaggauugccugccugggcuuguggaaggaucuguuguuuacuucggcaagggaagguuacuguaggcuauaacccugagcacaugacucuaccccacuucuagcaaccauugucaguagcucuucaguaaugguugggccuuaugagucccuuccuuugauuugauagcuuucguuugggaggagggagaagguguuauuguuguugguuguaucuuguuauuacuggguuuugguauuucagacuuuagcucaggccaggccucaaacucccagguguccuccugccccaaccucccaaguucuggaaugagaggcaucagcuccucugccugacuuacacuaguuuccuguuacuuacuuucuguuugcugggaugcugauugauccaaagcuucaaguauguaggucgaguaaccuagaacugagcuguacccaaaguccuuauaguagcguuaaaccuaguuggccagguauaguggcacaauaucauuaaucccaucuggaggcagagaaggguagaucucugaauuugagguuagccuggucuacuuagugaguuccaggccagccauagcuacauaguaagaccugucucaaaggcaagauaaaaaauauauauauacugauaaaccuaguuaaaagacacagaaaguacaaaaaaauaaagagaucaucuauaauucucaguguagaauuaaaaauaguuguccuuugaucccagcacuuaggaggcagaggcaggcggaucucugaguuagaggccagccagggcuacacacagaaacccugucuugaaaaaccaaaaaagaagaaagaaaauaguugucacaaugcuggcuuuauuuucucuugauuucuuuuguaauacuagauagagauugaaccuagguucuugcucauuuaauugcugaacugucugccuacccuccucguaucgauuuagauccuggauuggauagaaggauuccuuauggaauccauccagaggucagcauugauguucuccuuuguuucgugccuuucuaggugauuguguguaccugaugagggacagucggcgcacgccugauggccacccaguccgucaguccuacagacucuuaucucacauuaaccgagauaaacuugacaucuuuagaaucgagaagcucuggaagaaugaaaaguaagugcugguuccucuccucccuccagcagagcgugcacugagguagaguugcugguagacuuaagaaccuugccuuucucauuaucccuauuuuuuuuuuaaagagaagaacgguuugccuuuggucaccauuauuuccgcccacaugagacucaucacucuccaucccgucgguucuaucacaacgagcuguuccgggugccccucuaugagaucauucccuuggaggccguaguugggaccugcuguguguuggaccuuuauacauacuguaaagguaaauaaaugauggaggcuuguuaggagguaacuuugccacuggagaacuggagagacggcucaacauuuaagagcauuaaucuugcagaggacccaaguucaguuuccagcacccacauggcagcucagaaccauuuauaacuccaguuguagggaauccaaaccuuacugcuggcuucaccuggguaccaggcauauacaugguacacuuacauauauguagacaaaacaucauagacauuaaaaaagauaaaucuaaaaguacugaaaaggauucucuuaauacuaacacuagcuaugagacaucagaaagaaccagucuucuuuuggauuuucaagauagaauuucucucuauagcccuggcuauagaccaggcuggucuuaauucugccucagccucccagaugcuaggauuaaagggugugucaccaucccugcccccucuugaguuuuguuuguuuguuuguuuguuuguuuguuugaauaaaccacgguauauuuacuuauuuauucauuuugaaacaggaucuuacugugcuaaccuggccuggaauugacuauguagacuagacugaccuugaacuccagagucagaucuagcuaccgcugacucuguaauacugagauuaagguuucugugcaccaccauagacaacuaauaaaggcauuuuaguguguaaacacaggcuuagugucccuuuuacaguacuuauguagucacagcaucaccgccaccuuuucucuucauguaagcuuaagggcuugaacucaggucagcaggccaacacucaggcccagaauuuuaaaauccaaguccaucucaugucacuaccuaaauacuugaccaagccuaaccaagccuaaguuuccuuaauuugaaaccagguuuuucucaguuuuacaaagaucaaauaaucuacagaagcucuaauuuauagcuagcuugauguguguuuguugccaugguuagccagaguuuagcuauauguaucuuuauuucaguaucauagcaaaaaacuuuauuacaguaauaaauauucuguuccauacugacaaacugcuugcaccucuccaauuuaaaaggaagucuccacuuugccgugugcugccucguccuuaggaugcucugugucaugccauccccauuaaccauucugucccucaggguuugcucaaaaaccccugccacauucaaucuaguuucugggcucuuuacagccuguuacugcuuugcacagcuaugcuccaacuccuuuggguaccaauacuuuaaacucuacugucuucuuuacaaccacagaaugcuaaucacuacagugucuccuccuaauggcucugucauuucucucugagauagaucuuauccacuggguugauuuuggaaacaaaggaaaauccaauuacuuauccuuguuucagaucuuuuuuuuuuuuuuuuuuuuugagacagggcuucucuauauagaccaggccucuuugaccuugaacucaaagaucuuccugccuccuaaaauuaaagauaugcaccaccacucuugggccugggucuauuuuaucuuuaauaauguggcuaaguguagguauuuaugugcgaauacugguguguuugggagccaaagugggagggugucauauccccugcagcuggacuuacagacaacuacgaguccucucaccuggguacugggaaccaaacucugguccucuguaagagcagcauguacucuuagcagcugagccauuucucauuucugagccugggaaaucaguuucuguaacaguguuugaauuuacagggagacccaaaggaauaaaggaacaagauguguauaucugugauuaucggcuugacaagucagcacaccuuuuuuacaagauucaucggaaucgauauccggucugcaccaaacccuaugccuuugaucauuuccccaagaagcucacucccaaaagagacuucucaguaaguuaccuuuggucuucuucugaggcagggcaccaccacuugguucagcugaucaugaauucucaguucacuugcugaaugccccugagugcuggaauuacuugcauaaugcuugaggccuugcuaucuuuuccuuuuuuuaaaaaauaguauguauaguguguguacauguguauaagcucaaguaagaaagccagaggagacuggcuugucuguucugcucuccaccauuaagcccuugagacagggucucucacuauaccugaugcugauagccagcaaacuccaguaacccuacacccagcacugggccauacccugcuuuguuaugugaguacuggugauuugaacccugguccucuggcuuguaugaugaauauucuaucugcggaguauucuccuuguaccucuacacuuuccuuuccgcauauucauaaugguaagaagccuguagaagccaguguagcagugcacuuggaaugcagaggcagguggcucucuaugaucugaaguccagccuggucuacauagcaaguucuagaccaguuagggcuagacacagugagaccuugucucaauaaauguugucaagaauagucacuuuaaaaguaaucucuuuaugcuucugaaacaaggucuuacucuagugcaggcuugccucacagccaccauguaaccuaggcuuaccuugaacuccaagcaaucuuaacucauaaaaacuccuugauguuuuguuuuucuuaacgucuaaaucaaaaauacaagacauggcugggugcgaagacagacaccauuaaucccagccuuccugcagaugcaaaagcaggugauuuugaagccagcauggccuuuauggcaaguuaggccagcuggaggcuacauagugccuuaaacaggccaugcauaagacaugggaguagacuaaauggcucaguggauaaaggcaguugccucagagaaugaagaccugaguuugaucccaaagcccacauaguaagagagaacccuucacacguuaccuguggugcuuguacacccaaacauaaugggauggauggauggauggaugaaugaauuuaaauguaagauaagaucauuaaaugaaucugaaaaguagcuucuugguagaacccuugcucauguuuacauuucucauucucaccuccucccugaguauuuuuuuucuaguugcugagaaugcagaccaaugacuuucauucauugcuauauaggauuuuggucauuaucauuucugucuuguaaugaaacuccaacugacaggcuccucauccucguuuguccuuuuaaagugagaguguuuuagucagcucucuauugcuauggcagauuuccugagauaaucugcuuaaaacauuauuuugccuuacagagguucuaucccaugguuccuguaacuguuaugagcccauaacagcauaaaacauuuugguagguguaugagacagaaaaagugauuugauuccuggugguaaaaaaggaaaaagagggggcuggugagauggcucaguagcuaagaacacugacuacucuccugaagguccugaguucaaauccuagcaaccacauaguggcucacagccaccuguaauaagaucugacucccucuucucgugcgucugaagacagcuacuguguacuuauguauaauaauaaauaaaucuuuggacuggagugagcagggacugagcagggccaacuagagcaagcagggccaaguagaacgaccagagguccuaaaaacucaauucccaauaaccacaugaaggcugaaaucaucuguacagcuauaguguacucauauacauaaaauaaauaaauaaauuuuaaaagaaaaagaaaaaaagcaaagcaaaaaaggaaggugucagcaucccuagauagauagauagauagauagauagauagauagauagauagauagauagauagauagauagauaggcaggcaggcaggcaggcaggcaggcaggcaggcaggcaggcagauaggcaggccgcccaaauugccuuccuuacucuagugaccccagaucaaauccaacauuaaugugucuaccucccucuccccgaccccuuguuuuucugcagccucauuaugucccagacaacuacaagaggaacggaggacggugagucuuagaagaauguaaggguuuuaagggguuagccaggagcuaauauagaacaagaaagccaguagcuccucauugugucuacuacuggcauuggcuauucuguguaggguagcucaguguaaugcugucacuaaagugggagagaugcaguaccauuacaaauccuuagggagacuagggggaugcaaagauaagagaaagagaacaagguuagcaacagagcugcagauggacucagaauauaucuuuaugaacugagcuuucucuauaaaaugaugaugcaucuguuaaaagagauacagucagcugggcagugguggugcacaccuuuaaucccagcacuugggaggcagaggauuucugaguucgaggacagccagagcuauacacagaaaccaugccuugaaaaaaaaagagagagugagagacagcauugcacuguucacauuuacagucuuugcuucuuuuguaaaugaaaaggauguuccuuaugaaggcuuuucuguugucucucaguuaagagcguaaauagccacugcugggacuguaggaaugacucaguggcuaagagccuuugccguccuuauagaggacaugaauucuguccccuguacccauccaugcccauuuguacauggccaccuguaaaucucgcuccaggggauccaacaccuugugcccuccgugggcaccuacacucacggacauacacaugugcaugcacacauucacacaggugugacaagugauguaagcacaguagaccucuauucagagguuacuguagucagacugcagguaucacaagcuguguccuucguguuccuaaagcaaucaaagggaacuaagcagcuuuaccaggccaggaguguuuuauggaauuuuaucucauuuuugcuucagauuucugagaccaagaagaaagguuuaauuuuuaaaauggaaauuaaauuaacuucuaagugguagaauacuagcaugcacaaacgaacauaaaaagaaaaaauuaaaucucagagaaaaguuugcaaagauaggagaaagauuuggguucuagugcuaacauucagauuuuguaacucaagccaggcucuaaacagcagauuccaggcucucaggacauccuuaggcuccucggugucacuuucccacccuccaagugccuuguuuggccuugcccugaauucacgaauccuuuuggcagaucauccuggaagucugaacgcucaaagccaccccuaaaagaccuaggacaagaagaugaugcuuugcccuugauugaagagguacuggcuagucaggagcaagcagccagggaagugcccagcccugaggagccagaccaggaaagagccacuggggacauuggggacgcugaaaagaaaccagaggagagcagucaagaagcccaguuagccagcacaccugaggagcgaaggcacagccagagggaacggcucaaccagauccugcucaaccuccuugagaaaauaccugggaaaaaugguaagacucgggcucauaauuaggcuagaaaauaaaugagaaguaaauaaaaaagagguaaaaaagcaacugugugugugugucuauguguaugugucugagcgugugugucuaugugugugugucugagaguauguguuguacuggaaaauaaaccuaguaccuuagaugggauagagaauacguuauaccucugaguuguuuuugguuuucuuuuaacuuuauuauuauauauaaguagacuauagcugucuucagagacaucagaagagggcgucagaucucauuauggaugguugugagccaccaugugguugcuaggauuugaacucuggaccuucagaagagcagucagugcucuuaaccgcagagccaucuugccagccccaaaccacugaguuuuguccagauuuagaacaaagucuacuuauuaugccagcaugaaacauguucuaagaaaaugguuucauucuuucauaaacuuagcucagucaugucuuuggagugaugcuaagaucagauggugucuuucaaacccuagagaaccauuuuucuuuucuuuuugagagccagggcacacuucaaaacaaacccuuagggcucggagcagaccuaaugcucuagagcaugaauccugaguucucuuagagugcacauccagagugugcuacagaagagugacaucugaugugcugucuugguucugauuucagccauugacgugaccuaccugcuggaggaaggguccggcaggaaacugcgaaggcgcacuuuguuuauaccagaaaauagcuuucggaagugacucucaaaaggaugagaaccgcgagcgagcaccugggauccaacggcaccaucaaguccagccucuugcucucuggacauggacuggggcagaaaaguucuguucaggcaagggggguggggucacguuucugacaugguacuuucuaaagcucggagcuaguggaaagggaaaggaaguaggcuugucugagacgggugcguuuacuucucucucuggcuucuccugaggguuaacagagacaggaggaccacacuuggaguagccagaagcuacugguacuuuccagcacuuccaaagggaaggguccggacccagccugccccguuuaucucuuagcucuaagagcuacgucagagaccuaaacagguacaguagcugaggccucuuuuaaguuccuuuaacgggaaaguucuuucucccuucuugcccaaccaggucaaaguacuagaacaugaaucagcugcucagagcacuuagaacugcugccacucucccuaccucuguucccagaguagagucaguagaaccagggaggcggagaggcccccaugggguccgaagggcaguauugguaauuauuuuugguuuacccuucauaaccugccgaacauacuuuuuccuccugagaaagcccagcccccgccagcacacaugcugcuucucuuccugugugucugcugugcaaaagauucacguccaagaaagaaaaacgguuuguaaaacugcauaaacccucuacacuucuccccuaacaaaacucacuacagaacuguugagcaguguucacucucggaguguuuguucuaaguguagguuaccgacugaaacacuacucuuauuuucuuaacuguauaguuccgguguccgucccucccacgagucccauuuuccuuccaccuuucugaaugacuucaucaucaggagguauagccagggucaccuucucacccagucucuugaccagaaguuaccagaccauacugucucuuuacaaguaaaauucaaaaagcuuugcuuugucuucucagacauacauaugcauauacauuuuagauguucuuauaagagaaaagaugguuuuuaaaugugccaaguuauguguguguauaaauauauauaugugugugugugcguguauauauauauauguguguguguguauguguauauauauaugugugugugggugcgagugugcgaguauguguaugugggggugggugcgcguguguguguguguguguaugcugugagauugguaagcaauacauuaguaaacacaucuucauuacucuuuuccaauacuggaccaaugauguccuaacuguacauuuccuuccccuuaugaugacgacgcucugacucauuuagguagagacauuugaccaccuucauuccauugauuuuuuuuuucuccuuucuguguuauucuuaagggaaaagagagagagagaaagaggggauggcauagauccccuugagcagagaaaaagcaaaauauuuuauuaaagaaaaaaagaaauuaagaaaauaguuuggaguauuuucuuacuguagagaagcauuguacauuaccacgagaccuggguaugagaugcucgcgcguggcgcuggggagcgcauggccaagcccacuggagugguuucuuuuguuucucauugcagggagggggaggggggaggacuaagggcacuuugggggucuccuuuuagucaaaagcaagaaaaugacaagaaagagauuaaauucaauguuuuccuuuaauaguguuaaacacuaaaauuuuaaaauaagaaagaaaaaacuuuguaaaauguaagaacagaagcaaaagacacuacgcugucauuuuuaucuuucuuuuguugaaagauuaaaaacugaaauguuuuuuagacaaucaaauguuagguaagugcaaaaaacuuguuuuucuuacugguguagaaauuaaugccuuuuuuauuuuucaguuauuuuauaauaacaaaauaaaaacaacccccagcugccagguggguuuugguguucgaaaugcggggcaaagcacuacaucacugcaaauagauacagaguuagucugcaugucuguaggcugugugauugcggaaaauauaaaugcugcuaauauauuuccuuuuuacagaaaagcauaucuaaauagaugauuguuuugauguuaaucuuuguaaauuauguauuaccaauuuuaacauuggauguaauugcauaaaggcuugcaucucaauccuugaaagucuagcauuaaauggaaacaacuuuuccuaac

SEQ ID NO: 1497 - RNA, 8437 nt, Mus musculus
cguggcaugccgggagucguaguuuuauauuuauguucugccuccugagccuggagacugggaacuacaacucccagagugcugagcggaugcacgcucagcuuuuagguguaagccgcaaacaucuuggaccccgggagaauccgcguugaagaacaggugagagcuauuguuggggcuggagcugagguuuacccgugucucggaucgggugaagcuccgaggcacuaaaggaccaguccguguuggaguuacggggcuuggggucggugggccagaaugaacgguuugcuugugccuucgugaauuucuaaacgcuggcgucuuccucaagucuuccguacgccaggccuuuaguuuacucuugugaguccucccacgcccaccuguugcucggaggccggcugcgguuagcaccagugccgggacagaugacaagcgcacagcaccuucggcuccaguccccucauugggacuaucuaagagcuucccucucuuuccccuacauccggacuccuggguuccagcuuuggcucuucgucagcucagcucucuuacauucacugaaccucaguucggugucuccauuaacauugugacuuaaggaccuugcaucccguaauucccguaauacaauguuccgaauuguagugaacgcaaccuuggaaguagaaaguguucaguuuuagccauuuucgguuuaagugaagaucuauuggaucucagucacuccgacaaacuuuucauuuccuguguguuuuuuauguaauucuugaguuuagaagcgggguggggcguucuaaugcaggagguaacaagcuuggcuugggggauaccuuagguaacugcuaccaagcaucugccuucggugcuugcuccugcagggagugcuuggugcccccacccccaugcacacccaggaugccccuguccugcuggcugagaucucugggggucuuccugcugccagcccccugcugggcaccccgggagagguggcuugguuuccuacaacgacccucccuggcauauggguguccaguccugggggccuggcacagugcccgcugguggugccaaguguggacagaggagccucggugagugugguugggguguggggcuucggggagggaagcacccgagccacccucucauuuguuuguguguguguuuuuuuuucccucagagcauuuagcuccucugucagaaugaaugggaaccagaaauuggaugcuuauaaccaagaaaagcagaauuucauccagcacuucucccagaucgucaaggugcugacugagaaggagcugggacacccagagauaggggaugcuauugcccggcucaaggaggugaggcauucaggacugaagaagcugguagagguguggauucaugagggguuucgauaagagcgaagugacuaccugggucucuggaguagaugggucucugcugcacuucagcccuccucggggauguuuggcuccaugacuuuugaccauccagagagccuugcuugagaguagccuuggaccuaguaaaguuugauuucaugcccugaaacuaugauaggaucuuaguagauaccaugaggcuguuggcacugaggccugagggaaguuauuguauuguuagaaagacuguucuacuggaguuaccuauuuccuuccaguguuuauuuucuuaagacagaguuucauguuuuuuaagcccacauggccucagacacacaaaccccaccucagccuucugugugcuaugucagugacaguaccaccgugccuggauugggaagucuuuuaaagacagacauuuuuauuuucacuuuuuggacauuugacgauuugccugcguguauguaugugugaggaugguugugagcugccaugugaaugcugggacucaaacccagguccucccgaggggcagugcuuuucauugcugagccaucucuguagccuggggaguucuuacuuuauaaauguugucucaucucugaggaaaaaaaacuaagaggagaguuuucuuugucuaugcugugucgguauuaaagagcuagcuccuuaguuaguuagcaggaagcacaguugagaaggccccaggaggaggacauuggaggggucagaaauagcccugaaccuugcugucccuucaaagccuucuuuugccuaacuuuggagaagccucguuuuuucuuuuguuuguuuuccguagccaggguuggcuagaaccuauuauguaucugaggcuagccucagacucaugcagucugccugccugcuuccaucuucugaguacugagaugauaggugucagucaucccuccacaccagggcccuugucuucaacacaggcuuguuggcaggugucccaguccuccacuugggggaagucuuggguguauguuauauagcagguacuugggugccacagcccauaggauguuggagagggaaugaagaggggagugauccaggggcucuccaagggggaguugggguucaaagagggagaagggaaaaaaaucucuucaggucccugcuguguggacccugaugucuucucauccugccucagguccuagaguacaaugccuuaggaggcaaguacaaccgggguuugaccgugguacaagccuuccaggagcugguggagccgaagaaacaggaugcugagagucuucagcgggcccugacagugggcugguguguagaacugguaagagcgggccagaggagcagaggguccugcaguuggguuccuugaugaggagacuaagcuuauuucuugcuuguguugguguuucugugucucuugugugcuguagucacauuuaggcagugugaaucacuucagggacugacaggugggcacagagaauuuucagaaauauuaaccuuaaaucucaccagaugguggugguggcggcccacgccuuuggucucaucacugggagcagagggaaguggaucuuuuugaguucuaggcuagccugauuuacagaguagguucuaggacagccagagcuacucaagaaacuuuuguuucaaauaacagaaaccuuaaacuuccuaaacuuaaaaaaaaaaaaaaaaaaaaaagaaaaggaaagaaguaguuuuaccagcuuggccgguaagcgcauuagcuaucggagcagaagagccaaauugggaugccagggccgugugacaauccagcuguggcagugaacacaaucugcaugguagguagaggcaggaggcuggcugggcugccuggcucagugagagccuguuugaagggaacgcauugcugugacaggcgagacaccugcaucuuccuuaggcuucugcucccugggcucaugcuuacacugauaagcacacaucugugugguagcugggacacguguguaauacauacggccaccuagugcugggcacggagacaggcagguccccagagcuugcuggcaagcuagguuagccagucagucagugccaggcucaggcucagugaaagaagguuugucuccaaaaaaggagguggagaguguggaggacaccugacucauguaugugcucaguccagacacccgugugaacacgugugacacagacacaugcacacaggacucagagcagcggcucugucagugccaggcagacaguaacacuuguguucaguuguguucaguuccucaauauccauauaacagcugugugcaucuguaauacccuuccugggguggggagagauacaggucccuggagcacaauuguuggccagucugaugcaguuucagugauagacccugucucaaaaggauaagguagaaaggcuggagagaugggucaguaguuaaaaggcaccgggguucaauggcuaguacccauaugaugccucacaaccguguguaacuucagaccgagggaaucugauacccucccugcccucggcggccaccaggcaugcacaugauucgcagacacuugcagaccaacaccagugcguauagaagagugcucgguuugguagcaugugaacugaaauuggaacaaugcagaaaagauuagcauggccccuuugcaaggaugacaagagaugaaauguucauucucuuuuuuuccuuucuagcuuuucauuucuaucaaaugugugaaaauacauaaagauugguaccaaaaauaugauauacaaaauuuacaaaaugagaaagacaucucagagaaccccacccccaccccaaaugaggaaggcauccaauguugaccucugaccuccacaugaaugcaucuguaacacaugugcacacaacacacacauacaaacaucuuugacauguucacuuacagaaaugauuuuccggagccaagugaaagcugcuucccuaagauaguggaugugcccccaccccauggcucuaacuuguuucagaccuggcucuugaaugacugugacuuuuuuuuuuucuggguaggugagggguuuccaaaguuuucaugaagcucagggucuugucuauuauaaacacucucuuaucccuuaacuacaucgcugcccuuugguuuugguuuuugguuuuucaagauaggguuucucuguauagcccuggcuguccuggaacuuacuuuguugaccaggcuggccucgaacucagaaccaccugccucugccuuccaagugcugggauuagaggugagcuccaucagugccuggcuguuuuguuuucgagacagauuuucacuguguacagcucauacauacucaagaucaccuugcuucagccuuccgagugcugggauuauaggugugugccaucacacauacugacuuacaguuugugguguuuggaugauguaaugauagacuucuguugagaaucauagggaugacagggugagucaauaaaaguucuggagcccugaguuugaucccuagcgcccauguacgaagaugcauacugacucccaaaagucacccucugaacucacugcaugcuguggcaugcgagcauccacaccgaggcacaccucccucaccccugaucaguggagggcugguacuguucuaguggguaaagugaguucuaucccagaacccagggaaagacggaaacggcaaaacaacuccuagaaguuguccucugacuuccacuugugugcugugguguguacauacaauaauagaagcccuugcacacaauaauaauagaaguuuguuaaaagagaaaaaagugcuuaauuuuguuguggaggucaaaagccuucccuacuguaugugaagccccgagucccauccucagcaccuuuaacacaguaaagccaggucguucaguuaaagcacuugcugugugacaaauguguagccugacuggagcgggaggugguucaguguucaggaggugggcugaggacccugagguugaggccagccuggccuuuauagugagguugucucaaggaaacaacccagaagugucauggguguugucuuccaucuccuuaacggcgagcucuugggaggcaccacucugaggucagggcuaggcucuggggauaucaagugaguccuuugcugagaugaagagcauuugccggcaggcaaaguggcucaguugguagcauggagucuuggggucauugcccagcuguguacagaagcaggcacugcagcagacagcugugaucucagcaccugggucguagagguaagggcagaagugcagguccuuggccauguaaggagcuaggcucucuccaaagggaaaagccauuuagccaggggggugcuccuggaagugugaccgucagcccaucacugcggggagucaggguggcaguuagugcagaugccaugcaugccggaugauggugacugguuuguucccauagcuugcugagucugcucccucauacaccccagcacugcccgcccagaggugggcagcacucacugggaaaaugccucacagucuugcccaugccaaucuggugugcgcauuuuuuaaguugagagucccucuuuccaaauagcuguagcuugugucaaguugaccuuaaacucaccaacacagucacuuacugggguagaaauucacugaugcuuuggagaagagggagccacaugaaguuguuuuacacucuccugcuaccggggacucuagagccuguuagaggugccagagguguguuuuaguucauuagccugaaaaaaaaaggaugccuacgugguaucgagaggaggucuccacagccaacccuucuacccaguguacagcaguguucagagcagcagcugucucugagagagagcuccuccuagagcccuucagucuuacccuguuccucuccuagcuccaggcuuucuuccuugugucagaugacaucauggacucuucccucacucgccggggacagaucugcugguaucagaagguaaggcacgcaggaaaguagcaaugggugugguagacaggccauaggagaggugguuggggugucugcugugaugguuugaaucuggccagcaguaacuuguuucacacuguuccuaacagccaggcauaggcuuggaugccaucaacgacgcucugcuucuggaagccuccaucuaucguuugcugaaguucuacugcagggagcagcccuacuaccugaaccugcuggagcucuuucugcaggugcauugcaguggggcuggggacccacaccugucuccuguagcucuagccucuguggcacgugcucugcugugcuagacugggaagugugcaauggcaagugaagaaggcugucaugugauugugagcaugcacggagcugcucucuucccuccugccugccugccuaguugucagcugcuugggaugcaagcauuuccuggucccggagaaagccuggcucagagcccguguguuauuuucuucccuagaguuccuaucagacagagaucgggcagacucuagaccucaugacagcaccccagggccauguggaucuugguagauacacugaaaagaggugaggccacuagcaaucauguguagacagagacuaaagaugggcuguguccccaugaaugcaucuucuccccugacucagguacaaaucgauugucaaguacaagacggcuuucuacucuuucuaccugccuauugcggccgccauguacauggugaguugguggcacuuccacuguuuucuuucggggacgcugggacaggagggcauuuacugugugacggugugaccucgggcaagcccucugucccucugauacuggaaagugggcagaguugaggccuguggaugguacaucuggcggggggcggagggggggcggcagagcgaaauugaggcugaggcaggagacuagguguggaggugguuuaugggucaggucuucguuucauuuuguaagaaguugaaguugaaaguggaaccguaauggcugcagcucccaggggaagauguguggucaugcugccuacccugucuccuacaggcaggcauugauggggagaaggaacacgccaaugcccugaagauccugauggagaugggcgaguucuuccagguccagguaggcagguccugcagcccagagugcauauuuucucuuucccggccuggggaccuccucaucucuccuuuaugccugcugccuaggacgacuaccuugaucucuuuggagaccccagugugacgggaaaggucggcacugacauccaggacaacaaaugcagcuggcuggugguucagugucugcuacgagccucuccucaacagcgccagaucuuagaggugcucgaguggggccugggaguggcaugucccuuugcuaaggggauggaggaggggugguuaggaaagcagggugauuuugcuguccaggagacauugggcaacuaagugcaguuugauguuugugcugaagguggcuagcaggcagaaccgggaagguuuuggauagugccagacaacgcaugcugcccaauaacucagccgugucaaggcugggaaacccuagaggaaguagaauccagagccaauaccugaacuuugggcucgggaggcaaugcuugguaucuuggauccccagagaggagaguuuugccagugucuggagugaaugaaugaguugugagggccuuuggacccagccaaguaaagcuguuuucgugcuuccaggagaauuaugggcagaaggacccagaaaaaguggcucgggugaaagcacuguaugaggcgcuggaucugcagucugcuuucuucaaguaugaggaagacaguuacaaccgccucaagagucucauagagcagugcucugcgccccugcccccauccaucuucauggaacuugcaaacaagaucuacaaacggagaaagugaccccggaauuggagaggcugggagggagggggucucaauaaauuauuguucaacauccu

SEQ ID NO: 1498 - RNA, 388 nt, Mus musculus
gauggcgucgcucaagccauugaaggagaagaagcucauggaggucaaacuuggagugcugccaagcuggauauugaugagggauuucaccaccaauggcauugcaggagccuuucagagaggggauguccugucuuacaacaaggacaucaauguucagaaaggcggcaucucauggugcuggcugccuacgugguuuucagcuacuacauuucuuacaaggaacucaaacaugagcggcgacacaaguaccacugaagaggggucgcuagagggcauugcauggccaaguguaacugccugccccacucugaccuaggaagaauucaacuagcugaaccuucauacccugacugagaacuaguguucaauaaaaggugacugguuc

SEQ ID NO: 1499 - RNA, 1535 nt, Mus musculus
cuucuucgccugccuggccagguucuguguggacaccggcaguggcucaggcuuugggcugucuaugcucuggcugcuccuuuucacucccugcuccuuugucugcugguaccgcccgauguauaaggcuuuccgguaagugaaaggggugauggaagggcugcaaugagauacaaugagaggugaugggaggaagggcugcagugagaggugaugggaggaagggcugcagugagaugcagugaggugaugagagaagggcuacagugagaugcagugagaggugaugggaggaagggcugcagugagaugcagugaggugaugagagaagggcuacagugagaugcagugagaggugaugggagcugcucugaaccucauuuucuaauucucccacacuugcuuuuuuucucuuugcaggagugauaguucauucaauuucuucguuuuuuucuucauuuucuucguccaggauguguucuuuguccuccaggccauuggcaucccaggguggggcuucaggugugugagcuaccauucguccucagcccuuccucacacauugggcaacucaguuuaaugggguuguccaacuaagggucaugugggucuuuuccuugggaaagacuaauguaacugaagucagggcacucuauggcuagagccaagacagcaguagacaggcagaggcugaaaauuaauuuuccuggagaggccaugucacaauggacgaaagaucaagggagugcccagaagugagaaggaucucuuucucucucucucuuuuuuuuucuugguuuuuuugagacaggguuucucuguguagcccuggcuguccuguccuggaacuuacuuuguagaccuggcugaccucgaacucagaaaucugccugccucugccucccgagugcuaggauuaaagccgugggccaccaugccuggcucgaaucuguuuuucaugaggaugccaggagagcuaggagcggaugcuucagaaaugacugaaaaguaugaagagaauagauguagugggauugguucaugggaugccgccauauuggccgaggcccugaccguugaugggccuggagcauguucuuagaccuaggggacuccgggugagcagagccccggcagaguggucgguccucacccgugcaucuucccacagcggcugggugacugcucuggugguggugggauccaaaccugccguggcggugcucaugcugcucgucgcccugcucuucaccggcaucgcagugcugggaaucgugaugcugaagcgggugagggccggucgggagaagguggggcuggggagugagaucauugggucccuaggggcugcugaguggaacauuaaggaaauggggcagggcggguggguuaucaacuaauggacuuucuugggugggugaguuuguguguuuggagggagugccaacgcagaaggaacgguacaaagcaggagacuagugaguggugccauccuccugggaugggaggggccugccucccuuauaaucucuuc

SEQ ID NO: 1500 - RNA, 6044 nt, Mus musculus
gacugccuugcuccuccacacagguccagcuugccuaggcauccccaucuugugcuucuuaagacggugaacucacccuggacguaggcacagcuuccacaggcaaccagugcacagcacacacuuuacaacccugggaagcuggagggacucuagggcuucccucccauacacagcacauacuagaaaggagaaugagacauccgaacccuuggcccugccccgugucacuguaaggucccccaggcccugccgugccuccuuuagucacagauagcacaggagcgaacucuuucccuuuaauguccaugcuaagcccaggugccugcucaggugucaguuccaucacuggcgacgccacagguaagugugaauggaguagccaggugacacggucuccaggaagcccaggucaggaucacugaugguaagagggacauccuccgaagaucuggagagaagaaaagucaagacucaaccugcugaugccagccaccucacacggcucaggcccagaccugcccuugcacccagcuuaccgguuuaacacgaccacaacugcagagccgucagggcguaacagugcuacuguuuccaagucagugcucucacuggccaccaacgccacucucugggaucccucgggaaugaacuugcugaacgugaagauagaaaucaucaggaccccaggcuucccugggcaacacagccagacucuuagcccugagccucagcugugccacugggccuugguccuguccuguggcaggacuccagcaucagucaucuggggauuaucugugacucugaugccaccuugucacuucccgcccacauggugcaacagaggaggagugugccccuuccaggguugccacccuagaaaccuuccugcucccucaugggacaggaugauguaagccugauacagacagaugauaggccuacuauggaauggggugcccgcgcucucuacucaccugaaguggccaagaugguagaacaugggcuguuuguaaaaugcgucuuuggggaugucgacaauaauggggcuaucgacaaaguugcggacccaguugggcccuccuucaggauucagggcaagguuccaguccguccauccaguuacgugguaaaggagguucuagaguagaggccaggguaaaagguaaagauggcuaucccuagaaaagacagucaaggaucacaggacuaggagugguuuguuccucugaagggacacucugucucagcaucugaggaggugaggacuguggagauggaggcaucucaggagcugagaaaucugagguagauaugccugccagggaccaaacaugaagaaaaagaccgauggccauacacaucugugaaagagaagauaaccauggcaucccacaguugccccaaagagaaggcuggcaagccagccgaggaggaaggcccguuugccuuugugagauuaggaaagggaucucagauggugugcuuugggaaggggagacaggcggcucaccguaaugaugcugugacuguacugcaucccucgaucccaggagcccaaccgaacacucuguucccagaacuuggagcccacgcaggccuccgaagcaaagagcauuguguuggggaacaagcggugugucucuccuaaaguagcuuuggcuggagccaggaaauccauauaccagugaacagcaaugccaugaacguacuuagcugccucuggaucagagagcaccugcauggagagagggaaggagcaauagggaagggagccacugaccacaagcccugcacagagcugugagagaggaacuacauguccugagaaaugggugguaggacccagcaaccagauggccuuacacugacagcaaugauucacagggcccuggaaaguucagagugggcagugccccaggcagccagacccagccuaggguguuccaggagucacaagcuggagcugguaaaguucuugccaugcagcugaggaccugagucccccagcacccacaccuaugcaaggccuuacacugucccagcgcugggcagguaggggcaaguggcucccuggggcucagugacuagcaaaccuagccuaaucauggagagacuuagugucaaaaaccaaacaaagaaaaaaguauaccgagcucagcugcucuugaugaauugucagauaaggcccacacauacaccucccugcacauaaaaaaggaguugagaggucagguauggaggcauaugaugucaaucacagcacuugggagacaaggggcaaguagaucuugaggaguugaaggucaguuuggucuauauaauuucagaacaaccagaguuaucuggugagauccuguugucucaaaaaucaaacaaucaauuaauuaauuaguagaagucaggagugguagaugcuuacaaucccagcacuuacgagucaaagcaugaacacaacuucaaggccagccgaguuuauauaacaagacccuaucucaacccuggcaccagggaacguacucuaaaauuggagccagucauuuuggaugguagaucuggaguccauugggacacccugggaaguucuagcgcuuaccaccucugcccagcgggguagcagcaagcguuggucaucuagcaugaguagcuucacaucaugggaacuguuggcaagggcuggcccuaggucacgggaaaugaagucucucugguguucaggagugaagcccaggcacuggaagggguaccccgugaagagcccugcuguagguucauucuccgcugucacugcccagaaucuuaggccauacuuagcauaagcauccagaaaccuggcaagagagaaagggccugagugaucagggccaagaaaguggaccaagacaugggcaauagguaaaacuaacaaacugaaaggcauggaauguugaaaguggagcaggucaagggauacgauguagacuacgguguccagaucccagggcccugacgaucccuuacuugacaaaguaauuggcccaggucuggugaaagauauccccuggcugacccuugagcgaccccuucccauucacucuuccauuggucuugagccaagugggugauguccagggacuggcaaagagugaaauggggcgugaggacaucuucagggcuuggugaaucagggguaucuggagacaaacagugaagagagagacacccagagcuggaacacauacuaguucuaccagugcaucagguccaaccaucagcccccacccucuuacccccaagucaaauaggcugcagaauguuccauguugcucuagagacagcucuaaccuggaccuucccagccccaagacggcaauccaauagggcugaggcaacuagaaugcccaccuugagcuuggugucuucuucugggaggcugaaguuggauaacuggaagucguuaggggugucagcauagguauagacacggauggagaagucacaacuggccauggguacccggaugauguuauauucaauuccugcaggaauugauggccaagauagggagaucugaaucaauaggagacuauggagccaaguguaccaugccugugaucccauuccuccugaggcugaggcagccagaucaaugugagcaggccagccagggcuacaaggcaagacccugucucaaaauaagauaagauaaaauaaaauaaaacaaggugaguaugaaaauuggcuuuaaucaguuauuaguccucaauaggcccucauucagagccagggucuaggugugggcuuguggagaccagaaccuaagugaaaccgaagccccucugcacauguauuuccuaaguacuuagcagaauauugaaaaaggugaucguauuucaguggcacugagucaggaaccaucggccugguacacuugguggcauaauacuuguaauuccagcacuuggaaaacuaagucagaaaagaguucgaggcuagucauggcuacaguguucgaggcaagccugguaaagcaagguagggaugggacaaagggaaagaguaagaacugagaggcaggcuggggauguaguucagguggcagaaugccugccaaggaugcauggcgcccuaaguuugagcuccaacacugugugaacugggcuugcuaaugcacaccuguaauuccaacacucaggagacgagaggcaggaguucagccaucacugacuacacaguagauuugucuggaacacaugaggucuacuccaggagcauuacagaggcgaggagagaagaaaaggaagggaggcaaauguccgggaaaaguauggaagcaagagcaaaaagccuggcaagacagcuccgugggaagacccccgacucuagcccaugggucccaugguggacaguggacacccgaaaauuguccucugaccucccccucacucaugcacagcacacacaagagauaaugaaauguaauaaaaaauuuaaaaauaaaauaaagccaggguaugaaaaggggcauaaguuacaguguaccaccuugcucugcccuccucaccguugguagagaaguaggaucugaguagcagcuucugaguagguggggacaaagcaaggauguugagcgcaguggcgucugucauggcgccuccaaauccuuucacuuucuggaacuucuuuucuggcugcaaagugaguaguaacccugggaaaagaagaggaaaagucagaguccagaagaggacaugcugaucacuggugugacuuuggguccaggcuuagagggacagauaaaguggcuaccugugccagugcgauuggccuggauggccccgacacucagcuccauccgacguccacgucgagugcucucguaacggcugaagguacccagagccgguaaggucacggggucaagagagucacaguacgaugcauuacagacacagaccacugagcuguagccaaagcuuuuggggaugcaggguugggcaccuaggaggcagggcacaagcagaggcaggcaucaaagcggguuuaugagggagugggcaugcuagguacgagacagaacaacaauuaaaaaaaaaaaaauccgggcuggugagauggcucaguggguaagagcacccgacugcucuuccaaaggucuggaguucaaaucccaguaaccacaugguggcucacaaccaucuguaacgagaucugacgcccucuucuggugugucugaagacagcuacaguguacuuacauauaauaaauaaauaaauauuuuuuuaaaaaaauccuuccaccauacucccagcccaaagaugucucaggcauucuaaaagaguuacagagucccuacugaaauuucagcaccauaauggaaggcuaccagaggacuuugggggcaggggacaccuucaugccuccaucuccauccuagacucaccauaugcccaagauaccgccugaaauaggaagaauccgaugagccuggcagccaugacaccagcacacuucugagaagaaaauguagaggaaagauaauaguguaagacucucucuacccugcaaccacccuccuggccagaguuuagcugccuguggaugcucacagcauaggcucccaccuuuauuagugauuagacagugcccguagacccuggaggcguccugcauucauucacucugcuagggaguuugcugcccacuccaaagaagacucucuucacucuuuucccccaucgauuucaaccuucagcccucccuccaucugugcccucaaagagccaugaugcccugaauuuaaaaaaaaaaaaauugaacucaccgaauuccauaaucuagauaggcagaauucccgaagcaagauugacaaggcaaauuguagcccugcccgcuuaccucuccagaagaucuuggaaacuggagcuacucaggaccagcgaaugagaagacuguggaaguuucugugccuuggagggauagaagaccuaccaaauaaaacacagacagauaucauagcucuuggaaccgacuagcacagcaaguuccuuccggcuuaaag

SEQ ID NO: 1501 - RNA, 3226 nt, Mus musculus
ugugguugugggagcugugacacuucccacuguagauucucauuccuagccccaaguuaccucuuuuucuaguuccuccucguucucugauuugugcucgccacacagcagcuguagccgcuccauguacuggcgcugcaugcggccgggcaggaagaaguugaggggaaagggcauagccucugcauaccacuuucgggucacuuccacauaguucuuggcgucuauccaaaaaguauggaucuggauugggcagacaggaagagaaagccugagcccgugcaccugccugucacggggugggcuucuaagucucauggcucuguagcucugcucccuucugugcgggcugggacugcuaggucugagcguacucacuagcacaggcaguaguuucuccuccagcagagacaugaaggcuaggguaucugcuccuuggcgagcugacagaucguagucggcauuauacuucuguggaagaaauguucauggggugaauauugaaggauugcagggacacuuauuuuuucaguagagaaggaacaguaaccccacacuagccucaagcauaguagagguagaagaaggagucuuuccugcugaggucuccuugccucagcucagugaguagccuguugcuguuggcagaaagccugggcuuuggagcccacuggcugucaagguccugcacccacugcggggagggaagaaggccuggccacaaagugggagcagcucccggacuuuccacggaaagcuggcggggugccugccgacagcagcucucuaacaguaacuuccugaucuagacaccacaccacagagcuagcaacgaggcacucggcugcaggcugggccucagaagucagggggcaccauccuuacccuucuugaacccagucaauuuacauccagccaccccaaccccagcuugucccccacagcaagcucuuggcuaugucuugcacuucacuccaaacccuugugcaccacuacuguaccuucaucgcaccgguauuuccgucuugucuuaguguggcccaccuuuccaggcuucaggcuguuccuuaguacccccuccacagacuaagaaagcuuugaaccugcagagccucuugaagaugacucuuaaauuucccugaaucucaguuucuccuuuauggaaggagacaguaauguuuuucucucgauguggcuggguuuggaaauaauuuaggaaaaaacccuuuggaaacugaaaaggcuguguuuauaugcaaguaacccggguccugccaggaacgcuggcuuauaucuggauccgguuucuccaggccgcuaagcuuccauuacuuccccagcucccuggaaaguagaaaugagaaaggggauucuauuucugacuguguguucccucuuggaacaacgcuaugaaugccaggccucugagagcauccugccuaagcacccuaguuuacaaguaaggaacuguaguuggugagcugccuuagcagguaacuguccuugcugucaggcucaaugacaagaguugcauugcaggaggccacauagcagaaggaaaggacuuagucuaccaagcuguccaaggaccuccccaagugugccacggcaugugcucacacacacacacacaccccaaagcaagagaaauaaaugcuuacaaaacaaauaguucauuacuuugagaaguuaaaucaccuguccaacgucauagucaaugacagaauaacagagccaaggccucuacucucucguaauucuuaaucauccaaaccuggcacgaagcuuuguccauccugaguccuguaucuagcauaacuuagcacuugagaagagaaauaguccuuagaaaucuuugugguuuuuuucucucucucucucucccccgacuuuuacuccuuucuuugacaguucuggccuggaacucacucuauagagcaggcugacuuucaacuacagagaucugccugccucugccuucuagguguucagauuaaagaugugugccaccacugcccagugacuuuuuucuuuuuugagagggguucuuaugucuuccaggcuggccccaaacacacuauguagccaaagaugauuuuaaauuucugaucaucccacuucuaccaagugcugggauuauaugcguguaccaccaugacgguuuauauuagaaauuccuuucaggucuacccggaaaccaacugcuguucucuacucuucuuuauuuuccaugugucaucagccuguguauuucucuuccucccugcccauuugauuucuccgcuuaucccaccccacagccccuuaaguucacuaucuggccaacugcuugucacagucacacugcaucccccaugcugcuccucccugcucuggaucacacugcucuugccuggccugugucugguggccaauaaauaaguuacacuucacggacuggauuuccuccauugucagcccccacucaagucaccuaccucuuuacgaagaugggugaugaucuuguguggcacuguaaugacuuucccaucacugguucgaagagcaggcagaguuccugauauugagaaagaaguauacucacaggguccagcuugccuagucauacucauuugcauugcauuccuguccccugcuccuccccuggcacauuccugucccucagggauaccugaagggcucugccaaggauugcuggucuuguguaucuucaguggggcgccuguaaaucugguauaggucugcagggaaggaagcagacgguagagaggccaggguauggcuucauaaagaaaccaagaaaagaauccgugacucaguaaauuauguucuauggucuauacuuuuauaccaaaaggagaggcggaaagagggugucauuccuauuuacaaaugggcaaacuagaccagacaguucauggacauguuuauauguccauuuccaagauuaaacauuaggaaaagauuucuacccuuaugccaucuacacuguaaagccuauucacaaaagcuuuuccuaauuaacuucccucuuccuggaaguacugauuuacuuugacagucucuguauucuguuucuacuuuacaucaauacacgugaucguuucauuauuugcuuacauguuugccuuucuguuaacaauuucaauacaagggucaaaaucguauugcaagggaauguuuuuuacucuaagaggcauaauaaauguuuuuugcaaucccgaag

SEQ ID NO: 1502 - RNA, 3226 nt, Mus musculus
cuucgggauugcaaaaaacauuuauuaugccucuuagaguaaaaaacauucccuugcaauacgauuuugacccuuguauugaaauuguuaacagaaaggcaaacauguaagcaaauaaugaaacgaucacguguauugauguaaaguagaaacagaauacagagacugucaaaguaaaucaguacuuccaggaagagggaaguuaauuaggaaaagcuuuugugaauaggcuuuacaguguagauggcauaaggguagaaaucuuuuccuaauguuuaaucuuggaaauggacauauaaacauguccaugaacugucuggucuaguuugcccauuuguaaauaggaaugacacccucuuuccgccucuccuuuugguauaaaaguauagaccauagaacauaauuuacugagucacggauucuuuucuugguuucuuuaugaagccauacccuggccucucuaccgucugcuuccuucccugcagaccuauaccagauuuacaggcgccccacugaagauacacaagaccagcaauccuuggcagagcccuucagguaucccugagggacaggaaugugccaggggaggagcaggggacaggaaugcaaugcaaaugaguaugacuaggcaagcuggacccugugaguauacuucuuucucaauaucaggaacucugccugcucuucgaaccagugaugggaaagucauuacagugccacacaagaucaucacccaucuucguaaagagguaggugacuugagugggggcugacaauggaggaaauccaguccgugaaguguaacuuauuuauuggccaccagacacaggccaggcaagagcagugugauccagagcagggaggagcagcaugggggaugcagugugacugugacaagcaguuggccagauagugaacuuaaggggcuguggggugggauaagcggagaaaucaaaugggcagggaggaagagaaauacacaggcugaugacacauggaaaauaaagaagaguagagaacagcaguugguuuccggguagaccugaaaggaauuucuaauauaaaccgucauggugguacacgcauauaaucccagcacuugguagaagugggaugaucagaaauuuaaaaucaucuuuggcuacauaguguguuuggggccagccuggaagacauaagaaccccucucaaaaaagaaaaaagucacugggcagugguggcacacaucuuuaaucugaacaccuagaaggcagaggcaggcagaucucuguaguugaaagucagccugcucuauagagugaguuccaggccagaacugucaaagaaaggaguaaaagucgggggagagagagagagagaaaaaaaccacaaagauuucuaaggacuauuucucuucucaagugcuaaguuaugcuagauacaggacucaggauggacaaagcuucgugccagguuuggaugauuaagaauuacgagagaguagaggccuuggcucuguuauucugucauugacuaugacguuggacaggugauuuaacuucucaaaguaaugaacuauuuguuuuguaagcauuuauuucucuugcuuuggggugugugugugugugugagcacaugccguggcacacuuggggagguccuuggacagcuugguagacuaaguccuuuccuucugcuauguggccuccugcaaugcaacucuugucauugagccugacagcaaggacaguuaccugcuaaggcagcucaccaacuacaguuccuuacuuguaaacuagggugcuuaggcaggaugcucucagaggccuggcauucauagcguuguuccaagagggaacacacagucagaaauagaauccccuuucucauuucuacuuuccagggagcuggggaaguaauggaagcuuagcggccuggagaaaccggauccagauauaagccagcguuccuggcaggacccggguuacuugcauauaaacacagccuuuucaguuuccaaaggguuuuuuccuaaauuauuuccaaacccagccacaucgagagaaaaacauuacugucuccuuccauaaaggagaaacugagauucagggaaauuuaagagucaucuucaagaggcucugcagguucaaagcuuucuuagucuguggaggggguacuaaggaacagccugaagccuggaaaggugggccacacuaagacaagacggaaauaccggugcgaugaagguacaguaguggugcacaaggguuuggagugaagugcaagacauagccaagagcuugcugugggggacaagcugggguugggguggcuggauguaaauugacuggguucaagaaggguaaggauggugcccccugacuucugaggcccagccugcagccgagugccucguugcuagcucugugguguggugucuagaucaggaaguuacuguuagagagcugcugucggcaggcaccccgccagcuuuccguggaaaguccgggagcugcucccacuuuguggccaggccuucuucccuccccgcagugggugcaggaccuugacagccagugggcuccaaagcccaggcuuucugccaacagcaacaggcuacucacugagcugaggcaaggagaccucagcaggaaagacuccuucuucuaccucuacuaugcuugaggcuagugugggguuacuguuccuucucuacugaaaaaauaagugucccugcaauccuucaauauucaccccaugaacauuucuuccacagaaguauaaugccgacuacgaucugucagcucgccaaggagcagauacccuagccuucaugucucugcuggaggagaaacuacugccugugcuagugaguacgcucagaccuagcagucccagcccgcacagaagggagcagagcuacagagccaugagacuuagaagcccaccccgugacaggcaggugcacgggcucaggcuuucucuuccugucugcccaauccagauccauacuuuuuggauagacgccaagaacuauguggaagugacccgaaagugguaugcagaggcuaugcccuuuccccucaacuucuuccugcccggccgcaugcagcgccaguacauggagcggcuacagcugcuguguggcgagcacaaaucagagaacgaggaggaacuagaaaaagagguaacuuggggcuaggaaugagaaucuacagugggaagugucacagcucccacaaccaca

SEQ ID NO: 1503 - RNA, 12908 nt, Mus musculus
cggccuucucucgccaggaaccgccccugguccccgccucccuggccgccggggcuuuggggucuggggaggcguggcucuuggcggccugagccgcggcggggcugugagagguggggcaucggccuucuggggagcgccgcgggcucguccugaggcggcccccguaagggagcagggccgccguccagacgcgcuugggacuuucgcggcgccucugccgagcguagccacgaaccgccggcgacacggagggcuugggagaggggcaucuggugcggcuugucggucucugggggcacuugccaaacugcacauggccccgacaaccccgggcccucucaggucucagcccugagcggacgccgcgggggggucccccgagccgcauguuuuccacugcgcguuauguuuggagagggccucgcgcugccugucgccauggaaacaaaacaggggcgguggcggcgcccgagcugaggcccggcuggggccugagugggggaaggggaggugcggcucgcgggcaguugccuucguaacgggaacuccuggucgguccccagcuccccucggguucaccccggacagggccaucccgcgguauccaguguuccccagucccauccucgcuccugucuucuaguuuauggcucuagccucuggugaugcuuuccccuuucugaugucuuagaaagccaucaaguucucgucggugcuuccagauuucuauuuucccaagagugaggggaaauggaggaaugggcacaugucagggacgcaacacaccguaauaaaaaaauuuuuuuuuuuuuugcugugccacaucaauaagccucgugucguacguagucuucuaggcacuguagcaaaggaugguccacugacauccauuuccgccaaccgugaaauaaugccuagaaccuagaauugcccaaggcaggggauucugacuuuuccaaccacugcuugcagagaacaguagcauuugguagcgcuguuaaguugaaagcucccaagaaccagaugucaggcuaaagggaagcaucuuugaggaaaaucauuaugguggagcaggaggcaaggaaagcucugggacucuuucccagugccucugguuucgggagccggugaugccuccaaggugauuggcagcucuuuguuucaaccccccccccuacccgccugcucccccccaaccccccagcucgcuccucagucccuccgccccccuccugcuccugcucuccgccuagucuuuuucccucccagucgccuugccugccagggguagugaaccggcuaagcggcauggagaagccggaacuuugggguguccuggcucuccuccuccucugcucuuacacguguggcagucaggaccuucaggguaagccugcauucaucccccuugacaccucuuugucuccuuucuuuugcccccaggcaaauaacagaccacaugugaguuugagagagagggaagaguccugaaauggguuggagagaaaaguuaacacugcgaagagugaaggguuggugauaauguaggaggggugggcaccagaguggugggugagugcagauuggugcagugucaggcacugagaccaggauggauccaggaggacuccacgacagaguuagucucagagcaucaacaggauagucugggcaagcagcuugauugauggugacugcacggugggggacccugggcuugguucccccccccuuuacucuggcucuugguuucuaaaagauagggcggggguggggauugggcagcuugaacucucccggaggucugguggggggauggcccaugggugguguaggagaggugguaggagcagaugacacaagcaaagauucuuuacuggcuggaagggaaaccacagauuggccaggacacaggaggaagagaugcuggcuggguccuacauucccaggggggaaagacuaaacagcgaugggagggucagagcgcuuuguggacggcuguaagaugugugugaugagccccugggaugggaggaccggccccaggguuuggagugugcuaaacccagcaauggagagaugguacuccugguuccugaguugugggcaccaggugccacuccagacucuagucagcaaugucucccuugcgccaccuggugggacauaggaaguuugcgaguggcuuugguauuuguaagugggcucuaagccuauagguucccaaggcuuuggaagcaauagaaggugcugggagggaagcauugccuugauaacaaaaaaagggccaaugguuuuguuuuuagagauagggucuuguagccuggucuaaaguagcggaggcugccugauugcuugaggcaguccucucagccugaggcuacaggcauguaccagcaucccuaaagaguuugaguuuugaggaugcaguucagagguaggaagaugauaauuagggaugccucagccgggcgugguggggcacgccuuuaaucccagcacucaggaggcagaggcaggcggauuucugaguucgaggccagccuggucuacagaguguguuccaggacagccagggcuacagaaaauccuugucucaaaaaaaaaaaaaaaaaaaaaaaaaaaaaaaaaaaaaacaaacauaaaaaaaagggaugccucaccucugagagcucaggagagagggcaggccuaccucagacuccaaccacuuccucuaauuuuuaaaucccuaucuggccaguaauugaccugcugacagugggcgaauccaggcagaugguagcuguggcagagaagauucggacagcuuuacucacugcuggggauaucuaccucuuguccacuuuccgccucccuccaaagcaaggugguguccucuuuggccucuacucucgccaagacaacacacgauggcuggaggccucuguugugggcaagaucaacaaaggugacuggugggcaccccuuuccagcaucaaugaccccuugagcagucucccucaugcccucucccaggugccucuuuauucuccaugaccucuacuagggcuacugguauggaggaacucaaacaguugggucaggcugguauuuauagggauggauggcagguuguaggcugggaugcucagggagggugagacagcucugugucccagcaaugacuguaccacucagaucuuugcuaaaguucaguggguacagaucuaguugccaccuugggaaaggauagucuccuagacauggagaauaaggucaucuaaggccaauuugaaaagcauucauuuacuacuuucauuguuuauacauuuauuuacuuuucaagauaggguuucuccauguagcuccagccugcaacucagagauccacaugccugguccugugagugcuugucacaucaacgccuggcugaaaagcauuuauugugcaccuguuacauacaagguguugagaguuacacauuaggaauuaaccuaauuuguaguuucucucugagcugucaugccacacgccuuuaauuccaggcagauggaggcaguggcaggcagaucucugagucugaggccagcuuguuccucagagugaguuccaguauacucagagcuacacagauaaaccugucucaaaaaaaacaaagagacagacagccaugggguggcauauugguauauagaagagaugauggaagucaguuggaacaugggguggggcuagugcacauacugaccuccaauccugggcagugcuggugcgguaccagcgggaagauggcaaaguccaugcagugaaccuacagcaagcaggccuggcugaugggcgcacacacacggcucuccugcgacuccgaggaccuucucgacccagcccuggccugcagcuguauguggacuguaaacugggugaccaacaugcuggccuuccagcacuggccccgaucccuccagcagaggucaguggacuggagauuagaacuggacaaaaggcuuaucugaggaugcaggugagaaggaaccucugguuuggggaacaugguuuguagcaccaagaggagcugcucgaucugccugccucccugcugaccccuagggcuuuguggaaucgaugaaaauuauucuggguggauccauggcucggguaggagcccugagugaauguccauuccaaggagacgacuccauucacaaugcagguaacagauccuucugaccuccuccccaguuaacacuuuccuuuagcuugaccauuccugaagcuuucaaccgccccccuccccccaacuccaagucuuuuauccuugacucauguguaggagguguagaucagaaaaauaagaucauccagcagggcuguaacuccggggaacucuaggguuaaggaguaagguaauggcuuagucucaagauuuuuguaguugcucuuggcaacugucaccuacaauugaguggcaccuuuagccaaggacucucauccuggucugugacaaggaugcuuagagacucuuaccuaagcaaacacccacuucucccagagacuugaaaggguucuugaaggggcagcuugggggaaggguuugaaauggaauguacugggggccuggaccuacuuuggguugccucucauuuggaguccuccuggaacuacuaugccugggaaugaagacuugaaauuuuucuggcuuccuauaaggcaaugcccagagggccuuuagccugauggaagggguggcugugaccgaguaaggggcuaugugaagagugcuugccuaccgugugcaaggcuguguaguggauugccucugucaugacacucugcacugcuucaucuuucuugaggguccagggcugucccucuucuagacccccuuccuucccacuuccuuaguaucucccacugacugcucucacuucuccucuagugaccagcgcacugcaauccauucuaggugagucaguuaugaagaggcaguggaggcaagggugguccucugucauggguggggucuaagguguggugugggcuucggggacaagagcugacuuacagugcaaagagggcccagaguggcuccccgauucuaagucucuccauccccugguccuugacaggggagcagaccaaggcauuggucacccagcucacccucuucaaccagauccuaguggagcuucgggacgacauccgagaccagguuugagugggcaggccaaggaugcgauucugggguggggugugacgacaguggcagagagaugacuucuccucacucgucaggugaaggaaaugucacucauccggaacaccaucauggagugucaggugugcggugagugggagaggagggccccagagagcacugcuaugcuccccaccguguggcuucagcuuuuccuuccuagccauccgaagagugacccucgaggguggcucugaccgugucuaccucccagguuuccacgagcagcguucacacugcagccccagccccugcuuccgaggcguggacuguauggaaguguaugaguacccgggcuaucgcugugggcccugcccaccuggccugcagggcaauggcacccacugugaugacaucaacgaggugagugauggcggggcucucgaggguacaaaaaaaaaugggugaaaguuguucagaagcagaggaauucaggagagcucagagaccagaaagcacaggaaggaggaaaaagauaaaggguagacuagagggcuaugcggugaaggagcugggggagagguagggaaguuugagauggccagccaggggaaacggagcacugugagguugggcugagagagcugcccagggaccaggagugaugcucuuaggaucacacacagcugcucacuuccccaggaaaaugccugacgucugccuucucauuugguccccagugugcucacgcugaccccuguuucccgggguccagcugcaucaacaccaugccuggcuuccacugcgaggccuguccuccaggguacaagggcacccgagugucuggugugggcaucgacuaugcucgagccagcaaacaggucagaugguaaagucuguauggauuugugaaaaaugagaugagacuccccuacaccagcucuggcuuugggucuaaacaugccagugcucacccaugggcccugucaguagugacuucuguaucugugagaucccccuccacccugcccuuuuaggucugcaaugacauugaugaauguaaugaugguaacaacggaggcugugacccaaauuccaucugcaccaacacgguggugaguugaaugcccugcucugccucugacuggggaaaggaaaccgugucacucccucuucaaauuuccuccuucuuccugucccccuugggcaccaugcaagauggccagguugauucugccuuuuacaguugugaccuuuagcaaguuauuucaucauuuugagccucaguuuccucauuagaaaaauggggcuauuaucugccuuuaaagaaaguuguccuggggcuggagagauggcuuagucguuaagaacacugacugcucuuccaaaggaccuggguucaauucccaguacccacauggcaucucacacuguaauuccaauaucugacagccucacacagauauacaugcaggcaaaacacuaaugcacauaaaauuaaaaaaaaaagucugugcugagaaccuaaaggagauagauacagcagguguaguucuggguggcugccugagguuccacagguagaacgagacucguccaggcucauccuuucuuaacuccaccucucuacucuuuuuuuuuuuuuuuuuuuuaaagauuuuauuuauuuauaugaguacauagucacuguguucagacacaccagaagagggcgucagaucucauuacagauggcugugagccaccaugugguugcugggaauugaacucaggaccucuggaaaaguagucagugcucuuaaccucugagccaucucuccagcccccaccucucuacucuuaggggucuuucaaauguggucccugccgccuggguuuccuggggaaccagagccagggcugcguuccagcaaggaccugccacagcccugcccacagccccugccacauccacgcccacugucucuuugaacgcaauggcgcugugucaugccagguaaccuagauuuaagaugaggaggaaaaaaggagggcucuggagaaauguauaaagcuggugaaaauguagggacugaccucagugccuucaugggaaagagguaagcacaggcuggaggcuuauuaauguggggaacagagcccagagcagggagaguaauggggcagggcacagggaugcaaggcccaauggcuaacgcugaccauauguuuuugccuaguguaacgugggcugggcagggaaugggaacgugugugggccugacacagauauagacggcuauccggaccaggcucuucccugcauggauaacaacaagcacugcaagcaggugagaccagaggcugugggggagcagugaagggcaggauggcuccccagaacucacccaugcccuuccucuugaaccucaggacaauugccuuuugacacccaacucugggcaagaagaugcugauaacgauggugucggggaccagugugaugacgaugcugacggggaugguaucaagaauguggagguacgggguggggcucuccacaguuagaagcacuuguuuugcacccagaggguggcuuacaaacaucuguaacucuaguuccaucucuggccuuucugggcccugcacucaugugggcacaggcaaaacacccauacagagaaaauaaaaugagucaaaacaaaacaaaacaaaacaaaagggcucagcaguuaagagcagugacugcucuuccagagguccugaagccuuuuuuggugugucugaaguaacagugcacauccauaaaaacaacaacuuugagguagauuugcaaugguggcacaugccuguaaucccagcacuuaagagaaagaggcgggagauucucagcuugggcuacagaaugagauccugucucuaaaaaccaaacaagccgggugugguggcgcaugccuuuaaucccagcacuugggaggcagagacaggcggauuucugaguuugaggccagccuggucuacagagugaguuccaggacagucacggcuacacagaaaaacccugucucaaaaaaacaaaaacaaaacaaaaaaaacccaaggucagugugguagcucagagcaaauaaaggcacuugccaccaagccuagugacuugaguuuaaucccugaaacucauauagugggaggagagaaucuauuguuacaaauuguccucuggagugaccuccauauaggcacaguggcacuugugugaccacauacauauacuacuuaaauaaguacauguaagaaaaggaaagagggcuggagagauggcucagugguuaagagcacuggcugcucuuccagagguuccuaguucaauucccagcacccacauggcagcucacaacugccuguaauucuaguuccaggggaccuuacacagacauauaugcaguuaaaccaccaaugcacacaagaucuaaauaaauaaaaauaaauaaaucuuaagaaaagaaagaaggaaggaaggaaaaagaaagaaagaaagagagaaagagagaaagaaagaaagaaagaaagaaaggagagaugaaaugaaaacaaaagaaaagccagacccccucucugcugcucuaaucccagaggcugaggcagcaggagcccuguagacuguauagugauuuugguaacaucuaaaggccaaggaugcugugccccucucagcugcugcgggcucuccugugaaucccucccucuauccugccucuucuuggcccucggcaguucucuaggaacaucccuaugaaaugaacuguggagauauguaccuggucgagugggugggacagcaccaagcaguggacaaacacaggacaaggacauggacagaguaaguauggggacuucugauccuuuguccaggacaauugucgacuguuccccaacaaggaccagcagaauucagacacagacucguuuggugaugccugcgacaacugucccaauguucccaacaaugaccagaaggacacggauggcaauggagaaggagaugccugugacaacgauguggacggggauggugcaagccuggggcuguggggauggcugggggaccuaaggggagaggcugggagcuuggaagucaguggcaauggggaaaguaggcuuauaaucacuggcccgagaacaugauguggucaggcaagauguaggcaggucacacaaaguacaagcggguuuccugacaaagcucgagccuuccaccaacugagaagagugugccccacgagcagcaacagcaucguuucucauguccacuaggcauccccaacggguuggacaauugcccuaaaguacccaacccacugcagacagaccgggaugaagacggagugggagaugcuugcgacagcugcccugaaaugagcaauccuacccagguacagaggagugucagggugagggaggguggggauuggaggaugaggcccaguccuuuacccugucaguuaucaggaaauggugacaucagacccgccucucucagacagaugcagacagcgaccuggugggggaugucugugacaccaacgaagacagguagggucugggccgagacauccagggucucccagggauauuuuuuuuccucuccucauuuucaguugucucuguaauguaagcuuaacucaccaccccugcuaagcaggaagucauucucacugucuacccuccauucccacugcuggauggccaucuccccugaaugauggcaagggaaccaaguuagaggguaggcaggccccagagagcacacagaaggaaaagauggagcccgcccucucagcugggaucuguucauuuucuucugagcagcgacggagacgggcaccaggacaccaaggacaacuguccucagcugccaaauagcucucagcuggacucagacaaugacgggcuuggagaugagugugacggggacgaugacaaugacggugucccagauuacauuccucccgggccugauaacugucgccugguacccaauccuaaucagaaggacucagaugguaagacuggagucccggagaugcuuaagcugaucagguuuugcucaggagacaggccuacuggagggaguggaggauggaaggguagggaggacucaggaagaaccgggcggugacagucgcucuuugcaggcaacggugugggugaugucugugaagaugacuuugacaaugacgcagugguugacccucuggaugugugcccggagagugcagaaguuacccucacagacuuccgggccuaucagacugugauccuggaucccgagggugacgcccagaucgauccaaacuggguagugcucaaccagguaugcggggcaguaggcugggcaggcgcugucagaccuggcugccuguugggaccuggggugucacugugcaccuggaucagggcuuuuucucuuccuuuaucaaccccagggcauggaaauuguucagacuaugaacagugacccgggucuugcaguugguauguaaaggacacccggcucagucguuuccaaagggaaggcuccuguggaggguagauggagcauuugcagggccuuccuaguccuguaugcagcaggcaucucugcgcccgcccacacccacccacaguaggccgccuggcagcuguacugccccuaacacuccuccuguucccacuccaggguacacggccuuuaauggcguggacuuugaaggcaccuuccacgugaacacagucacugaugaugacuaugcgggcuuccucuucaguuaccaggacaguggccgcuucuauguggucauguggaaacagacggagcagaccuacuggcaggccacgccuuuccgagcaguggcccaaccagggcuucagcucaagguauccccagcugcccacuuuccccaccccagugacuuuccuaaagcuguucuugcccgaccucagggcccccacugucucugagcuucccuacccagacaugugcucuggaguucaacuguguggaauuccagagaauuccuuccucuucccucugacuuccuuucucgccagcucguccugucuuuugucucccuucacccugguccugugauugacgcacuaucuuugucaaugacucccaggcagugacauccauaucuggcccaggugagcaccuccggaaugcucuguggcauacuggccacaccccugaucagguacgacugcuguggacugacccacggaauguggguuggcgagacaagacauccuauagauggcggcugcuccaccggccccaaguuggcuacauucgguaagggaaaaggcuugagcccuggagagggggcaggggcaaaacucagccuccuguccccucuagcuagcagggacuuggggacuguggccuucgcucugcucacuucuuuacugucucugguagggcuugcagccaguuccuuccaguuucccuucccaacacggaggaggugguaucaggaacaccuuuccuuugcauccaauuuccccucuagauccaggguguugagcuagaugcccuucagcgcucugggagccucuagaccagggcagucuguggaagaaccugucccuuccagccccuaaguguccagaaccugcucccgcagcaucggacguuggaaagggaccaugauguauagaagagcagauugagaccuagaguuugcaggccucucugguuugauuuuucccuccaaguguccccaguuggugccagugccuggggaagggaagggaagggaaggggucugcuuagaagcggggcuuccuguggccagcagccuugaagcugaagcgcagggcugagcugguuccucuuuaagguaccuagagcaguggggcgccagggcagaggauaaaugaggggugguggacuagagccugggaagcgggugacuucacccccagccuuuugugcucauugccauagcaacccaauccuugcuaggaaugugcuggugcuuugagaugcaaaaggggcuggacaaagagcuaggggcccgaggccugagaaaaagcaccucuccuccccuuccagccuucccucccuucccucaggacuagagagccccaggggaggggugcaggagaccccaggacaguggcacagugcucacuggcaccuuagcaccaaugauaccucuguucccaacagggugaagcucuaugaggguccccagcuaguggcggauucuggggugauuauugacacguccaugcgaggggggcgucucggcguauucugcuucucccaagaaaacaucauuugguccaaucuccaguaccgaugcaauggugagccucuagacugcggucaacuugaccugugcccugggaaaaccauguccucugacccugacuuauuuucccucuucagacacagugccugaggacuuugagccauuccggaggcagcugcuccagggaagagugugaggagguggccacgggacccagauccugaucggagaccuuuggccauugaacucuguucuggagacccuggggucuaaccuacagccccucagccuaacggauggcucucuggcacccaccagggagcucagccccagagggguggcgaccccauugugcagggguugggagacuuucaagggguauuauuacucagguucuaaccccaggaaagacaacagcacauugccauaaaguuucaguuauuuucuaagucag

SEQ ID NO: 1504 - RNA, 2329 nt, Mus musculus
cggguuccggcgcgguuccacggggaagggcggagcuucgccuuccgcagcuccgggucugagcuacuggaacuccgcgcugggcuagggaaccggcuccggugggauggaggcgggcggcguggcagacucuuuccuuucuagugccugcgugcucuucacccugggcauguucuccacuggccugugagaguguggauggacugggcuggggcaggaagucaagaaaugaaagcgggcaagagacguggcugcaauaucuugcugcuuuuggaacccagaauaauaguggaauaggauuggaugauuugagguccaaggcgaggcugccucuuggccugaggggggagaucugcuugucguucaggaugauugguaaacaccgagaaaucuuuuacccacuccuaacaauuuccuuuggaucccuuccagcucggaccucaggcauaugcagaggacacggagcguggacaacauccaguuccugccuuuucucaccacggaugucaagugagaguguuguuggcugugaugggaaaggcugagggaggugcaagagaucccuggagaccugcugcaaccccagcagccccuuggaccuuaauccuccuucccucacagcaaccugagcuggcugaguuacggagucuugaagggagaugggacccuuaucaucgucaauagcgugggggccgugcuucagacucuuuauauccuggcauaucugcacuacaguccucagaagguagaggcccucccuugcacucaccuccaccccacaccuggccauguuggcagagcauauaguucuauuuccuggaagauuagugggauggcauuaauucccuuuccuagaaggcccuucugguucuccugcccaugaagucaacccuuuaaaaugcacacagagccacccacccuccccuuguucgaaaugcugguggcuuacccaaccccguggugucaagauauccugugcucccccaacaggcugggggaagagggcuauacugucugauaguuccuuuaggguuaggaccagggccaauggcuaagaauggccauucgcucugcuuccccacucagucacacuaacauuuauuggucucuuauuguacauguaugugaagcucacaugaaaaggggagggaucuaaaaauggcucuccccuucccuggggaucuccaguguuguguggcugagauuucucucaaauaacugaguggugagaggcugacgugaaggccgggauaaaaguugauuuccccauuagagcauggcagaagacaggaggaggcaauuccagcagagagaugaguguucuggguacagaugcauguaagacgccucuccccugcagcauggugugcuccugcagacggcaacccugcuggcuguccuucuccuggguuauggcuacuuuuggcuucuggugccggaccuugaggcccggcuucagcagcuaggccucuucuguagcgucuuuaccaucagcauguaccucuccccacuggcugauuuggugaguagggguggccaagagguaggggagaugcggagaagggcuaggcucccugagccagggacuggcuaauacuggggcgggggcggggcccagcucuuggaagaagucaagguagcagaggugagugggaugcaggaaaagggcugaaugaaagacgcaccacagggauuguggucuuuuuuccgcgaggaaauucucuggcgaggacucaggaaugguucuaugaaccugaaccaggcacauuuuugccguaggccaagaucguucagacuaaaucaacccagcgccucuccuucucccugaccauugccacgcucuuuugcuccgccucuuggucuauuuacggguuucgccuccgagacccauacaucacgguaagcagacucuagauugggacguugggucuacaaagcagagucuggucuuucuagcagcuuuuugauugcaggugcccaaccuuccaggaauccucaccagcuuaauccgccucgggcuuuucugcaaguacccuccagagcaagacaggaaguaccgccuccugcagaccugaccccaggcacccgagugccaacuggauaccaaacagagcuccuguuucugcugguccuugugaccaguuccauggaugcaauagguugugagaaaaagaugacuuugaaacuaaagggaccaaagaucuuuccuuagaucagauaggaccugugggaugaaaucacauuuuuacaggagaucaucuuuucucauuucggaggcugaggugguauuagaaugugccuuaaaauaaacuguuccccaccccugccu

SEQ ID NO: 1505 - RNA, 9069 nt, Mus musculus
agaagggcggagggaaggauugugggcgugacuaagauugggggcuggcagcggcggcagcagggagcugggaagcugagaagccgggagugcggggcucagucggggggcggcggcggcggcggcuccggggauggcggcggcuccgcugcugcugcugcugcugcucgugcccgugccgcugcugccgcugcuggcccaggggccugggggcgcacugggaaaccggcaugcgguauacuggaacagcuccaaucagcagugagucggggacccggagaacccgugcgucccgcgucagugaugggggagcuggugggcccgagaaguccuaggggaaccuggcagcaguccugggagacaggcuugguaccgagaggcgagggagaggggacgcacuaugugggcgucugugaaacucgggggugucugagagaagcuguuggggcauaguaaagagcgcucuggccgugcggaggaggcuguugggggucccuaaccccaucuugguuucucuccacacucgccaauggaauaguguucucugucccguagucucccccaccauccacgcuccuuuuggcuagguugaagucugugaguaccggugugcuagggauaggccgcugcguuugggagcugaaggaugaccuguuuucagccuguaauguugaugggguucugcuuaagacucuugguuuuaaaagugggguucggcauuaaggcaggaacuccgauucuccaccuccucaggacgaaggguaagggguugcucugguugugugaauaagcccugcuggggugagccgggccagggucgcgaaguuggggggcccuaggaacgcaggguacuggugagaaggaagaaggcagagaugucggcaugucacacacacacacacacacacacacgcacacacacacacacacacacgcacugaagcuagggacggcguauggcacugagugugaacgggcgugcgcggcugucagugugcgugugucugugugugauuugugugucugcgucggcgaccgucuaggggugggagcgggcggcggaucggggagggggcugcggucgguguccgcguggccagucuugucugggcugggguggcucuuggcgccgccgcggucugggcgggugucagggcggccgugugguuuccuccgguguguggcgcggcggcucggugccggcugccggaccgggccaucauucugcacaguccuugcugcccuugucuucucccugccgagcugucguguguaucacucuggccaccucaguguauugguagggggaucccuggggacacggggaucacugucacaccugcccgggcgguggcggcagcuuugcuucugacucuccgcccugggggccgacuagggaacaaauggugagaccccaggggaggggaccugaagggccucgaccacgacccccaaccuuccgggggaggggcuccugcuugcugcucugcucuuuguuguuuggggcucugcgccucccccucuuucuccucgcgcccagagugucagacuggggguggggaugagcuaaugacgccccccuuucgcuucccauggaaaccucgggggugggguugcagccccucccccccggagcgggacuccauccuccccggggggccccgagggcugacuccccugcuguaucuaucuugcucaucccccccuuaagauuuacacguccgacccccgccccgcuacagucuggcacgagcagagagcucgcaggcgagagacccuggguuccccgccacccuuggggaaccccacugcugguagcuugccagagccuaggggguguggaaauagccuuggggggagcguugaucagguucaccucccccgcauacaccugggcgcaggugaaagcuccggaacgggaugguucccagaaccuccuuucgcccucuccacuccggugugggcagggaccgacggagguaggaggcggcgcacaccggaccaggaggccgcugccgcccccgccccgcuucccgggccuuuguugccgcugcgcccggacuccccggcucucucacugcggcauccgcggccccauaaaucgugagagcgacgugcuccagagccgggaguggagagggccggggagcugggggcggggccgggcugagccacaggcucccaggcccccccagucacgugaucuagguuccuggcucccaccucucaucacguguagagggucucugccccuuggggucacguggggagggucugcgaccccgccucuuggggucacgugggagggugcuggugggacacgugcaauagccuccuuugacagaccugcaguagccuacuccgacagaccuggggcggguggcuggguccuggcuaccuagcuaucaccccuucccccagucagccccuugaguuauagucccugggaauaaucgagaccuuuuccuaaccuggcccagaaacuaggacgcggugggagcaaccuuauuggagagaguggugagagugugaagccguggggucuccugcgucggggacugaaugggggcggaguugaaggccaaacaugucuuucccccucuccagagccucauuucugugaacuaaaacgaagguguugcuacucuccucuagagcaucuucuucucgugaucucccuaccuaucuaggaaacguugcuguugcugacgacuaucauucacacauucauucaacaaauauuuauugagaccucuacuacgcccgugguggucaguuuucgucugcucgccaguguguccagauuucucuucugcgcugucuccucugcugugggccucucuggacucaaugcugacucuuugccguuuuuuuuuuuucccccaagucuugcuugguucucauucauuuccucccuuucccgguuucuggcuuccccucucucucucucucugugccucccucccucccuuucccuuucgggcgaauccgucuguguucgccuccccucuguauauggcagagucuuuccaucccuguaugucucgcuuucggcggguccucgcucuucuccgccgcugcagaucaauaaaccuccgccgccgcugcugucgcuacugucgcagggucgaggggcgggggugaccggcgcgcugcuuccccuccaggacgaagcuggcggggcgcgggggugucagugugcaagcgccgcccugggagcguucccgccgccgccguugcccacccccaccccccagccuuggcgcgcggacuccacgccgcgcacacguggucgggccucgccugcuggagcgggcggcgcgcagccucggggacgcgcaguagaggggaagaaccuagucucugcauuuuucuccacucucuuaacucuacaucuugacuucuaaagccgaggauagggguuuaacaaguucagagucucuugggagccuuuccguucuccagggucuuguuagacacccuguuuaccugccccuaauugucccagggggagacguuugcuccuucuccgcucccccaccucccguacugucccccgcggacacugaaagcugaaggcugaguucugcgggccuaggaagcaggggcgcuguugaugugagaagagucgggaugcccccagggcguugcaagccggugggacacaguaagaccuauagaagaacggggaggacgccuuucugcggagaaguaggaggcaacaaggagaugacauggagggcugaauggaaacucccugaaggagcagggcacacaguccccagaugcuagcccaccccacgcugagagcaggagggggguaacccucgaggcgugguuagcagcuggggccuaugugcaccucccucgcugcuaggcuaaguaggaugacagauucaauuaaagagguugugccuaacagacaggucgggucuccuaggaguuaugguuugggauuccuggcacccggccuucugcucucuccaccagauaccaacuggauacagcuaccuugccagcagguuuugaaccaaguggccagguuuuuuuuuuuuuuuuggggggggugcauuucuggggcuuuucugccgucaaucacagagauagguaagaggaggcuucuucucuugucgcugucacacagcaaccacuaaauauacccagcucaccgucuugaggaaacugaggcaccaccuguaggaacaucuuuggaguuggcuuaaaauccacuguaaugggugugugguuggaagggauggggcagcugcagggaggagcugcuuccaaaucaaaccggauacacgggugaggccaagggaacaaggccccaggggagcuauggggcugccccaggccugccaccaugugcuggcuagcuggccgcccccuccccagguccuuagggaaggaacaggagccuaggguuuaggguggacacacaaugcauggguggugccugggagcaaucaggccuugucuaacccguuuuccugcucccagcgccccgucgagacuccugcccaccugagugccagggacagggaggggccugagugacccaucacucccaugggaaccaagugggacugguggcauuccugaugacucaagaaggcugugcccguucuuacuagagaguccaaacaccagcuguuacccaucugccucguuccuagucuuggggaccgggcaacacaaguacagccaacgauguuggguaaugacagggaggacccucaaggccucaucccaagaagaggccuccaagaucauuucccuaaugugucuaauuauuguuugugaaacaagguucugcuuggugacauggggagccaguucuuucccucagugaguucucagggucuagggaccccgauggauugacauuuuacccuguggcccaugcuucccugugcccacaacagucccauagcacuaccaacaugugugcauacuugccuuaaagaaguuaaagacgacuucuacccgaucuuccacacguguggauugagcugccucugacucccuacaccguucagugccaccacaaaggauguccacagcaacacuuagaugggacugucaggcaggcgagacuuccagggcauccagaucugcuucucugucgcagagacucaucuggaauguggcagacacagucaucuugucuaggcgcugugcuauuguuacucugccuauccuggggguuggggggggggggcaguggcaucuagguggagaaagauguggaaugaagcagaaguccuagcaagaugacaggucaaacccgagcucuucagcucccuggucugugucagguuauuggggaccuaaugguuuauggccucaggauggagggaaauaggacucagaagcacaaagauagaggucuugucauguaggagauacagggcaaaccccugagauuguugggaccagcuaaaacuggcauaggcgcagcacacaugcaaucuagcucuucugagugucugccgcuugugagugggugguggacauuuuuguguuggugccauagagcuugugcaugcaugugcgugaagcugccauacauguguguaugagggcaaguccugucggacugaccugggguggaccugcagcagcaaaaggcauucugggagaagagagaagggaagagagagagagagagagagagagagagagagagagagagagagagagagagacagcgcgagagagcuuggguuccaaggaagggaucucucuacuuucacccuacccuuccauucauuccuucagucccuccucuggccugcugaauuauggggaauggucuaaggaaauccgggccuaggucugggagucguuggggccugugcguuucuguggcaaccagagcuagguuccuucuuuucuccgccccucucccuuuccucuccuuccuuaggagguaggccaggcuuccuugugcuuuugcuacccucugguggccaccaggggaaagacaggcccaaaaggagaggacacaagggacuggcacacuagaccacaggcacagaaaugggcugagaaaagauuguagaaaaagccaagagagugagggacugaaguguuaugaucaaaauauauauauaguguucuaaugaagguccgugggguguugacaggguguugacauggaaagccuuggagcauuggaguuucuucucugacccacuucauuuguccacagccugcggcgagagggcuacaccgugcaggugaacgugaacgacuaucuggauauuuacuguccgcacuacaacagcucagggccuggcggcggggcggagcaguacgugcuguacauggugaaccugagcggcuaccgcaccugcaacgccagccaaggcuccaagcgcugggaaugcaaccggcagcacgccucgcacagccccaucaaguucuccgagaaguuccagcguuacagcgccuucucgcugggcuaugaauuccaugccggccaagaauacuacuacaucugugagugccggguccugggucuucugaaugacaggguggggucccagggauccccggccagccguuguaguggucaccagggauaggcuucaggguuucagcucugagaaguugcaaggcuguggggauggggugacagucccaaauuugggucgcagagcauuucuguugggaugggcuagccacgaagucauggugaccaauguccaaagaaagauuggagcagagacuuggggacacagccggaugcgggcaauuuggagggggaugggagucuauguuaaagccgcaagggcaccaagugagugaaagaaaucuccuccccagccacgcccacucacaaccugcacuggaagugucugaggaugaagguguucgucugcugcgccuccagugaguagcgucgguuuccaaccacguccgcauccuugccucccugcuuuggggcucccuuggcuuccuggggaugggggcggagggcacaggcgaccgggauggcuccccagcuguagcagggggaggggguccuggcccugacuuuccccuccucucuccccacccgcaccccaccccgcagcaucgcacuccggggagaagccgguccccacucucccccaguucaccaugggccccaaugugaagaucaacguguugggugagucugcgcagcgcccucuuguggccacugcuggaaucgcagcccccuucccagugcaugcuucccacccacccccucccgcaugccuucccaugggacacgagcccuuccggccccucccccguggguggucacaucucuggcuccacugcugcugcugcugccgccgccgccgcgugccccccgccccagcgcacagcacagcccuuaccaguuugccuauuuaucuuuccacagaagacuuugagggagagaauccccaggugcccaagcuugagaagagcaucagugggaccagccccaagcgggaacaccugccucuggccgugggcaucgccuucuuccucaugacgcucuuggccuccuagcucugccccuuccuaugacagagagaggugggaagggcugagaaggagcagggagcuugcuguggggccuacauccuucuucccaugguugggagcggggucugcacuguacaucucucugggccugcccucuuugcccacacacucucuaggacaggcaccguaguggaucaggcacagggacagccacaggucccagguggccuguggcuuugguaauguuugguaccaaaccugggggcuauaaaggcagugcucaggacucccuggccccugguaccuuucccugacccuuggugcccucccucuuugucccccaagaggcaaauaugccccagagagaacaaacgaagcaugggaggugcccccuguccucuccucuggggcagaacauggggaggggacuaggugggugagggguggagccucaggcugccccucccccuguuuacagcaauaagcauguccucucccuccacucccacauagaggacugugguuuggauugaauccaaguuuacaaauagacaccccugggggggagcaggcaguggacaggggugggcaucggggugccagacaggcauguacagacucuauaucucuauauauaauguacagacagacagagucccuuccccuucuuaaccuugaccuuucucgacuuccccuuccagacucagaccccuuccccuaccagguuaggccccccuugggaccccccuggccccucuuuugucuucugugaagacaggaccuaugcaacgcacagacacuuuuggagaccguaacaacaaugcccccucccuuccagcccugagccgggaaccaacucccaggaccuugcccugcccacccuaagugguccccacccauccugggccuuuuucaagugcuuuggcugugacuuucauacucugcucuuagucuaaaaaaaauaaacuggagauaaaaauaccugagugugugugguuucaaggggccacgucccucuguuucacuggcugaaccaauccuguggggcucaaggcccgggugagcaggcauucuagguuagaggccacagaguggagagagggacagagcuucaaguugagcccgggugacuuugggcagguuccuuaaccuuucuaggcuccggcuucccacagggaaaguggugugaguacccgcuucccaggcccuguguacccgaguuaaggcucaggcuggugcgcucuaugcuguagucagaagcuuuuggcuggguccagggauuucaggggauuugugauccuagauaggaaaaaaaaaguuacaugguuauuuucacucaccugugacaaguuuaacauucccuuucuguacuugggcaacaggccacagcagcauaaagaguacgugugacuuuguagccaacagaaaucccagauguuuucagaccugcuuuauaucucagaauaucauuuaugugucacuacuuugaaaugaucauaguuguuagacuuuacuuguuuuuaacauguuaauaaagaaacauauauauuacauaccaaaaau

SEQ ID NO: 1506 - RNA, 3471 nt, Mus musculus
uggggggggugcauuucuggggcuuuucugccgucaaucacagagauagguaagaggaggcuucuucucuugucgcugucacacagcaaccacuaaauauacccagcucaccgucuugaggaaacugaggcaccaccuguaggaacaucuuuggaguuggcuuaaaauccacuguaaugggugugugguuggaagggauggggcagcugcagggaggagcugcuuccaaaucaaaccggauacacgggugaggccaagggaacaaggccccaggggagcuauggggcugccccaggccugccaccaugugcuggcuagcuggccgcccccuccccagguccuuagggaaggaacaggagccuaggguuuaggguggacacacaaugcauggguggugccugggagcaaucaggccuugucuaacccguuuuccugcucccagcgccccgucgagacuccugcccaccugagugccagggacagggaggggccugagugacccaucacucccaugggaaccaagugggacugguggcauuccugaugacucaagaaggcugugcccguucuuacuagagaguccaaacaccagcuguuacccaucugccucguuccuagucuuggggaccgggcaacacaaguacagccaacgauguuggguaaugacagggaggacccucaaggccucaucccaagaagaggccuccaagaucauuucccuaaugugucuaauuauuguuugugaaacaagguucugcuuggugacauggggagccaguucuuucccucagugaguucucagggucuagggaccccgauggauugacauuuuacccuguggcccaugcuucccugugcccacaacagucccauagcacuaccaacaugugugcauacuugccuuaaagaaguuaaagacgacuucuacccgaucuuccacacguguggauugagcugccucugacucccuacaccguucagugccaccacaaaggauguccacagcaacacuuagaugggacugucaggcaggcgagacuuccagggcauccagaucugcuucucugucgcagagacucaucuggaauguggcagacacagucaucuugucuaggcgcugugcuauuguuacucugccuauccuggggguuggggggggggggcaguggcaucuagguggagaaagauguggaaugaagcagaaguccuagcaagaugacaggucaaacccgagcucuucagcucccuggucugugucagguuauuggggaccuaaugguuuauggccucaggauggagggaaauaggacucagaagcacaaagauagaggucuugucauguaggagauacagggcaaaccccugagauuguugggaccagcuaaaacuggcauaggcgcagcacacaugcaaucuagcucuucugagugucugccgcuugugagugggugguggacauuuuuguguuggugccauagagcuugugcaugcaugugcgugaagcugccauacauguguguaugagggcaaguccugucggacugaccugggguggaccugcagcagcaaaaggcauucugggagaagagagaagggaagagagagagagagagagagagagagagagagagagagagagagagagagagacagcgcgagagagcuuggguuccaaggaagggaucucucuacuuucacccuacccuuccauucauuccuucagucccuccucuggccugcugaauuauggggaauggucuaaggaaauccgggccuaggucugggagucguuggggccugugcguuucuguggcaaccagagcuagguuccuucuuuucuccgccccucucccuuuccucuccuuccuuaggagguaggccaggcuuccuugugcuuuugcuacccucugguggccaccaggggaaagacaggcccaaaaggagaggacacaagggacuggcacacuagaccacaggcacagaaaugggcugagaaaagauuguagaaaaagccaagagagugagggacugaaguguuaugaucaaaauauauauauaguguucuaaugaagguccgugggguguugacaggguguugacauggaaagccuuggagcauuggaguuucuucucugacccacuucauuuguccacagccugcggcgagagggcuacaccgugcaggugaacgugaacgacuaucuggauauuuacuguccgcacuacaacagcucagggccuggcggcggggcggagcaguacgugcuguacauggugaaccugagcggcuaccgcaccugcaacgccagccaaggcuccaagcgcugggaaugcaaccggcagcacgccucgcacagccccaucaaguucuccgagaaguuccagcguuacagcgccuucucgcugggcuaugaauuccaugccggccaagaauacuacuacaucugugagugccggguccugggucuucugaaugacaggguggggucccagggauccccggccagccguuguaguggucaccagggauaggcuucaggguuucagcucugagaaguugcaaggcuguggggauggggugacagucccaaauuugggucgcagagcauuucuguugggaugggcuagccacgaagucauggugaccaauguccaaagaaagauuggagcagagacuuggggacacagccggaugcgggcaauuuggagggggaugggagucuauguuaaagccgcaagggcaccaagugagugaaagaaaucuccuccccagccacgcccacucacaaccugcacuggaagugucugaggaugaagguguucgucugcugcgccuccagugaguagcgucgguuuccaaccacguccgcauccuugccucccugcuuuggggcucccuuggcuuccuggggaugggggcggagggcacaggcgaccgggauggcuccccagcuguagcagggggaggggguccuggcccugacuuuccccuccucucuccccacccgcaccccaccccgcagcaucgcacuccggggagaagccgguccccacucucccccaguucaccaugggccccaaugugaagaucaacguguugggugagucugcgcagcgcccucuuguggccacugcuggaaucgcagcccccuucccagugcaugcuucccacccacccccucccgcaugccuucccaugggacacgagcccuuccggccccucccccguggguggucacaucucuggcuccacugcugcugcugcugccgccgccgccgcgugccccccgccccagcgcacagcacagcccuuaccaguuugccuauuuaucuuuccacagaagacuuugagggagagaauccccaggugcccaagcuugagaagagcaucagugggaccagccccaagcgggaacaccugccucuggccgugggcaucgccuucuuccucaugacgcucuuggccuccua

SEQ ID NO: 1507 - RNA, 9984 nt, Mus musculus
uuuacauaaccuuuauuaugcacugagaacuacacucacggacuccuuaacaacaauccuauaagguagaugcuauuacuuaucaucuuuauuuaacauuugaagaaguuaaaacucagagaaauuaaauaacuugccugaguucguacaguuauagaugucaaaaaucauccuggaacucagacaggcaggaggagcgacagcucaucuguguggccuccgaggaacugaguaguucguuugguggcauugccugguuccuaacaaacccuugcccaccucaggcccuagcuugucaccccaauacccugugaaguggcucaaauccugcccucuuuuucucacagagaucuaaucccuggccgcccaacucuggugugguaccagccugauggcacccgaauggucagcgagggcuacagucuagugagucaggcccucuggugcuguuucaggccugggcaaaagagggaaggaagaagggaggauggcagcccuggaggaagugggaggguccugccugcccuugcuggcaagcuggacucuaggguugucuggucuccccugugggcuggugcuaacuaauguggcuucccugcuguaggaaaacugcugcuaccgaggacgagugcagggccaccccagcuccugggugucccucugugccugcucugggaucagguacuguggguggguuagcuaccagggaagaggauccacacaggcagggagcugaaauacucugacucccugucuuuuuccuuagggggcucauuguccuguccccagagagaggcuauacacuggagcugggcccuggggaccuucagcguccugucauuucucggauccaagaccaccuguugcugggccacaccugugccccaagcuggcaugccucugugcccacucgggcaggaccagaccuccuucuggaacagcaucacgcucacagggugaggaggcagccugagagcccagaccccagggacgguugcugcugcugagggagccauccccauguuucagacauggugugaacacugccucgauugcuauuccuagcaacccgagaaggcaggugcugcccaaagcucuauuuuccaaggaagaaauccuaauuuucaaagauggagauuacacuacagugugaaaauuaaagugaauugauauggcaagugcuuagaacuggugccuggaacacuguaugugucagcuguuauuuaguuguuuuuguuuuuguguuucuuugucuguuugccuccugaguaacgggauuaaaggucugcucugccauacccacccauaauagguuuugauuugcuuuuguuuguuuguguuuaagauagggucucucucucucuauauauauauauauagccuuggcuguccugaaacuuaaccaggcuggccuugaacucacagagauccaccugccucugccugugcugggauuaaagcaaccaacaugccuggcuuuaguuaguauuucuuaaaaucgaaggaagccagguuugaugauacacaacuguuuccuagcagcuguuugggggucagaggcaggaggauagaguucacugccagccggagcugcacagcaagacacugucucaaaaaaaccaaaagcuugcuuuggagugggaaaauagagucccauuaugggcuucauaaucuguccuugguccacuaugggcaggucucugagcucucacacacccugugaggucuucuucaucuuaacuacucaaaguggguauggacacagcuuacccagcccuggcccugaggagaaucugccugacacaucucacuucuuauccacagcuuaagcgagauguaguaacagagacgaaaauuguggaguuggugauuguggcugauaauucagaggugaguguguugacaccauagcccucuccugcucccugccccacccccacuuuccuacauuucaagauaaccccacuccccccauucccccccccccauccccaggucagaaaguacccugacuuccaacaacugcugaaccggacacuagaagcggcucucuugcuagacacggugagucuggggcuggguaggaggcccagcccucccuuacuguggcccuagccccaucacuaucuuacugcggccccgccccuuuucugagccugggcccuuuuaguucuuccagcccuugaauguccggguagcccuugugggccuagaggcauggacccagcacaaccugauagaaaugagcuccaacccagcuguccugcuagacaacuuccuccgcuggcgccggacagacuugcugccucgacugccccaugacagugcccaacuggugacguaaggaucccaaacucugcuaccggggccugaugcuauccugucacggcugaguguccaucccuucaucucccgugaggcucugacaaugauggcuuuagacucugaucucucaccucugcccugcaguguaacuuccuucucuggucccauggugggcauggccauucagaauuccaucuguuccccugacuucuccggaggugugaauaugguaagcugucugcaggucuccucauuuccccauauacuucuccaguguuuggggccuuuauucacugaacacucucuucaaacuuguccagucucagagcuguggggaaagaaggcagagggccacaaaguggccuuuacuugucacagaacuuguguguggccaguugauuguagaauacagaguugucacuuaugacaucuuugcauuucuagggggaaagaggcccaaaggcagaggugauauuugggggauauauauauaucuggcacccaggccuggacucuccuacuuuagucaauuaaggaggaaucaguauccaaggcaguggaugaggaggggacgggaauagucaggguaggcugaccauuguguugaguccaggcugggguuggaccugggguaucucccuccccaaugauaggaccacuccacaagcaucuuaggcguugccuccucgauugcccaugaauugggccacagucuggguuuggaccaugauucucccgggcacagcugucccuguccagguccagccccggcuaagagcugcaucauggaggccuccacagagugaguaacuggggguggggugaggugggggaugggauguuaggguucaugaggguaaggcaaggugcgagagccucugccuagcucgccuggcugcuuuccucagcuuccuaccagguuugaacuucagcaacugcagccgacaggcccuggaaaaggcccuccuggaaggaaugggcagcugccucuucgaacggcaacccagccuggccccuauguccucuuuguguggaaauauguuuguggaccccggagagcagugugacuguggcuucccagaugugagccccugaccccaaagccuugcccgcacccaucuguguccucgcucucguuauucagcccugaguuuccuguguagcuuucuggcuuugaggggccggcucucguucacuccgugccuuugauaccuggguuugcucccuggguggaccggagggcuugugugcaggcacugcugugagacucaggcccccucugaacccuugccugcaggaaugcacugaucccugcugugaccauuucaccugccagcugaggccaggagcgcagugugcaucugauggacccuguugucaaaacugcaagguggguauggaccugggacuagcccccgccaccgagcuaaccugccaggugccaggcucaaagacucauccugagcucugacccugagcuccuggcugacccugcccaguaccuacuuugaugcucacuacccuccacaguugcacccagcugguuggcugugccgcccucccacagacgauugugaucugccugaguucugcccaggagauagcucucagugcccgucugacaucagacuuggggacggugagccuugugcuaguggagaggcuguguguaugcaugggcgcugugccuccuaugcccggcagugccagucacuuuggggacccggggcccagccugcugcgccacuuugccuccaaacagccaacacucgggguaaugccuuugggagcugugggcgcagcccuggugguagcuacaugccuugugccccuagguaaguggggaaaaaugggcuuuuccugaguuugugggcaccuuggcgcuucuucuaccaacccuucuggccuuucucccuacccccagagaugucaugugugggcaacugcagugccagugggguaggagccagccucuguugggcucaguccaagaucggcucucggagguccuggaagccaacgggacacaguuaaacugcagcuggguggaccuggaccugggcaaugauguggcccagccucuucuggcucugccuggcacugccugugguccuggccuggugaguagccugggcgauugagaaugggugggaagcagccucugacccauaacaagccagauucuucaggccaaacagucuuguuuccccacccagcuucgguuucacgucuguaaaggggagccucacaguccugcaggccccagucccucuaaggcuuugagaaugugaucuuugcucuucucucuacggagcaggugugcaucggccaccgaugccagcccguggaucuccugggagcacaggaaugucgaagaaaaugccacggccauggggugagcugguguggaagagaugaagggggaaagcgagcccacugaagggaaaagucuggacuuggaagcagacagaccucgguucccgucuuugccacuucccaggauauuuuauuagccuucuugggcuguuuccucuuccaaguggacauaauaaugguacccauauccuggagggccugaaaguggcuaacuagugaccagcauauuaaagguauuaacuuagucgggcggggguggcacacgccuuuaaucccagcacuugggaggcagagacaggcggcucucugaguuugaggccagccuggucuacagagugaguuccaggacagccagggcuacacagagaaacccuaucucaaaagacaaaaacaaaaacaacaacaaaagcauuagcuugcuggcauuuccccuggcacggauaaagacucccccucuccaggacugccugucuacccauccuccgaagcauuccugacagucugagaagcuuuaggggauaaaaaagaauucuugaaaagccggcaguggugguacaugccuuuagucccagcacuugggagguagaggcagguggauuuccgaguuugaaggcagccugcucucuagaacgaauucuaggaaagucagggauacacagauaaauccugucuugaaaaacuaaagcaaaauaaaacaaaaaggaaagccauacacagggaagugguccuaucugacagacgcccucauugcuugccuuuuguccuucuaggucugugacagcagcgggcacugccgcugugaagagggcugggcaccuccagacugcaugacccagcucaaagguagcuagaggaugggcccgggguauugggaagcucugaccaucuccucucuccuucguccccuuccugaccccuuuacucucugucccuugacucugugacuccugaaggugucucugguuccucagcaccucacuuccucccuaucccugcuccucucucaggagagaguucuuagccagacccacccucaguuuggaccucucuccauagcaaccagcucccugaccacaggccugcuccucagccuccuguuguuauugguccucguacuacuuggugccagcuacuggcaccgugcccgccugcaucagcggcucugccagcuuaagggauccagcugccaauauagguaugaacauccugucccugcugcuguuuccuucagucagggacaguccuggagcccugauucuaaaggccccaagacauucaguccuuaccccuugcuucuaaguuccaacucucagauccugaguuuccugacuaccauuccuacacaccuaccugucaucucuguguauuucccuuaacuucacccccagauacaagggccacuucucucaggaccccaaggcaggggaaagguagccuucuuccaggaugcucaagcacacacaacuacccuccaagggccaaaggguucaauucucccagaucagcagguagguggcuagucccauuuuuuucuuuggcuuucuucauacucagggcaccccaauccuguccuccugaacgaccaggaccuccacagcgggcacagcagaugacaggcacuaagguaagcccuggaugccagaggaaagaggaguccacauuacuuguuaacucgggccuuagagguagcacuaaggguucaagacucagaaagacuuggaguacucagucaauccaaggacucaggaccaguaaguagcaggcagagaaacaaggacagccagagugggugagccagucaccaccagaaggcucugcugagcucuuucagcuggcccaaucaguggcuuugagagaugguucuauccaugcccuucacagcgaccagagccaugggauaauggggccuugugcaaaaggaccuuccgugugcuaagaucugauaaggcccaggacaucaugugugaaaggaugccaagugcccagggccuaagcccucuaccuuuaauggcaagaggguguguauggagucagccugcauguccccuccagcacaugccacuccccgcaugcagcucagugaccucacugccucuggggcccugcugcccucucugaacacuaaccccuuucugcccacaucugucuguuuccucuugccuacucugccugucugcuccuccugccuucucagcaagcuaguguggucagcuuuccagugccccccuccaggccgcugccaccuaaccccgugcccaagaaacuccagguaaaucugggcugggccuugcccuggcucaggacaggugggagguguggugcccaaucgcaguucucaucccugcuuccccccagugguguucuucauuaggagaccagggugcccccucagccuucaaagucccagaugcagcaaagggugagccucccgccauggucucuacuaccaccugguggucuauaguaggacugcagccauccagggacuccgugaucgaucugcaccuuccuuccccggggcucugcgcaugcucccguuuuccucuggacacucccacccccacccucggcugaguuugcaugucgaccccuggguagugucugcacgcucacuaccuuggaccaugcuuuccaagccacugcuccucucuuuguucaggcugcgcuggcugaccgauccaauccccccacucgcccucugcccgcugacccuguggugaggcgcccaaagguaacagugagggggaacaggacauugccucuccuaccuagagcaaugguggcaaugggagacagguugccucccucugugccugacggcauguaucccaguggcaccuuugguagugacagguuuguuuggagacaaaagugaccacuagcacggcucuuagaaccccuacauugugggugagaaacaugaccucuuuccaaacuggccuucuuucucagucucaggggccuaccaaacccccacccccaagaaagccacugccugccaacccacagggccagcacccaccaggugaccugccuggcccaggagauggaagcuugccgcugguggugcccuccagguaggugaagaggguguugcugagguuaagugacuugcugccagcgaggcaucuaggcaggaguucugaccauuuuccuucuuggcuuuucuaaacuccaggccagcuccaccacccccugcagcaucuucgcucuaccucugaccucuggagauuuggcugccuccuucucaagcucuaagacucaaagaaauggaaccucugccccaaacacuagagaagcaggagaacagacaaucugguguccagcccuaaagaaccaccaggcgcuguuaagcaauaccuggggacgcacuaaaauagcugcagcgggaugcuggggaggggccgaagccggggcuggaguagguggcggaaggacauggacacugucuaucucugcucuguuguaauaaaugugagaucuuggaaugugucugcuccuggaagcuggguaguuccugcuguuugcaggucuggccacuaggagacgcugcugggucaaaccagggccuguagaauaggaucacuucccagaaagggucaacaagaaugugucacuuaggaugccucuggcuugcuucugcccagucuggguccgauggccucuggacucccaaguucuccccagcaaugcugcucagcccccaccacagcuagagacaaaugaccuaagucgucagaccugcauccccacccucugaccaguggcugggaaaauggaucuaacugguguucucagagcccugagccuggguggagcagggcagcggcugcuuggauuccaaggcuucacaccugccuccuccacuucccugcccccaccugaagguuccagaacaaaggugcuuugugcuuuguacugauugcuaccaccucaucauuuagaccucaggacugaggacuccugggagagaggugugugcggauaaggggcaggcugugucccacaauggucacccagcacgaugcucuagaggaaugucagggguguccccagagccacuucaguccuuccccuuguaccaucugcgugugcaaagcaaaagaacaaugcauggaagguaauucugcuucagccuccaaaaguaucugggguaucaggugcuggccaucaugugugugugugugugugugugugugugugugugugugcgcgcgcgcgcgcgcgcacggcaccuauguacacacuuuccuacccccaaauaggaacuugcugugugcugacuagaaugcuggauucuucuauggguguacuucaugugccauccagcucugaccucccagacuucaaugaggcuuucuaccuugaaccaaugaagacacaaaggacaagaucuaaacauaaaccgaaccggcccucuuagguggugcugcaugaaccccguggcuguaaucccagcacuggagaggauagagcaggaggaucauugccagucugaggccagccuggcuuauaauagaaguuccaagccagccagacuuuaguguuaagacccuguuuuaaacaaaauaaaguacaacauaggauuugaaagaagacagccuugguaaagugcuuaccugaguuuggauaaccagcacccguguaaaaagcccuaaguuuagugguuuauuucuguaaccccuccgugggugggaggggugagguggggcuaggaaacaggagcacccccuccuaccccgaccccaagcuuacaggacugcaagccaagccaaucaggguucagugagagacccugucucaaaaaauaagguggagaaggaauagaagcgccgacacguacacacacauagaaaaccaaaacccucaagcauuaaguccuuaguggaauauccaccaugccacccucuuccagcacagugagauaacaaagggacgcuuuggcuaaccuggagcgcucggggcacaggaagcacaaaggguuaacaagaguuggcgcugaguagagaggcggagacaaguuuucauugguggaaaguuacccagggcuguggucuaggagccuccacaccccuccuccguuccguaccccccaccccccuccacuuuuguaccuuucucgccgggacagagaagugggccgggaccagccgggccagaccagacuggaccccaggggcgaugcggcugcugccccugcugcggacugugcucugggccgcgcugcucggcucgcgccugccggggugcuccagccuccgccacccaaucuacuggaacucc

SEQ ID NO: 1508 - RNA, 11489 nt, Mus musculus
cggggcggggcggagccucagacggggcggggcggggccuaguugcugcgcugcaccgagcugguguccggcggggccguggcugcuccuccacgcguagccccgcaccugcugccccaguccagcccggagcuccgcggccaugcggcuggcgcugcucugggcucugggacuccugggcgcgggcagcccucggcccuccccgccgcugccaaauauaggugaguucccaggacagugggucgaggggaugauuuggaaagagguacaaggaaacccggaggcaaugggguguuggggucugccggagccuaaccagagggcagccugcgugaucugcggaccaaagccuagggccagguaauuuggagaacgaaaggaagaggaggauggggaggaggaggaggaggaagaggaggagggaggauggcguccucuguccugaagucccgaguuaucccugcagacacuuuugagucucaggcacugaagagcgugcgcgggggguggggguggggcgcucagaucauggaaagagucacuccuuaggacugacgucuucgucucucuagugccuagcugacaguucuacucaaugaagugcccggacuagcuagugggguuuuagugaaaaggauuauuuucagccguucauuccagaccugggcggccagcaccgcucacucgggugcgguugccaccagaagccuggcggagcgggaggggcccggaggagccaggggagggagcuuucgccaggaaagagacugggacaccaacuccuccuuggaacuuucacuucccgcugcugucuugggcugggggccgagaggguaggcggggguggaguguccggagaggagagggccauuguuggggggugcuggcggaggaagcggaggcuguugggaacgggugcgccugacugggcaucaaggcuguuuagggaggucagaguguuugcacugcucacccaaagauggguguucccggcaggcaucucuacugugagggaaaaggaagggcaagugggcacuaggccacagacuucucuuagaccuaagaaagggcauuccugauuggguggggagugugauugggaagggaugggaacaagggagggcccccgugaaaaucuugggauuggccaaagggaaggcaaggaggagcugcaagcuggauacucugaacuuuggggacuuaugggugaaauccguaaguuggggaaaaaaaaaccccuccuucccauauccuccuuuaaauccuggcacacacugcaggaccgcuuaagucacugauauagccuucugugcugagggucggugggucugaggacacuagugauuccagccuugcuagggauuuccucagcaaucucuuaggauguucugggacccugcaggaggcacugaggaagagcagcaagccagcccagagaggacgcugaguggauccauggagagccggguuguucaggacagccccccaaugagccuagcagacgugcuucaggugagggacagccugcuaauaagauuuucucuuuccucgcacuccacaguauuaaucaucuugaggguaacagguccauccggguccugcuccuuuccuucaagcccccggcuacacucagcuccauccccucugcacauacgugucugccucggccucagccugucuguccaucacguacacugggagaguucugacacuaagccuccuccuuuccacucacacuguucuuuuuuucaguaagggagagauuuggaaagggacagacagacagauacacacuuucugaagcugagucagaggaagggcuggggccugugcuggguccuucaugaugcuuccucucugggcaggaagccgagaagggguggcucagauaccuuccuugaccuccccacauaagccccuagaacaaugcccaggccaggcaggguuuccuggacccucccaugggaucccccaaccagugaccuaaucacugguacucuccugagagccugagguuuucugauuuuauaggauagaaguugugggcagggauaggggaggugacaugccucugguguccacagacugguuuaccugaggcccugaggauuuccuuggagcuggacagugagagucauguccuggagcuucuacaaaauagguaagguggcaggcgcgaauaauuacugggaggugauuuacauaaccuuuauuaugcacugagaacuacacucacggacuccuuaacaacaauccuauaagguagaugcuauuacuuaucaucuuuauuuaacauuugaagaaguuaaaacucagagaaauuaaauaacuugccugaguucguacaguuauagaugucaaaaaucauccuggaacucagacaggcaggaggagcgacagcucaucuguguggccuccgaggaacugaguaguucguuugguggcauugccugguuccuaacaaacccuugcccaccucaggcccuagcuugucaccccaauacccugugaaguggcucaaauccugcccucuuuuucucacagagaucuaaucccuggccgcccaacucuggugugguaccagccugauggcacccgaauggucagcgagggcuacagucuagugagucaggcccucuggugcuguuucaggccugggcaaaagagggaaggaagaagggaggauggcagcccuggaggaagugggaggguccugccugcccuugcuggcaagcuggacucuaggguugucuggucuccccugugggcuggugcuaacuaauguggcuucccugcuguaggaaaacugcugcuaccgaggacgagugcagggccaccccagcuccugggugucccucugugccugcucugggaucagguacuguggguggguuagcuaccagggaagaggauccacacaggcagggagcugaaauacucugacucccugucuuuuuccuuagggggcucauuguccuguccccagagagaggcuauacacuggagcugggcccuggggaccuucagcguccugucauuucucggauccaagaccaccuguugcugggccacaccugugccccaagcuggcaugccucugugcccacucgggcaggaccagaccuccuucuggaacagcaucacgcucacagggugaggaggcagccugagagcccagaccccagggacgguugcugcugcugagggagccauccccauguuucagacauggugugaacacugccucgauugcuauuccuagcaacccgagaaggcaggugcugcccaaagcucuauuuuccaaggaagaaauccuaauuuucaaagauggagauuacacuacagugugaaaauuaaagugaauugauauggcaagugcuuagaacuggugccuggaacacuguaugugucagcuguuauuuaguuguuuuuguuuuuguguuucuuugucuguuugccuccugaguaacgggauuaaaggucugcucugccauacccacccauaauagguuuugauuugcuuuuguuuguuuguguuuaagauagggucucucucucucuauauauauauauauagccuuggcuguccugaaacuuaaccaggcuggccuugaacucacagagauccaccugccucugccugugcugggauuaaagcaaccaacaugccuggcuuuaguuaguauuucuuaaaaucgaaggaagccagguuugaugauacacaacuguuuccuagcagcuguuugggggucagaggcaggaggauagaguucacugccagccggagcugcacagcaagacacugucucaaaaaaaccaaaagcuugcuuuggagugggaaaauagagucccauuaugggcuucauaaucuguccuugguccacuaugggcaggucucugagcucucacacacccugugaggucuucuucaucuuaacuacucaaaguggguauggacacagcuuacccagcccuggcccugaggagaaucugccugacacaucucacuucuuauccacagcuuaagcgagauguaguaacagagacgaaaauuguggaguuggugauuguggcugauaauucagaggugaguguguugacaccauagcccucuccugcucccugccccacccccacuuuccuacauuucaagauaaccccacuccccccauucccccccccccauccccaggucagaaaguacccugacuuccaacaacugcugaaccggacacuagaagcggcucucuugcuagacacggugagucuggggcuggguaggaggcccagcccucccuuacuguggcccuagccccaucacuaucuuacugcggccccgccccuuuucugagccugggcccuuuuaguucuuccagcccuugaauguccggguagcccuugugggccuagaggcauggacccagcacaaccugauagaaaugagcuccaacccagcuguccugcuagacaacuuccuccgcuggcgccggacagacuugcugccucgacugccccaugacagugcccaacuggugacguaaggaucccaaacucugcuaccggggccugaugcuauccugucacggcugaguguccaucccuucaucucccgugaggcucugacaaugauggcuuuagacucugaucucucaccucugcccugcaguguaacuuccuucucuggucccauggugggcauggccauucagaauuccaucuguuccccugacuucuccggaggugugaauaugguaagcugucugcaggucuccucauuuccccauauacuucuccaguguuuggggccuuuauucacugaacacucucuucaaacuuguccagucucagagcuguggggaaagaaggcagagggccacaaaguggccuuuacuugucacagaacuuguguguggccaguugauuguagaauacagaguugucacuuaugacaucuuugcauuucuagggggaaagaggcccaaaggcagaggugauauuugggggauauauauauaucuggcacccaggccuggacucuccuacuuuagucaauuaaggaggaaucaguauccaaggcaguggaugaggaggggacgggaauagucaggguaggcugaccauuguguugaguccaggcugggguuggaccugggguaucucccuccccaaugauaggaccacuccacaagcaucuuaggcguugccuccucgauugcccaugaauugggccacagucuggguuuggaccaugauucucccgggcacagcugucccuguccagguccagccccggcuaagagcugcaucauggaggccuccacagagugaguaacuggggguggggugaggugggggaugggauguuaggguucaugaggguaaggcaaggugcgagagccucugccuagcucgccuggcugcuuuccucagcuuccuaccagguuugaacuucagcaacugcagccgacaggcccuggaaaaggcccuccuggaaggaaugggcagcugccucuucgaacggcaacccagccuggccccuauguccucuuuguguggaaauauguuuguggaccccggagagcagugugacuguggcuucccagaugugagccccugaccccaaagccuugcccgcacccaucuguguccucgcucucguuauucagcccugaguuuccuguguagcuuucuggcuuugaggggccggcucucguucacuccgugccuuugauaccuggguuugcucccuggguggaccggagggcuugugugcaggcacugcugugagacucaggcccccucugaacccuugccugcaggaaugcacugaucccugcugugaccauuucaccugccagcugaggccaggagcgcagugugcaucugauggacccuguugucaaaacugcaagguggguauggaccugggacuagcccccgccaccgagcuaaccugccaggugccaggcucaaagacucauccugagcucugacccugagcuccuggcugacccugcccaguaccuacuuugaugcucacuacccuccacaguugcacccagcugguuggcugugccgcccucccacagacgauugugaucugccugaguucugcccaggagauagcucucagugcccgucugacaucagacuuggggacggugagccuugugcuaguggagaggcuguguguaugcaugggcgcugugccuccuaugcccggcagugccagucacuuuggggacccggggcccagccugcugcgccacuuugccuccaaacagccaacacucgggguaaugccuuugggagcugugggcgcagcccuggugguagcuacaugccuugugccccuagguaaguggggaaaaaugggcuuuuccugaguuugugggcaccuuggcgcuucuucuaccaacccuucuggccuuucucccuacccccagagaugucaugugugggcaacugcagugccagugggguaggagccagccucuguugggcucaguccaagaucggcucucggagguccuggaagccaacgggacacaguuaaacugcagcuggguggaccuggaccugggcaaugauguggcccagccucuucuggcucugccuggcacugccugugguccuggccuggugaguagccugggcgauugagaaugggugggaagcagccucugacccauaacaagccagauucuucaggccaaacagucuuguuuccccacccagcuucgguuucacgucuguaaaggggagccucacaguccugcaggccccagucccucuaaggcuuugagaaugugaucuuugcucuucucucuacggagcaggugugcaucggccaccgaugccagcccguggaucuccugggagcacaggaaugucgaagaaaaugccacggccauggggugagcugguguggaagagaugaagggggaaagcgagcccacugaagggaaaagucuggacuuggaagcagacagaccucgguucccgucuuugccacuucccaggauauuuuauuagccuucuugggcuguuuccucuuccaaguggacauaauaaugguacccauauccuggagggccugaaaguggcuaacuagugaccagcauauuaaagguauuaacuuagucgggcggggguggcacacgccuuuaaucccagcacuugggaggcagagacaggcggcucucugaguuugaggccagccuggucuacagagugaguuccaggacagccagggcuacacagagaaacccuaucucaaaagacaaaaacaaaaacaacaacaaaagcauuagcuugcuggcauuuccccuggcacggauaaagacucccccucuccaggacugccugucuacccauccuccgaagcauuccugacagucugagaagcuuuaggggauaaaaaagaauucuugaaaagccggcaguggugguacaugccuuuagucccagcacuugggagguagaggcagguggauuuccgaguuugaaggcagccugcucucuagaacgaauucuaggaaagucagggauacacagauaaauccugucuugaaaaacuaaagcaaaauaaaacaaaaaggaaagccauacacagggaagugguccuaucugacagacgcccucauugcuugccuuuuguccuucuaggucugugacagcagcgggcacugccgcugugaagagggcugggcaccuccagacugcaugacccagcucaaagguagcuagaggaugggcccgggguauugggaagcucugaccaucuccucucuccuucguccccuuccugaccccuuuacucucugucccuugacucugugacuccugaaggugucucugguuccucagcaccucacuuccucccuaucccugcuccucucucaggagagaguucuuagccagacccacccucaguuuggaccucucuccauagcaaccagcucccugaccacaggccugcuccucagccuccuguuguuauugguccucguacuacuuggugccagcuacuggcaccgugcccgccugcaucagcggcucugccagcuuaagggauccagcugccaauauagguaugaacauccugucccugcugcuguuuccuucagucagggacaguccuggagcccugauucuaaaggccccaagacauucaguccuuaccccuugcuucuaaguuccaacucucagauccugaguuuccugacuaccauuccuacacaccuaccugucaucucuguguauuucccuuaacuucacccccagauacaagggccacuucucucaggaccccaaggcaggggaaagguagccuucuuccaggaugcucaagcacacacaacuacccuccaagggccaaaggguucaauucucccagaucagcagguagguggcuagucccauuuuuuucuuuggcuuucuucauacucagggcaccccaauccuguccuccugaacgaccaggaccuccacagcgggcacagcagaugacaggcacuaagguaagcccuggaugccagaggaaagaggaguccacauuacuuguuaacucgggccuuagagguagcacuaaggguucaagacucagaaagacuuggaguacucagucaauccaaggacucaggaccaguaaguagcaggcagagaaacaaggacagccagagugggugagccagucaccaccagaaggcucugcugagcucuuucagcuggcccaaucaguggcuuugagagaugguucuauccaugcccuucacagcgaccagagccaugggauaauggggccuugugcaaaaggaccuuccgugugcuaagaucugauaaggcccaggacaucaugugugaaaggaugccaagugcccagggccuaagcccucuaccuuuaauggcaagaggguguguauggagucagccugcauguccccuccagcacaugccacuccccgcaugcagcucagugaccucacugccucuggggcccugcugcccucucugaacacuaaccccuuucugcccacaucugucuguuuccucuugccuacucugccugucugcuccuccugccuucucagcaagcuaguguggucagcuuuccagugccccccuccaggccgcugccaccuaaccccgugcccaagaaacuccagguaaaucugggcugggccuugcccuggcucaggacaggugggagguguggugcccaaucgcaguucucaucccugcuuccccccagugguguucuucauuaggagaccagggugcccccucagccuucaaagucccagaugcagcaaagggugagccucccgccauggucucuacuaccaccugguggucuauaguaggacugcagccauccagggacuccgugaucgaucugcaccuuccuuccccggggcucugcgcaugcucccguuuuccucuggacacucccacccccacccucggcugaguuugcaugucgaccccuggguagugucugcacgcucacuaccuuggaccaugcuuuccaagccacugcuccucucuuuguucaggcugcgcuggcugaccgauccaauccccccacucgcccucugcccgcugacccuguggugaggcgcccaaagguaacagugagggggaacaggacauugccucuccuaccuagagcaaugguggcaaugggagacagguugccucccucugugccugacggcauguaucccaguggcaccuuugguagugacagguuuguuuggagacaaaagugaccacuagcacggcucuuagaaccccuacauugugggugagaaacaugaccucuuuccaaacuggccuucuuucucagucucaggggccuaccaaacccccacccccaagaaagccacugccugccaacccacagggccagcacccaccaggugaccugccuggcccaggagauggaagcuugccgcugguggugcccuccagguaggugaagaggguguugcugagguuaagugacuugcugccagcgaggcaucuaggcaggaguucugaccauuuuccuucuuggcuuuucuaaacuccaggccagcuccaccacccccugcagcaucuucgcucuaccucugaccucuggagauuuggcugccuccuucucaagcucuaagacucaaagaaauggaaccucugccccaaacacuagagaagcaggagaacagacaaucugguguccagcccuaaagaaccaccaggcgcuguuaagcaauaccuggggacgcacuaaaauagcugcagcgggaugcuggggaggggccgaagccggggcuggaguagguggcggaaggacauggacacugucuaucucugcucuguuguaauaaaugugagaucuuggaaugugucugcuccuggaagcuggguaguuccugcuguuugcaggucuggccacuaggagacgcugcugggucaaaccagggccuguagaauaggaucacuucccagaaagggucaacaagaaugugucacuuaggaugccucuggcuugcuucugcccagucuggguccgauggccucuggacucccaaguucuccccagcaaugcugcucagcccccaccacagcuagagacaaaugaccuaagucgucagaccugcauccccacccucugaccaguggcugggaaaauggaucuaacugguguucucagagcccugagccuggguggagcagggcagcggcugcuuggauuccaaggcuucacaccugccuccuccacuucccugcccccaccugaagguuccagaacaaaggugcuuugugcuuuguacugauugcuaccaccucaucauuuagaccucaggacugaggacuccugggagagaggugugugcggauaaggggcaggcugugucccacaauggucacccagcacgaugcucuagaggaaugucagggguguccccagagccacuucaguccuuccccuuguaccaucugcgugugcaaagcaaaagaacaaugcauggaagguaauucugcuucagccuccaaaaguaucugggguaucaggugcuggccaucaugugugugugugugugugugugugugugugugugugugcgcgcgcgcgcgcgcgcacggcaccuauguacacacuuuccuacccccaaauaggaacuugcugugugcugacuagaaugcuggauucuucuauggguguacuucaugugccauccagcucugaccucccagacuucaaugaggcuuucuaccuugaaccaaugaagacacaaaggacaagaucuaaacauaaaccgaaccggcccucuuagguggugcugcaugaaccccguggcuguaaucccagcacuggagaggauagagcaggaggaucauugccagucugaggccagccuggcuuauaauagaaguuccaagccagccagacuuuaguguuaagacccuguuuuaaacaaaauaaaguacaacauaggauuuga

SEQ ID NO: 1509 - RNA, 12243 nt, Mus musculus
cauggaggagggguccagcacggcacgggccgugguccguaguaccuguggcuuuaccguggguuuguccuuggccaccgccuuugggcuccuagagcuucuaggggaaggacacagccccuuuggcugccuggugaccaccgucacuuuggcugccuuccugagcuugggcaugggguucucccggcagguccgcgucucugugcucuugcugcuuccacaggccuucuccagugagccugggagcagggcggggucggcuugggguagggagggaaguauuauaaaagccccuguuaaggauuaacgggggcccuggucuguaacugagcugucuccgcagagcagagccgguugcugcuacugguagcuuccuuugggcuggugcuacaagggccuugugcgaacacccugcagaacuucacccgggcaagugaagcuguggcuuguggggcagagcuggcccugaaccagacggcugaaaugcuggagcgggccaagcagccccuuaucaguaaggcccaccucagccuaaccauuggcucccauccugcagggcuugugcuuaguugcuuucugcuggaauuguguccuacccuaagaguggcuggaccuggaaagccacuuucuaguccagcuaaauccucuuccccuugcccuccagccuccuccucuaccuggucauuuucacagcccagcacccaggcucccugauggcucugauagcccccuuuuauucccuccccgccacccaaggaaauggugagacucucagcuccugcaggacgacgccuauagcaauguugcccuuuguccuucaggugcucugucuaagauuaaagcuauugcccagaaggccaaaguggugggugaccggauacgcaaguucuuccgguccauuauagaugccgugaaacacauagguagguguguugcauguuugguuugggaggucaaaaugcccccaaucuuauuauccuaagugccuuuccaggacugcucaggucucacuccacacagcauaucugaccccugaccaguucugugugugugugugugugugugugugugugugugugguggugguggugguggucguggugguggugguguuuguguuacugaagucacugaaaaaggcuggucuaaauuauauagaauggcccucggggaggggggguuguccagcacagcacgggcuguggucugaaguaccuguggcuuuacccuggguuuguccuuggccacagccaggugccugcagaaugugugguauuggcuccuucauauuggugauaugugcaacuccgagcugggcaacccuuacucaaaaugcacacagguguuugaugaugccaagauccacuguaugaaggucguuucgggauucccucaccuguguuaugcgcucuugcccuacaaacugcuggucuguggacuugccagcugugagagagccggggcuccccugcaggggagggggaggggaugugagacuguaggaucggucagagggugggcacaggggauauccuacaagagguguugaguguggggcucauaaggauucuggggucagggagggaaagaugggaaguaaggaaggaccaaugcuaagaaagcagaguagagaaaggcccaaaacuguuagcaccuguagagaaaggcagaaaguccagacggucccuugagaaguaguuucccuaggggugggcaggcgggcuggcuccuccugacccucagcuccccugccucucagugguccagaaauucugugucuugccuuccuaccucgaauuuuuccugcgaacggucauccgcacucgugagugacaccccaaccccgaccuccuucugccaguguucgccucgucuuacugcggccacuggcgcugaagucucccaguccauccauagugggaaugcaagagcaggaugggacuuugcagggucacccagacuaaugucuaaguugaucugauugagaaacugaggcccaguggguggaggaggagccucauuaaagccagacuccagagcagaauccaggaggagcagggccuccccgcuggagcauaggucacgugggcugggaggaaccagagcguaggucguggcucacucgugaugaaguaggagccuuaggccaagucuagugcugugugucuggaagcugucacuguuuucuagaguaggucugggccccgggagcucuagcuugugaguccugcaacggcagagccuggacagcccccacuccgugcccucugucuuccuaacaacugucucggcuccuguccccucugaccucaccggucccagccgugaugaaacugcuuggcaagcuacgucgagaguuugaguucaacaugacagccacccacuacuucucuguggaccucaauuccucucggagccugucccagguggcuuuggaccugcaggaggcugucagcaugaaguuguacacugccagggaggcgcugucuuugaugggcuacaccaugccucugcuuauuggauuucucuacauccagugagggucaaccaagggcgagaugggcuguggggcugaccauccauggcaucuugggggguggggagaggaggggaacuggcaggaaagcauagccugggguaccuggaggucugggaaggaaagccaaggaaucucauaugugcuucuccucagagcccuguguuaccgguacuauuaucugaacuccgacaaauucgacaaugucuauauuaccaggcgcuuccuagacauggaggcaguacgcucccuugcagggaugccuacggugcugccucucaguucucaugaggccaaacacuacauccagccaggugaggaugcugaggacagaaaggaagaacucuggagcagcccgggccucccucaaccccguauaucucugacuguuuuggagcauacaggggccagagggaagagagauggcuucauucugagauggagacacagggaacaacauggcacagugaugugagguugggaaggcuuuuugaggugaaggcaggagggguggacauccuaauauggaaaggaagacugccuaggagguaggaggcaggcaagaccacagaggauccagggaugagauacugagcccaggcagagcugcaagguuuuccauguaaccaucaagcuccguccccagaagagugcucuucugggggagcaauuaaauuaagcugaacuugauacgagcaggcaccucccaagagcugggauacaugggcaggagaaucggggaacacacuucugacuaccuccuccuucagacuccauguuccugagccagcgggaacagauguuuuauaccuuggagaucuuuaaccucacccgccaucuccucaucaugcuccuccuggucuuucuggacuauggcgucuucuggcuacuugaucuggcccgguaccaccuccagggcgagauuguagcccgcaguaagugcccaucccaucccguguccacucaugccaugcauucucuucaucccuggcuccuuccuucuccugggggaaucucugaagauucaugucacugccauccacucuuccaaccucugccucccaucugggucaaggauagagcauaacagcauagcuagaggcacaagcucuaaguugaacuagucuggguucaaaucccagcccuguccuuugucagaaugugaauuuaaguaauuugcuugggagccggagcuggagccccaacacaauucaguacccugauucagccccagcacacacauccacauacaaaggacaaauugcuuaaccucccagagcuucaguucgcucaucugagcaauggagcaauggcugccgacuggguuacuguaaggagucagacuauuuuuguuuagcaccuucaugaccaauucacaucauccucuaacuuccacacaugugcugugguacauaugcccccuuagccauacacacacacacauacacacacacacaaacaugcacauacauacaaacaugcacacacacaaacaugcgcacacacaaacaugcacauacacacaugcacacacaugcucaaaugugcacacacauauacacaugcacacaagcauacgcauaugcacacacaaaugcacacaugcacaagcacacacacauauacacgugcauacauacauguauacacacauacacacaugcucgaacacacgcacaugcacacacauaugcaugcacaugcauuaauaacaagugaacaaacaaacaaacaaacaaggaaaauggaaacucaguaaaaaaguaaagcacaccuguaagccugagagugugguccugaccuguaaguccaggcuuggaggcuggggcaccuguaagccugagagugugguccugaccuguaagcccaggcuuggaggcuggggcaccuguaagccugagaguguggcccugaccuguaagcccaggcuuggaggcuggggcaccuguaagccugagagugugguccugaccuguaagcccaggcuuggaggcuggggcaccuguaagccugagaguguggcccugaccuguaagcccaggcuuggaggcugggacaggacagcaggauugagugccgagguugcauagugagacccugucuuuaaaaccaaaggaaaacauugucccuguucagccaacauuucaaugguucugggauggucauaaagauuauagcaggcagggcagugguggcgcacgccuuuaaucccagcacuugagaggcagaggcagguggauuucugaguucgaggccagccuagucuacagagugaguuccaggacagccaggaaaaaccaaaaaaaaaaaaaaaaaaaguuuauagcagugucugcuagcuggauuguaguguuaggaaggaggccagaccucaggguaccuugagagaucagagaugaagguguggguuaugccuaggaucugccuggcucuacuuuccaggcagagauuaggccauuaucuugagugucucucauaguaucuuugugccaggcccugugguagugucuauaucgguggaaggguccggcuacucagggaauauuuaccgugaccuggcgucagcguuugauguuaugcaacaaggcaacgucaguguauugucgccgcgcugcacccugcaccccucagaaccggaugcuaaggguuacaucguuauugguaucuaccucacucagagugaagaggggaggaggagagcacguggagcaggaguguggcuagugccuuggguagugcucacugugcaugugcugugcucccagguaccauguacggucugugcuucuucgucacucuguuuggcagcuaugucagcaggcugcggcgugcuaucugugccuccuauuaccccagcagggaacaggugaggaggcccugaugcuaaguugguggcuggcugucuuggcuuugaggauauugaagucccuggcagcuccagucuuuaguccucuaccaaagccuacagcaaagacugggccuuuggguggagcugggaggaaccauauccuuugagcggggguggggggcugaggccugucagugcuuccaaagcuuugcaaaaaccauagcagcagggcagugugauccacuuggguguaccauaugaugguugcugugcagggacuccacgaugaaggacggagucugguuaggcugccagacagcuauuuaaauuauuauuauugacuuuuauuuuaugugcauugguguuucgucugcauguguaacuguguaagguugucaggauuccuggaacuggaguuacaguugugagcugccauguggguguugcgaauggaacccggauccucuggaagaguagccagugcucuuaaguccugagccacugcuccagccucccacccccaccuccagacaggcguuuaaaggggauucuuuuacuuuuuaaaguuuuauuuagguauaucuuuuuuuuuuuuuccugagugaguguauuccacguguuuguggaugcucacagaggccagagguguuggauccccuagaacuggagucacagccuguugugagcugacuaauguggguucugggggaacugggggucacuugucgccccccaccuucccaaacccaggaaaggaucaccuaccuuuacaacaugcuucugagccaucggaccaacauaacggcgacagugcagcgagcagugaggcgacggucagcugaccaaggccaaaugaauauccuccaggugcuggccauccggugagccuggugugcuuuccuacagucccaggggggcaauagacagaacaagagccagaggucccaguaggugguugugccucccaaggacaagauucuugguugagaagguaucuaauccauaacuuucauauccuggagggaaaaauaaggaccagaggguuuuuuuguuuguuuguuuuaagauuuauuuauuuauaugaauacauuguaguugucuucagacacaccagaagagggcauuggaucccacugcagaugguugugagccaccauguaguugcugggaauugaacucaggacuucuggaagagcagucagugcucuuaacugcugagccaucucuccagcccaggagcagaguuuuauuuucaaaaaauguuuguuucuaucuaaugugaauggguguugggugcaugcaccaugcgcauguggugcugacagaggccauaagaaggccucagaucccuuuggacuagaguuacagaugaaccaauauccuggagauuggagcuggaucuucugaaagagcaggcagugcucuccacugggugggccaucuuuccaguccugaggauaagaugucucuuuaaagauuuacuuacgugcacgaguguuuugccugcauggauacuguguguaccaaacacaugucugguacuuguagagaucagaagaagauaugggauccccuaaaaggaguuauggaugacugugagccaucauggaggugcugggaaccaaacccagguccucugcuagagcaacaaaggauuuuaaccacugagccauuucuccagcccuaaagagcuaacgguucuugagagugaggagugaaggaaaugggggagaggccagcaauggagaaacaguugcuagagucagaaagauggugguuagggcacuggaaggccuccuucuccauuggcaguugguguggguuugggaaaggcuaagcuugacaucuguuaccuuucuucuaagguugccuuuucuaaggccauugcuuggcccguuuucgcugcagcagucuuacugcaugggcuguggggagccugaagacaaagggggcauggagaacuuuguguccugcaguaccccaggcugcagaggugaguacccccaucccucuugguacuugcacaugaugaucaaccaugguucuuccuuuauggaauuuuccuauaccuuuauaugucuguacccuucaauuucuacacaucuucucauuuacauagaacuauuacuaugcaccuucucauuuacauagcucuauuacaaugcaucuucucauuuacauaguucuauuacuaugugucuucucauuuacauaguucuauuacuaugugucuucucauuuacauaacagccuuccuuuagccccuuuccccuauaauguccuugaucccccccccccuugcacaauuuccuagugggcauacuugauaaggauggucuuuucagggcugggcuggggggguggggggcaaggccaaacacuagggagcacaaggugugagggguuagcucaagccuccuucccuccuggucuccucuaggucucuacugcccuaccuguuuccgucuccuaaacaacaccuguucuguguguucugcuccacucuccaaccaggggcaccuggaccuggagcugugagucucucagggaugggggaggggcgcugcaguaugugggggcagcgggaauaauggccuucuuccaggauaucuguaggucauugagacaguaggcuuuugcagggacuccagugaugaggagaguccucagcuguggcuggcugcagcucgaagaaaggcccccgagcaggagcugaaacuucgacaacagcuucaggaagcacugggcacgaaccuuucagacaaguccaccuccaagcccgagcgagcaggaaacaggugggaaugguaccuguuuugucacaucugcacaggcuagugucugccucaaugcagggacagagacagggacagggacaggagauagggcagaggagacugaguuucccccaaagccugcccccuugccugaguagcuuacaguguguguaguggggagagguguuucaaacuccccauccccccucaaaaaagaaaaaagaaacuucacagagcaggguguggaguggcacucggaagacacuuccagcacuaggaaggcagagacaggcaaaucucugugaguucaaggccagccaagcuacacagagaaagccugucuggggaagggggugggguggguacaaaacaaacaaaaccccaaccaaucuguaaacaaaaaagacuucacugaaaaggagagaaaugagcugggguucggggcagccugggguuuguuaggcacaggcuaagggaggcgaggaagcagagaccuuugaguuuggagaauguaaaacauuuaggaggguaaauaaagcccaagggugugugugcuugugcugggugugagaccucgcugugagaggcagggugggaaggacuggggggggggggaggcuccccuggccucgggaggaucuuagcuggcuaagggaugcaugcauucacuuuuaucucuuuucuguuuugaggcgcggucucaauggguagaccaggcuguccuggaauucuguguagaccaggcuguccuugaauuccaagagggaucuaccugcuuuuacugccucagugcugggauuaaagguggggagggccauuccuggccuuggccucaaauguuuagcaguccuuccuguuugggauuacaguaaaugcugggacuacagauaaaccacugugucugcuucucuuuuccuuagcccucuuccuuuuuccucuucuuccuccucccuuguggguucuaaccuugcacaugcaagauauggcuuuuuuauuuuuuaucuuuuuuuuuuuuuuuaagacagggucucacuaagaagaccugauuugccuggaauuccauucuauguagaucaggcuggccuugaacucagagagauagguaucugcuuuagccgaaugcugagauuaaagguguguuuacucuuaucaucaggccauucucucucucucucucucucucucucucacacacacacacacacacacacagccuaaauucuuuuuguuuauuuauuguuuguugaaaucagauuuuucuauguagccaagaauggcucaaaacuccuucccuaaggcugggauuagcuggguguuucacacccugcucaagcugguggucuucaaaguuaagugugugucuguuggggggggggaggggagagccaguuuagucuauacagugaguuccugaucaguaaggucuacauagugagauccuggcuuaacaaucagagaagucugaggcuacuuagugaguuccaugcaaaccagaucauuuuggcaagaccagaaaagauaaaaggaaggaaagaggcuaaagaggcagcugugagguaagagcacuugauagccagacagugguggcacacgccuuuaaucccagcauuugauuuagggguaagaggcagguggauagauauccaggccagccuggucuacagaguugaguuccaggacagccagauauacacagagaaacccugucucaaaaaaaacaaacaaaacaaaaccacuugggcuacuuucaggcucaguucccagcgcccacauugcagcuaacuaguaucucuaauuccaggggauccaacaccuuccucuggacuuuguggccacuggacaugcauacagaacucacacauauaaacaagcaaagcauucauaaagauaaugaauauucaaggacagagauggcaucauggcuaaucuugcuauucuuccgaagaauccguccuagcgcucauguuaaggggugagggacucaugagcugcaggcgggaucuugugugacuucugaacaagcacccacacguguggcagauacugacauagacauccacauacaauuaaaagccuuaaaguaaggagaaaugggaaauugaaucuauuacugggagcuacuggaauaggcuaaggaggcggaaagagggggacaggggcagaaccugaggcaagaggcucaagagagcaggagagcuuagcccaugaaaggcaaaccaugagcaagcugggaccaacaauccauccagagccgggggaccagacaacugguauguauggcuugugggaacauuuuucaugguuucaggauggcuaaaacuagaucacaaagcaccugacaaagacucagaaauagagaauguggcuucuaaagaggaagaugauuuaggauuccuuuaauauaacauuugcaauuaaaaagagggcuuaauuacuuuauuuauugaggcaggguuuuacuauauagccucuggcuggcccaacauaguuauauauaccaggauggccuugaauucauagagaucugccugcuuuuggcucccuauucuuuuuguuuuguuuuguuuguuuuuugagacaggguuucucuguauagcccuggcuguccuggaacucacucuguagaccaggcuggccucgaacucagaaauccuucugccucugccucccaagugcugggauuaaaggugugugccaccaccgcacagccucccuauucauacuaugugguccaugcuggccuugaacuuguaacccuucuaccucagucuccauagaaugaaaguuaugaugugcuaccaugcuuggcucuaaaaaaaggaagccugaugauaaagaauuggcuucacauacaagguacacggcaccaacagguguuucugcaucccaguacauuuaggagauggaaaagagcauugaagucuaugaaugcaguguaguagcagagugcuugugagagcacaagcucaaccuccagcccuggacuaagguaccagaggaagagcugggccaggcaauggugcaugagguagccagaggggcugcucugagacugaagaguggagacccuucuaaacagacugcagacugcuccagccucaauuucucuagggaguaggaggcaaggacaccugcugagacccgagaggugucugggagugacauaguuuucagagugggugguagagaaugaaaugucugcugugaggaagagugcaaagaaacuggcccugggaggcugagggacuuccagguagaguuaaggggcaggugauagugaagccuuuguucuuagucagaggagguuuuuuuuuuuuuuuuugccuuuggugacagggccucaauauuguaggccagguugguuugaaauguauagugacuguccucucucagcuuuuggaaggcugaucccauuguuuuccucuuguaaauaugguagccacgaguuugagaguugaagucuuuuucugggucgguaggagagaagaacggaugaguaauuucgggaacagagacaaucgccuuugagcagucggggcaauuugcugauacccuggcuggguuggagagagguauuccaguugccagguccucagagcacuaggugguagugcacgccuuuaaucccagcacuugggaggcagaggcaggcggaucugugaguuugagaccagucuggucuacagggacagggcuacacagagaaaccccgucucaacaaaacagagacagaguuauaaaaacaaagaagagaggaaaggaagaacugggauggaugccagaagggcggcaguuagggcccgagcugggacgguggcagagguuacccaccagugacuuugaguuuacugguccuuccucuccucccaggaaccaggacagaaagcagugacuucagaggaagcguccacagcaucucccagaagcucaucuggcuuugugggccuccccuuucucccagaaccccaggcaccacuucggaaaucccuguccccaaacaagaccccuccccagccucagacccucccgaccccucccacugccgccccccucccccaauaaaggaaccaaaaguggacaca

SEQ ID NO: 1510 - RNA, 7208 nt, Mus musculus
uauauauacauaauuuuauuuauguaugcgaguaugcuuucuucagacacagcagaggaaggcaucagaccccauuacagaugguugugagccaucaugugauugcugggauuugaacucaggaccucuggaagagcagccagugcucuuaacugguaagccaucucuccagcccgaaaaucauuuuaaauaaauaaauaaauaaaagucucaagcuguagcucugucccacucacuguguaaaugaggcuggccucaaacucaaagaguugccugucucugccuccugaguauauuuuuuaaaguauacuuuaggguuggcaagauggcucaguagaugaaggcacuugcugucaagccuccucauuccaauccccaggacaggacacacaugaugggaagagagaaccaacucgugcaagcuguccucugaccuccacaccugagugagugucugugugcucaggaggaaaaguaaacuucaaaaguaggcaggcuggagugugguggugaaaccuaucucagaaccaagcaacaaacaacccuacaacaaaaguaggaaagauaacuaauguuaaaggggauuauuucacauuaacuugaauaaacaggcccaagaagggaagcgauucaucccaaggucagaagaacaacacucuuuaguagaacagacauucagugcacccacguuuccacaucucaacuuuagggcuugccagguggguagcacacacacaucuaucuucccuucgauuccggaagcugacgugggcaguuugauccccggagguggagaacagcaggagcgauauaguaagacuccuauccagaaaagaagaaaaaaagagagagagagagaaucaaaaucaggauuccucguuaaccuuccuuccucaucugauugguuuaauugagccaggcaguaguggcacucagcacucaggaggcagagaggcuggcugaucuacaaaccuacucuacaaagugaguuccaggacaacuaggguuacacagggaaacccugucuugacaaacagaaaaagaaagaaagaaagaaagaaagaaagaaagaaagaaagaaagaaagaaagaaagaaagaaagaaagaaaggaaggaagaaaggagggaagggagagagagagaguuuaguggcccaggaggcagaggcaucccuccuaagcagaagcugauucccaucaaagcuccaagaucacuguguccuuuacuccucggaccaacuuaaggucccaucuaaauaccuuuugacuacaaugguuuccuuaacaagaacuuucccauuuuucuuuuuuuuuuuuuuaaagauuuauuuauuuauuauauggaaguacauuguagcugucuucagacacuccagaagagggagucagaucucgcuacggaugguuugugagccaccaugugguugcugggauuugaacucuggaccuucggaagagcagucgggugcucuuacccacugagccaucucaccagcccucccauuuuccuagaagagaaaaagacauguggcaacuuuucccaaugcucucaccccaaaagagcuacucaggccuugaacacucuaggcuucaggagccuaggacaggguggguagagaagcaagauaccaagacagagaggggaguuacugccugcccugggcuccuugaggcccucuagcaggcacaauagauaggggucucuuugggguugaaaggagcagacuagaccaacaagcuagaagugaccuucagguaucacagcaagagaaaagccuucuauccaaaaugucuguagguuacauuccagguagaaccaagggugcaaugugagagacagaguuggggguggagcacaaagagguaagaaagaaaucacaguaagaugaaucugagggccaagagggacagccccacauuuucacagcagacagagaggagaagcuggcaaucacacaucugggcacagacaccucuaggcacaaggaacaaagcucucauuugcauuucguuuacauaggaguuauuuccccaucccuacgaagaagccucuggcuucucagacuuaagcgucuuuccccagccuccuaaaaaguauccauuccaaucaguuagcuacgcacagcuccuuacuuaucuggccuggucugaagaaccgcuacccuaacccauaacuggaagggguuuaggagccuuucgccaccuaguggcagguaggaagcaggcugcgcgcagagggguucuguuuugccugucugggacguggaguuuuggaaaauguuccccggagcuuccugaagcuaaauuuaccucccccagcccuggggggcgcagagaucccagcggcgauuagcacugcgcugcagcgggcuccagccgagaggcccagaauaggcgcgcaguuauaaauagugcuacccgcaggugugggggguagucggcgggaggggguacccuuggcagccaccgccucuucagguggguugggcggucgcgguagggguucuggggggcggcgggagggagggggcugcggucugagcgcccccagcgguuuccugggcggcggguuuuucgagggaagcggaggcagccgcgggaaaggggcgggggagcagcgauuaggugggcgccuggagcagaccgaggagcugcuuucagcucagugcccccaccagaaacaagcccccagacucacuuuaggacccugacauggaaagccucgccuccagccgcacacuuccuccgggacucugcaaacuuguagcugcucaacucuucuguguacuuggaccagccagucucgaaaccaggccgccacccagagucacuauucccagccuuaguuauaaaguccuucuugcugcggcuuuuauccuucucagggcaaacaucucauucucgggguauuuacucaccuacuucucucgugcauuaaagucuagaaucuagaaaguugccugaagauguaagucugaaugugaggaugggggacgcucaccaggaagccccugcacaccccacacuugccuuccaguucuauagcagcucagguguauaugggauugauaugggggucaggggagacgccagauucccaauaagggggcgggguuccaccagcgcuucuuggccucggucucugguuuggcaguuacgacccaaagcgggggaggggauuuagacagaaauuucaaguccguguucccccaacaugaaagggaacuaauaacuauuuguaccacaaggaaaagcaaacauggaaacaugaaauggaaaagagccacuaaggaacuaacaguagauuuccagaacugcuaaagaaugauaauccagccgcagaaagacccggguugugucuagccagaagcaauuccagaggcagggguggaacaacaaagcgguucgcgucuaagucccuuagagcuagugacaagacccucacucuucuggagcccugggccacuuuccuacccucucccaaaucuuuuuccuagaucuuguacccuucucgugaaagcaguuuucccuccacuuuacuuaggugucuaguacuguugccuagcacggcuuacucccuggucagcaggacccugacaguagaaggaagggaaaaacccuaguccagacacaucuugcucggaauccuuccgacaguccugcggggccgcuaggaaaaccuggagcaaagaucagacuugaccuagggcgugcugguguugggggcgggggaaagcgggacagaaacagauaggaaaacccggaacggauugcuugagccagaguuccucaugcuagccacuggucccuauugccccccuaauucuccagugagauaaugucuggggugaggggcuguuuaguuuggcuugagcccuccggggcgccucacacuuuccgccccuggcugaggggcagagcagcggccucgaggcugagucauggggggggggggggggggagaaagagggagggaagggccgacuccaccccucccccugcuuggggaucccgggucagcccgggugagggccagggccccccuggcaccgcccauugugguccaacagguugagcugguguccugcggagccaccugcuggaaagggaaggaggcccccugcggagggagcugggaaagagaacaaguccgacccgguuccgccuggccugcugcugcgaagccgaaccugguccuagagagcgggauuugacuccguuugaaacgaguaggaggggcccuuuuggggucuauagcaucgccagcccaguuguaagcgucccucagagacuaccauucuuugggucgggcacuuaaauacgaauaccgguuuuucccaaacccacuuaagcaaacauccuaaaccacccaggucucuaucgucaccucggggucugagugaaucugcgccaagaucccuccacuguagggucucaguuucuccacuaaaaguaccggcugguugaaggcaaagcgucggggccccagagggagcgcaccucccccuuccccuucccagacucagucccuccccuuugaaaaugccaaggcagcaacgggcacuggcuagagcgcaaaggcuccuugccccgggcacuguucccuccccgcggggcgccgucacgcguggggagggacacagagugcccacagacucgacucccccgcucccucggagggggaugggccaagaggcugaagcucaaugucuagagguucucucucuuccuggggcucugaccugguuaaagccccucggcaggaccccacucuuucuaaauuuuaggucuucauccccagcagcguauccguaaccucucauaccauucccuccccagguggugacccuacagaagccccucuugaaagagaggaagucccugagggggcugcuccauucccuggccacugcggacacugucuucggccucccuccccuucugguuucuggccagcccaggcuccacccccucccuggaugaacccuaggcgcgucccacaugggauaggcggguguucaggccaauggaugggcagggcgguggcgugcaagggguggagcugggcagcagcagagggcuggacgggggucggaggcggagcuccaguuaagguggaccggaggagauagugguagaaagcagagagggagagggaucgcggcaggugaagggaguuugaaggaaagaagggaaaggaaaagggugggaaaggcucagggagcgaagcaaaaucucggagaaaagggacgaaaaggagggagggacccauaugcucccugcuggaacuagcuguuggaagagguggaaguuuauguccuuauugggcggagggagggggugccuggggggggcggaugaaaaaccaggaagugacagaggguguugcuaaggguggggggggaguuuggggguggcaggggcggggggagggaggggagggauggggggaaagcaagagagaggacaggugagacagcaggacaggugaggcgggccuugggggggggggcgaguggaagccaggugaauguacggcucuccgcggccaaggggggggcgggcaacaggaggaggcaaaggguggcggaggaggagccccccagcaacgagcagcgagccacugaccgcggccuucugaccaggaccggagcagagccccaagccccccagccuggcgggggacgcgcuucuuccuacacccugugccucugcagcuccagcgaacggacccaacggcugaaagguaagugaaccccacuuuuugucccuuggcucgggauacacuaaacucgagccuacugcaguguccuucgugcguccugugagaccccuguacacacacguacacacacacacaccagauuucaaccagucgcauucccuguagcuuuccugggucuuuggaauugguuuuaacuuggaggaaagguagagaacuauggacuauuggccuccccccaacucugagcggagggucuccagaaacuuucuuugcacuucuaauaucauacagacugugagcuacgggauggagagggggugagcugcacugaacuuaccccuacccccagucgcuuuugugacuuuagggggagaccccagacccgaccgaauggagggaauggaaacccugacggacuauaacuaggacaacgcguguccccacccacccacccagcuccgcgccccccuggcacggugggcuggacccaggccaguggcacgggggguggggggcagcgggaggaaccgcggcuugggggaaaguuaccggcuggacuauucgguuucuugcgcuuccagagccgcgucgucucuccagcgguagugcggcucagcaggacgaccccucugccccucccgcuccgcaaucacauuccggucucucaagccucaggcccaccgccaccuuuucaaagucagcuuuugcucucacaacuccagugcgagggugggugauaagaacucgaccuaccagcggucuugccgccggcgccggcgcaccugcccugagcagagugggggucgcugugugguagaaaccuagugcgcaccgcuggccgagguuggccauucagagggguggggggcgcugcuuuccauuuccagcuuucucuccccuccucccaccccacccaaguaagagagcgacguguccuggccagagcggggggggcgggagugggggggcagcgugggcagcggguugugcccggacacgugccugcccaggcgccccggcccugcuaguguuuggagagagggcggguccccugccccccgccccgcacaacccccauguaucaaagggcggcugagacguggugagaccucggggcgcccugggggggcgggggguaaggcggggagccuggguccggagcaggggaggggcagaggcgccggugcuagcugacccacaggaaacgagcacugcugaccuaguuugggacaccggaagugggugcuggggagaaggggagaccggcaagcuguccuggcuuccgggccagguggagggcguucuugaauugacccccucccgaaugccuuagagaccccuagcugcagcugagaacgggaaugagucagcgcagcuauuucuccuucccccaacuuauucccagaggaggggaccguuuaucaaggguuggggggagucagauugggaagugaggaguuaaauaaaccaagauaggaacucu

SEQ ID NO: 1511 - RNA, 11349 nt, Mus musculus
ggaagcuguccuaggacaugcggaaaggaaagagcgaaugacccugugcagggggcaaaauagaggugggaugauacgagaucagugaucugaagccuggugagaaaaagagaucucgggauagaaagggugcagaaguagguugagcccuggucauuggcggagggaggaaagaaaugcauuuaaagggacccuaaggcccagaauaagguagacauuuaaagggacaggugauccgaagagaagagacauuuaaaggugcagauauacccaagauagggcaaauuuuaaaccugcucggcagacggagauaucuaaagugguaggucuugggaaaacauggcacuuuaaaggaauaggaaucgagacguuuuuaggaaccuggggcuuaagaguauguuaaagaggccggaguaagggugacuaaagaagauugagccuuccuuccucuaggaagaagguacacuccugacgucuucauuguccuuucuggcucuuccagguucccucaaccccggaacucaggguauggccuccugcauccuguagaccuggcggccucucaguacauacggccccaauuugggguucugaguggcuacuggaaagccuugcaaaagagcacagagggcaggaccauggcaucuagggccucugaacugcccccaggaucagggcgcagcgugacagcaggcaucaucauuguuggagaugagauccuuaaggugugucuggaacggaagaggggaagaguguggcauucuauugucguggacucuuuacggugaaaggagggaaaccggaguaggaauccccuuucuugccaaaguccggcccuggagugaguccuaacacauuggaggaaaagugacccuucgguugaguguuucuguugaaagauggguaguaacuuuccuacaacuugcuacgaaguaugacugggggcagaguagccacauaacaagugacagguggcacagcaaguagaggaagcucagcaggcuggauaggcgagcuagaaggaagguaagagaagaaaggacucuauucuggacggccagggugcuguuagaggauguggcaagcauggguuggcaacaguaauaguuacccugaucuuuuuuagugucuaccagaggcuggucugcacuuaacuauaucacauguggccuuacaaacuucaaaaauuccaugaaauugggguuuuuauuacagaucucuauaaauuaugaaacagccucaaggagguuaggaaacuuaccccagaucacaagccuacaaaguccuaggaacaaagugauacaugccuuaaccuccagcacuugggagacagaggcaaguggaucuuugugaguucgaggccagccugaucuacauagccaguuccagaacagccagggcuacacagagaaacccugucucaaaauaaauuaaaaaaggaaaauaguggaagagauaggauucuagcccaauucuuccuuacuccagaacacaaaccugagacagagucugacuggguaucccuggcuggcuuagagcucuuguuuuauguaaacuagacugguuuuaaacucacagaaauucaccugccucugccucugccucuggggugcugggauuaaagauguaugccaccaugccaggcuuaaaauuuuuaauuuuauguuuauauaucuguauguuggggugggggagugcccacagaggucagaaguuauagauuccauggagugggacuuaaggcuguuacgagcugcccaaccagucugggaaccaagcuuggguccucuggaacagaggcaagcacucuuggcuacuaagccagcucuucggcuccagaacacaaacuuuucauuuauuuuauuuggagacagaguccaacacaaacucuuuaacuacucauccccccuguagagagagaaaaguagaagcuaaggcuaggaaagaagauagggcacacaguauagccagccagcuuuaaugauugcaaaagaauuugaacuuuauucuguaugcaauuggagccaacauguuucugagcacagaagugauuuagcgaacacagugacgcauuaaaaaaaguuacuuauaaggcagggagcagagcauaguggagaggauugaggacuggggggaguggaacacugggggggggguaggggauggaugugugggagacuggagguuggcccagagccugucaacaucacccaggaaaaagacucuaaggaagugagaauguggaggagagaagaugggagagguuuuagaagugggguugauugaaaugaaaggccuaacugaccaugacuacaucugagauaucacugagcaaagcaaccagggucguggugaggcugcucaguaugaaccugaagccagggacuaaaacucaaacuguuggggucggugaccaaguccaaagagccccacagaauuaaugauugagucuauaucaagucaagcucaaagugcagaacugacuaugaaaucuauaaauccaagugaggucaggacgaaugacagccaaguagccccagggagaaucccuucuucucuacauucaauuugguuucucguucuuacucccauuccaggcucccuggcaguaucccccuccaaaacccagcgcuccaucacuagacagauguagcuaccuccccaucugcccuucauuccccagcacugacaaucuugucuuucccucaaucccuagggacacacgcaagauaccaacacuuacuuucuuugccggacccugcgcucccuggggguccagguuugccgagucucuguugugccugaugaaguagccaccauugcauccgaggucaacucauucuccaggcgcuucacucacguccucaccgcggggggcaucggccccacucaugaugauguuaccuuugaggcaguggcacaggcuuuuggggaggagcucaaaccacacccugagcuccaagcagccaucaaaacccuaggaggggaggguugggagaagcugucgauggugcccuccucugcccgccugcauuacgguacagauccucgaaccggccaccccuucagauucccgcuggucucuguccgaaaugucuaccucuucccaggaauuccggagcuucugcgacgaguuuuggagggacugaaagggcuguuccaaaacacagcugugcaguuccaccugaaggaguuguauguggccgcgucagagggcucuaucgcccccauccugucggaggcucaggcccacuuugggcguaggcuuagccuggguuccuacccugacuggagcagcaacuacuuucaagugaagcugauucuagacuccgaggaaaaagagcccuuggaggaaugucuggccuaucugacugcacgucugccccaaggaucacugguccccuaccagcccgaugcuguugagaaggcuggugaggcuguguacaaacucgcggagucagguaggagucuccuaggggaaagcaguguggaccagagucuggguucuccucuagguuuaauaaugcuuucagaggccgggcggugguagcgcaugccuuuaaucccagcacucgggaggcagagacaggaggauuucugaguuugaggccagccuggucuacaaagugaguuccaggacagccagagcuauacagagaaacccugucucgaaaaaaaccaaaaaaacaaacaaaaauaauaauaaugcuuuucagaggccuucccacagaugcaagaaaaagguugcuuuguucauuuccccaauaacuauugauacauccucucaccagcgcugcgcugggggggucacgguugguauagcuugucagaacuguugugcucuacaaaacggauuagcugguaaacgggugguuguauaggugagaugugauucugaaauggauuccagaacuccacaccagagagaccagcuuugaucuggggaaggagaaggguucucuggacuaaugcggcucucugagagauagggauuuggucgcaccuagagguaggcaggagcaaacaauguggaaagagacuggcaggaagcagguagggcuguggagaaugaagggagccagagcagcccucagucucugccugggaggaaagacuaaaaacauggucaugugaggggggcucgaagagcaagcagggagacagaagaugcagggcagcacggaagaguuuagauuuacccgcagaacaccaggacaaucaugaaagucuuuaagcaagggucacaugacuucuuuaacagccauggauaccuugcuagccuucuuguauaccuagcugacguucucuucccugccugcauggcaggcucuugucuggggaagaagguagcaggugcccuacagaccaucgagacugcccuggcucaguaccaucucucccagcucugcgugggcuucaaugggggcaaggacugcaccgcacuccugcaccucuuccaugcagccgugcagagguaagccuaccccugggagcuaaggccucagaaagacccaccugaaaccucuccagcuccccaccccagaaagcacagcgucagcgugcacagguggugcuugagaggaagguagcuaggugaucagccagugccguuucccccguacucauugaacaucuggcauaugucuggccccaggucuagguguguagucaaccacagggaagucaacaguccagcuggggaggugagauuuacuggcagucauagaaccuggcgugguugcagccccagcagucagggagugagguugcuucaucugagcucaggagcuggaggcuagccuggggaguguuuuguauguguaagcaccuaguacgugcguuagucagaagaggguguuggauccauccucagugccaggacuuacagaugguuggguugugaguuaccaugugaauucugggaauggaacccagaucuuccccaagagcaaaaagugcuuuuaacugcugagugaacucuucggcccuugaguuuuuuguuuguuuguuuguuuaagauuuauuuauucauuuaauguauaugaauacacuguugcuaucuucagacacaccagaagagggcaucagaucccauuacagaugguugugaaccaccaugucuuugcugggaauugaacucagaaccucuggaggagcaguuagugcucuuaacugcugaaccaucucuccagcccccauaaguuuuuugguuugguuugguuuuuuuuuuuuuuuuuuuuuuuuuuuugguuuuucaagacaggguuucucuguauagcccuggcuguccuggaacucacuuuguagaccaggcuggccucgaacucagaaaucagccugucucugccucccaagugcugggauuaaaggcgugugccaccacgcccagaucccauaaguuuuuuuaaagcccuaucuuuaaaaaaauaaaauaaaaucucagcuggcuguggugguucaugccuucaacccuaacagaggcaguagaggcaggcguauugcuaugauuuugaggcuauccuggacaacauaaaaagccagugaaacccaguuguuuuuuucccuuggggcaaggggaguuuuuuaaucuuguaauaacagaacugaugcuuggguuugaggucagaaugaacuaggcaaacuggcacaugccuauaaucccagcccucgggaugcugaagcagaaauacugcaaguuugaggccagcugcuacauauucaauuacagccugagcucugcagcaagacccggccucaaagcaaaaggauaagaggucagggugggcuucucaggaauugggucugaguuugcuggguggaaaggauaagaaagagggagagagcaugggugccaaagagaacccugaccucccuggagagcaauuuucuucuccauacuggcaagucuguggauccuuacucuccccagaaaauuuccugauguuccaaaaccucuccagauccuguacauucguagcaucucgcccuucccugaguuggaacaguuucugcaggacaccaucaagagguauugggaccuagaggaucgggcucccggaggaccuugguagaaucuacccugguccucaucucuguucucuuccucccuaagguauaaucuccagguguuagaagccgaggguaacaugaagcaggcccugggugagcuucaggaaaagcacccccagcuggaggcuguccugaugggcacucgacggacugaccccuacuccuguagccucagccauuucagucccaccgacccuggcuggccuucauucaugagaaucaacccgcugcugguaaugugacaggauuguuggccuccggucccuaaaccuucccaaugcccgcugugagaaggcuagagccaaggcgcccagucucccaaggcaggcagugcugggcauucauccuuuuaaccaauuaaguggcaggcagugugcuucucccuguggaaaaaacagugaccugggccugugcuauucaauacgauaguagucauuuguucauacuuaaauuguaauuuaacugaaauacagauuauggggcugaggauguaguucguuugacauagcgcuugcuuagcacaccugaagaucauguaccugugccuauaauuucagccuucaguagaauuagaaguuuaaggccaggguuggcaaaauggcucagccagugaaggcacagugaaggcugccaggccugauggccucgcuuuuaucuccaggaccgauauggcagaagagaacugacucccacaacuugcccuuugaccucacacauuccccgccucccccccccaaaaaaaaaaacacaaauaauuuuuuuuuuaagguucaaggaaagccuuggcuacacaguaagcuugaggccagucuaaccaugagaugcuauuucaaaaauagaaagaaaaaaauacaaauuacuaaaaccacugagaggccgagguaggaggauugugugaguucaagccaagccugguugaaacgcugucucaaaaaaacaaaagcccugaauuauuuacuuucagaagaugaaauuuauggcaagugacucauaaugucuuguuuuguuuuguuuuucgagacaggguuucucuguguagcccuggcuguccuggaacucacucuguagaccaggcuggccucgaacucagaaauucaucugccucugccucccaagugcccagugucauuuuuuuuuuaauuagauaaaauuuaaaugucaauucuaagagccagggaugggcuugggugaguccuugccuagcuuguauaaagcuauagguucaauuccuaguaccacauaacaggaggauguagcugagcaggugaagugccuccuuagaugcacaaagccucggguucaggcucuaccaccacgccugcccaagccugcccaucaccacucuaaguacagaucgcucuggacuugggaggacagacguucaggucauucccagcucagcaguuagugaaaggauagccuaagauguguaagacaugccuaguacacaccucaacucccagcaggugggaagauaaggcaggaggauggccaucuugagaacugccugaacuacacaguaggacccugcuaggaagaaaggaagagagaaaggaaaagcaggaagggaaggggagaagaaaaauuaggccaauauuuuauguguauggguguuuucuccgcauguaugucuggcuaccauaugcauacugagugcuugaggaggccagaagagggagucaguacccuagaacuggagauacaggugauuguagucacuauguggguguuaggaacugauccuggguccucuggaagagcaaucagugcucuuaaccucugagccaucucuccagcccccaaacucacuucuuaaguuauccuagccacauuucuuuucuuuaagauuuacuuauuuguuuauuuuauguauuuauuuuauguacaacuauaagcuaucuuaagacacacaagaagagggcaucagaucucauuauagaugguuguaagccacccugagguugcugggaauuaacuuaggaccucuggagggaccacugagccaucucuccagcccucuagccacauuucgaaucccgcaauaugagggagcauguggcuagacaguucuacuguggcagaaagcucuagacuugaacacagcccucaucauccauguggaguuuacuccacggggguaggugacuggaagcagaaucaggcaaaggauaaagacuuucucuggcucucuacugagcccacacagagcaagguacacuagcgauccagauagcaagcccuccucaaggccaagugaacaaaaguaccugggaugggcccauccccaggauggugugguagguguggcugaggacaggucuagugacugauugucauuucccaggacuggaccuacagaaacaucugggaguuucugcggcagcuguuugucccauacugcauccuauaugacagaggguaaggugguugacgggcuggggugagaggaugcugggaaagagagcccacccaucacccacaucacccacaugcuccugucucaacacuccagguacacaucccuggggagucgggaaaacacaacgcagaauccggcccugaagugccugagcccaggaggacacccugucuaccguccagcauaccuacuggagaaugaggaugaggagagaaauuccagaaugugaucucacacaagcuggggacaagacagagggaagggggcuggccugggcuaccugucaugucaguaaaguguaccucacaccccauuguuggugccuguugcucuggcugugccuuccugguccgaggucaagggaggcugacagaucugaacuggcagugcucccucggggguccaggaguaacauagaacauacuagaaaggagcugcuccagaugggucucagugucaaccacagccagagcccaccaaaggagaggaggcaaccaggcagagcacugccugcauggacgggaaguugagcuuuccuggcuguggaggacagaggauggagcagccaagcccgccugcccgcccuaaccaccauuccugucugaaaggcugagucagccugcucagaggcccagaaccuucuuuugcuagacccuagagccuuuguuuuuagucaugaggccugaagggguggggacagugaauaaaaggucccaaaggcaguguccacacccuucugcugagcugcuguccacaugaggccaccaacgcagccccugacccaggcccugcccuucucucucagagaugcccuucgaggcacuggccuccaggugccugucauuaaaaugggcacagguugggagggcauguaucgaacccugaaggaagucgccuacauccuucuuuguugcugguguaucaaggaacugcuggauuaaugguggcagggaacaccuccugucaccccugacaccaagaccugcaucccucagguggggaggggagggcagacucucaggagguguggcugcagcuucugggguggaaccugcagcccagcucucccaucuuuucuauagcccuaagacuccuggagccagcuggccuucaccaaggaugggucacaaagaacugaagaaagaaccacgaaccuugcucugagcuguccauccaucugaccugccucacccuggggaaucucuccucagcucccaucucugcugugcuccugguacgcaugagcuuggcucagacuccauugagacuacggcaggaucuaauauuccuccaaaaauuggcacagugagcccaccaacccacguacuugaagaacuaggaauggacugccccugaaaugccugguaaucacuccacuauaaauauaauaaauaggccucgaggccaaaaauucugaacauucaaaggggaaugagggcaugugugcuuggaaagggcuuagagccagagagcaggaagaaggacagaucucgggaguagugagaccaagaaccagcuuugcugaaucucuguugccaggagggaagagcaaaacagaaaagccauguuccucccaacuuuugugcagagaggacagaauggagcaagcccuauucuaugaggccugggaugcuaggaugaggacccaaagacucagccuuuucccagaagaugugaccuaggcagcucccuguccuaaggaacacgggaaguguacucagcuagucccaguucagauacacuaagacacccuaagagaaagcacccaugaggucauaccaccccuucaagccugucacagcacacgugugacagcacauaaucugcgugagugaauggccuccugacuugccguuggcagccaccagcacuugcuuucuuugaacuguuagcagccugugcacaugcguauacaucaacuuguucaugcgccauccccaccccacccccauccccacccuuacccuuaguagcacucuuuggccuagccauugcccaccucuuaccugcagcacugacccguagguaguauauagcucucugccccaucuccuggagccagcucuuuuuuggccuuuugcuuaguuagcuccuuuuucucugggccuguuuuuauuguugguuaucugguugguugguugguugguugaguuuccguguuggggacugaacccaggacuuuguaccuacuccucucccuauaccacagccugauuuuuguugucauacagauacuauauguacuaguugugguaacccacaccuuuaauuccagcacuugggaggcggaggcuggaagauuuugagaccauccugaucuauacagcacauucuucagugaauaagugaauaugaauuggauaaucaaauguuaaaauuagugaaagaagcaaaaaaaaaaaaaaaaagauuuuuuguuuuguuuguuuuuucaagacaggguuucucuguauagcccuggcuguccuggaacucacucuguagaccaggcuggccucaaacucagaaauccgcccgccucugccucccgagugcuggguuaaagucgugugccaccaugcccagcuaaaauaaauauuuugcuuuuuugaaacugggccacucuuuagcccaggcugguuuugaacuuacugugcagcccuggcuagccccuuauuggagccagggcuacacaaugagacccuaccuaaaaagaaaugaacaaauacuuucuaaagaaauacuauaugccugggcagucaggaagcagaaacaggagugucuccagugcgacaccagccuggggcuguacuuccaagcuaucucuggguacauaagaaaucugucucaaaauaaauaaagaaaacaaaaaugucgggaua

SEQ ID NO: 1512 - RNA, 2914 nt, Mus musculus
guuaagauuauaaaaaacuuccuuuaaucaaggcuuguaacauggaagagaucugucagauaaaaugcaaaauuuccaauacauugaaacauaaauccauaagucaucauaaauacaauacccaauaguaaaaaacacgucagcaaauucacaccauccuuguaacagccaugaucuagauuucacaugcuucugccaaaugacuaauauggccugcugggucccgcgcacacgagggcuuugaggucacacucaucugacagggcuguggcacugguggcucaacuccagaagcaaagcagguaccagcacauucaaacaguguauccuuuacauaucaaagugagaaauaagaaagcaacauggucacgcgaucagaaagauggcagggagugaggacagcuguggaccgcucgaggccggaaggcgguucgccggcuucauuucuuuggcuucuugggcaguggccgucggaacaguaagaugugagguucuggaagaaacagugaaaucuaagaaagaaacucccagcauucugagcagucgacagugcaugcuacugcgcagugcagugcuacggacucuucacagcaugcaggugcacacagcccgagagccugcccuuucugccacgcacagaaguguuacaauagaauuaacugucuuugcuuaucuggaacagauccagugauuugcaggggccaucaccaggauauauguggcuuuaaaaagaguccccuccaaugacugacgcccuccucccucuacugcucugcucuguaaucucccuacauuucacugaccugguucauggaucauauaguggacccaucccugacucugcugaacgccgagguuccuccauucagauucagacaucagauggguuuucgggaccagcuuggcuauguccuugggcaacaugacaugccuguaacagaaacauggggaugugagugaggacugugucagagcugucagucugccagacacugaccuacauacugagagcggaguguggcacacgugccaugauucuggcacucggggauauggcagcaugaccgggaguuucaggcuauccugcgcuacagagaaucugugaaaauaaguaacuagcccagugugggcacuccuuuaauccccgcacucaggaggcagaggcaggugggucucaguugaggccagccuggucuacagggcaaguuccaggacaaccacagcagcagaugaacccugucucaaaaacacaaaaccaaacaaccacaaccacaacgaaacaacaacaaacaaaaacaagaaagaaagcaaaaccaaaauaaaaacaccauggguuuucaccacuuucauaagaguuauuaaaaccacaaaugagcaauuugaugugugacuccuggguaugagauacugacgauauuuguuucuccuuugaucacaggccucacaggccucuagcugguuaccuacucuaggacuguguggaaaggccuuuuacggaacagguaugaagacaaacaugcaaauguucauacuucuaagggaugugcuaugauacuuggaaaaucccaagcuuucccaaacauaaguuuauggcaaaaaauuaccugacuugacucaggcuaccccaaguagauuuacuuuaucaugcucagugaagauguacuaaaugcuucuuccuuugugauaauaacaagagccccaccccauuguuguccaaaugucagaaaagagcuuccauucuaacugugacuucgauacacagaaccaaaaaaaaaaaaaaaaaaagaaaaaaaagaaaaaaaagaaaaaaaaaaaagaaacccaaacaaaccccuccuuuaaacaaaaaugccaaggcuaagcuggaguuacagcuucccagagaugaagccacucauuucuccagccaugcaaaugcuguaaguguaacauuguuacagacguggaaaacagcugaguacuuuacacuugagacaagguuccaucuguagugugaucugggcuggacccuaugacaauccugcagccucagcuuccagaaugcugagauuaaagaugugagcuaccguaccagcuuaucuugcaccuuaacagaaaacacuugaaaccucuaugcgcgccaugaaugaucaaguauuugaaagguaucuacccacggccacagucuucaugccacuccaaguccuguaaaagccuaucuaaaacaaggcugacaacuacucaucuuuuuuauaaacuaaaaaccaccaacacugaggcucucuuagaaccguccuuucaucaagagcaugaaacuuucaguucugcacgggcuaccuucuuucucccagcagacuuugagauuucaguaacgcgagcaguuccuauuagggaaaucgccacaacaaaguugcuuuagugaugugaauucccagagguaaaacugaucagagcuacaagacgcuucaauuuaacagccggccaacucuaaguucccuuucauuguuuuacauccuccguccaccuuuugcgcaugugcuuugcugcuguacccaaucccacccccaccccacuccccgguaauuccuugcgcacgcgcccguucuacacugucccccgcccccaucccccgccucccacuccggccuagguaacuaacuccucgcgugcucucuuuugucuguaguccccgcgccggcacuaaccgguauucgaacuccucgucgucguauuuguccgaauaguagauuuguuugugggacaugauugcucuguccgagggcgcucagccccgcgccgcaggccuccagacaacucccagcagcacgcgcucccacccucuuuggccucgcuuucaaacacaccgcccgcacuuccuauuggucucugcggccgaaggcgggacagcuccauuuugaaguccucgauuggcuug

SEQ ID NO: 1513 - RNA, 4920 nt, Mus musculus
gggcguguccggaccgcccccaggcccacccgcagcucgcacggccccugucgaguggugcguuccacucugcuaccgggcuagcugggcggcgacaggcgcacuucggaggaguggcguggcgaggcccagccuuccugggugcggcgucugggcccuucccugcuuucccuccccaccgcguuccgugguggugacccauuggaguuccgguuccgguugcuguggcugcgggcgggcggugagucuggagcaggcgcgcaguuggugcaacggcucugugcuuucccccucggcguggcuagggcuugcugcugcucgggggggcugcgcugccccugacuccccuccgggcgauggugcggcccgaggacgccuccaucccccgccgacgcugacucggguccccaauccauggccgccucggcgccgcccccaccggacaagcuggagggaggcagcggccccgcaccgccccccgcgccgcccagcaccgggaggaagcagggcaaggccggugagagcgcagagaagggcaggggcuguugaggcccgggacccuggaaccucggauggaacgguugggggaugggggagguugccuaggagccuggagguagccucaggugagaagggucagugguuggagacaggugucacagaacacuucagguuuuggaugacacugaauugagacaaaccugguaguuucaagagauuggguuaucuuugauuugcaggaagacguagcugagaguauagucauacuagccauuuuucauaucucaccccuguuucuuaaauaaguaagcaaguguacguggaaguuagagucuggagaguggcugggaggaaagagacuuguagaaaccucgggaaaacuugccuccgucugcccauugcugcucuucuaggucugcaaaugaagagcccugaaaagaagcgaagaaaguccaauacucagguaaaugggggucuguggugggaguaucguagaagcccccccugcuuugucuagcuguguaccuggcugcccucuugugcuuuccaccaggugcagggucaagaaaaaaacagaaauacucuuccuucuuuuuccuuucggauccuaguucugucuugaugacagcguuuagcccagcuccuuucccuuccuuuuugagacaaggucucuugugucccagacuggcuucauauuugccguguagcuaaggauggcuuuggaucuuuaugauauuccugcuuuggcuuaccaaagugaugggauuccagaugugcaccgccauacugguuucuguagugcuggggacccucuggacaagugcggggucccuuucccagaacucuggaggagaggcaucugugagcuaccacgugggugcugggaacagaacccagggcuucugcaagagcugcaagugccccuaaacccgugagccauuucuccagccuggauucuuguugcugguaugacuggcauguaucaccaggcucagcuuacugaaucuuuucuaagugucauaaugcuacagugcuuuaaccguuuauauuauaaaaauugaggaaaauacuaguuuuauaaaauuaaauacuuccugggccaggccagccaggguggccacacagagaaacucuaaacaaacaaacaaacaaacaaacaaacaaauauucugagugccagccuaccuauugugcacaaaaccaugaguucaaacuccaggaccuuauaaaccagauauauacaucccagaaacagagguagggggaugaggacagugagaaguucaaggucagccuggguuauaaaagauacugucucaaaauuuaaaaaauuuaaaaaguaauuacuuugaggucagaccuggguuuuguauuuuuugugauuuuugauauuuauuauuauuguuguuguuguuguuguuguuguugcauuuagcuauaugaugugugagaggccagagaugugaucccuccaacauggguacuaggaaucacucuggugcuuaaccacugagcuaucccuccaacccuaucugccuuguuggaguuuugguuuuuuaaacaaugcgguugcaccgugggguuguugcaccaugggcuuugccuugcacccucuagcgugucuaaggucagccagagguuuggaucugagcugcgucagccuccaaagaguguguugugucugcggugcucuccuuguuggccucugucucccaucuucuuccuguuuucaccaggguccugcauauucacaucugacggaguucgccccacccccgacccccaugguggaucaucuggucgcuucuaacccuuuugaggaugauuucggagccccuaaaguggggggcgcaggcccuccguuccucggcaguccggugcccuuuggaggcuuucguguacaggggggcauggcaggccagguacccccaggcuacggcacuggaggaggaggggguccccagccacuucgucggcagcccccuccuuuuccccccaacccuauggguccagcuuuuaauaugcccccucagggcccuggcuacccgcccccuggcaacaugaacuuucccagucaacccuucaaccagucucugggccaaaacuuuagcccaccuggugggcaggugaugccaggcccaguaggcggauuuggucccaugaucucaccgaccaugggacagccuccuagaggggagcuggguccuccuccucucccccaacgcuuuacccaaccaggagcaccuuuugguccuucucuucagagaccuggucagggacuccccagccugccccccaacacaagucccuucccugguccagacccugguuuuccuggcccuggcggugaggauggugggaagcccuugaacccaccggcucccaccgccuuuccccaggagccccauucgggcucccccgcugcugcugucaaugggaaucagcccaguuuccccccuagcagcaguggucgaggugggggcacuccagaugccaacagucuggcaccccccggcaaggcagggggaggcucagggccccagccucccccaggccugguguaccccugcggugccugccguagugagguaaaugaugaccaggaugccauucugugugaggccuccugccagaagugguuucaccgcgagugcaccggcaugaccgagagugccuacggccugcugaccaccgaggccucugccgucugggccugugaucuuugccucaagaccaaggagauccagucugucuacauccgagagggcaugggccaguugguggcugcuaacgaugggugacucuaguaccauggccugggaaagugcaccuuuuccaccgugcuccugcagaguggcucucuuucuuuccuugucuuccaccacuggcaucccaucuccauggagcagaaacauguuuccuggaagcagaaaaggaacugaggcggacaggcagaaaagccuggguugcuugucuucuguuguuguugguuuuguuuuuguuuuuuucugggaacuugugcacugaguaccuucagagauccaggaagcuaaagccugguugagcagagccauuccuagagucuaaccagaggcugcaagagaaaaugggcuggaggaaguuuuagagagcaaggauguccugugcgcagaugaccccaacacccgugccuacaauaccuguauagccccauggcugcugcuguagcucuuggagucgaauguucaagguuccuuggcucccugagguagagccccuuuccuuggguucaggagacaaauggggauuucuuucuuuuucucugugucccuuugcuuccccugcaccugacuuacuccauuccccucggagcaccaaauaccuugaggaaauaggagaguuccugacuagggcaguugucugggcuucaagacuguagguaagagaugcugagaggacgucuuccucauaccaaagucauuguccucucucagcuucucuugugguuguuucucucagugaccauguuuugccaaaaauugguauauguggucugagugaccagaguauuugaaguuggggcuccccuagaagucuggacugcagguguaaccccccccaaucuggugcacagugggacagugcuacuuuucagcucuuggugcccucauauccucugucuccagaaaacauuugggaaggcacgaagcccuuauaccucacuccuuccccugaugaaaggauccaagggaggcccugccauggcuuuggggacauggggccgagcagcaggacccucaaagccaugguaccgcaagcuggaagaaccugaaguggucugcuuagucuuuuuuauccugcgaugucaucgugggccuggcgauccagcaauuaggcuagguuuauuuuugguuuuguagcacucccugccagagaugggaucgaggccugaucaggagccucucucagcugcucuucuuuccagcuaacccaaaaguccauuccucaaauggguggggaaggcaggcuuggguguggcccuccugagagucggaggugcccagcuugaccgcgaaggcugcccucugggaugucccgucucagcccucacgcucccugcauggggagagagaagacucaagaguuggcagccuuggaagcugaggagggcgaggguggaccugcuucuuacucugccccccaauuccuaaacuacacgaggcagccccucuacuuagcuuuguguugugcuaugguuuuguucgcccauguuaccugccgcuacuuuuguguugucuccaugguuuguaaaaugcucccggggagggcccauccccuuguucuucucugcuaccuuuuggaagaaaguggguuggcagggaugugguuacaggaucuuuuuguacgguuggauuaauaaaaugacuugaaaauccaaac

SEQ ID NO: 1514 - RNA, 14251 nt, Mus musculus
cgugacuccccucuugucuuccugggcugggagguugcaacaaguuaagcugaagacugaagcgaggagcugggucagguaaaggaguccuugccgggaaggggcguuacagacucccacuuuauccccagauaacaaaagagggcaaagcuguauaaaaggagugggcagccccggcguccacauacugcccaacacaggaccgaagggcggggaaggagggagacagaugauuccgaagcaggaacucaggcaaguuuuuguggucccagguccuucccuuuaaaggucagacagagaaggaaguuagagacaaucaagggcauaucaaaccagacuucccaguuuugugcagacugggaacacucucuuuuuuagaaacagcagaaguuuuugugaaauccugccugagugaaaaggggagagagaguaguggguggguuuucuucuuagaggucaaagacugcccuaaaaucacagcugggaaggguggcagcuaagugggcucuggauugcuuagacaggcuuccuaauaagguauuaaugugccgaugugccggccugggaaagcggggaugcuuuuugguaucaaggguugggaccccgagugcagggguucuaggaagacuucugcuucaguuuuagguuugucuuguugaccuaaauaccauaccauugccgauuuccauggagacgaugggucugacaucacccugguugccauggugcugaguucuggaggaccugagcaggcuguaaacagccagggauaaacagggaccucugcucuagcugcuguggccacuuccuuccugcugccaccuguuaacagucacacacagcaacuggggauggcaggacaguggagggacugagagccaaaagcugaaggaagauggcugugugggugucacuagaagaaggggguggggaguucgggguuuuuuggggacuugguauagggaagucauugcaauuguuuugucccugugugggauggguaucagugucuaggagacaugagcauuguggaagacaccacuagauguccuuuaccuaucuugggccugaaucuugcccaacaggagccacaggauuuuuuuuuuuuuuaaugauuuauuuauuuaauguaaguacacuguagcugucuucagacacaccagaagagggagucagaucucguuagggaugguugugagccaccaugugguuggugggauuugaacucaggaccuucggaagaguagucuggugcucuuaccugcugagccauuucaccagccccagagccacaggguuuuuuaaggcaaucaugcaggacuuaaacccagugggaguaguuggggagcauuuggcugguacagucaaauuucacauucugccuuuucugccagugggucagcuagcugucugucacuccauccucuuacuugaucccgguugcaccgcccuagcccaagggcacagccuugcuuuaugcuggucuuuggaaguagagggugauaccuuaaccccagcugcccuuagcugugauuagcaagggacaggaucagagacccaguuccccaccccccauuuugcagaucuuaauguaauuuaucgaugguaauugccacaacccccgcuccuccacuucuccccagucacuuucaagaucccagagaucaaccuguacaauuuaagguugagagggagugacccaagugggccgcugggcccuacaguauuggaaaacuuccuuccugcucacuccagugguaauccuagcugagcccugcacagccagugcugagaaccccuaaaccgguagucccuaaccuuccuaacgcugcaacccuuuaauacaguuccucauguuguggugacccccaacugugaaauuauuucguugcuacugcagaacuguaguuuugcugcugucacaaauccuaguguaaaucucugauacgcaggauaucugguauguaagcccugugggaugucgacucacagguugagaaccacuguccuaagugccccaguguguggaggacugaugguggauggguacugggacacuugggccuuaaggaagcuggugagccuuuucuuuggguucugugggaggacacuggggacuauggaggacccagguauugugaaagggacccaggucauuuccuucucucuucagucagucagccucugagauuccuccucuagccagaacaccagggguuggacuucucagccuuuguuccucuuugaaucuuuauggccagugcaguuuuccaagguccuauggacccuugaaugagguagcuuuccuguggcuuuuagcacagugaaguaaauacugucaggaaagcuaugggaccuggggcaggaggacugggaccagcccgggguuuugaggagacugaccaucuuuugaggccugaaauccugcugcugcuaucugccucuccugaagagaacucuccuccuccuuuuccuccuccuccucuucuuccuuuuccucuuccuccucugcuuccuccuccuccucucuccuccuccuccucuucuuccuccuccucucccccucuuccucuucuucaucuuccucuucuuccucuuccucccccucuuuuuccuccuccuuuuucuuccuucuuccuuccucuucuuuuuucuuuaucuuuugguuguuucuuuggaacaaagcucaucuguguugccccggcuauccuggaacuugcucuggcaucacacucaaagagccacugggauuaaaagcaaguguaggccuucacgcccaggaauucccguucuuaagagaguuuuucucugcagguggccacucuagcugcacuggaccuccacaacuauggccuccugcccagacucagauaauagcugggugcucgcugguucugagguaggaagagugggccugggcagcacaugggagaggggauuccuacaugggugggcugcuuugacuggaaccugcaggaguaaggguccugaacagcaaggugucggucgagggagugagagugccagggauuagggaaugaagaagaucaaagcaacagcugggauccagagucuuacacaggcuggcuacugaugccaagcaaguuuacuccgagguacgguguccuguaugcuauuuacauggagaaguagccaaggucagcagagagcuaagucagacaauguuggcaaagaacacaggauaccucagacacgacugccuugggcuggauagccacauucuaggggaagagucaagucaccagaaacugcaaccuugauuccuucaagacccuggcugcagcccuagaccagcauugccaagccuguucaugaacaggggcacagaacuaaaguccccuuuguccuuucauugggaccucgaggaagucuuagguuggccuggcuucccacacugcuuucuggaucuguccuguucucuucaugguccuaauggucauugcagagucccugugggcucuuauggggcuccagugcagggaggagauccggcacggagcucugcuguuggggcuugggcuaagcagggaagaagggaccagauaggucagcugagggaagcagagaggaacuucuggugugacugcagcaagaguaaggucaugaggugaugaaggggagccauguugaggagacugaagaaccuuaggauaagguggacaccugcuauaaacucuguuggaagggccucuucaaggguguugucuuagggcuacuauugcugugauaaaacaccaugaccaaagcaacuugugggugaaaggguuuauuugaaccuauacuucagguaacaauccaucacugagggaagucaggucagaaacucaaacagggcagguacuuggaggcaggagcugauguaccuauggaggggugcugcuuacugccuugcucuccauggcuugcucagccuguuuucuucuagaacccagaaccacuagcccagggauggcaccacccacaaugggaaggguccuccccccaucaaucacuaauuaagaaaaugcacuguagaccugguuacagccugaucuuaugagggcauuuucccaguugggguucuggccucucagaugacucuagccugugucagguugacauaaaauuagccagcacaugugucaucugaugagcggacagugcagggcugcugaguuggagaguagccuaacacgcagugucacuggcaggggaccaagccuguguggcuggauggggacagggacagugcuuucaaagcuucucuagcucuccagguggcauuuguuagggcaggaaaccagagggcuccuggugccaccaagaagggagaaggccugguaggcugggcacuaguagcuagagagggauggcagcaugugucaaagggaccucagagacuuucuuagagccacuaggaggaauuggacaugguggagcaagcuguaagcccacuaauugggagauggaggcuagagggucaggaggucaggguuauccuuggcuacacagcaaguuuugggauacaugagaccuugugucaauaaauuaauaaauaaauaaacaccagcagcuagaaaagccacagaacucgguuuagacuuggguuugaggugcccuuuaggagaccaacugggggugaggaguugaccucagcccugacccuagaguagaauacaaggaccagugcucaauggugggaauuaagauaggcccugugcucagugggcccuggucuccugucauagugccuuugcugacagcgggggacuugggccaaguauuucaccuguucauccuuuauuauaaaccaguuuugugauccuugccuuggagggguaacccugaggaaaaggugauuuggaaauugccaaggaauauacugaggucaaaaguuauucuugcuggguggugguggcgcaugccuuuaaucccagcacuugggaggcagaggcaggcggauuucugaguuugaggccagccuagucuacagagugaguuccgggacagccagggcuacacagagaaacccugccucgaaaaaccaaaaggaaaaaaaaaaguuauccuugagccagguaugcauggcuuuacggcuuuauccauaguggucaggagacagaggagguggauacacacacacacacacacacacacacacacacacacacacacacacacauuccuccccccuggaaaguuggggagauggcuuaguggguaaagcacuugccacauaaacuugcgacccugaguucagcuccccaaagccacuaacccugugauaugcucgugcguguuugcaauccugcugcuccuauaaugagauaggagcaggaaacaggagaauuuucacaaguccaaggccagcuacucugcaaauacagcagagaauaauguuucaaaagaggcagauggggagggcugaugcgaguuaucccccucccuuuucuugcugaauagcccugacuggucuggaacuuacuauguagaccaggcuggccugaaauuugcagaaacccaucugugucugccuccugugugcugggauuaaaggcaugugcuacaacaccugacugagguugauuuuuuuuaccuccacauuuauacugugguaucaugugugccuucauagacacacacagacacacagugacacacauacacauacauacauacauacauacauacauacauacauacauacauacagagagagaaagagagagagagagaaagggggagagagagagagagagagagagagaauuauuucuggacguagaguggaguccuaggggugggcaggugucggucugcuaaggaguuguaugcagaaaaguuacccaaguggaguagucagagcuaagggucaggcugcaagccagcaccauggggucaggcuggcuguggcuggggguaguugagccucugccaguagcugcugggagauucgggggcauauagggcaaugggaaaggccagagaacucaagauggaugugugggugggcagaggagaggacagcuucaggggugucccugagagcauaaccgugaccugggucuggguuggguaguuggcuuaugaggagcacagcacugacgauaggggcaggggucccagauacugucggccucccucagggucugcugggugaauguuuugguuccacauccuuacuuggggcuaugaguucauagaaaccugaccucuggggcaauggggaaggguaggaaguugcagaguagaauaaccacguuggauagcaccaggguagagcaggcugcaguuucugagauguggacugugguauuugagugcagcuagcccccucagauccaaucagggaaucucugcuccugauuuuguccugauguucucaccaaauaucuuaguucucaucucccucuggccagaaucugccuguggagacucugggcccagaacccaggauggacccagaaucugagggagccucccaggcccuucgggacuccuccaaggcagauggcaaagaauuagcugggaccuuggauggagaagguaauggggguucauggaggguuggguguaaccuguccucuuaucguuuuaauugggggaagggugaucaccuacguuauuugcuugcuagucuggccuuaugagcugccacucucugaaguggcuguggcccgugggugcuaaagggcugcacuguucaguucagggcugugaguuuuucugggcuucaucuuccaucacagagaagcuuuuccagacggaaaguucccagagagaaacugcuguucugacagagucugcggccaaggugaggugcuucccuggggcaggugggggcgggggggggggaguggagagagcacgccucacagccucauccacaucagggcacucugggagccgauggucaugggacggaggccccuggagacacagugguccaggaagauucgcaggagacuccuguggcgacgagccucggaccagacacacaggaccuggagagugagauccauccacagaacuuacccuccagucccagagcaggucaggggcuaucuugccuuccguugcccaccuuuuagaaagcauggagggguagagggauggcuccgccgucaagagcacuagcugcccuucagagggucugaguucaaucccagcacccacaugccagcucacaccugucuggaacuccagacaagagaaguuagggagcuugaaggagggcccauggcuggcugauucuuucugccggguguccucuuuucuuguuucuagagcagugguuuucaaccuuccuaaugcuaugaccaauuuuuuuguuuguuugguugguugguuuugguuuuucaagacaggguuucucaguguagcucuggcuguccuggaacucacucuguagaccaggcuggccucgaacucggaaauccgccugccucugccuccugagugcugggauuaaaggcgugugcaugugucaccacugcccgguuuauguugugaccuuuaauacgguuccucaugcuguggugaccuccaaccguaaaauuacuuucauuacuacuucauauguguaauugaaucauaauguaaauaucuguguuuuccaauggucuuagguaaccccuguguaagggucauuugacuccuaaagggucucgaccuacaggucaugaaccuguucucgaacaaacccuuuauuuccagaguccuuuccuugugcuggcucuggauccauggugagggaaggugggaggcucaggagggacuguguaagaagcugacuggccuaagccacagagcuacucagacuaugagggaugcagaaaggacaugcgauucagcaacaguuccugaaggagugggcgggagacagcuccgucaggugguggcuaagaaggagggagagacagggacaaggggaggugacauuugagaagcguauugagcauagaguaggucaggagaaaacacuccacaacauggcaccaacaaaagacuggggcuaguccccagucuguccaaggcaguggcagaggugauaggagacacaccuccccacacccuccaucucugucgaauagccaggggaggcugaggugggaccuaaggcagggacugugaggccugcagagagagucuacugacuaugaaguccaucaaguggagaacuguccgacuaucugacaugggcuagagagggaagauugagguuaaccagaaaggcauuggugugccucucccugaacccaagguacggggacacacuaggaaagauggagucggaggguaguguguugaaugucccccugaaggggagacccugaaaaaugugacuagaggacacaaaagucagagaggcaagccugggacgcugggaagaccauggaggggaggagaguggggugggugagagguuaugagggaaaaggacugagaaaagccaaaagagcacaguggccaaggaguuuagcggggggcccaggacggugggauccugcauagaaacuugaugugaggccuacuggaagaagaaggauuuuauagaaauggcuccuguguuuguagauguuugucagugacuggacagggccgguccguuaguacgcagcuugagugggcagucuuccugugccuucucuguggccagggcugggccuccuggugccuuccuccucuucccugugucccugugucaccucugccugucucacugcccuguccucuucccuuccuccaguuuggaaagagcaucgcugcuccagcagugacgacgacacugauguagauguggagggucugcggagacggaggggccgggagcccagcucaucccagcccgugguacccguagauguggaggaccaggccaagggcgaggguauagguggagagcugggcaucucccucaacauguguuuccugggggcccugguucuucugggccuggggauccuccuguucucuggugaguaccacuggcugggccuccagucugacuuuggcccugccuuacugcccuguccacaccuaacucugucugcuucccugaggccucaccagacugucuucauuuucagguacacugcuggagcccgagacuggugagcaggagaggcccuggcuuucugucuguguugggugguaauguguguuguauggggagaggcucucagguaagguguuuagagguguauguuauuucuucagcuguugaacuuaucagcuguucagggugccauuuaucccuuuaacucagcaggacgacaggccauggggugugugacaggucauggagugugcucagugaaagagggguaacugggagaggggugaugggcucuguggaccagggauucaggugcucacuaacccacagggcccauggaggaagccgaguugcaggucuuuccagaaaccgggccggagacugaacugguagagacucuggggaacaggcaggugcguauggguuuuccacagguguguguguggggagcacugguggggaggagcuggguugcccugccugggaggaagcaugaaguagcugcucuucuaucaucaggaugagauagagcaccugcaggcuucaagugucccaccagacaguguccccagccugcagagcaugggguuucugcuggacaagcuggccaaggagaaccaggauauccggcugcugcaggcucagcuacaggugggcccuagcaagggggggggucuucauuuggccuccuuuaccuaguauguccuagugggcuuccccagagggaguuuucccuagucaccugacccuggagccucgcccuuugccacuguagugagggcaucuucuuagucuugcuugccucccucaugcuaaggacuguguuagggccggugugccugguuuacaugcuagaucaccucugagugaugaguagggucuucccauuugaagaacacgccaaggcucauacuaagugcuaggaucaaugcacagcguccgcucuggguagaggggguggaagagggacgaggagggcuagcuagcuaguggcuaugccgggucuaaagaguauauguuuguuguguaaggacauagaugcuggguagaauucgaccaucucaggaacugacccagacaaggggugaagaagaggaggaacccuucuggcucuccaggcagcacuggggcucacacccagggccuuacacgcacuacacaggcucauugccaacagaacugcaucucuagcccuugcccacucuaauagaaucgggguagaaggcauugugcccacccugacaaggacgacuucuguuuucuucuguuucuaacuacauucuaggcucagaaagaagaacuucagagccuguugcaccagcccaaagggcuggaggaggagaaugcccggcuccgggaagcccugcagcagggcaagaccucccaccaggcccuagaaucagaacugcagcagcuaagggcccgacuccaagggcuagaggcuaacuguguccgggguguagauggggugugucucaacugggguggagauccacaggauggcaaggccacuaaagaacaaggccacaaggggcaggagccagaccccagcuuauuggagcagcauaagcagcuugaggcggaggccaaggcccuaaggcaggagcugcagagacaguggcagcugcuggggucugugcacugggaccugcagaggggcuugcgggaugcuggccggggagccccagcucacccuggccuggcugaacucggucacauguuggcccagacacugcaggaccucgagaaucaggguaucaacacuggcaggucccccaaugacucggaggccuggcaccagaagaagccucacacccagagucccagggaguggggugggaaggagaaguggcgcggugggcagagggaucagaaggcugagcacuggaagccgaggaaggaggagucuggccaggagaggcaaaggagcuggagggaugagggccgggagcacacugggcgcuggagggaggacagacugcgggcggacgaaucugggagcagaaaggacagcaagcgacaggaccccaagguacacccuaggaaagaugggaacucccauucuguagaaaggcagaagcauucuugggggaaagacaacagcccugacgcccuguccuccugggaggagcugcugaggcgcaaguaccgacccccucagggcuguucagguguggccgacugugcccggcaggagggccuggcccucuuugguguggagcuggccccugugcggcagcaggagcuggccucugugcugagagaauacuugucucggcugcccugggccgggcagcugaccaaacagcugccccucucaccugcuuacuuuggagaagauggcaucuucaggcaugaccggcuucgcuucagagauuuuguggaugccuuggaggacagccuggaggagguggcacugaaacagacaggcgacgaugaugaaguggaugacuuugaggacuuugucuucggccacuucuuuggggacaaggcccugaagaagaggugggaauuggggaugggcgugggagagaguagccgagggauuugaaggcguugggcccugaaugaagaggucuguagcuugagucucucucuucauuucugauccccuggccuuacaaaaagaaggcuucuggguacacauccuaucuucccaugaggggcugcagugguccugaggggucccccuuugagccaggacccccuccccaccuugccuguacauagagggccccuugucucccccaauggauucauccuggagcccagguuccucccuugcuugguggcagucaccugagcuggccuccaccagaagaacagggcuccuucuccuuagggucuuaucucaguauguggcauuguuuccuaaaggccauuuccugcuuccuucccugucucccccauaggucacgaaagaaggagaagcacuccuggaaccccagaguuguggggcccagggaagagcacagccgccauccgcaccacuaccaccaaggcugagcccuguccugcugcaacagccggccuuggcaugcacccagcucaagaugccuggaguuaugugacccuagcagcuaugcucccacuguccagcgggccccuccuggcucguuggugcccuugaaugaccuucacagaagagagcaacgcacuuggcccugcacugguaccacuuuugcuaaaaaaaaaaaaaaaaaagaagaagaagaaaaaaaaaaaggccauaguuggcgcugcugaacugucuaagcagacauaugcaaagauaaaggcccuggguacuaagugacauguaggggccugcugggagccugcuggggaggacucuuauucugaagucagagagcugucauuuuuuuguggcuauccuggguccacagcagagccuaucacccugugcuagagcugcugguuagagacuuagcuccagacuugccuugggguuuagcuagcuguggagacagcuaucccuaagccugaggaguccucaccaugccucuugcggcuuucaccuccccaccugagcugucccaccauggcggggcucugucacuugagguggucccuaaaugcaaggaacaccuugcagucaccacgcugguguuuaggcacaaucuaggcacugcacucggccuucccauccauuccccaugugcgcccaccuuccccaaggagccuagccuugaguccagccaccaauugucucacaguccaggugggguggccucaagccaggucauucuccgcaguguggugugguguucuuauccucagaaagagagcugaagggaauggagucagugaagcaaggaagcagacauucuguuucugccacacaagaaucgaucccuuuuuuggagcgugcuguggaggacagggaacacgcuaaccugggucugcagaggugagggagccacuagguggcgcucuggcuucacauuucucuagacuucucccuccugccccuggucaccaccccacaccccagacacccuacccauugacuagcucucaagaauucccagaaucccccugguuauucuucaggaacgccccgcccccucaguucaaaccucuacgccauugguagcacacugggcuucuagcucuggaacucucccagggacucuagggggcagugaccacacaggucaggucaauuaaggaggggauuaaggacuguaagcuuacugggcaauggugaugcacgccuuuaaucccagcccuugggaggcagaggcaggcugauuucugaguuugaggccagccugaucuacaaagugaguuccaggauagccagggaaacaaaacaggacuguaggcucuagaaagugcuggaaucgauuuugaauuauuuagcaaugcuuuuaugucacuguuaaaaggcuuuuaagugcaguggcuuguuuaauuuccgugcuagacaagacagguagaaaggguggcucauuccacaaauguuuaaacagucugcuguguggugcuggagggauggcucagccgcugagggcacaggcugcucuuccagaagccccagguuugauucccagcacccacaugguagcucacaaaugucugcaacuucagucuccagggaucugauguucucuucuggcccuguaggcaccaggcacacacacacacgguacacaaacauacacgcaaaaacaaaaaaagaucacccaucaccacauuucuugaaaauaaaagucuauuguguaugagaaccagguagugaggcccuaggccuguagacccuuuaauaugcauggaaucugcagcagcaggagcucugguuagacuuaaggcacauuaccuuacacaggucaguguuguaggcugggggcuccaggaaggagccgucugguuuagaaagacaauuauauucccugucucucuggaccagugucccucagaaggaaggcagguuuaacccugcuuuugcugcucacucaaggguccucagagaucgaucuguuuauacagauguggugaccuugguggcugggugaaagcucaaggccggaggcagguaggcuggcauguuggggugcugggucuggagauggggauucacaggccugccuugguuuccuagaugguguugguacagggcucucuggccucugguuuccaugucaagagcucauguuggauaauaaauuuuggagucucagaguuccucua

SEQ ID NO: 1515 - RNA, 14251 nt, Mus musculus
uagaggaacucugagacuccaaaauuuauuauccaacaugagcucuugacauggaaaccagaggccagagagcccuguaccaacaccaucuaggaaaccaaggcaggccugugaauccccaucuccagacccagcaccccaacaugccagccuaccugccuccggccuugagcuuucacccagccaccaaggucaccacaucuguauaaacagaucgaucucugaggacccuugagugagcagcaaaagcaggguuaaaccugccuuccuucugagggacacugguccagagagacagggaauauaauugucuuucuaaaccagacggcuccuuccuggagcccccagccuacaacacugaccuguguaagguaaugugccuuaagucuaaccagagcuccugcugcugcagauuccaugcauauuaaagggucuacaggccuagggccucacuaccugguucucauacacaauagacuuuuauuuucaagaaauguggugaugggugaucuuuuuuuguuuuugcguguauguuuguguaccgugugugugugugccuggugccuacagggccagaagagaacaucagaucccuggagacugaaguugcagacauuugugagcuaccaugugggugcugggaaucaaaccuggggcuucuggaagagcagccugugcccucagcggcugagccaucccuccagcaccacacagcagacuguuuaaacauuuguggaaugagccacccuuucuaccugucuugucuagcacggaaauuaaacaagccacugcacuuaaaagccuuuuaacagugacauaaaagcauugcuaaauaauucaaaaucgauuccagcacuuucuagagccuacaguccuguuuuguuucccuggcuauccuggaacucacuuuguagaucaggcuggccucaaacucagaaaucagccugccucugccucccaagggcugggauuaaaggcgugcaucaccauugcccaguaagcuuacaguccuuaauccccuccuuaauugaccugaccuguguggucacugcccccuagagucccugggagaguuccagagcuagaagcccagugugcuaccaauggcguagagguuugaacugagggggcggggcguuccugaagaauaaccagggggauucugggaauucuugagagcuagucaauggguagggugucuggggugugggguggugaccaggggcaggagggagaagucuagagaaaugugaagccagagcgccaccuaguggcucccucaccucugcagacccagguuagcguguucccuguccuccacagcacgcuccaaaaaagggaucgauucuuguguggcagaaacagaaugucugcuuccuugcuucacugacuccauucccuucagcucucuuucugaggauaagaacaccacaccacacugcggagaaugaccuggcuugaggccaccccaccuggacugugagacaauugguggcuggacucaaggcuaggcuccuuggggaaggugggcgcacauggggaauggaugggaaggccgagugcagugccuagauugugccuaaacaccagcguggugacugcaagguguuccuugcauuuagggaccaccucaagugacagagccccgccauggugggacagcucagguggggaggugaaagccgcaagaggcauggugaggacuccucaggcuuagggauagcugucuccacagcuagcuaaaccccaaggcaagucuggagcuaagucucuaaccagcagcucuagcacagggugauaggcucugcuguggacccaggauagccacaaaaaaaugacagcucucugacuucagaauaagaguccuccccagcaggcucccagcaggccccuacaugucacuuaguacccagggccuuuaucuuugcauaugucugcuuagacaguucagcagcgccaacuauggccuuuuuuuuuuucuucuucuucuuuuuuuuuuuuuuuuuuagcaaaagugguaccagugcagggccaagugcguugcucucuucugugaaggucauucaagggcaccaacgagccaggaggggcccgcuggacagugggagcauagcugcuagggucacauaacuccaggcaucuugagcugggugcaugccaaggccggcuguugcagcaggacagggcucagccuuggugguaguggugcggauggcggcugugcucuucccugggccccacaacucugggguuccaggagugcuucuccuucuuucgugaccuaugggggagacagggaaggaagcaggaaauggccuuuaggaaacaaugccacauacugagauaagacccuaaggagaaggagcccuguucuucugguggaggccagcucaggugacugccaccaagcaagggaggaaccugggcuccaggaugaauccauugggggagacaaggggcccucuauguacaggcaagguggggaggggguccuggcucaaagggggaccccucaggaccacugcagccccucaugggaagauaggauguguacccagaagccuucuuuuuguaaggccaggggaucagaaaugaagagagagacucaagcuacagaccucuucauucagggcccaacgccuucaaaucccucggcuacucucucccacgcccauccccaauucccaccucuucuucagggccuuguccccaaagaaguggccgaagacaaaguccucaaagucauccacuucaucaucgucgccugucuguuucagugccaccuccuccaggcuguccuccaaggcauccacaaaaucucugaagcgaagccggucaugccugaagaugccaucuucuccaaaguaagcaggugagaggggcagcuguuuggucagcugcccggcccagggcagccgagacaaguauucucucagcacagaggccagcuccugcugccgcacaggggccagcuccacaccaaagagggccaggcccuccugccgggcacagucggccacaccugaacagcccugagggggucgguacuugcgccucagcagcuccucccaggaggacagggcgucagggcuguugucuuucccccaagaaugcuucugccuuucuacagaaugggaguucccaucuuuccuaggguguaccuugggguccugucgcuugcuguccuuucugcucccagauucguccgcccgcagucuguccucccuccagcgcccagugugcucccggcccucaucccuccagcuccuuugccucuccuggccagacuccuccuuccucggcuuccagugcucagccuucugaucccucugcccaccgcgccacuucuccuucccaccccacucccugggacucugggugugaggcuucuucuggugccaggccuccgagucauugggggaccugccaguguugauacccugauucucgagguccugcagugucugggccaacaugugaccgaguucagccaggccagggugagcuggggcuccccggccagcaucccgcaagccccucugcaggucccagugcacagaccccagcagcugccacugucucugcagcuccugccuuagggccuuggccuccgccucaagcugcuuaugcugcuccaauaagcuggggucuggcuccugccccuuguggccuuguucuuuaguggccuugccauccuguggaucuccaccccaguugagacacaccccaucuacaccccggacacaguuagccucuagcccuuggagucgggcccuuagcugcugcaguucugauucuagggccuggugggaggucuugcccugcugcagggcuucccggagccgggcauucuccuccuccagcccuuugggcuggugcaacaggcucugaaguucuucuuucugagccuagaauguaguuagaaacagaagaaaacagaagucguccuugucagggugggcacaaugccuucuaccccgauucuauuagagugggcaagggcuagagaugcaguucuguuggcaaugagccuguguagugcguguaaggcccugggugugagccccagugcugccuggagagccagaaggguuccuccucuucuucaccccuugucugggucaguuccugagauggucgaauucuacccagcaucuauguccuuacacaacaaacauauacucuuuagacccggcauagccacuagcuagcuagcccuccucgucccucuuccacccccucuacccagagcggacgcugugcauugauccuagcacuuaguaugagccuuggcguguucuucaaaugggaagacccuacucaucacucagaggugaucuagcauguaaaccaggcacaccggcccuaacacaguccuuagcaugagggaggcaagcaagacuaagaagaugcccucacuacaguggcaaagggcgaggcuccagggucaggugacuagggaaaacucccucuggggaagcccacuaggacauacuagguaaaggaggccaaaugaagacccccccccuugcuagggcccaccuguagcugagccugcagcagccggauauccugguucuccuuggccagcuuguccagcagaaaccccaugcucugcaggcuggggacacugucuggugggacacuugaagccugcaggugcucuaucucauccugaugauagaagagcagcuacuucaugcuuccucccaggcagggcaacccagcuccuccccaccagugcuccccacacacacaccuguggaaaacccauacgcaccugccuguuccccagagucucuaccaguucagucuccggcccgguuucuggaaagaccugcaacucggcuuccuccaugggcccuguggguuagugagcaccugaaucccugguccacagagcccaucaccccucucccaguuaccccucuuucacugagcacacuccaugaccugucacacaccccauggccugucguccugcugaguuaaagggauaaauggcacccugaacagcugauaaguucaacagcugaagaaauaacauacaccucuaaacaccuuaccugagagccucuccccauacaacacacauuaccacccaacacagacagaaagccagggccucuccugcucaccagucucgggcuccagcaguguaccugaaaaugaagacagucuggugaggccucagggaagcagacagaguuagguguggacagggcaguaaggcagggccaaagucagacuggaggcccagccagugguacucaccagagaacaggaggauccccaggcccagaagaaccagggcccccaggaaacacauguugagggagaugcccagcucuccaccuauacccucgcccuuggccugguccuccacaucuacggguaccacgggcugggaugagcugggcucccggccccuccgucuccgcagacccuccacaucuacaucagugucgucgucacugcuggagcagcgaugcucuuuccaaacuggaggaagggaagaggacagggcagugagacaggcagaggugacacagggacacagggaagaggaggaaggcaccaggaggcccagcccuggccacagagaaggcacaggaagacugcccacucaagcugcguacuaacggaccggcccuguccagucacugacaaacaucuacaaacacaggagccauuucuauaaaauccuucuucuuccaguaggccucacaucaaguuucuaugcaggaucccaccguccugggccccccgcuaaacuccuuggccacugugcucuuuuggcuuuucucaguccuuuucccucauaaccucucacccaccccacucuccuccccuccauggucuucccagcgucccaggcuugccucucugacuuuuguguccucuagucacauuuuucagggucuccccuucagggggacauucaacacacuacccuccgacuccaucuuuccuaguguguccccguaccuuggguucagggagaggcacaccaaugccuuucugguuaaccucaaucuucccucucuagcccaugucagauagucggacaguucuccacuugauggacuucauagucaguagacucucucugcaggccucacagucccugccuuaggucccaccucagccuccccuggcuauucgacagagauggaggguguggggaggugugucuccuaucaccucugccacugccuuggacagacuggggacuagccccagucuuuuguuggugccauguuguggaguguuuucuccugaccuacucuaugcucaauacgcuucucaaaugucaccuccccuugucccugucucucccuccuucuuagccaccaccugacggagcugucucccgcccacuccuucaggaacuguugcugaaucgcauguccuuucugcaucccucauagucugaguagcucuguggcuuaggccagucagcuucuuacacagucccuccugagccucccaccuucccucaccauggauccagagccagcacaaggaaaggacucuggaaauaaaggguuuguucgagaacagguucaugaccuguaggucgagacccuuuaggagucaaaugacccuuacacagggguuaccuaagaccauuggaaaacacagauauuuacauuaugauucaauuacacauaugaaguaguaaugaaaguaauuuuacgguuggaggucaccacagcaugaggaaccguauuaaaggucacaacauaaaccgggcaguggugacacaugcacacgccuuuaaucccagcacucaggaggcagaggcaggcggauuuccgaguucgaggccagccuggucuacagagugaguuccaggacagccagagcuacacugagaaacccugucuugaaaaaccaaaaccaaccaaccaaacaaacaaaaaaauuggucauagcauuaggaagguugaaaaccacugcucuagaaacaagaaaagaggacacccggcagaaagaaucagccagccaugggcccuccuucaagcucccuaacuucucuugucuggaguuccagacaggugugagcuggcaugugggugcugggauugaacucagacccucugaagggcagcuagugcucuugacggcggagccaucccucuaccccuccaugcuuucuaaaaggugggcaacggaaggcaagauagccccugaccugcucugggacuggaggguaaguucuguggauggaucucacucuccagguccugugugucugguccgaggcucgucgccacaggagucuccugcgaaucuuccuggaccacugugucuccaggggccuccgucccaugaccaucggcucccagagugcccugauguggaugaggcugugaggcgugcucucuccacucccccccccccgcccccaccugccccagggaagcaccucaccuuggccgcagacucugucagaacagcaguuucucucugggaacuuuccgucuggaaaagcuucucugugauggaagaugaagcccagaaaaacucacagcccugaacugaacagugcagcccuuuagcacccacgggccacagccacuucagagaguggcagcucauaaggccagacuagcaagcaaauaacguaggugaucacccuucccccaauuaaaacgauaagaggacagguuacacccaacccuccaugaacccccauuaccuucuccauccaaggucccagcuaauucuuugccaucugccuuggaggagucccgaagggccugggaggcucccucagauucuggguccauccuggguucugggcccagagucuccacaggcagauucuggccagagggagaugagaacuaagauauuuggugagaacaucaggacaaaaucaggagcagagauucccugauuggaucugagggggcuagcugcacucaaauaccacaguccacaucucagaaacugcagccugcucuacccuggugcuauccaacgugguuauucuacucugcaacuuccuacccuuccccauugccccagaggucagguuucuaugaacucauagccccaaguaaggauguggaaccaaaacauucacccagcagacccugagggaggccgacaguaucugggaccccugccccuaucgucagugcugugcuccucauaagccaacuacccaacccagacccaggucacgguuaugcucucagggacaccccugaagcuguccucuccucugcccacccacacauccaucuugaguucucuggccuuucccauugcccuauaugcccccgaaucucccagcagcuacuggcagaggcucaacuacccccagccacagccagccugaccccauggugcuggcuugcagccugacccuuagcucugacuacuccacuuggguaacuuuucugcauacaacuccuuagcagaccgacaccugcccaccccuaggacuccacucuacguccagaaauaauucucucucucucucucucucucucucccccuuucucucucucucucuuucucucucuguauguauguauguauguauguauguauguauguauguauguauguguaugugugucacugugugucugugugugucuaugaaggcacacaugauaccacaguauaaauguggagguaaaaaaaaucaaccucagucagguguuguagcacaugccuuuaaucccagcacacaggaggcagacacagauggguuucugcaaauuucaggccagccuggucuacauaguaaguuccagaccagucagggcuauucagcaagaaaagggagggggauaacucgcaucagcccuccccaucugccucuuuugaaacauuauucucugcuguauuugcagaguagcuggccuuggacuugugaaaauucuccuguuuccugcuccuaucucauuauaggagcagcaggauugcaaacacgcacgagcauaucacaggguuaguggcuuuggggagcugaacucagggucgcaaguuuauguggcaagugcuuuacccacuaagccaucuccccaacuuuccaggggggaggaauguguguguguguguguguguguguguguguguguguguguguguguguauccaccuccucugucuccugaccacuauggauaaagccguaaagccaugcauaccuggcucaaggauaacuuuuuuuuuuccuuuugguuuuucgaggcaggguuucucuguguagcccuggcugucccggaacucacucuguagacuaggcuggccucaaacucagaaauccgccugccucugccucccaagugcugggauuaaaggcaugcgccaccaccacccagcaagaauaacuuuugaccucaguauauuccuuggcaauuuccaaaucaccuuuuccucaggguuaccccuccaaggcaaggaucacaaaacugguuuauaauaaaggaugaacaggugaaauacuuggcccaagucccccgcugucagcaaaggcacuaugacaggagaccagggcccacugagcacagggccuaucuuaauucccaccauugagcacugguccuuguauucuacucuagggucagggcugaggucaacuccucacccccaguuggucuccuaaagggcaccucaaacccaagucuaaaccgaguucuguggcuuuucuagcugcugguguuuauuuauuuauuaauuuauugacacaaggucucauguaucccaaaacuugcuguguagccaaggauaacccugaccuccugacccucuagccuccaucucccaauuagugggcuuacagcuugcuccaccauguccaauuccuccuaguggcucuaagaaagucucugaggucccuuugacacaugcugccaucccucucuagcuacuagugcccagccuaccaggccuucucccuucuugguggcaccaggagcccucugguuuccugcccuaacaaaugccaccuggagagcuagagaagcuuugaaagcacugucccuguccccauccagccacacaggcuugguccccugccagugacacugcguguuaggcuacucuccaacucagcagcccugcacuguccgcucaucagaugacacaugugcuggcuaauuuuaugucaaccugacacaggcuagagucaucugagaggccagaaccccaacugggaaaaugcccucauaagaucaggcuguaaccaggucuacagugcauuuucuuaauuagugauugauggggggaggacccuucccauuguggguggugccaucccugggcuagugguucuggguucuagaagaaaacaggcugagcaagccauggagagcaaggcaguaagcagcaccccuccauagguacaucagcuccugccuccaaguaccugcccuguuugaguuucugaccugacuucccucagugauggauuguuaccugaaguauagguucaaauaaacccuuucacccacaaguugcuuuggucaugguguuuuaucacagcaauaguagcccuaagacaacacccuugaagaggcccuuccaacagaguuuauagcagguguccaccuuauccuaagguucuucagucuccucaacauggcuccccuucaucaccucaugaccuuacucuugcugcagucacaccagaaguuccucucugcuucccucagcugaccuaucuggucccuucuucccugcuuagcccaagccccaacagcagagcuccgugccggaucuccucccugcacuggagccccauaagagcccacagggacucugcaaugaccauuaggaccaugaagagaacaggacagauccagaaagcagugugggaagccaggccaaccuaagacuuccucgaggucccaaugaaaggacaaaggggacuuuaguucugugccccuguucaugaacaggcuuggcaaugcuggucuagggcugcagccagggucuugaaggaaucaagguugcaguuucuggugacuugacucuuccccuagaauguggcuauccagcccaaggcagucgugucugagguauccuguguucuuugccaacauugucugacuuagcucucugcugaccuuggcuacuucuccauguaaauagcauacaggacaccguaccucggaguaaacuugcuuggcaucaguagccagccuguguaagacucuggaucccagcuguugcuuugaucuucuucauucccuaaucccuggcacucucacucccucgaccgacaccuugcuguucaggacccuuacuccugcagguuccagucaaagcagcccacccauguaggaauccccucucccaugugcugcccaggcccacucuuccuaccucagaaccagcgagcacccagcuauuaucugagucugggcaggaggccauaguuguggagguccagugcagcuagaguggccaccugcagagaaaaacucucuuaagaacgggaauuccugggcgugaaggccuacacuugcuuuuaaucccaguggcucuuugagugugaugccagagcaaguuccaggauagccggggcaacacagaugagcuuuguuccaaagaaacaaccaaaagauaaagaaaaaagaagaggaaggaagaaggaagaaaaaggaggaggaaaaagagggggaggaagaggaagaagaggaagaugaagaagaggaagagggggagaggaggaggaagaagaggaggaggaggagagaggaggaggaggaagcagaggaggaagaggaaaaggaagaagaggaggaggaggaaaaggaggaggagaguucucuucaggagaggcagauagcagcagcaggauuucaggccucaaaagauggucagucuccucaaaaccccgggcuggucccaguccuccugccccaggucccauagcuuuccugacaguauuuacuucacugugcuaaaagccacaggaaagcuaccucauucaaggguccauaggaccuuggaaaacugcacuggccauaaagauucaaagaggaacaaaggcugagaaguccaaccccugguguucuggcuagaggaggaaucucagaggcugacugacugaagagagaaggaaaugaccugggucccuuucacaauaccuggguccuccauaguccccaguguccucccacagaacccaaagaaaaggcucaccagcuuccuuaaggcccaagugucccaguacccauccaccaucaguccuccacacacuggggcacuuaggacagugguucucaaccugugagucgacaucccacagggcuuacauaccagauauccugcguaucagagauuuacacuaggauuugugacagcagcaaaacuacaguucugcaguagcaacgaaauaauuucacaguugggggucaccacaacaugaggaacuguauuaaaggguugcagcguuaggaagguuagggacuaccgguuuagggguucucagcacuggcugugcagggcucagcuaggauuaccacuggagugagcaggaaggaaguuuuccaauacuguagggcccagcggcccacuugggucacucccucucaaccuuaaauuguacagguugaucucugggaucuugaaagugacuggggagaaguggaggagcggggguuguggcaauuaccaucgauaaauuacauuaagaucugcaaaaugggggguggggaacugggucucugauccugucccuugcuaaucacagcuaagggcagcugggguuaagguaucacccucuacuuccaaagaccagcauaaagcaaggcugugcccuugggcuagggcggugcaaccgggaucaaguaagaggauggagugacagacagcuagcugacccacuggcagaaaaggcagaaugugaaauuugacuguaccagccaaaugcuccccaacuacucccacuggguuuaaguccugcaugauugccuuaaaaaacccuguggcucuggggcuggugaaauggcucagcagguaagagcaccagacuacucuuccgaagguccugaguucaaaucccaccaaccacaugguggcucacaaccaucccuaacgagaucugacucccucuucuggugugucugaagacagcuacaguguacuuacauuaaauaaauaaaucauuaaaaaaaaaaaaaauccuguggcuccuguugggcaagauucaggcccaagauagguaaaggacaucuaguggugucuuccacaaugcucaugucuccuagacacugauacccaucccacacagggacaaaacaauugcaaugacuucccuauaccaaguccccaaaaaaccccgaacuccccacccccuucuucuagugacacccacacagccaucuuccuucagcuuuuggcucucagucccuccacuguccugccauccccaguugcugugugugacuguuaacagguggcagcaggaaggaaguggccacagcagcuagagcagaggucccuguuuaucccuggcuguuuacagccugcucagguccuccagaacucagcaccauggcaaccagggugaugucagacccaucgucuccauggaaaucggcaaugguaugguauuuaggucaacaagacaaaccuaaaacugaagcagaagucuuccuagaaccccugcacucggggucccaacccuugauaccaaaaagcauccccgcuuucccaggccggcacaucggcacauuaauaccuuauuaggaagccugucuaagcaauccagagcccacuuagcugccacccuucccagcugugauuuuagggcagucuuugaccucuaagaagaaaacccacccacuacucucucuccccuuuucacucaggcaggauuucacaaaaacuucugcuguuucuaaaaaagagaguguucccagucugcacaaaacugggaagucugguuugauaugcccuugauugucucuaacuuccuucucugucugaccuuuaaagggaaggaccugggaccacaaaaacuugccugaguuccugcuucggaaucaucugucucccuccuuccccgcccuucgguccuguguugggcaguauguggacgccggggcugcccacuccuuuuauacagcuuugcccucuuuuguuaucuggggauaaagugggagucuguaacgccccuucccggcaaggacuccuuuaccugacccagcuccucgcuucagucuucagcuuaacuuguugcaaccucccagcccaggaagacaagaggggagucacg

SEQ ID NO: 1516 - RNA, 5892 nt, Mus musculus
agacauuaaaauuaauacauuuccuuuauuuaaaguguuuugcauuuuaaauuuuuguuaucaggguaauacuuguguucaugaagaccaacuuuaaaacacgaaguaacaaagcagagaggauucaaaaucgugccuccaaaggaagagacaaaacuauguaucuacaaauauuuagguauaccaaugacacagagaacuauaguccgcauaucuggauacauaaacgcccagauuuuguguaaaagaacaauuacaaauaaucaggcucuccucccugccacuauuccuccucuucaaagacaagagaccccuugucucuucaaguuugggcuucuggggcugagaaugucucagugauuaagagcacuggcugcucuucuagacgucuccaauuugauuccuagcaaucacagcucacaaacaccugcaacuccaauuucagauggaaugucuucuucuggccuccacagauauuacacccauugauacagauacacacaccgcaccugaauauguacaugcaagcaaacacucauacccauaaaauaaaaaauucuaaaacuaguuauuggaaauuauuacauaauaguaucaaugcaaauaguaaauuuuauaguacguguauuuuuaaauaacuuuuauucucagcauuauuuauuuauuauauguaaguacacuguagcuguccucagacacucuagaagagggcaucagaucuaauuauagaugguugugagccaccaugugguugcugggauuugaauucaggaccuucggaagagcagucagugcucuuaaccacugagccaucucuucagcccaguauguguauuuaaaacuauuaaaauaacacuuuuaaaaauaaauauuuuuaucauuuuaauaaaaacacuuauuuaaaauaacauucaugucuguuuugcuuguuauuguuuuauuuucaagacagaguuucucugugcagcuuuagcuguucugggacucauucuguagacaguccuagccucaaacuuggcucugccugucucugcuuccugaaugcugggauuaaagguguguaccaccacugcucagcugucauauuuugggcacacaaauauacacauaaaacguacauuuuagacauuuugcaaagaggauccaaguguguuauaccuuugugaucauccuucauucguuaauucacgagucucuuuucaucugaguaagcauucuugggcuguauuauuuauuguacaugcucagcaagcccucuguuguagugugauuugucuugugagccugggccuuuaaaggaucccuaguugcuagucaacuggccuuuuaagaauucuuagcuguuagaacugccggacccugugaucuucaguguugguugccucuuggauuucugggaacaggagauuuaaaaaaaaaaaaaaagccaacugaggcugagaaagcacagggcuagcagagggaaaagagaagggaguugaacaugaauucuucuaacagaguaaaaagagaagacaguuggugacagcugagccaggagaagcugagcugagcagauaggcuagaacaguugcuauaguuuggaguugccaguacugagaaaacugagagaagggauucuuuaagcauacuguuggugaacugagggaggaagggcugggagaaaccuuugaaggggccgagugauuaaaccaggacgagggcuuauaaauuucugcucaguggaaggguaucuacuggggcucugaagcccaggaacugcacagcugauguggggcagugucucaagggcagggcaucccgagacaugggaguccaggagccacacagcucugagauuccugaagccuucucagcagagacacugcagcucccaggggaggguaucccagcugagcugaagagaucaggaagcugagcccccuccccugcuuuaauucuucccuucucuucaucgcuucuuggcuuauaagagucacaccaggcagcaaaucucaugaagggauuggagagaugaauccaggagaaggaaggacaaauccagggguggcuucuggaaauggacagcagagauugaacaaagggcagggcuuauauaggauuucucaggggcuagaacuuuucgggcagauuuccaaugugaggauuggugggauuucaaguccuacgcuuggggaagaucagggauugguggggagguuagcgaggaggcagugccacuguggacagcuccugcaguaacuucuuccuuuaauguuaauuuuaugauggccacaggcugaggcaggaaagaaggcacugucaccguggacagcuccugugguaaugcucaugacagcaggugagguguuguggugcggccauuuugaaaacucuuguggugguaugacacggcagcugagggcuggaaagaagggcugaaguuugacagcucuuacagugcaccacucggggacuauagggcugcuaagaaguuaaaacaacugguuacuguuuguaagaaaagcagacauuagaaaaaaauuaaaacaguuuauacucugccauugagguaacccuacaaucccgauuucucuuccuuauuuuuuuuuuaagacagggucuguguagcuuaggcuggcaucaaauucaugaucuuccugucucagcauccugagugcuggauccccuccuuugucuuagaauuuaugccuuucuuccuaaccuccuuccacuucagaaccaaaccuugguuucccacaaagcucagcucuguuagugcugcuacugauauuugcuuccacagcuuaaggcucuguugaccuuucaaucuucccaguucuuacaauaagcucaaaucccuaaacgcuccaagaucuggucuuugccugcccuaccuccaucauucuccucuauucuagaccaauuauucuucuguuccuucaguuugauaaucuuuccuuaaaacccugugugccauugugauggcuaaggaaacugcauucuguaccagguacuucuuugauacccacuggcagagcucugcccuaaaguucugaaagaugaacuccuagcaaacuccacccuccacagaaugguguaacugcugugaaaugauuaacagcuugcccuggcuucuguaaacccacuuaucacuguuuucagagguauccccuuuagagcugugaauaaggggaaagagacggugccucacauagcugagggaaguuaagaacuuucuuacacagcuacaaguuccacagaagcaagauaauggucaucuccaccuucaaaaaaauccuucucuuaaccccuuguuggcagcaugccuuugauguggcuuuaaaguggcuuuaaaaccccacuugcaguuuuaauaaaucuaauuguaauuugaauugaguuuguagccuuugcugguguucucacacucuguaacuugagacaugucagcucuugcuccacccgugcuacucacucuucagaaaugaguguccuucauucagaacuccuuuccagauggcuagucuuccccucugaggcacuuacuacagcuaaaagucagugccugagugugucucugugcauuaaaugucugcuuugcuuaguuuguauuuauuguuaggaggggcaaaggccauggcauggugugugaaaaucagaggacagcuuuguggagucuaugcucuucuacuuuuuuggguaccuaacauuauuaaacucaagacacuaggcuuguguggcaucugacuggcccaagugucugauuuccugucagguugagaaaauaaggacugaaucuguuucauuuaaugcuguuucuucaguguaucauacacaguaggugcucaguaaauauuuguccauuucccacauuuaacaaggcaguuuguuuuguagauucugguuuuauaauuucuauuuuccuuaauaugaauuccaugaggguagguuguuuuuaaucacuugccucugcauucacuaaauaaauauaucuacuucauuuccaguucagauggcaaccacacucaugcccaauuaucuuagguaugauuuuacaugaagcuuagcagcaaccaaaagagcugagaugcugagugaaguagcaauagaaggcaccaugccccacugaccuugacuucuggguuucucaaugacaaagcauagcauggaugaggcccugggcucaaucuucaggacaauaaguaaauguauacauuuaaaacuuguauaugggguuggggacauggaagaccuaaaguuccaguuccuuggguaagggcuaaaggucaugugaucugugaaaaguucuaaaaggaaguguguggggcuaguagaauaggggaguugagcaagguggugcaugugugccuauaaguuaagcacugggaagcuaagacaagagaauaagauucaggccagccuggacuauauagcaagacccugacaauaacaauaaaggaagcaggcaagcagacagaacaggguaaaggacguggagacagacuuagaaguucugcucaguaucuauacauccugaccuuuaucuguaaaauacagguuaaagcacucaccuugcaaugguguuaaggguuagaaauauuugcuuaguauuccuggcuuggggaaugcuugauaaauuagacuuuuuacaauuacucuuuuugugugugaugaugggggagggugucaaauuuggagcuucuacuagcuaagcaagcauucuaccacacccucagcccuuauuuauuaguuauuuggccgagaaaggaguuuacuaaguuauccagguaggccuuggccuucugacucuccuagauaguugcgacuacaacccuguucugcuaggacuggcuuacccuaguauuuuaugcuuccagcuuguggacauaggcacaaagaugguaugcagcuaaauguucaggcugcucuggucauuagaaaaaccagccccacccacacacccacacucauccccccaggcucaaagaacacgaauuucuuaaaacauacggaguuaaacuuggccuaguaaagcuuucugcuaacaucacugagugaaucaguagcccagcaccaagguacagucagcuuccaaaaaacauagagguggugacgguagacgggccaacggcucacaugaugaauuggucccaaacccaucaggccuuacaacauccuggcaccugccaguuugcagcucuggguuucaggacccuccguuguccuuugugauagugccaccuagugggaacgacgagguacugccgcaaacuucaagccccguucaggaucagugcgacgaggugggaagaagaauagcagguaggcgugggugucgucuaugcaaccccuagcuuaguacucugcacucacacauaacgaagcccugugauucuguggaggaagccgcaccaucuguccccucagacguagcugaccagcgaccauacucgauacuucaguaucccugcacagagccuuugggaacaggcuaaagaggccuccccgucuuguacagugccauuguugugauggagaaacugaggcuccccaggagcguagauaacccaaggucacacaccauagaggaaccgcagggagauccaaguccguuucuccgaccguagcgaaaggcgccuucccgccgcagacgcggaggccggugacccggcccgacgacccccaugggaauacaggacagacacggccaugcgccgcacgcgggggccgcgggacgcaagcaggaagccagagucccgcgcggggagccccugggaacacaggcaccggccacgugacaagagacgccggccaugugacagggaagcgcuggcaaaggccccccggugcacggucacgcacgacgcacguacacgcacggaagcgcuucgagcagcgaggcgagggccu

SEQ ID NO: 1517 - RNA, 1140 nt, Mus musculus
caguguguuucuuucccucugcauuugcaugggaagcugcccuguagcuucaagcucuguagcuuggaagggaaccuugguggagucugguaaauagcaaacgccgguuccuuuguguccagucaagucaugauggguaaucaaagcccuacuccuuguugagcaguuaggcuccagguacaucgacaguguuuccaggaaucuuuaucaugggcuuaaaaauacaucucuaauaggugagaaaacugagacuuccggaucgggauagcaaucuugaggaggguaacacaugugucucugggccagacucaaaagcgcacacugguuucguugccucugcaguagccuucaaagagcugcuccuccacuggaagaugagaggaaaucuuuuucucagguuauggacgccuaaguuuuccuucagaccaauuaaaucacaaucucugggcucgaagcagacaucggugucuuuucggauucccuguuugauucccguaagcacccaggacacugaccugccuucuacuuuaacagccagagccacuggcuggcgcucaugaaagcaaaacucaagcggaggcgcggauggaaggaaggagggggauauuucuccuuaucucagcgucaaaaccuggggaggggcccuggugggggucccugggggcucagguguggcgcggcugcaggaaguaacccccuccgguggcccggagcgcuggccgauugcgccauccuacugggcuuucguaaccgcgagccggggcugccaagaggagcuucagcaccgguuccucaaauguuucacuguugccaggacggccggcugcugugugucacgugcaugugggaagucgcgcccacaccgaucugagccacgccggggcgagcgcucgcagugcgagcugaguguggagcccgaggccgagggcgacugcucucgcugccccagucugccggccgcccggccccggcugcggagccgcucugccgcccgccgucccgcguagaaggaagcaugcugaccgucggcugcacgcuguuggucgcccugcuggccgcgcccgcggucgcgcugguccucgggagcugccgcgcgcuggguaagaggaacccggagcgggcguggggaaugugacacug

SEQ ID NO: 1518 - RNA, 3334 nt, Mus musculus
agaagcuucgugucugaggagcacggucagccccgccucuuccuccggcuuacgacuuuuacgacaacgccgcaccguaggguugcuuuccggcagcgaacgcugagcccuggcuauauccgacaggguagcguaagcuggucguggucucguguugcccaugggcugcagagcuucaaaguuucuagugccccuacuggaaugagcgucuuugaucuuuuccgaggcuuuuucggcuuuccuggaccucggaggugagaauaguucugggcuggauauacgggagggguguuuugguggacacuugaccccuucaucauauuuuuggaaagcuuccuuucccgcccccuucaacuccugcugagaggucaaagaucgcauucuugaguacucaccccgccacaguaaucaaagcagugguuaagaggacagaaacggcagcuuucuccagaccugggugaugcaacagggaccugggcggagaaaacaaugggggucuggggaagaggaccaugagcaaguaauugggcgauuaguaguaggcuggaugacccugaagaaaaaccaugggucgucuggcagcuguugggaggugcggagaggcucuguuuagaaacaauacaaaacccuaauagauccaucaacguuguucugaaaccagaucuccuguguuuucagcugcccagaccccucuuuggcccaguuugcugcccuuguguugauuuuuauggcuuagacaguguugaagucuucguggcuuauuugccuucacucucagccacagagauccuuuuuuuggagggaugacucgagaugaugacgacgaugaugaugaugaugacgaagcggaggaagacagaggcgcguggggucgagagagcuaugcguuugaugguucucagccuccagaggaauucgguuucagcuucagccccaggggagggaugcgauuccacggcaacuuuggcuuugaugaucuaguacgagauuuuaauagcaucuucagcgagaugggggccuggaccuugccuucccacucuccuggugugugaauuucccugagggagacccuauggguuucuaguggguuagugaugaauaacagaacuugcagaguaguugggauagucuacagaaauugauuuuuaaaagacuuaaaauguuuaaggccuuuccuaucccagaaucaccuaccaacuuucuacagaacuuccagguccugagucagaaacaccuggugagagacugcgggaggggcagacacuacgagacucaaugcuuaaguacccagauagucaccaacccaggaucuuugagggggucuuggagagucaugcaaaaccugaauccccaaaaccagcuccagauugggggucgcagggaccuuuucauagggugaguacucucugcaccugaacuguaagcccuuggugggaucucuuagaguugaguugcaauuuuagccccuuuaauuaguucauuuauccagauuuucuucauuauugggauuuucguuuugaaacuuacuucacuguauagauuuagauaucugccugccucuggauuaaaugugugccaccacaccucaucuaagauuuauuuucuuuuauauguaugaguguuuugccugcuugaaugucucuguaccacauguaccugugcccacagaggucaaaaaggauauugaauccccuggaacucaaauuauguaugguuaugagccaccaugcucuugcugggaacuauaaacuaugguccucuacaagaguguccccuccccucucuuauuugauuugauuuguuuguuuauguauuuugagacggagucucuguaguauuggcugaccuggaacuugcuauauagaccaugcuggccucaaacucagggaucuccugccucugaguuuguuaguuaggauuuuguugcuguuuguugguguuuuguuuuguuuuuuguuuguuuguuuguuucaagacaggguuucucuguguagcccuggcuguccuggaacucacucuguagaccaggcuggccucgaacucagaaaucugccugccucugccuccggagugcugggauuaaaggcgugcaccaccaugcccgguuugacaccuuccaaucuuaaacuugaaggucagagaacccauauuccucccuuguuccaaaaccccagaaauacuuccauuugggcagcuuauauucacauaccuucuuccuuaguuuuauauggacuucuacgaaaaagaauuccugaaauucuuuccugcacuuuuaagauucguucuuagccgggcgugguggcacacgcuuuuaaucccagcacucgggaggcaaaggcagguggauuucugaguucaaggccagccuggucuacaaagugaguuccaggacagccagagcuauacagagaaacccugucuggaaaaaaaaaaaaaagauuggaagguguuuuuucacugauuguguguggcuucuucuacaguuggaugauacauggccugugaguccccauucuagagccaaagaggacaaagguaagucuagaaggaggcacauuuaccauaccauucuccugaaguucucucagaagguucuuccugaaaaacguaucuaauuaccugcccuccacucucuccuggcuugucaucucucugcccuuccagaucuugacucccagguuucccaggaaggucuggguccacuucuucaaccccagcccaaaucguauuucaaaaguaucucugugaccaagaucacuaagccagauggggugaguugagaggaagaaguauaauccucuggggaaagggaccaguauaagaaaauacuaaacucagcauagugcuguuagcaauauauugggauuucucuugcagacaguggaggaacgccgcacugugguagacagugagggccggagggagaccacagugacccaucaagaagcccaugacaguuccagaagugguaagaguauaacucaaaaggcccaucucuuaacauuuuggggaaaggaugugccuaccuuuugauacaucuucucucuuuuuggugugacuuucucccuuagauccagacucucagagaucuucagcuuuggaugaucccuuuuccauucuggauuugcuacuaggacguugguuucggucccgauagcguucuuaaacagaggccuucagguccuucccacucccuuccuguugcccauugccaauaagcuuagcucugucugucaucccagggucuuaaaugugugaaacaauuaauugagcuuaugccagucugucauucauccaaauugaccaauaaagccuuuauuuaugcuaaaggucu

SEQ ID NO: 1519 - RNA, 53191 nt, Mus musculus
ugacgugcgcggcccuuucgcgucacgugcugagggacgcaggaaggcaagugggagggggaaggcgcgagagcgagcgcgagagggaaaaggagggaggggguggggaggagggaaucuuauaucacgugacaggggcggcgcggcccggggugucaguguggaggagacugagguaaaguugggagcgcagcggcguuggcggcggcggcggcggcagcggcaacgcggcggggccggguauuguccgcggccccuuuaaauccgcgauccccuuuuuacccucccuucuuuuccucuguccccuccguauuccugucccgcgguaggccccccccacgccgugugucuccccacuguacacccucccuucuggucuugggaacccgggcguccaaccuccccaccucgaauuggccgccggggguuuuguuuauaguuggguucgcggccuacugggccgcgccagagccggggccucgauuugggagcguggccggggcggggcuuggggcagccggagggggggggcauguggcuagagccugaagggggagagcgagaaagagcgcgggcgagcgaggccugggcccagccugagguaggguuguuuaggagggucagugucuuguggagaaggccuccucccuccccaguccucucugggccucugauccggauccggccugguuuugggggcggaggggggguggcgaugggguggagcugccccaaacucccccauguggcccucgguuuggagugcggaggauuaauuuguuccgggugggagguagagaagcgaauggccccaugggcucuagauguggcgcggaggggggugagucucccauccuccgcgcgugggcuucuguccucucuguucauuuccagccucuuugucagcuccucuuauuacccugccuucuuucuuaccgacccuggucguggaauauauuuucgcugcagucuuugacuuccuguugucuauacuguaguuuuggcuacccaagcaguuaucuuauuugggaagcuggacauggaggcccccguggauuguguugcgccuaagggaugucacuagacugggcauuuguucauuuuucucauaaugggaauggaauuccaaauuucuugagacccuucaccugguggacagccccuaaauuguuuugcaaagugaugucacaaacaagagacuguuuuccacgauucuuaaaauuuagcaaccucugguguagguuguuguggaaagaaaaaacaguuaaaggcgauuuuguuaaauuuguuuuugccuuugacucacugacuacuaaauggagagauuauuuuuugucuccaccucccauauucugcguuggggauaucugcugugucuugcugggagggggguaugagucaguuugacaaccagcauuagagauuaaaauauuuggauguguaucuguugauaagacuguguuguggguccuauaccacugucuuuaauuauagaucaucccagugauuguuucuguugugaaugggagauacugcugucauguaaaauagugaggaagggcuaaauguacuggcuuuccccaguguuucuaacugggaagacuccuauuagauugaaggugguuggggaaugggacacaggucuaggaaaauuaguuucucuguuagaagugguaagccuuacccaucccaguccaacuucagaaugucugaauuguuucucacauuagauuguaagcucccugagagcagcaacuaagucacacugcuuuuguauuuccugaaggauuggacaaguaguagauucucaauaaauacuuauuguuuauuuuuuucaguaaaauuucucuggcuauuuuuuuaaguagcuggcuuucaaaauguagucaagggcacuucuuuguugaaaccuguacuuguucuguaguguucccuugguuuccaauacuucuuucucaucccacuucccuuaaguacuuagguuuucuaugaguucacaaaacaaggccacucacuuucacuguauaacucuagguauucaucuuuguuugcuacuaaaauguacuaauucugugcccuuaagugguuugcccagauuauuuacuuuugaccuguugcucauuguuacuaaugaggggguuaaauuuuucuuaguuacacauuucaaaguauuuccaaagagggaaauggaaguuaaaagcaagacugauuaaaaagauuuuuuuuucuggcuaguuacauaucuuucaauaugacuauauuuacaucuaacuuguaaaaugugcagugaucuauacaacuaaucuuacagcuuauauuuaugguauaauucuuaaaaauucauauacauggaauagaaaccauauagcauuuuuaaaccacaggaacaggaguagguugggauugacuaucuuauagcuaauuuuaaaacauaauuuuuccucuagcucuucucccccaacuauugcuguuuuggauccaccaguacuuaguuaaacaacacuuguauuuuuguaaauuaaguauugaaacaacuauaauguuagcuugggaaagugaccuaauacuauacuauuuacaggucuuuguacauguauguuggggaagagguacugguuaaaaauuagugcugugccuguuaaaaccuaaauuggcgaugaggaaugaaguagaagucuuuguucuuaauaaccacaucaaaaacaaagacuugugcaaccuauugacacuccuuggugaaaagccagcuuuuuuucuguguuauccaagaaaugggugaaguucaugucuccacuuaauccuugcauauuucuuuagaacucuccugaccucaaaauucagugucugcugggcagucuagaauuaccuuguauaacguuucguuagugaacaaaaaaauguagagcaggaaaguauaaauuugucuucuuugaaaagggauaaaacaaugaaaaguaacuugauuuugagcacacuaucaugaugaugaauguuuccuuuguuuacucaaagcagcagaugagauuacauuacaaaacaauaugaagaaagagaacuugaauuuaguagaacacuuauuugauagaaaguacagaaacuauguucuaguuuugagaaggcucuauguucuaugucucuucaaaaagugaagccauucugcaaacauuauccaauuuaaagucauuuccuagaagccuuuucaaacuuggugauagguggauuugauugggggcagauuugggauucucuuuuguuuuaaggugagugguggagaguaauugccauucuguuuacuugaaaauauauaggagaccagcugaaacagcugcaaaggcaguguguuggaauuaacugucuaggaaauagauucuggguagucacuaggacuaacacaugcccuagucaugaagagcuaaaacuggaaauaaaaggcuaguuaugaauuugucuuuucuaaguaguagaagucacacacagcuugucaaacaguguaaggcuaugacuguuuuuaauguguacuggguauuuuuuuuuccuucuagcccgguuauggcuaugaacccuuaggcccuuaacugagcuaugcccacaguucauccaguauuauaaaacugcaauuucuuugauuuauagacuaaucuagaagguucuuccuccuuuccucccucucuccccuuuccucccucucuccucccuuccuuccuucuuucaugucugucuaucuuuugugacaggaucuuacuguguugcccaggcuggccucaaauuuaugaucuucucuggucagcuuuccaagugcugggauuacagguaugugcugugcccaacuccuggaaggcauguauuuucaggguuuguuaauugucuuucuuuuugucaaagacacuucagauacuuugacauguuuagaaaguuuuuuaauauugauaaugauuuuugcuuauuugcaagauagcaguaaucaaguauguuucuaaugucuuuuuuuuuaaaagucauaugggacagcacaugggaggaagaagcaggaagauugccaugaguuugaggccagccaaggcuacauagacuaucuucaaacaaacaucacauauacuuuuauacguuuucagguguaggguuugauuacuuagccuagccuaggacuuuaugcauacagaaccauauguuuuaucacugaugcauaugaauaaaaauguaauaacagucauauuuauuacacuauaacaaaaaaaauguuuuuuucaguggcacacaccuguagucacaauacucaggaaguagaggaaagaugauuagguuuucuuucuuuuuuuuuuuuuuuuuuuuuaauuacguauuuuccucaauuacauuuccaaugcuaucccaaaagucccccacacccuccucccccugauuagguuuucaaagucaguuuugcuauaguauguuugaggccagcucacacuaaaacccaaaauauauauuaaaagauggaucuugaguugaaaauauagcuaaguuguagagagcuugccuagcauauauaaaggccugaguuugauccccagcaccacuagaaaaaagaauaaaaguaggugaauuaaaaauaaaaauaggugaguuaaaaaaaaauagaugaacuuccuugguuuguugagaauagcaaaguaauuggugguaaaguacugauaaaauggaauuuaaacuuuuuaccuauguuuaaccaucuguuuuuuccucuucaguauucuuccuuguaaauacuguuauuuguauauacuguaaaugaugacgucggugggcacuaaccgagcccggggaaacugggaacaaccucaaaaccaaaaccagacacagcacaagcagcggccacagguaaugaauccaaggaugugaaucaaugaguaacuauaccaccugauagugguuuccaugcaguguagcaucauucugugcuuugggguguugauuuagguuccuuauuguuagcuauuccauggucugauaacuauuagcaacauucuguguaaauguguuuacuuuuuuauuguuuaauguugugaggcuuacgacuucauuuugaauacugugcuguguccaguauuagagcuaguugagcaguacguuacuuauucucuuuaaccaauauuuaucaaauauaacccuuuucgugaaagauuuugacuucugcucuuauuuuccccuaagguuuugaggccuuccuuaccugaguuuuuccuuccccaugagaaacuagcauauucacuauucuuguacguuaacaaaugagaccauagagcaaucauucucaaccucccuaauacugugacccuauaauacaguuugaguuauggugacucauucauuuauauauaaagaaauaauuuuuuuugcuuuuucauaacucauuuugacacuguaacuaugaauuguaacuaaugugcaggauaucugauaugcgccccccucgcccugaaaugguuguuugacccucaaagggaugaugagcauugcuaaguuuuagaggaauaaauuaacuuuggauauuaaguuugauuuagauguguuguaaaucacaaaaucccuaacaaguguuauggguaugaguuacuuacuugaauuaagcgcagugguccaguauauugauuauauaagacuagacuaaagguuuccaggauacuccuugacuuaacuuuuuaccccuuucuuucccuuuucucuuucuucuuuuuccuccagagucuugguagauagcacuggcuggccuaguagucacuguguaguucaggcugaucucgaacuuagaaucuucugugugucagguuuuguguaauaaauucaguugugggcugucaccauggucuguuuucuuauuuauuuauuuauuuauuuauuuauuuauuuauuugguggcaagguuucucugugaugcccuggcuggcuucaaacucagaucugccugccucugccuccuuagugcuagaauuaaaggugugugacacuuuacguggcuccauuuuuuuuuuuuuuuuuuugagacagguuuucacugagauguugagauuggcuuugacuugugauauucuugccucagccuucugaguacaugaauuagaggucuauaucaccagaucugcuccccuuaaacuuuuuuauucaagauagguuuucucuguguugucucaguuguccuggaacucacucugcagacuggguuggucuugaacucugagaucaucuugugucugucccugccuuccaagugcuaggaucaaaggcaugcaccaccacugucuggcucccuuaauuaaacauuuuuauuuaauagccuuucuaaguaaauuuguaguagaauuuuaguacuuaaaucucuacucuggguagaugggguguguagugauaguaugcuuuuaauccaagcacucagcauguucuacaugaguuacaggauugagccagagcuaagcagugagacacugaaaaacaaaaacaaagaccacucaguuaugguaguaaaauucuugaucuuacauauacuguauacuuauaagauauguugaguauauccuuggguuaaaaucuaauaauauuucaaguaagugguuaguauuggauugaagaaauaggaaccuuguuuacacacauauauauauuuuuaaagauuuauuuauuuauauuauauguaaguacacuguagcugucuucagacacuccagaagaaggcauuagaucucauuacagaugguugugagccacaugugguugcugggauuugaacugaggaccuucagaagagcaguugguacucuuaacugcugagccaucucucuagcccuacacaauaucuuuauaaauacauuaaugugaauugauggacagauauuuccaggaugaaagcuccuugagcuaugaacauuggugaaaagguucauugcucucuggauuuagaucuuaauuaguuuacagcuucacccuguauuugccauucuguuuuaagugucauauauuuuacuuguuuacauuuuaaaugauaucccccuuccugguugccccuccacaaauccuccauccccauccccccuuccugucuccacuguuugugucuuaaacauuacuuuauuacuuguuuguuugaggcacaguuucuguauuuuugcuauccuggaaucuaguguguagaccaggcugacuuuaaacucagagauuagcuugauucugccucuugagagcugggauuaaaggcaugcucuaccacugcccuugucuaguuuuuaaauuuuguagugcugagaaguggcccuauagcuuugaguacucuggguaaagaucuccccagucuuguuuuuauguuuuuuauuuugagacagggucucauaaaguugccuaggcuggccuugagcucauuuuguagucuaggucaaccuugagcuucccauccuuuuuuuguuguuuuuuuugagacaggguuucucuguguagcacuggcuguccuggaccucacucuguagaccaggcuggccucaaacucagaaauccgccuaccucugccucccgagugcugggauuaaaggcaugcgccaccacgcccggcuuuuuuuuuuaaauaacacagacacaacugaguugguaaaggguaaagaucuacuacuuagaucccucuuaguuaauuucuugcccuugauuaaaguuucuugauucugucucaaucccuaggccacugcagagcaaauucgacuugcacagaugauuucggaccauaaugaugcugacuuugaggagaaggugaaacaagugaguguccuaguuuucucugaaaauaucagaauauaaucaggauuaaaugucauugaugcuuauauugaauauaauuauccuagguagggaaauggcuaagagggaaaguccuugauggccugaguuugaauuccauaaagccaugcuuuggagcacacauuuguaaucccaguguuuguucuuacugugagaugggugaugaggacaggagaaucccuuucuguuuuauacaguggugaaaacaaaaagagagacuugucucaagguagaaauacaggacugauaccaaggcugucuuguaaccucuauguaugagcugugguacacacauuccugccacacauuccugcccccauauguauguguguguguguacacauaaauaaauauauggcacacauaccaggaaaaauaauuauauuuguugauuuuuuuuuagaucauucaauaauuaacuucauugcaauuauauugcauuccuuuggauagguacuuuguccaaaaaguuuugucuuaauucugacuuugugggguguguguguguuguguuguguuuuucuucugacacacccagaaucuuggcaugauaaauucauaccuuauuacugagugauauucucagccccuuguaccugggaagcauggaaaacgauauguagagcucgugucucaacuuaauucuccauuuaaugcuuaacuauucugacuccaucucuaagccauaguucuuacuggauguguuuauauacacagaugcuaugguacuugauguggaggcaacaagauaauuugugggagcugggcuuuuucuucccguguagguucuagggauugaacuuaaguuaucuggcuugguaguaagugcuuuuacuugcuggcccucucuccagccuuaaaauuuuguuuuuggaaguauaguuauguuuuacaugucuucuuuuuuaaggucuucuuugaaauguaccuggugugucaucccuucaucuauuuuucuuguaagaguauaaaacugcuuaugauuacugcuuuuuuucuuucaguugauugauaucacaggcaaaaaccaggaugaaugugugauugcuuugcaugacugcaauggagaugucaacagagccaucaauguucuccuggaaggaaauccagacacgguagagaacuaauaacauuuuugagaaugggggucuggguugggagacuaguaauaauuuuaaaaguugcuaguagacagauggucuuaaaacagccugccuuuucucuaaauagaauaagaaacauccauagagauccuggcagguuacaaauacuguaccuuuuguauacacauccucuucauaagagucauuaggagaaagcaagugaaguaagucucuucuaauuggucuggaauaaguuguucauuccagauaauugauuucaaggcuuggaaggguuauguugcuuugaacuagaggugcuauuuuacagucuugauuacuaaucagagaagauuucucuuuucauauuuguacuaacaagaaauaaauugcuagauucuaaauugaggacauuccuauauaguuauuaucuuuauauuaacaugcuguuucauugcuugaacucaguuuuguuguacuauuaaaaagaugagcuauauagccuguuuauauucuuggaucugaugaagaauaucuuagaagaucaugugccuuagaauuuagacaguuacuuugauuucucaucccaccaaauaaguuuguuuuuucugugucucaucuuuaacaauagaacauugccuuauugccauuguggguuuuuuuuuuuuuugagacaggguuucucuguauagcccuggcuguccuggaacucacuuuguagaccaggcuggccuggaacucagaaaucugccugccucugccucccgagugcugggaucaaaggcgugcgucaccacgcccggcgccauugugauauugcuaaagcucuuauuagagaacuuuaguuuuauauggauagaucauuuugaaagauucucacuauacugaucuuucacugaggaauguuugguugaaauagaguucauccuuuaaaauaccaacuuaacuauauuaacuaucucacaauuucauauguauauuaauauaacuuugaucauauuuccuccauuagcuuuuuuauccccuucugccucuugccaaacucaaauaucucucccuucuacuuuacugccuuuauguguaucuuuaauuaggcuuaccauacaugaauauggauuagaaguugcuuacuugagcaaggauaauuuaucaguggcuacacugcugaguaauaugauucccccuccuccagcaaccauuaacugucugugucucuucaggcaggaguggggccuuacgugcccuucucccaugcaugauggaauguuguaggacccagucuugugccaggacauugcugauaugaguuaauguugucuugccauagcauaacaagaagacagcuucucacggcucuccuuccuauccucuagcucuuuuaacuauguucucuuauguuuacugagucuuggaaaggggugcuguagaugccugacuuagggcugaguauucaacaguuauuuauucucagcacuuugaccauaauacaucucuaucaacucuugccuacuacagaaagacucaaagaaguuauauguuaaugugcauguugaggaucaaacuugggcaggcacuguaauggcuuggugucucucuagcucaauguguuuacagaacuaaaaugugaaccucaaacuugauacccuucagccucagccccucauugcugggauuacauguguauuccaccaggucugacuuaaacuuauucuuuguuuguuuuuguuuauaggauacucucuuauuauuacuauuuuguauuuuuaaaaaauguauuguuggaccaggccugaugaugcaggccuuuaauccaguacucaggagguagaggcagaucucuugaguuuguuugaggccagccugccugaauuauagaguuaguuccagggcagcuagacagccaguacuguuauauagggaaacucaaaaaaagaaaaaagaaaaaaaaacagccacaaaaaaaaacccuuacuggucaaguuuuuauuauguuugugugacguguauagggguagacaugugcauguggacaucaaaggcuagcagucaggaguugguuuucaaagcaagugccuuuaccugccaaacuaucucaccuguugucaugcuuuuuaaaagguucaaauuuuucuuugcagaaguuguagcuuauuucucuuaucucaccucuuguggcuucugucuaguuauacaaaucugaucuccucugucaaaaaaaaggaaaaugagcuagcacauauuccacuuaggccacauuuaaaucaacuacuauaaauaaagccaaugaggaguacucauaguauugaauauuuuuuaguggauaagaucacuaaaaaagaauacuaacacagugucaaaggaagaucauaauaguaauuuuuuucccuuacagaacucacuguugucagcaguucauauauacaucacagacuuuaccuugagauaggauuuaucuguuuagcucugggcuguccuggaacucacucaguaaauccaccugugucugccuccugagugcuggaauuaaagacacggccacuauuucuggcuguuacacagauucuauaaacuugucagaauuugagucagacuagcauaaaauuugaaaacuuggcuggauaugguuguguacaccuuuauccaaauacucaguggcagagacaguugaaucucugugaguuugaggccagcuauaucuuuguaguaggguaaccuggauaacauaguaaguucucauuucaaaaccaaaaaaccuuaaaguuugucggaacuuguuagucugauguucaguguucgugguacagauuuagguguagaauuaugaugacuuaggaaucuaaguuucagugagcaucaaaugacauaccagccacuauugguacauaccaacuggaauaaaucauuaggaaaaugcauagggaggaauuugcuacguucuagguuaauacuugucuugguaaaaugcuguuacuuuauuuaaaaaagaaaaacaacuuuauauguauauuuagccaacauacagugauguggaaugucuauaucacuugcaugucugguauccuuggcaucagauuccaaggaaauuggacauacagaugguugugaacugcaguguugguacuggguuguuggaacccgaauccuucagaagaguaacugauacuuuuuuguuuguuugcuuguuugauugguuuuucaagacaggguuucucuguguagcccuggcuguccuggaacucacucuguagaccagcuggccuugaacucagaaauccaccugccucugccucccaagugcugggauuaaaggcaugcgccaccacugccuggcuaacugauacucuuaacccucugagccaccuauccagccccugcugaauuacuuacacgaucaaaacgugauacuguuuuuuuaauauauauaaauuuuauuugacuuuugaagugauagugcuuggauugaaaucaggcuuucauacauguguguauucuacuauugagagccuuguacccuaacccccagcccuagacuuaacuuuuuuuuuuuuuuugguuuuuuuuugggggggggguuucaagacaggguuucucucuauagcccuggcuauccuggaacucacuugguagaccagcuggccuugaacucagaaauccgccugccucugccucccaggugcugggauuaaaggcgugcaccacuaccacccagccuaacuuuauuuuuaacucaaaucuuuauuuugucaagaugugcauaagauuaaucauuuuaacauaugaguaagagaaauaacuguuuuccuucuaaauuuauggguuucauaaaauaugcuagaggacaaaacuuacucaguuuucaucuacuaguaacauuuagaaaccuucaguuuuaaguuuugcuuaauuugauaagaauguauguagcccaaugucgugccucaggccuuuauucccagcacugaggagguagaaguagucagaucucugaguuagaggccaaccuggacuacauaauuaguuccaggccagcuaucgugagguaaugagaccuugucucaacacaaacaaaaaagaauuucaacuguaauguguugaugaaucuagagagauuuuuuuuuucuaguuuagggaaggugcuugauaaggagcagucccuagguucuuagacuacuguaccugagcuacugagcugaauagaacuuagaagucaucucugcauguauuagccagguagugugaugaauaucuguuaucucagcuuuuggugcuaagguggagggauuggaaauuugaguguagccugucccaugguccccuaccucccaccucauaaaacaaaaauacuucacuuuuggcaucacuaaguguaagaguugaguuuaucuguauucugcauauaaacagaaguaaacuaauacauauuuguuucuguuuuuuguauguuugcuuguuugagacagaauuucucuguguaguccuggcugugcuagaagucacucuagaccauucuggccuugaacuuaacagagaucuaccucacccugccuccugagugcuggaguuaaaggcauggauuacauugucuggcucaaaauuucuuaacuguggguccugagaagauaauuguacuaguuuucauccuuagugaauuaauuguaguucauauugaucaaacaugaguguucuaccuuucuuuagcauuccugggagaugguugggaagaagaaaggagucucaggacaaaaggaugguggacaaacugaaucuaaugaagaaggaaaagaaaaucgagaccgggacagagacuauagucggcgacguggugggccaccaagacgggggagaggugccagccguggacgagaguguaugcauggggcuuuaucaaaaccagcuguggguuaguaaugucuggacuucaggcaugugucaggauccugcuaggcaggccccuguaaccauuauaucaccuauuugcauuucuugccaucaucuguuaagaccuugacaucuuuuacauguagccuuuccuacaguagucacuuauaugacaaucauguagucauuuguaaaguuacuugacucagcucucugugaugucucaucacuaucccgagugaccuucguguuccauccuaccaggucauguucucuuaguuuugucucccugacacuguguucaauauaaugcauauguuuguauguauccuaacagaucacguucugucuguguguguuuuauauuucaguucggggccaggaaaauggauuggauggcaccaagaguggagggccuucuggaagaggcacagacagaggcagaagaggccguggccguggcagaggugacaguguugaggggaaguggcauauaggcaugagauaguuaucuuaguaagguugacaagcaaauaaacacuagaauauauauuuauuuuuguuagguagaauaggaaagaagggagaugacaacccuagucuuuuuguuaauguaguacacuugcuugaacagcaguguguguaaaugccugugcauguguuuaugugugugucgaggggggacagauaccaaaaucagguggcagugcucccuaaacacuuuuuauuuucuaguuuuucauuuuuaaacuuaaauuuuuauuacaugguuuuuaaacuuuuuauucaaggaagauuauauuuuucauagugaugaacaaugaauucaugaguucucaguuccuuuuuucccuucacuguuuucucuuacucauuucccugacucugaucaaaguuucagagauguguaaagguuuuuuugcauauuuguuuucuguuuuuuugucuuuguuuuuuguuuguuuuguuuuugcuuuugcuuuuuuauauuguugcacaugugcguaagcacucuaccauuaaauauaaaccuagaacccaguagaugacauuggaucugcucuuaaaaccgcagauagcaggaugugguagcauauggcuuuaaucccagcacuugagaggcagaggcaaauggaucucucaguuugaggccggcuugauagacagagugaguuccaggacugccagggcuacacaauacaaaacagacagacaaaaacaaaacaaaaaagaaucacagacuuaagaaccacuguagguucugguaccaaauccaggguuucuuuuuucuuuuuuuugguuuuucagacaggguuucucuguauaguccuggcuguccuggagcucacucuguagaccaagcuggccuuaaacucagaaauccgucugccucugccucccaagagcugggauuaaaggugugagccaccauugccuggcuaaauccaggguuucuacaagagcaggaagcacucuuaacuauggagccaccucuagccccucauuuauauauauuuuuuuuuguuaaaagcaacauugugauagaccucuuuauugauaaaucuugugauuguuucuuuuggauaauuuuuuuagaaaugggcuuucgaugcacaggguuuuaagacuuuuuuucuuguuccaagagugaugcuaaggaaugcuaggcaaauguuuguuacuggauggaucaagguccauaaaaaccuuuaauuacauuuuuacugauuuuguggacauauaugugugacacgggugaauggcagugaaccuuucuuuucuacuauguggguccugggaauugaauuuacaucauuagauuuggcagcaaguaucuuuaccccaucuagccauaucacaagcccugguuuuaagacuuuuuuucuucuuuuuuuuuuuaaagauuuauuuauuauauuacaucuaagcacacuguagcugucuuuagaaaccagaagagggcgucggaucucauuaugggaugguugugagcuaccaugugguugcugggauuugaacucaagacuuucagaagagcagucaguguucuuaaccgcugagccaucucuccagccccaagacuuaggucuuacuaagcaguucuggcuauguaggccaggcugguguggaacucacagacaucuaccugccacugcuuccugaaugcuaggaucgaagauauuucagcaaaguggacuuuguugguaaugguaaaaaaaaaauuacuauaaaccauaaauucuggacacauuucaaaaaugucauaccaaagaaauauggagacauacuacuaguaaggaaagaaaaguuaaaaaucugaaauaaaaagccacccagcuuuuuaucagugagauaaccaccagaaaugcuuccuguaaaaaguuaaaaaaaaaaaaagaaaaaaaaacaaaaaacccugagguucagccauuaaauaguacuuccuguucuugcagagguccugcuuucuguucccagcauccacacaaugucucacaaccaucaguaacuccaguucaaagauaucugauguuugcuuugacuuccucaaguaccuccugcacacaugcgaugcccauauguguguauguauguauacacauauauacacuuagaagugguaguguacagcuguaaucauagcucucaggagguagaggcauguggauuucuguggguuuugauaaccaucauugaggggaaagucugcaguguuucucuaaaacaaaauaucacaagagaaaaaguaccaaauguucaaaaguuuugaguaaauucgcauucuuggauaaacaugauagugucccuuguuagucagaucuugcuccccccuccccccaaaaaaaaucuaaaaugcuuuguacugagcaguaagaaugcugaagauaagaguagucuacagcuuacuaagaggcuuuccgcucuggccaggucagauagguuucaaaauugcuucucuagggucuugaauguaggugucacuuacaucuggcuauuuugucuuaauaacaucaguuauguucucucuuaaugagauacugagcaaaaaaucccuuuugguuuaauauuaauuucaaaacuuguaaacugguauacuuuugccacauauuucuuugcucugggaguuuuggcuuuaguaacuuuuuguggaauggucuuauuuuaauugaccaucuuuugcuuuucuuuccuuacuauuccuugauuuuagccaauucuuuguauuuuaagugaauuuucuauaaguuaguagacuuauuugggaaguucuccaccuacuuuuagcaacauaaggcauacauuuauucacacuacuuuuuugguaguggauagacuccauggcugaggacuugaauuagguaauuagcauuuaacuugguagugauucucaucucucuuguacauucaggcccauugguuuuagaauugucaguaccaauuucauaaacccagguaaagggaacagcuuuuaccaaccaaagugaugcauugaauucaucuggcugaaacagucuaagaaucuuaucuggccccuuguagguuuuguuuuuugucuuuuuaaacacccuuguagguuucuuuucuuuuuguuuuguuuuguuuuuguuuuuuuuugagacaaauucucauuggccuggaaauucaccagugggcuguuuggcuugcccaggaaucuaucaaguugagggguuuuuuguuuuguuuuguuuuguuuuguuuuguuuuaaagauuuauuuauuuauuacauguaaguacaucuuaggugccuucagacauucuagaagagggagucauaucucauuacggaugguugugagccaccaugugguugcugggauuugaacucaggaccuuuggaagagcagucagugcucuuaaacacugagccaucucuccagcccaaguugagguuuuuaugcuaagaugucaagcacuuuaccugcauuaucuaucucccuccccuuuggcaguuuaagcagcagauaaacagcuguuggcaguaaugauuguuucauguuagauuaauugguaugcuccaugguacuggaagaaauaaacacuuagcuauuccaaagaugucuugccuggguagguuuucaguaucagcuucuaaaauauuucuguuuuugugcagguaguucugguaggcgaggaggaagguuuucugcucaaggaaugggguaaguuucauugauguuuuaaauuuucacucugagaauggacaaagagaacuucagccaaaacgagauugaauaauuuguagacuugcuuuuuuaauugagcuccacuguuuuuacagccuaagcaacuuuaagcuuacagucgucuugccucagccucugaaaugaugguauuacaaugugugcaccaugacaccuggcugauuuguagaugaauaaaaaaugucgguuugugcucauuuucaggucuaugcauucaccaucucuaucauuguguauagcuuaugcuaugccauuucccaguagcugaucuuaaaaagccugugugguuauagaaugaggacugaucuuguuaggaggaaauggucaagauugugcuuguuuuauucacguuaauguucccuguaucugcuaaugaaguuagaaaauguaaagcuuuuauuauuuauuuauuuauuuauuuauuuauuuauuuagaaccuuuaacccagcugauuaugcagagccagccaacacugaugauaacuauggcaauagcaguggcaauacauggaacaacacuggccacuuugaaccagaugauggaacaagugagugacuuuucuaagaauuuuuuucuuauuuuggcauguugcuauggauugaaaaaucagggucugugcauaauagccaaauauaccauugggauguacucauuccuggaaauaacuuugcauaaaacauuuuuguuauuuuaugauuauacauagauuuaaaagcugaacagagauagaaaagauaguauaaggaugaagauuuaauguguauaguauuaguucgucauggguuugugagcauauuuuauguaucaguuuaccugaucacucuuuuaugaaguagccaaggcaagucacaacccuucccauaauaccacuuguuuggguuuuaacauaccugcaagcuggccuggaacucauggguuuuuuuuuuguuuuguuuuguuuuguuuuuuggcuaagcuucccaagugcuagaaugauagauguaugcuuccacaccuaaccugaaaucaguccuauuuuuaggaaauuuuauuuauuuaguuguuguuguugagacuagacuugugucccaagugggccuuaagcucacuaugugagugaagaugaucugcuucucuugucuccacuuguccaggaauuauauacaggagcacacacaccauaccuggcuuuaauauaggguuuauaaucaccgucuuaaugauaaagcugaagguugaaagagauuaugaauuuacuaguauuugaguucagaacuauuugacucuaaaacuuuaugcucuuuccauuagcccauauggcagcuucuagugcuauguguauuuuguagcauucuauauuaggggacuuucagcuuugaguauaauaaauuaaacugaguaagauacuagucaagauuaacagaacccagagucagagucaagaagcacuauugauuuauuuucuaaauaccaaaauaggaauguuguugaaugaaguauuuugagacaggauuucuuugugacagaauagcccuggcuauucuggaauuuacuuuguguagaccaagcugaccuugagagccucuugagguuaaaggugugauccaccaccacuuagguggaauguccuuuuuuuuucuuccuuuuucuuuuuuuuaauauauacugggauauaauaauauaauauaucccagaagagacuuacuggacuucuagcuuuccauugaauagucuuuuugguguuuuucacuugguagaguguuuauagguuuugaauaaaaccacuuuuguagauauguuuaggcuuagggguuauaccaacauauuuucaagguuaaaagauaauaugcuguuuuaauaagagcaucccuagaauuuagaguauauuguuuuuuguuuuuguuuuuuugaauuuuuuucacagugcuggggauugaaucaggacauuaugcaugcuaagcaaaaacucugucauccuugcuuggcaccuagaaugccuucuuuuuuugugauaucaaacuuuugcuguuugaauuggcauaugcgaacuuguggguuuuuuauuuuacaaagaggucuggguuuaacagaagucuuaaaauuuuagacuuguugacauguuacuucaaauuuuacuauauuuauccacacacauaugguaaaauguguuggguaauuugcuugcauguaugucuguauacaacaugcgugcuuugccuguggaggccagaaaaggauauuagaucccuuacaacuggagauuggaugguuauugacugcuggguggauacuagaaauugaauccuuguccucugacccacugaggcaucucucaagcuuccucuuuuuuaaauuuuuaguuuuuccuguggguggacgcagaaccugagguacugaaaaaaaaaaugugggcaucuuaauagauucccuuaaucauuugacugugaagugguuuuaauauauuguuaggcuuuauuucuuuuucuuuuguagaagcagugguaacaguuuaaauauuuuaaaaaaaaccgauuuuuuuuuuuuuuaccuauaguguauuagauauuuagguuuuuaaucuuuggaagaaaaaacaauggaaaauaagggauuggcuuuuagucuagauuaaaaaacuuggguguauguguaugugggggugucguucccaguccuuauccuuggaugucuuuuuguuguuguuguuguugggguaggcggggaaugugguggcagggacuggguuucuuuguauaauccuagcucacucuagaccaggcuagcuucagacuuauagaucugccugccucuuccuuucuagugcugggaaaggcauguaccaccaccauccagcuccuaacccccauuuucccaagcugucuuuaagaaucugauugggaaaauaaggacuguuguaaugauuagaacagaacagauuuuacaagucuggagucacaaaucaaugauguauggcuagaaagcaaugauagaugaugccacugucaucuuccugugugaaaggauuggugauagcuucauauguuccuguugucaucucaugaugugacauaccuuuaugcaugaucucuuuuauguuuucauagagcaaacuucaaauuccuuuuuuaauuuaagaaauaauucaaaucuacccuuaaaauauccacagguacaaugggaauuacguauugggggcagauguucucauucacaagcaaaauuucacugguuguuuuuucuuuucuuuucuuuuuuguuucaggacuugauuucauugggguugaggggucaaauuauccccgaaaauuugagacugcuccugguaugauacauccaggugccuaauugccccggauauuuuuacagauuuuuaugaauugaaauaucuguggauauguggauuuuucugucuuucugcuuuuuuuuucuuucuaccuuuuucuuuaaucuucuguguccacuuuuaccuccccaaaauguauucauuuaguaaauauuuggcauuuacauugacugagcuuugugcugugggaauguaaacccuaaguuuuguagaacauuucauuuuacuguugcuaguuuccuuagucauaacugaacuuccaguauaggaaagcaucaagcacaaguauauauaucaaguuaccaguguacagaaagaaaauucuugcacaaagaaccuagguuagguaacuauuuaguccauucuaacuccagguuuauauuaagugcuaacucauuuggacuuccauuuauugcagaugaggcagauuucagggagaagagagggaagaacuguaagaguaagaggcuauuauuugugacuuguauuucccuguagcaaauaauuucuauuagcaaaaaaauuuuuuuuguuuguuuuuuaaagauugauuuauuuuauguauaugaguacacugucacucuauucagacacaucagaagaaggcaucaaaucccauuacagaugguugugggccaccaugugggugcugggaauugaacucaggaccucuggaagagcagucagugcucuuaacugcugagccaucucuuagagcccuauuuugaaauuuuuaagugguuuuuguagcuguuagauguuuuuuuuugccuuuuucucuuuaaugaaauacgaucuuauuauguagaccaccagguugcccucaaaaagucuguaugcagacaggcaugcuuauaucugucugcauauguagaugugagcaucuugaucucagagaucaauaucuuuauuaaucuguugcaaccuuccuguucucugaaugcaccugaagcucaucaauucaaauagguuagccggccagcaagccccaguaauccuccuguucugcuuccuggggcuagcauuagacucaugccucugugcuuuguuuuguuuuuaugaugcugggagucaaauccaggguuucgugcaagcgugcucccacugaaccaaaugcccaaccuaugccuaauuucuaaguuaauguuggcauuugaacucaugcaugcaaaaaagucuuuaccuacugaaccaucuuuccuugccccaugaccucaaguuuuuuauguucuuguguuaccuuugaaguauuggaaggaggcauacucaaucauuuguuaacuuucuuauuuuuacuuuaagauuuuuauuuuuauugagacagaaucucacuuugcauccuugacaggccuggaauuugcugucuagaccaaguuguccuggaggagauccucagucuccugaguuuuuagaucgaaaggacuugucacuaugcuuagcaaccacuugucgauucuugagaaaacuucaaaagugauucauauauuaugaguucuuguguuuuaaaaaaagggaaaguucuaguuucugguagagacaaauucuuauauuaguguucugguagaagagaagaauucuauuucucaaaaauguuuuuaugagacauuuucuuugagauguguaugugagacaaaaaauugugaggaaggggaaaaggggaauguuagaauugacaagucucuugcuguccaagcaugaggacuggaguuuagauucucaccauuuacaagccacacggauguagaggccugucuauaacccagaacuugggaagagaugggauccucuauguaagcuggcagcuaaacaagaucagcuuuagguugagccagagacccugccucaguaaaacaaaggggcacagaaaauacaugaaaucaaccucuaguuuccaccuacuuuuugaacacauaccagcacaaacacaacauugugucuacacuuaugaacauauauacauaacacacacacagaggguaugggggagagcgugagagagaacaagcgagcaacaaagacgcccauguauauauauguuuauauauauauauauauauauguauauauagaagugggcugauuguauauagaacuuuuaucuacagacuuuuagcucaagagaaggggaaaaugauuuccuucauggucugugcaauaccuuuugcaggacagauucuauauucucuauaagugcuauuguacauacuugauuuuaauuuagcuuuguaucucccaaaagagcaagucugugcaguguucccuauacaguuaacugguuuaaaccaguaagacuuaugaaccugacuugugcugaucuuuugggggggaggguccauuuuuaauaacagagagguccuuuugucuguuuucuuuguucagcuuccacaccuacuuauucuccuuucauuaaacaugugccaaguuuuuguaguuuucuacuacugguguuguuucucuucauaucaucuugaguuugguuuuguuuaucuuuauacaaaauaaauagauguuacuugcauguucuguuuuaaauuaguugcuaccaucucauuaaaugacugcuaagacaaagcugagguuuuuaaagauacugcauggcaugguaaauaugguggggaagaggguaggaaaggaucuuaaauggauggauguguuuauacguauguccuuuuguguaucucauccauuccuguuacagcucuguaauccaauuggcuaugaaaucauaaucuuauuaaaaacuauacuuugguguuucuaaagaguuuuucccuaucucugaagucaacaacuucuuucuguuugcuaaauucuaauaaucauacuauugcuugucaaaauguuaaugcaguauuguugucugaacauguuuuaugacacuaaauuuauuuuaccuuuuuuuccccuccuaggugcauggaggacugcaacagaagaguggggaacugaagacuggaaugaagauguagguauucuugagcuaguccuuaccuaaugcauucuaucccuaaguuguguuuagggauagaaaauggauauauuucugccuuucaaaaucacugcuaagauucugaccuaaaacuuuuacauccaaaauaguguucugaaccagaacauuucacauauguuauaugaaggagacugggcauggacaggacucuguggaaccacacuauggaaagggcaagugcagguguguaaguccaauaccugauugucagauugacccaggaagauagacugguuggguaggguaccaacaaugaaauuaggacugggaagaagcuaaaugguagaacacuugucuaguaugugugagaaucuugcauucaaauccuagcacugcagaaaaauuguuuuuaguuaagcauaugguagguuguacauugagucacagcugcuaaugucauacagcuguacuuggagcuguugcauuauuugguguuaaguccuauaauggauuggcaguggauaguuaugguaccuaagccuugaguuuaaaauccaguuguuugugaaacuucuaacuacccaaugcccaaaucuguaauugaaaugacuauccaauuagguaucugcuaccuugacucuacuuggaaaacuuauagaugggugguuuauaaagaauuuucuugaauauuaucugaguaaaaagaauuuuaauugguuacagugaaauuuuugcugugaauucugguuuucagugaucauggauaaacuuauuuuaauauuuaaaauuugcuuuucuuuauauauagguagguaagguagcuuugucagauuguuuugguugucagucuuagguaucaaaacauuccaguacaugagcaucacaggguuaugauuguuuguuaucgcuaagcuaaacugcuuugugaauaugaacaaguuuuaccaucugaaauuugguuuauguuaguaaggaauauauuugggguacuauggguuuucuguuuauuaccaaagagauuuuggucaagaaguaaagaaaacaaaccuaauucaacuuuuuuauuuaggaagaagaguuauccccuguaauugguuacauaauuagaugccuuacauguauaauguagucaguaugaauacaaaauuuauauauagcugaaauuccugaaaagacauuauuuggccagcgcuuggaccugaacugcucaauagccaguuaaauuaacauuuuuucuuucuucaucuuggucaugcuuuuccuuucauugggggagagaaaaugguggaagauaaauguccuuuggguagagguaggaguugggauuuauaacgagaaaaugaaaagguguuuccucaauauauguaacuagcacagagauagccuuccugugaguucagucuguauaugauaugacucuguuguguuuuauuguguuccuugauucuauuccuuacuuggauaaaacaauuaagcagacuugagaucaauccauuuaguauuucucaggguaguuuuuuggguuuuuuguuguugcuguuguuuuuuggugguuuuuuguuuuguuuucauagaguuuccuucuuuuuugguacugaauuuauuuaccuuaccuguggcaaauuucacacaccaggaguaacugauuccuuucuuuacagcuuucugagaccaagaucuuuaccgccucuaaugugucuucagugccucugccugcggagaaugugacaaucacugcuggucagaggcaaguguguuguaaaaugauuguaccuuuuuuuaagcuuuauuuacuuuuuuaaguauuauuuuucauauaugaauacacugucacuaucuucagacacuggaagagggcaucagaucucauuacagaugguuguuagccaccauaugguugcugggaauugaacucaggaccucugagugcuuuuaucuguugagccaucuuuccaguccuuauuuuugaguauuuaauagauguugagcuaauguaggcagaauuugcuaaaccaucagucguuaguauuuuauuuaauggcuuguucucccuuggacauagguggaccuggggaaagcugaauauuuucuuucucccucuugauuuuagucauucuaccuugggucacuacuuuagcauaaacuccucagguguuacugaaauauauugugaguaacggagcauaguauuuugaauuucuuuuucucuuuuugaugagaugcugggggugauuuuacauccuuguaaaugcuagguuuauacugugccuuugagcuacacaucaaccccauaauuuguuuauaucacagguaagcuuuuaaguuuagagaaaaacuucuaaaaccuucucuguucuaaauccauuugaggguaugaguaaucauauauaugguguuuuguuuuuugaaacagaauuuugcucuuuaggccauguuguccuuaagcuuuaaaguaguccucuugcauuagcucuaaguuuacugguguuugcaccaccaugcucagcugaguauauggucucauauuuuagaaauacuaauauaauauaauacuaauuauguauuaaaaucauagcuaaacaguuuuaaauuauuuauuagauuuugauauucagaguagagugucaagcguggugcacaacuuuaaucuuaguaauuggagagaaaggcagguggaucucuguucgaagcuaguuagagcuacauagugaaaccuuaccucagaaaaauuuucugaguauguuauggcccaugguuauuauaauucaaguacuugggaggcugaggcaagagaaacauauaaggcaaaucuuggcuacauaguaagacucuguauuagagagacagcucccuccuuaaaaaaaaacccaaaaaccccacaaacccuugaagauuuaguauuucauuaaaucagugcuaucuuuaaauuaaauguuuaacuauuuugucaguuuaacacucaguuacuuugauuaauggaacacauuaggacuuuacaagacuguagcaucggaauauaaccuucauguucauuuaaccaugaucuaaguuugcaggguauguuagaauguucauucauaaagauccuuuucuuucccaaacuagaauugaccuugcuguucuguuggggaagacaccaucuucaauggagaaugauucaucuaaucuggauccaucucaggcuccuucccuggcucagccucugguguuuaguaauucgaagcagaaugccauaucacagccugcuucagggaguacauuuucucaccauagcaugguaaauaugaaaccauuacacuaaccccagaaucacauacacaggaccauuccuuuuucaaugauuguaagauagagccucacuguguauaggcuaguccucugagaguacaaacaugagcaucauucccagcugcucuguagugacaaguuuguaguuuuguaagaauguuuuuguuuuaaacccagguauggaauaugguguugcuucagauuauccacaauagcuaugauuugccuccuggucugguggggauaugauuuuacuaguuggaaaaagugucuuuaauuguguguuuggaauucuggggacuuuuuagaggauauauaauugcuagggccuuacgaggugggguggguuguuguugggguauugcuugguacuggacacaguuaaguagucauguggaaagaagaaauaauaagaaauuuauuuauugauuauguaaguacacuguagcugucuucagacacaccagaagagggcaucagaucucuuuacagaugguugugagccaccaugugguugcugggauuugaacucaggaccuuuggaagaacagucaguguucuuaacugcugagccaucucuccagccccuccuuuccuuuuuuuaacucguccuucuacuuuuguuuuuguuuguuuguuuguuugguuuguuuguuuuaccacucuccauugcaagaaacuuuugacuaaaacugacagaauauagaguuuuuuaguuucauuuaauaggcucauugugcccauuuuucaaaacaauaguucucccucuugugccuuuaaguucccuggccacuggcuuuugacccacuuuaugguuaccuuccuuuuguguuuugccuuuaguuuuauuuuauuuaguuauuuacccauuuguuuguuuugaaucaaggucucauagcucaggcuggccuugaacucaccacucauuauggcugagguugaauuuguacuauuuuuguuuuguuuuugagacagggucucauuguauagccaggacuguccugaaaaucacagagauccucuugucucugccuuccaagugcugggauaaaggcagcauauuuuaucaugcuugaggaucuugaacuugugauucucuguuuagcuuugcaaguguuaguauaucuuaaauaagcuuccuacaacuuuaugauguguacugcuuuuacuccuauuucagaugggaauuuuuccaaaagaugcacucaggauuugaauauagguauugagacucuagauugugcucauaauaaugcaguauaguuggucugguauaaggcuggccuuaaacuuuuugcuauucuuugcuugguagcauucuaugaguagcauuauuaugcauugacuuuuggucugucuuugugaguaagcugaggaagauuaccagcuguaaacuucucugaucucuuuguugaucuguaggugagcauguuggggaaaggauuuggugauguuggggaagcuaaagguggcaguacaacaggcucccaguucuuggagcaauucaagacugcgcaggcccuugcucaacuggcagcucaacauucucaaucuggaagcacuaccaccuccucuugggauaugggcucaacaacacaaucaccaucacuggugcaguaugguaaguugaugggugacuuaaaucuuugacacaggagagauuuauugucuagaagauagggaaggacuggauaaucugaggcuguauacaauugaaauuaacuuuaguucucuuucuuuauuaaccugggauuuugagagaauucucuuuagauuuuguguguuugugugauggugcccuugcuggucucaaacuuccuggccuccaagucagagaucugcuuggcucuaggccuuuugagugcugggauuaaaggugagcaucaguaaaacucucacuuggucccuugaaucuuccuuaagcuuaagagccaacaaacccuaaggauucuauaucugcuucuccagugcuaggauugcacacauguuauaauacuguguccauccuuuucacauaaugagagucaaacucaggucuauauacuuucacagcacuuuagugacugagacaccuuaccuagcccuaaauuauucuuugauuucucuucaguuugauggccguggccaucuuagaauuuuguacuuuaaauauggauaauuuagcucuuaagcucuuaccuuucuuacucaucucuagcccuccuucucucucucuccauguggccauagcuggccucuuuguuucuaccuucuuucucccugccuuuccaaaauaaagcucuaaaaaccauuuuuuaaaaaaugaauaauuuauggauaugugacauauacaggcaggucagugguauugauuuuucugguuucugguuuccuuuuuuuuuuuuuuuuuuuugguuuuuugagacaggguuucucuguagcccuggcuguccgggaacucaccacucuguagauaaggcuggucgucuagaaaucugccugccucugccucuccugccucuccugagugcugggauuaaaggcgugcacuacaacuaccuggcuauugauuuuauuaagcugugcugaaguauagaaauuauucagugguucuuuugaaagcaucugauuauaugcaauuuggguagcuggaugguuggauggauugaugguuguguaugccaugguacaugucuuaaugugcuucuguuucugugaugaagaaaugaccaaaaguaaauuagggaagaaagaauuuacuuaccugacuuauagggaaggcaagggaggaacuuggaagcuagaacuaaaacagaggucauggaggaacucuguuuacuggcuugcuugccauaguuuguuuaguuuauuuucuuacacagcccucucauuucaguuauuaauccugaaaauacaggccaggugugaugcauagcauucugacacaggcagguagaucucuuaaguugaagucuaggacagcauggucuacacuggaaauuuuauuuaagacacccagugcuauaaagagucucaaaccaaaaaaaaaaaaaaacaaaaaaaacaaaaaagaagagaaggaaaaugggggugggcggggugaggggugugggaggaaaugcaggggcuggagagauggcucagcaauuaaguggcuauuuuuccaaacauucuggauucaauuuuagcauccacguaguggcuuacaauaauaaauuggaaccccagggucucagaggguauugggcaaguauaguacauagacauggauguggacaaaagucugugugcauaaaauaaauacuuguuuguuuuuaagaaaaugcccuaaagacuugccaacaaucagagacauuuucucaacugagguucuucccaaauaacucuagcuugugucaaguaaacaaauuuauguggcaagaaucuuuaugcacugagagccauuuugcuagcuggaguucuugaaucuugaaggucuuauuacuaguauuaguauaggacauuuccuuggaauguaucaaugucacuggcucauaacuuguguuucuucuugcagaucugaagagugcaaaugauucaacagugcacaguccuuuuacaaagcgccaggcauucaccccaucuucaaccaugauggagguauuccuucaggagaagccaccugcaguggcuaccucgacagcugcaccaccucccccgucuucuccucugccaagcaaauccaccucggcuccacagaugucuccggggucuucagacaaccaguccuccagcccucagccggcucagcagaaacugaaacagcaaaagaagaaaaccuccuugacgucuaagguacuugagcuucuuagggagaugcuguuuuaaggcagggagguuaugguauuucaggaugagauagucuaaggguuuauuuggaaauuuaaacuugaaaggaauaauuuuauuucuacaaaaagauuguauuaaacguuuacauauuuuuuuccuaccuuuuucauagauuccugcucuggcuguggagaugccuggcucagcagauaucucagggcuaaaucuacaguuuggggcauugcaguuugggucagagccuguccuuucugauuaugaguccacccccaccacgagcgccuccucaagccaggcuccuaguagccuguauaccagcacggccagguagaggaaucaucacccagaagaccucuuuugguagcuuaguuuugugcuuacuucuucuccucuggagaggccauauuucugacuggauaaaaguagucaaucauagcauuuuguugugugcuuuuaaagaaauacguuguuacuaggauuaucuaugauuuaaaacauuuagauaaaugccauuuagauacuucuagaaugucuuaagcucaguuuguuuguuuguuuuguuuuguuuguaugugcagacauacacgugcaucuggaggcccggggucaauaucaggugucuuucucaaaaaucacucucuacuucauuuucugaaucagcaucucucacugaaccuggagcucacuagaccaauuuggauagccaauaagcuccacgaaacuuauugucuccauuuccccaguguacuaagaucauaaaugucuucuucccagauuuuauguagguguucaguaucaguucaugccuucauuguuacauggcuaaugcuguacuaacugagccaucucccuagcuucucaagguuuguuugauucugacgguaccuugacaucuccugcagugaaaagugcuuuauuuguugugggacuauguuugugaaaaguaaaaauaggaacucaguaaaaacauuaaaauuaaaaaaaaaaaaagccauaaaaauaaaugaaccuuuucugucuucugguaguuaccaaggaaagccaucuuaugcauagauaaucaauuuuuccuuaaugagguaucuggcuuuagucuagaucagauuaguugagucauaauugccacugaugccuaaaaagauuuuauauaaaaaaaauuuuuuucuggacuguuguggcucaugggaguaggggaaaugugugagaugagagcaaaugcuguguuacagaaacuagugauaaucugcuauugaaauaaaaccauuucggguaagaaacuucagaaagacaggcugggcgugcugguaccccaguccuagcacucaggagguucaaagccagccagggcuagugacaaccucccccaaagggaaaugcuggagaaaugaccuggugguuaaguuccuuguugaccauguacacaacuugauuuucagaauccacaugauacauaggcauacaugugaacaaaacacugguauacauuaaaucuuaaauuuuuuguuuuguuuuuugauuuuucaagacagacuuucacuguguagcccugacuguccuaaaccucauucuguaggccuccauucaggcaucugccugccucccaagugcuggaaugaaaggugugcaccaccacugccaagaguuucuuugaagcauaauucaaaaaauguuuuccccacucugggaaauucuaccagugaugaaacugaucaauagaugauuuuucuugugccaggguuucauggugugauguggaggggugcauugaguucuuuacucucccaagugccugauuuuuaaacauuucuccuuguuaauuaauugacaguauuuuauuccaauagacgaucaucauuuccuaagacauuuuucuuuuccacagugagucuucaucuacaguuucaucuaaucagagucaggagucugguuaucagaguggcccgauucagucgacaacuuauaccucccaaaauaaugcucagggcccucuauaugaacagagauccacacagacgcggcgguaucccagcuccaucucuucaucaccccaaaaggaccugacucaggcuaagguaguaguuuaaugauucccugggccuugguuagcaaaguaguggguaaaagucccucuaauauaguuucacuuuucuggaaauggugcuacagucuuggaggugccaacugagaugcugacaaaagcacauuucugugauugguaaacuaaacauuauuuucagcaaauguggaggacccucaagauucagaacauuucucuuugcaauaaagauuuguugguuauggcaaaaacugucucaaauaccuguccuuuccucauagaagaucagauugcuaaccuucggggugcauauauauuaguaaaucuacguuacucugguaaaagggauaacauauaccuaagauggucugaaguaccugucuagcaggauggguccuaagaauuguuuuauuuuaaacuauuugguggggguaguggcugugugcauaugagugcugguacccuaagaagccagagacaucagaaucccuggaguggaguuacaggugguugugagcugucuaauauaugcgauaggaauugaacucaggugcucuuuguguguaauccaugcuuuuaacuguugagccaucuuuccagguucccuaaaauauauuugaccaaaauuaaauuaagugacugauaacaucucucuuacaagcuugucuguucuugcuuuuuuuuuuuucuccucuccagaaugguuuuagcucugugcaggccacgcaguuacagaccacgcaaucuguugaagguaagcauuuuccaggcuuuuucuucuugguuuuaguggcuuuccucaacauugauguagaguuguucguuuuuuuggaagguaggaaggacccuguuguguagaccaagcuggccucaaauucacaagagauuugcccacuucugccucccaaguguugaaauuaaagacaugugccacugugcucagcuguguguguguguacacaguagucagcuuuuaacuucucuaucuucugaggucuuuuuguuuugcuuuguuuuauguguaugggcauuggccugugugagugucuauguaccaaguaugugcccagggucagauacccugaaacugguugcagauaccauguggauuguuggaaaucuggguccucuggaagaauugagugcucuuaacugcugagccaucugucuaggcccauaucuuuuuuuuuuuuuuaaacauauuuuuaaguguguugguguuuuuccugaauuuauaucuauaugaacgugccaggucuucugggaacuggagauacacacaucccaugcaggugcugggaaucaaacccagauccucugguagaaagccuuugcucuuaauugcgcuaagcaaucucuccagccauauuuuguuuuuugaaacacauguucaugcuguagccauagcuccucugaaaaucguagugauuuuucuguguaagcuucccaugagcuagauuaugggcaugaacuaccauacauaaguucucuauuucaguuagauuguuaaaauuuagguuuauccuuuuuuuuuuuuuuuuuuuuuuuuuuuuuugguauuguguguacaagcaugugugugccacagcacucauggaugucagagaaaacuuucaggagucuauugucauucuccacuuggauuuugguaucagacucaagucaucaagugguuugugugguguuaggaauggaacccagggccugauauaagcagucuaccuugaguugucucugcaguccaaaaagaguuaugcuuaacauaaugacuaauucccacuuuucuuuuuucuuuucaaguaguugaggauuguaguuuuucuuuacucauagauacuccuuguuuucugaugaagggaaauguuuuccuauuuccaggugcuacaggcucugcagugaaaucugaaucaccuuccacuucuaguauacccucucucaaugaaacaguaccugcagcuuccuuacugacgacagccaaucagcauucauccuccuuaaguggcuugagccauacggaggagauuccaaauaccaccaccacacaacauagcagguaauuuggggugagaauuuaguuggguuuguguguuucgguaacagagcccaucuggucuggucuucauuacucuaccuguuagagacuacauuagcccugcuuuugugagaagugacaaugacaaaggagacuuaauuugcuuuuagaaucugcucuugcuuugauuguucacaacccuaaaaacuagccauuauauaugucggcaugaucucagaaaucuuguuccucuuuucugcuuugguuuuuguuuuguuuugugguaauugcucauuggaguuccaggucagauaaaaccguaacauugugauaguggcugauggcaaccuuuucuccuucauagugcauuaucuacacagcagaauacccuuucuucaucaacaucuucugggcguacuucaacauccacucuuuugguauguaugacgcuugagaggaagugguuuuaauuuucuaaccauaagauucucccauauaauauaauuuuuuguuuguuuguuuugguugguugguuggucggcuuuuccucuuucuugagucaggaccuugcuauguagcucucaaacucuauguggacuaacuuuaaauuccccuugccucugccucucuaguguugggauuacagguauguauuuggcauaccuagcucacccaguaggauguucuugaaauuuucuuugacucaacugaguuuguaggaaaaagaguaaagggauauuggaaagucaaaagaguccagaaguuguacuuaauggagcauaauuaaaaguguuuuuccuuuucacagaaaauaggcaaggacuucauguucucuguuaaaugcagaacagcauacacuuuuuguuuuuguuuuuuaauggaggucccaauauuuuggaugcagaagcaggcagaucucuuguagccuggucuacagagugagugccaggacugcacagagaaauccuaucucaaaacaaacaaacaaaaaaaaacaaacaaaaaaaaaagaagauauuauagcucagucauggaguucaucacuaacagacauaaggcccuggauuaauuccuacaaaaaauugugucuuuaacugguauaaguaugucuguucuuagccugggaaaugcuuaaauauaagucuuuaaaaugguaugaagcagggcgucuuuaugaaaaugguguccagaugaauuacuuuaugguugccaggguuacuuagggaaagguguuaaguuuauagaagccuaggaaaagcuuuccuaaacuaugaaauuuuaguuuuaaagucaaagcugguacuuucuuccagcuuauauuuuaguuuuguaaguugaacuagugaagcaagguguagaaaagaaggcugugauacacuuuuuaguucugugcuuuucccccucacuaaucgaugucauuggucccuauggaauuuguccccagccacuuugcuguucucugaacaaaaaaacgaugaugauggccaaugggcaauugcgaggaacauguagcuagaaauccugauacccuggguuggcuuuuuuaaauuucagauuugaugaggucauacauugcuuaucuucucuaaccuguugcuaaucguuguuuucuuuaucuucuacuguuucccuuugaagcauacaaguguggagagugaggcaaaucuacauucuuccuccagcaccuucucuaccacauccagcacugucucugcaccucccccaguggucagugucuccuccagucugaauaguggcaguagucugggccuuagccugggcagcaacucuacugucacagccucaacucgaagcucaguugcuacaacuucagguagcuuugccuaggagggugacauuccucuaggauggagaagauaguaaauuguaugacagcauaaaaauguuuucuuucaggaaaagcuccucccaaccuuccuccuggagucccgccauuguugccuaauccauauauuauggcuccggggcuguuacaugccuauccgguaagugggacugaaggaucuucuccacaaagugaggauggugugacucuucucuguaguucuggauucagauggaaaacaauaauuaaagcagaauaaaugaaugguacccacauuugggcaaaugguuuuuuaaauuuguguguguguguguaccuauuaugugcuaagaucagaggaaacuggaguuuccauuucaccuuuauucagguuccaguuuggcuugcuuuguuugguggcaaguugcuuaccuacuaagcuauaucacuagccaaaaaauagcaggguuuguguauuuguuugcuuuuauguaucuggggguuuuguuuacauguauguuacauacaccauagugugccuggugccuguggaggccagcauuggauccccuaaaacucaaguuacauacaauuguauaagacaugugggugcugggaaucaaaucuggguucuguggaaaagcagccagugcucuugggauaacuguccagauuccacccuucaaaaugcaaucguuuuguagagcaaggaauaaacuuagucagggcccuuugcugaguauuuauucuuugugaauuaugaucuggaccuugagcaucaaaggccaguguguaguuucuuggugguuuucuauauugcuauugcuucucuaccucuuuagaccuauguuuuuuugguggguuuuuuuuuuuuuuuuuggccuuuuaagaacucgauucuagaauuaccuuaacugccaccuuuaaguauucaguauccacuaaaaugaaaaauauuuauaaaaauucuauuaaaaaacacccauuuuugcuggguguauugucaaaugcccuuaauccuggcacuuagaagccagaggcagcaacagucaugccucugugaaguuugagcccagucuggucuacauagaaaacuccaggacagccagagcuacaucugaagauagaaaaauaaauuuuaaaaaucuuuuuucaguuucuuuggccaggugacauuguguuuaaucccagcacuuuggaggcagaggcaauucaauuuuuagaguucaaagccaaccuggucacccaacuguauucuaggccagcuagcacuacacagugagugcuaucucaaaacaaaauuaaaaagucacuuauuuuuacccuauggaagaaguuuagauaauagaagaaauauguaaauugcaccuauuuuuccccccucaagacaggguuucucuguguaccccuggcuguccuggaacucacucuguagaccagacuggccucaaacucagaaaucugccugccucugccucccaagugcugggauuaaacacagugucaccaaugcccagccuaaauugcacucuuaacuuugaccuagaacuuucaaagaucuguuucuugucuccugagaguugggcuuaagggcauaggccucuggggccugccuuuguuuucuuuuauuuuaauaacuuuuauuaauuggcaauuucuuacaugucuacaauauuuugaucauaaccaccucucuauucucauuuuccucauuccuucuugaacuucccaacuucccuuccuacuuaucucucucuuuuuuuuuuuaacauguagggauguucugccuguguuaugaaugugcaccaugugaggguagacagguauggaggucagaagggagcauugaauugagaacuagaauuacucauggcaaugaguugucuuauggcccuagcaacugagcuacauucuuuucaagaacaagugcucucaaucacugagccaucucucuaaccucacauuacauacuuuucuaaaaaaauguauuuccauguuuaugagugcuuuguacucauguguguacuugauucccuuggaagguagaaaaagaacauuggguucccucgaacuggaguuacagauggguauacaccaccuuguagaugcugcgaaucaaaccuacuuccucuagaagaacagccagugcucauaacuguugauccaucucucuagcccccacauugaauacuuuuuaacaguaacucuuugcaccuagaaauaugggaaaaugaggauaaaauaugaauccuucacauuucaacccaaguuuuaaagacugcaagagacggugacugcuaaauaaaaauuaaagccugcuguucauguacuacccauucuccccuacaggugcccugaugccagccccugucuuuauauaguauguagcuucaggaaagcuuuaagaccuuucaugaaacauuuaauuucuuuguacuuuacuuuccacuuaaagaaaacagaaggaaauaaucugcuuuguucugacaaugaggauauauguucuuuaucuugccuuuugcugccaucaugacuaguucccauuaauguuguuaaaugucugucuugcagccacaaguauaugguuaugaugauuuacagaugcuccagacaagauuuccauugguaaguaugugggauagaaauuuggaaaaaaaccauuaaauugagggauugggguaggugcauuaaggcaggguuuuacuguguauguaaccuuggaugucuuugaacucacucuauagaucagacaggccucaaacucacagaaauaccccugccucugccucugccuccggauuaaugccucaguugcugggauuaauggcaugcccaccaccucgaggcaaaaucauuaaaguuauuguugaaaucaguuguauaguggcucaugccuguaauccuagugugugagaaguggagacaggaagaccaagaguucaaaacaugugucaguuauauagugaguuaaagaccagcuugagcuauacaguaccuccuuucuuucagggggacaaaaacaaaacugauggaaggauucucagauguucgauuauugucacaaacagcuguuucucagucugccccccacauauacuuuauuauauaugcauacauauacacacacacaggcaauuuaaucagguuaacaaaacacaugugacauaacaccucaaauggacuaauaauaaaacuguuaacaagcuuccuaucaacaucaauuuccugcucuguuuuguuauuauuguuagagacccuuaugguugaaccuagaacuuaaugcaugcuagguagauacuucacugcugagcuguauucuuaaccuuucuuuugauuaguuggagagguaucuuaccacguuuuccaggcuagccuccuggaccucauauucuccugccucaauuuccuaaguaucugggacuauacacauuuauaaugauaauguguuauagcauagauauauacccaaccucuguuuuuuuuuuuuuuuuuuuucuaauuuuuuucugucucaccucuucuuaucuuauuuacugauaaguuccccugaauccccaaaauuuugugcuuucaaccuuuacucuuaguaaggcaaauuugacaguauuacaggaguaauuugaauuaauggaagcucuagucagcuuauucagaugauuaggauauuuuuaaugucuuaagguuuuuuuauuugguuguuugguuuuagacacgggguuccuguguguuucugucuugcuguccuugaauucaauuuguggaccaugcuggccucaaacugauagagaucuugccuaugccuccugaguacuggaauuaaaggaaugggucacaauacccagucagucuuaagacuuguguagugccucuugcauuuuaggcaaaugcuauacuucagagcuuuugguuucauuaaauugcucaggcuggugcugaacucacuuuuuaucuuaggauagccuaaaacuugguaguaguuagauuuacaagccuuccucaacaggaccagauuauguuguacugauacagaaucucacuagacuguaucuggccuugguaguuguccugcuucagaaucuuaaaaugcugggauuauggggaguaccaccauacacagcuuuuguuguuguaagacgagcugggugugguggcacaugcuuuuaaucccaccacucagucuacauagccauacuguguagcuaccuuggcuggccuagaauugcuuuguagacuauccuggucucaaacucuaaagauccaucugccucugccucccacacaguacauaugacugcggaugccagaggacacuauuaagugugucuuguuuuaucacuuugcccaccuacccacauauccuacuugcuacugguacaagacaugcccauggucauacccaccucuuuacauggaugcuggagaucaaaguaguaaacacucuuaccuacugagucaaucuccacucucagcuucugaagcacuucaggaaaaagaagaaccuguguucucaaaaauuagcugggaagaucuguauaauauuaaaccuuguugguccuacuagaccuuaauguguacccaaugagcauauccguagaccuugucuuauucuacucguggcaggcuggggggaacaguguaugccagauuaauugaaguucauaugaguuguaagcuuuuaaaucaguaacuggauaauuugcaauacucccaacagucucaugcuucuauucaucuuugugguuuuuacgauaaagaaugaguggaauuuaaucuaugcucuuuuguuuugguucuaggauuacuacaguaucccguuucccacacccaccacuccacuuacugggagggaugguagccuggccagcaacccuuacucugguaggauugggauagagcugaauacagggaggugaauuagaauuggagguagaagcaagaagguuccauaauuaagauuuuuggcagauuugugaauuuucuuccucccuaccccuuguugucauggauaugaugagucaaggcugggaguuucauaauucuauuaugaauauguuccugugacaucauuuuucuuuuaaaaauuuuguuuuauguauaugaauacacugucucugucuucagacaaaccagaagagggcaugagauccccauuacagaugguugugagauguugcugggaauuaaacucgggaccucuggaagagcagucaguacucuuaaccacugagccaucucuucagcucccugugacauauuuuuuuuuuuauaauuuauuaauuauauguaaguacacuguagcugucuucagacacuccagaagaggagucagaucucguuauggaugguugugagucaccaugugguugcugggauuugaacucaggaccuucagaagagcagucggugcucuuaccugcugagccaucucaccagcccccugugacaucuuuuuauauuaucauuuucuguugacuuauuucucggcauuaugguucuggauauugaaugcagguuuuuacaaugcuaaguauaagcucuaguacugaacuauacucccaacuuuaauggguguuuuugguuuuuagcuaguccaucuuuucgcuagaaauauaauugguuguuuugguuuuggcuuuuguuuuuuugguuuuucaagacaggguuucucuguauagcccuggcuauccuagaacugacucuguuguagaccuggaacucagagauucaauugccucugucuccugaauacuggguuuaaagguguguaaagucaccucuaccuggcugauuuuuguuuguuuuuacaugacugaccaaucauuaucuuuucaauuucccucaacuauuguuauccuucaagcuuuggagaaacaagggugcauuggagaugauagaaaacaagauggcaaaugaacauugggagguaucauucuggaagccucuuugcacauuauagaguguacagcugcccuucuuuucauaggcgaccucaccaaauucggccgcggggaugccuccuccccagccccagccacaaccuuggcccaaccccaacagaaccagacgcagacucaccacaccacgcagcagacauuccugaacccggcgcugccuccuggcuauaguuacaccagccugccauacuacacaggggucccgggccuccccagcaccuuccaguaugggccugcuguguucccugugaguaacugagugguuguggucuccuuguaagggauccaguccugagcaccauccuagaugcuuucacagcuacaugacuccuuagaaauacaugaggauaacuuguaccuuuggcccauuucuggccugggaauaaaggguaugaaauuuuuaauuagaacaagaauugccugauaguagaauuauccaaaagaggacuaugauacugugugucuuugcugccccuccuuucccuguaaccauugucucuaucucuaaaccacucuaccuuuugauuucuugggucaauucuaaacauuaguguaucaguuacuuuuuuguuaauuuauaauaccaugauuaagagcaacucacaguagaaaguugauguuuggcuuacaguuugaaggagagaguccauaauggugaggucccaggagcaggaaguagagaucaagaaugcagggcagggcacaaacccucaaauccuaucccagugauguacuuccuccagcaaggcuccaccuccuagagauuccguaaucucaacgaacgaggggccagauguuaaaauauaugagcauaugugggguggugagaauuuucucauuuaaccaucaggaaggaucccauuucacuguucagucuuugacuggccuauguuaugauaaguaucuaccuaaaugucuaaucuuugguguaggacaagugagacagauguuaucuguugcugggucauuccuuuucuguccuucuugcucuucagguggcuccuaccucuuccaagcagcauggugugaaugucagugugaaugccucggcuaccccuuuccaacagccaaguggauaugggucucauggauacaacacugguaaguuaccuuugacccuugcuuaguggucugugugguauauuaguagauggagaaagucccacucaaaagugggucaguaaggauaugcuaacucuugacauauaauuaccauuguuuggcugaguuaggugucuaagacaauaccagugaagauuuaugcuaggacuuguauccacuauucacagugggaaugaucaaaagacuaguguuggcugaucugaguuugagaaauaaaaaagcaaggaccccagguuucuuugaaaugacauugagggaaaaugauaguauccauggcacugagaguuaaagaguucugaagagaagagauagauacguuucuaacacugugcacaauauguuuggcauaaauguguuuguaucacuaauuuuguuacaugacuuccccuuuuuaauucucuagaagaccuacaauguggagaaaaacaaguagacaugauugacuacucauuagagugagacuugaacccuuaggcuucuucauuuauauagcuagucuuguugcuauugcacaucugguggcacggaaggaaguauauagauuuuauggacacauagccucuggccucuauaccugaugucgugcuuuacuuuuggaagauggagauaaaaagaacauuuuguuuuuguaggguuuuguuguucuuguugugaauuuauauauauauauuuuaauuugguucauuuugguuuuguuuuuggaaacagggugucucuauguagaccuguccuggcacucaguauguagaccagggugaccuggaauccacagauuugucugccucugccuccagaguucugggacuaaagguguacaccuccacaucuggcuuguguuuuuguuuuguauuaauuuugagacuaguucucuaugaagccuaggcuugcaucaaauuuguggcaauccuuuugccacuaucuccugaguagugauguaauagguauauacccauaucugacucuaguagaggacuggaaacaauuccauguaauuuuuuaaagugacuuuuaggugaaucugggggaggugguuggugcaguugcuaagggauaaggauugaauuaucuuuaaaagcuuguagcaugguuacauuuuuauguaaauaaaaacccacaauuuuaugggauuuagagggagcaaccaguguucuucacuuuucugugggcucuggguggguaaauaagcauuucagugauuagagagcugaguacagaaagacugggucaugauauauauuaauuuacaaaucuugaagaacugcugagauuuaauacccguacuccuuauggcuacuacucucacugagcaggaccuagccugaucuuugguggggaaagagguauaagcuuuuugacuuggaguggcuucaucccaaaauauguacuacauuuagguauuggcgguccaguuacaaauauuuuaaaggguaugugauugaugaaaguuggaaucugauucugaaacuucuagcuucuuacuuaccuuaagauuucagaaaucuguuauagcagcuuuuugagaacccccaguucccaacccccaacagagggcucuuaucauuauauuccucaucaaccucuaaauucauuuaucuuuauguauuugauuccuuuuaggaagaaaauauccacccccuuacaagcauuucuggacggcugagagcuaauuuggcccaagccugggggcuguguuuuguguguguguauaaauuugcacugaagucuuguuucagaaaccagaccacugaggagagccugcugagcugaggccauggccugcguggcuuggggaaaugaguugguggauaccuucugggcuuuugaacuugcccguuccccauuucccucucccccauauguuugacccugucuuacccauuucgaguucgagccaugcagcaccuccgaagcaucaaugcacacaccugcuguugcuuuugauuucuggaaggcauguaguuccaacuuguaacaaaauauuuguagucuucaauaaacugugguauuucuuuagcuaacucugcguucuuuccgugcaugucuuucuggacacuaggagccaaugcuguauuguggauaaaggguggaggguggcuuuuucaaucaauccccaguauagccaaagagcuguuaguguuuuaguuuagugguuuuuaauuuggguggagggaaaacagucuguuuccagccuacugauugguugguaaagcuauuuauaaauaaacaaaaacaacaaaacugauuuccuaugcuuuuaugucuuuacuuuuucauauaggucauccccuugccucuggcauaggcugaggggaaagauaagaaguuagagugucaugacauggugaaaggcaaaagagguaguguucaaagcuguuguuagggaacuaucaucuuagacuuaauuucuacaucuaguucucaaaggcugacugguagcugauuagguuauuagugaucaauuauuugaugacuucaggcuuuuugggaccagugggaaugugguccuuugauggcuuuucagagauaaugaauuacuuguaagucauuuuuuuaaacuuguggauauagccaaagauguaugggagauguuuggucagauaugcugguggaaaauuugaucuccgugcacucacugccuggcacacuaucauaucagccuuugguuuauaacauaaauuugaacaaugauacuaccacucuugguuaauuggaaccauauauucagcuuuccuuuaguaguuccuaccccucugguccuauggaguguaaucaauuuucuaaguugcuacaaugcuaaguaaaagaaauguguucuuguuuuuuucugccuaccaccuacauuguuuuuguaaugauuuguauaacuauugaguugggguaggcaggacauguuggggugggaaaaagagcagaacucuauucugaggaucucugguauaacaagugaaaauaggaaaaccaaugccuguuuuuuguuguuguuuuagguuuucuauuaaauagaggcuauuacagcuacuauacagaacuucucucccucuagccccauuccuaguuccucauaucuucuaugcaauuuuuagaucucugaaacuaaacuuuuuagguaaaaaacaaaacaaaguaggaacuugcuagaacuaaguuaacuccuuacuaccuagcuuaagaauccaguuaguauuucucccauuccuguguaaccaaccacccuggcuucucuuuguagaugguaaccagaucagcuauaugcacuuagcuaguaaaaauaagucauugucucucugauuuugucuuuaaauucucuauuuauaucuuggcuuaucucccuucuacaucaaaccucugacuagcuuuagccccuuucauagcugaacuuaaaguuaugccugcuacccauuguucugucagauagaaauugggucugaaaagagaaggagaucucugcuaccuccaaaagaguuuguuguauuguucccuuuguuuacucugugccuuccaaguaugcaguuaaucuugcuuuauuucugugguucugugcuuuuuuuuccuccuagauuauauuuguuccuucugaagggcacuauuagaacuuguguuguggugggguuuaagaguuaaauucuuuucccucggugcuagaggucuuucaggcuagacaagcacuuaaucauugacuaaaucuuuaaccuuuaaagacaaacauucuacuggaagauucuaaaugauugugaacuuaacuccuaaaggcuaccuuuguuguagagauuggcuaggagaguuguggcucuggaauuuguaugaagacuguugaauugugagugaauagaguauuccuuacgauuuuugucguuaauacauuucuucucaggaacaaaacaaaacuccaucagagugcucccauauaaaagaacaauguaccuuuggaggcaggaaucuaagagcauaggaaugcaguuuuucugguuuccuuuuuaucuuuacaggaacugauaauguauucuuuuuucaauugugaauuaaauuucuacauuuuuguuuaaaaugucucuaguaggaugcuagaggauccccauggcuuuuccuguuuucuugauuuauugacuuagacucucaggaagaaagaguauaguaguuaguucaguucagcuugagaauaaaucacaauggauuauacugcuacaggcuccuuugaacuguggugguaaggaauuuuucuacaggaaaugagaccuauaugaguuaggucuggauuaaagcuguuguuucagggacagacugaaaacaagauuguuucuacauucuguauuaccccuuacuaugucuucccuaugcaccauaucgcuaaaauuauaaaacuagaaauuuaucuuauuucagcccauuaauucauaaagauauacgccuagacguucuacaaccagaaaagugagacuuuaaguaaacugggauucuaguaagugcucugggacugcacuagacuguucuuacuuaauaauguggauuuguaaggauuuugagcaaaauccuuaaugucuauagaacagaaagagccaaauuacccaucuuaaagggcauaauuaaguggaguuuuaguagacugguucauaauggacacuaaauuuauuauauccuuuugcuuccaaaucauacacuacugagauauugcuaauacccccuguuccccucaaaaagcagcccauauauauauauuccauacauaauaucuauaaaggacaaaagaauucuuaggcagcauuugugucaugaauucugacaucucagaacugacguaaaaguggaaaaauuauaccaaaauucuuuuacagugccauagcuagaaaagcggcagauaucacuguguccuaggaacagaggcuaggcuaacaacagagcuaauccucucucuccuccuccacuaggugugucagucaccuccaguaacacgggcgugccagauauauccgguucuguguacuccaaaacccagguagguaucuggucuggaugaaaguagaaagagauggaugaacauagaacaguuggauuugaaguuagaacaacccucaggaaugcugucaagaaccuguccuaccuuuucuaaaaugaauugucucuaggcuucuguuucauucuuucuaaauccauaaccaaaagugggaaugaagugaaguguuuguuauugaguuauuuacagauauaucuguugucuguccuuuuucugucccaauaagaucuucguuuuuuuucuaaaauaucuaaggaguuugaauuugugcuaaacuacagaggcaggaaugcucagacuagucagcacauuucucuaucuucuuaugaaauuacuuuuacuuauuuauuuugaagaaggguuucauuuuguaguccuagcugaccuggaacucauuguguagaccagacuaguuucaaacuccaaagauccaccugcuucccaaguaauugggauuaaagguauacaccaucaugccuggccaauguaagacuucauggcgugcucuaacagucaucucccugcucgauccuuacgacaagaguucagcaauauuucuuuuauuugugaggaaacugagguugaguaguuaauuugccuaggaucacggagcuaugaaaagacagagcuagaacuaagacuucugaauauuugacuugagguaugcuauugcuucugaggccucagaaaguccuaggauucuucuaaugaucauguuuuacugucuucccuccuguucuccugggauagcaguccuuugagaaacaaggguuucauuccgguacuccugcugccuccuucaacuugccuucagcccuaggaaguggagggcccaucaauccagccacagcugcugccuacccaccugcccccuuuaugcauauucugaccccacaucagcagccacacucucagauccuucaccaucaccugcagcaggauggccagguaacagcccuucccuccucucuccuuucccuuccucuuccuuccuaucccuuaaaacuaccucccuuuuccuuuucuuaaccuuccuuaccaccaccuucacccagcccucaccagugccagccaggggcacacagcacauacacaagcgcacauaacaugaacaguuagcaaaggaaacaugaaagaaugggccagauugaaacccuuuuauccgguuccuuugguaccuuucuccuccaccucccauggcacaguuguccuuauccugucagaccugggucacaccuucccucuaaccucucccagccuucucccuucccugacauuauagcuuucccuucuaacaguggaguucuauugucaaaaguuugucccuuuauuuuccauauauccugguucugccucagcuaccauauuugcagaugauucucuguugccagcgccagcaggaggagcagguaaugaaacugaauaauaugcuugaaccaaccuuuuuaguccccauuucaccuccacagccucagauaacuugaaaagccuacccaaucacaaaucgggauacacaaacagaaacacugugcuaagcucucuggccuccccauccucucucuuccuuaccccccucaacacccucuuuaucuuucuacccuccucaacucuggaaagcacuugguuacuagaauugaaaagauucuuggggcagcaucuggagccugaugccucaggucuuuguggcuuugaauugguuucacauuaauuaaugugugguggugggagaaucugaagggugguaaaagagaccucuuaagauucccaauguagguggcugggcaacuaaaauagggcuuuuuugcucucaaagauagcuuucuacguuucagcauucacagagaugagugagaauguaaucaccuugucaucacucacuuugaaaaggucagaauucucauaguugcuuuguuuguuuuuuagacaagggcaguggguaguggggaagucaacugaacaagaauagaaccaacucaccauuuuaucuccaaaguuuucuuguccauuuuucauuuucuucuacuuuaagguuuaaaaaaaaaaagucaccuuguaaaagaggcuauguagaccaaauuuucugugcuugaaaaguaagcuucauaguagguucuaaguaaaaaaaaaaaaugagagagcaugacuauuugcacauuuccacuugaagauguuacagauuggucccacuaacuagacaccuuuuuccucccccauaaccuucccauuccccugcagacgggcagcgggcaacguagccagaccagcuccaucccgcagaagccccagaccaacaagucugccuacaacagcuacagcuggggggccaacugaggcccugacccucuucuccugucccaucuucugagagggcuucucagccuggaaacuauggaaacagcaucaaagagagaaaagaauguggggcgauuccgcugcuccacacccccagcggcccaucccacaccucagcuucaugucugucccaucccuauaccaucccacccuguuguauguauuauaggauuuguauuuucuucuccuccccuccucuuccuccuuucucuuugcauucaagauuaugaaacuuugcugugggcccugccuuuccuucacuucuuccuguucacccuggugguguaugggugaggugggaaggugaccccccccccaaauauauaucagcccaacagcccuaagucuccuccuuuauuauuaggaaaaccaaaccacacacacacauacagacacacacacacacacacacacacacacacacacacacacaaaauggcgucauaaauaugaacagcauugucagauggauuaguugaaguguuuuuuuuuguacugugucuucaaauuuaauggauuaaugugucuuguauauauauauauauacauauauauauaaaaaaaggagaaaaaaaaaacaaaccucuaccuucagccucugcccauucuugcuccgucuaggauauccucacucucgucgaugaccagcuuggugaauaaguauuaccguaccaacuggggccucuucuagcaggcucgaaggcuguggaauaaagugaaaucuuugcccuuuaagaucucucaccuuaaugugcuaauauuuugcccuuaaggggauuuccuuauacauucugugacuggaaagaacuacugcaaaucuucauuucuucuagaaacugccucaucuacagcacguuucaggaagugaaaggggaaggagcuaaggacauuuagaaggcaaaggaccuugugggaaucuaagcaugguuuuaaaggauucugaagucucaagccagcauuagcugcuggccggcagaacucaaucuuggggucuuuuucucuuuggaggaguauaguaguucuuguucucugaguuauguuuuugagacagucucacuauguaacccugacuggccuggagcuugguguggagaccagguuggucucacauucagagaucugccugcuucuaccucuugagugcuaagguuaaagguugucagcacuacacccugccuugccuauuuuauguggcuuugaaaugccuacauuuugggaaaagaauggaugaucuuagagcaagaccuggggugggggcauggugcaguaaaagguuuuuggacuucaauuacgugaaagagaaguuucauuuuucuuuguaagagccauauugccagggacucgagauccuguuucagccuuccaaaacugcaaauauccucugugcugaggaggugagggaggucuguuuauuuugagucagagucucacucugu

SEQ ID NO: 1520 - RNA, 14437 nt, Mus musculus
cugaacuuuuuaaaaaaaagauuuauuuauuauuauauguaaguacacuguagcugacuucagacacuagaagagggcaucagauuucauuaugggugguugugagcuaccaugugguugcugggauuugaacucaggaccuuuggaaaagcagucagugcucuuaccugcugagccauccugccagcccaaaucugaaccuuuaagagcuagcuuuauuuguuaaaccaaaucagauuuuuaaaaccagacaauguacauaaucucucuucccgccacagugcauaucccacacugaccacaaggugucacucuuguguccagaggcaacauuuagguugacaaaauagugaaaaagauuuaaguuccagguccagguguguuuugggaagcucaggguaaagcaugaaggcuugcuuagcaggcgugacgagguggaagaacagugucuuggcagcugucagagucuuuccucauaaaaagcuuugcccaucugauugaguuccugcugguacugcugauacuccuuuucaaacagcucguguaaggcagcuugacggaccugguagggaaggcaauaaaguguuuggugucggcucuucaacaccucuucucagacucugguugccuuucccaucccuguguucuguugcaccuggacuuagcugggacauaaaaggaggcaguagaagaaagugugaaucacuggaggggaagccuaccuaauuucccuucccuuaggcagagacucauuguucaacaaauauuuugcugagaaugcaccaugaacuagaaaaucugcuagguacucaagaaaauaagagugacaucacaacugucccccaagaggagaaacaucggcuuaggcucucacuggaugaaaacagugaagacuaugaugcacugggaauuggaaaugugucacuugcagcugggguggggguuggggagacacgccuagaauuccaguauauucgaggcuugaugucugcaaguuccaggccauccugugaugcagagccagaccuugucuuaaaaauaaauacauaaaauaagaccccuggcuagauguagugaugcauuuuaaucccagcaugcaggagacaagaggcagguggagcucugaguucagggaggcuaaccuggccuacuuagcaaguuccaggucagcuacggcugcaaagugagauccuguuucaaacuaaacccaacccaaagaacccaagaaaacaaagcuuuaauaacccaaagcuaaaagagcaucucaccugcaaauaaugaaaauguaaaaauaaucacuuacugaaaaagaacuuugacaugugauguuaauguucugauaaaauaaugaaaaagaaucucagaggcaaaugauaugguuaagucgagagagagagagagagagagagagagagagagagagagagagagagagagagagaggaauuugauauccuggcuggcaggaacacagagcagcaaaggggaagacuccaggcugcccuccuagaacucaccacuaguagcuguuuguuagacagugcuaauuccuguuccuuaguauccuucauccuuagggcagcaaauagguuucuccguugguccaauguugucugccacauacagugaauaugaaaauuccgccaccugucccagauguaggggugggaauuaaacugguaaguuaguaguaaggauccgcugcuuugaacugacuuaggaucuaguguggacuguuacugaacucuuaccaugaauagagucagaugcaggucagcuguuauaguacacagagaaagaaacucacuugugucaccuuguucugggucuuacaucacugucccccuccccugcccuaccccacccuuuauuuucagacaggguuucacuguguagcccuagaaccaccugccucugcacccagagugcuguguuuaagucauucacuaccacugccuagcaacuaaaaaaaaaacaaaaacaaaaaaaacccaaaaaacauuuuuauguacccaaacugggcuccaacucacauuguagcuaacccagaacuucugaugcccaucucuguuggaaaauaaauccaaguccugugcaagcuaggcaaacagucuauaagugagcuaucugugcccuccuuuaaaaggcuucucacuauauaguccugauucucuggaauuauguggaccagucugggcacaaacucaagagagccccgucucugcccauaguguugaaauuaaagaacaaauaccaccaaacugcgccucccuuugggguugagagucuaucagucacaaguuaguuuaggcuggccucagauucaugcucauccaagcaccgagauuauagguaugggccucucugugcugcuucugccagcacuuaaaaaaaaaaaaaaaagaggaagauuggagauacagcuggugguagaaugcuuccaugcacaaagcccuggauucaauauaccccagugccacaaacaucacaauguuagcaggugaaaucugcaguucaaccugccagggacugucacuuguucaccaacuguugaaauaccugauguauaauuaguacaaagccaggugaggaacacaagaacauucaaaaaaagaaaggcaaaacaacaaacacuugugccguuucugcaggggaugggaagcaggggcagagaaagacaaggcucaucuccucucccuguuuuucucucugcucuguguuuuccuucuugaggaguccucacggagagcagauuucgguggugccucagggagaggagagcagaaaauacaaacugaugagagcagaugaaaacagauuaccugucgacagucuucuuaagugccacagcucuuugcaaauucugcaagagaagggaguucuguugaucuccuggauugcuagaagcauaccacuaguacccacuuuuugaggaaugaaguagugagcuucauaggggcaagugggaaagcuccacaucuugaaaucagacugaagagaaaauacaggagccagagggacuuaugcaaacagccacucuguuccacaagcaguuucccauauauugccaacucucccuuaugcuuccaagggucuuucucgggaaugguguacuuuggguaaaauaaccuggaaccauaucaaagaaaacuccaccaacucccaacccucuuuccgacccuccauaccucuucuaguuuugucauuuuuucugcagacauaucuacuacagacaugcuugcuaaguuuggggacacugggaaggcucuccuuucuguuuaguuuggucaccaagguuucaguagucauagcaacauuuaggcguccaacaaugacccuaguccugguaguugacugguuacuugggccuguugcccuagugaccugaagggaauccugauucuccagcuuucuauuagugacaaggccaggcuauaagcaugagccacacagucccuauuuuaggauuucuucuguuggaauuucagacuaucaguaguuuagauccagacacacaauccaaucaguuucuggaagcgacacuccacacccuauguccuguaaggaaaauguaagcacacaucaaaugccuguugcucuaaagaccacucuaaagaaaugauccaugguuuuacaguaguuaguuuuauuaaguacuuuguaaacugagacuaauacgcugacaucagaggauaccacuuuuucacauuaucucaccaucguggcauagguuaugccaagugccagaaugccccuuucuacuuguccuaaggacugggugaagguggggacagauccuuccacuuuaggaaagucauguucaugucacaauacaccugguuuaaacggagcaacaaaaucccaaaggacauucuacccacuuuugagaugcucuaaacccaaauauuucuauucaguugagugcaauggggcagacagagaagacaccucaccucaacuuacauccuugggauuaaacagcauuuaacaggguaggugauuuacagccaaaaucaagcgaagauuuucaaagaagcaucaacagaaauguuaagaaugacauuugaauucaaauccagaagaagugcuacugggagauacugaggucuuagccaauaucagaaaggguugggaaugaccuuuuagacacuguucuguaagaaugcuuuggccaauaaagccugggucugcugaaccagacaucccgagugcugcacggcugcacgugugcagccccaucacagagugcucuccaguguguuauaguuguccuuaaagcucuucaguuccaggaagugcuuagggcguuugcucuucugacuggaaggcagguaugugaccuggauuguuguuggugacauuucaggugacugaguuaggucuuuggcugcugacugguguugucucugagaacuuccaauucgugcuuugacccugaagaauauauagcaggcauggacagagugagaacuagcagaaaagggguuggagagaugacuccuugguuaauaacauauaccgcuccuccagaggaccagaguucaaguccuggcaaccacaugaagugucuguaauucuagcuccaggccagaaccuuuuuuuuuuuuuuuauuuugguuuuucaagacaggguuucucuguauauaguccuggcuguccuggacucacuuuguagaccaggcuggccucgaacucagaaaucauccugccucugcccccugagugcugggauuaaaggcgugcgccaccacgcccggcucaggccagaaccuuuacacaugcuuaacuaaaacuagugaaaaaugcaucuuaaaaacaagaaauucccaaaauacaacucagaaauuacuccaccccauaaaugcagcaaaaaaucaucugaucuauuuuaccaguuacuaagcaagguauaguggcagagaccuguaauucagggggcagaggaugucacaaauucaaagccagucuggucuacauagcaagucugccccaacucaaugcauuacaaaaugaccccccuccccgaccucucaaaacaaaacaaaacaaacaaaacacaaagcccaaacaacucauuaguaaaacaauuugauaauuuauauuaucagagaauccaaauuuuaauccuuucuuucuugggauguggagagagagaagggacagaaagggucuuacuaugcaggugaggcuggccuuauaggaaagugggccauuauaucuggcaccagcuuuuuuuuuuuuggggaggggggugucgagacaggguuuuucuguauagcccuggcuguccuggagcucacucuguagaccaggcuggccucgaacucagaaauccgccugccucugccucccgagugcugggauuacaggcaugcgccaccaaugccuggcuggcgaaacgagaauuugaaaaaaagaaaaauagccagguaugguagcauauaccaauaauccuaaaacucaagauggcaaaggcaagaggauuaucauugucuugaauuauagggaacaagaucauaucucaaaaagcccaaauuagggggcuggagagauggcucagcggauaagagcauugacuguucuuccaaagguccugaguucaaaucccagcaaccacauggugggucacaaccaucuguaauaucugauguccucuucuggugugucugaagauagcuacaguguacucauauacauaaaauaaguaaaccuuuaaaaaaaaaaaaaaacaacccaaauuaaaacaaaguaacaaaauaucuaaugaaauauaaagcaauaaaccuuguuucccaaacaguuucucuguguagcccuggcuguccuggaacucacucuguagaccaggcuggccucgaacucagaaauccgccugccucugcuucccgagugcugggauuaaaggcgugcaccuggcuauuuucaaguauaugcucugauaguuaaguacaaucaugauuuuauacaguuagccuucagaaugcuuuccauuuuacaaaacuuaaguuuauauugauuacaucccagcaaccaucauucuauauccccuccucuaacuacuuagaucacagugaaaucagcaucuauauuucaagugaauuuuuuaaaaagauuuguuuauuuguuuguuuauuuauuuauuuauuuauuuauuuauuauauguaaguacacuguagcugucuucagacgcaccagaaaagggcaucagaucucauuaugggugguugugagccaccaugugguugcugggauuugaacuucggaccuucagaagagcagucgggugcucuuacccacugagccaucucaccagcccucaagugaauuuuuaacacguuuccugccuaacuucuuucaagauuucuuauuuguguguaugagccugcaagcuuaugugcacaauacauuugcagaaaccuaaagacaucacaaguuggugucaaaugccggggcuugugcauguuuggcaaacauucuaccaauugaauuauauccucagacccuggaaacuaacucuagauuggcuuuccuuuuucaauauacauguucauucacaauuugccuaaguggcauaauaaaacuacuuuaaagcauucaccagucagauucuuuuuuaaacaaaugcuuaaacacugacuuucuacuuauuuucuuucuuuaaagacagguucacauugcauuacuugguuaaaaaaaauaaaaauaaaaaucuuauuuuuauuggaccaaagcacaaagaggacccuagaacagaggaauucuuaagugcugaaaaaacucauuccuagcuauaccauuuuuuuguuguuguuuuuuugagacaggguuucucuguguagcccuggcuguucuggaacucacucuguagaccaggcuggccuugaacucagaaauccaccugcggucugccucccgagugcugggauuaaaggcgugcgccaccaaugccuggcuuuuuuuuuuuuuuuuuuaaagauuuauuugacauuuuagugggguagacaaaaaaauaaaacccaaaacaagaauaaaacccaagauaugcucacaaaguucaaguuucucuugcuagcuuauagagcaaaauauccacuuuuguauuuaauccuggcaaguuuuaugagaacaguguagcucuucuguauucuccuauacuuuuguuuacuuauuuaguuuagauacagccuggucugguguagaccuugugauuuuucuccuuacgguacauauaugucuaacuagccuucuuucagguccccaccauacucacacaguggccagcucacucaaggccucuugauaucguaaguacucacucuggccaaagaccuuaggagacagaaaggaaaaaucaaucgcugugucugaagcauuucaucccauuaguuccuugaagggaaaaccaacaguucaacuuaccccugucccauagcgggcugucucauauccauccaggagaguaucaaugagggccuugccaacacccuugaaaggagugcuaguauuucgcagaucuagcaaguaggagcggaaauucuuacccauuaaagaacaggggugccggccuucagcaugaaacgggaucucugagaaaacaacagcacaaugacaccucugcucccugccuuuuccaaacuuagaaauaguuguaauuaccaucaagaaaccccgugucuuuuuuuuuuuuuuuccgagacuacacccagcugaaaccccgugucuuauaaaguuaauauacgcuaauaagauugugucuaaugaagccaggugugguggcgcacaccuuuaaucccagcacucgggaggcagaggcaggcggauuucugaguucaaggccagccuggucuacagagugaguuccaggacagccagagcuauacagagaaacccugucucaaaaaaccaaacaaacaaacaaacaaaaaaaaaucaaacaaaaauuuggggcuggugagauggcucagugguuaagagcaccgacugcucuuccgaagguccugaguucaaaucccagcaaccacaugguggcucacaaccauccguaacaagaucugaugcccucuucuggagugucugaagacagcuacaguguacucacauauaauaaaaauaaaauaaauaaaucuuaaaaaaaaaaaaagauugugucuaaugacacgaauaacgaguugccaaaaaaaaaaaaaaaaaaaagaaagaaaaagaaaaagaaaaacucuaauagaguuaagaucagagguauacagcuaugcccaagugguuauuuggguagucacuacagagcucuaagcucuaugccaaugauaucugauagauagcaucagcauccuuuccuguggacuuaguaaaaagcggaugcuacauuucccaauuccuuuugagggaaaacaauuaucacucaguuuauaaaacuagagguuucaggagaagacguuuaaaaaacaaaaucaagugcuaggcauaguguaguggcacacaccgauaauccaaccucugggaggcuaaggcaggacgaugcucaacucaaggccaguuugagcuacauagcaagaaucuauuucaaaaacaaaccugcaaaccaaaaacccaaccaaacaaaaaaaccccaaaacucucccaacauccacaauauaaaaccccgggaaaaaacaaaacaaaacaacccaaaaagcacccccaucccaaagucuaaaacaaacuggaggcucaaacuggagagcucagcagcuaacagcacuuacugcaauacacuugcagcagccuggguuuagaugcucacagcuacccagaauuccagauccagaggaucugauugcucuuuuuggccucuugcacacaaaugguacauauaaacccaugcaagcacacaauacguauaguauaaaaauaaggacagaggauggugggguaugucuuuaaucccaguacuagcaggcaaaggcaguagaucucugaauugaaggucugccaaggcuaauaucaagacuuugucuuuaaaaaaaaacccccuccccccccccaaaacaaaaacacaaagccgggcaguggugguacaugccuuuaaucccagcacuugggaggcagaggcagaugcagccugguuuacugauugaauucuaggacagcaagggcuacacagagaaaccuuguuucaaaacaaaacaagaaaagacaggcagaaagugaaaggaaggaaggcaggcagacagacagagcaaacugaggugauuuaucuuugagagaggaucucucuguagcuagcccuggaugucccagaacugccuuaguagacaaagcuagccuuuaacucacugagauuugccuguuugacuccugagcugugggauuaaagguauguaucaccacacuuggauacccaaagugguuucuuuuaacacagugcucucaaaauaaaucuuaagaagaaauggcucaucuuucuguuccauagguuuauauucuagaguguaccuuaucagcuaacuuaccagaggcacggauggcaucuagagcuuucauucuguacagauaguuguagcaaccuauugagaaaaagacuagucuuagugaucacuugcaaaauauuccaagauuauagugaauuaauaaacugccuccuuguaucuagcauauauccaauaacuuaggacuauaaaguuuuguuauagguguugacauuucuaauagaggaauucuaaagcugugggacuccucagugaaacauccuucaggagcuugucacauacuuugauuccccuggguuuccagcugcaguagucugguaucaucaucugcaaggagcugggguucauacuugauaucuugaacccuggauagucgaauaucgaucuccucuuuuaaguccugugcauucaggaaagaauacaucaucacuaucuuguauucuguuucccaacaaguuguaaaggggacagagcauauaaacuaauaugaaacagagaaauaucaaagaauggugugguuuguaaaugcuuggcccagggaguggcacuauuaggaaguguuggccuaggugugucauugugugagauuauuggauuucugaggacagccuggucuacaaagugaguaccaggccagccagacuacacagagaaacccugucuccaaagaauuaaaaauaaacaaaccaaacccaaauaagcaaaaauauguuuaauacacaauccacucuucaggaaaaaaaacuuuuuaacuaccauuuaaacuaaggagcuggguauuucaauguaugccuguaauuccagcagucaagacacagaaggagaucaggaacucauggccaacguuguguucuagaggccagccuagccuguaagagacucuggucucaaaaagccaaaaagggcugaauacgagagccaagugaagaccauuuuuagucaguaagaguauaugcaaaguuaugaaauccagucaauagagccugaugcugauaauggggagagucauagaaaaggaaguugguaguaaaguccccuggugucuuauuaaaaggaaaagcaugacggagauggcaaugggauguaaggauucugacuuacaacaggggaugcuaucucaguugucagagcaauugucuagcacacaccacguuccugggaucaggcuccagcaccacauaaaccacgagugucagugcaugcuuauaaccuuggcacuucagaaccgaaagcaggagggccagugcaaugccaggguuaccuacaaauccagcucuagccaaagauacaggagauccaguuggaaaaacaccagccaccaacaaaaagauuucaaaggagauggggacaggaggccaggcaguauagugaaauuggcaaaacccaagcuuagugaagacccugacucuaaaauuaagguggagagcaacugaagaaaauggacuaugccacaguauggcuuccacauauggcacacacaugcaugcauaccuacuuacacauaaguguacacauauacacaaaggauuucugacuuaaguauacuagguuugagauggcuauuugaaacuuaagggucuuuguuuuuuuuuuuccagacaaguuuucuuuguagaguccugacuguccuagagaucacucuguagauuaggcuggccucaaaauuacagauucuccugccuuugccuccugagugcugggauuaaagaaauaugcccaacuucccagccuugaaaccugaguuuuaaugucagaugguaguuauauauaccaacagguuucucaauagacaaaguuccauuagaaaacauuuuucuuuuucuuuucuuuuuuuuuuaaagauuuauuuauuuguuuuauguaugugaguacauacaaaauuaugaagguugugagccuucaugugguuguugggaauuaaauuuuuaggaccucugcucgcucugguuggccccacuugcucagucccugcuuguucuggcccaaagacucauuuauuauuauacauaagaacacuguagcugacuuuagaugcacaagaagagggcaucggaucucauuaugggugguugugagccaccaugugguuucugggauuugaacucaggaccuucgaaagagcagucaaugcucuugcccgcugagccaucucgccagcccagaagacauuuuucuuaaagccaagaaaagcaaagcacuuaaggagaaaguuuagacacuacuagauuauuuacuuuuacuauucuuuuuuugguuuuucaugucaagguuuuucuacauugcccuggcuguccugaacuagcucuguagacuugguuggccucagagauccaccugucucugccugagugcugggauuaaagguaugcucuaccaagcccagcacgauuauuuaauuuguggacgcagucugauguggcacauuaucuugguaaucucauuacuuguacuguccuugcaggagggcugcuuugagguuccguggugagaguuauuggguuacaauuggguguucaguaugucucaaaauacaaaacaaagaacaauaacaacauuaaaaaguuguuagguaauuucuuucuuuggcuuuagguuugacuugaaaaguauaacuaggugauuauugccccgccccuugcuuucagcagugucaaggauuaaacccagucgucugcauucuaagcaagcacaaugggcaucuuuaaaauucugcaaaggcaaccauucucacaacgcuggaaccaacuguaaguguucucagcaucaugcuuaaacuaaagcaacaugaaauauuuaguaauuuuaguugaagaugagacauuuuacagcugaauugguuuaaaucuuaagguacauguuguggagcagcagugagcaggaaguuauugcuuagacuguggaaugaaaggaagcauaugaauaaaagucuucuuuuaaaguccgagaaaaaucuccuugugccaaagaacagguuuaccuugcauucuagugaccuaccuugggggcauuguguccuacaggaacaugagguccccuucuagauuucauugcaaagcgcaugauuugucucuucacaaaaauaaacagcaguacgaauaccugcccaaagagauuagagccauuuuaguaauagcaauaauuuuuuaaaauguucacuuucaaaaucccuggguuuaggccuucagagcuggaugcuuuggggcgaagccgggucgcuaaggacggaggugggucaggggcuaguaacggagaggcauguuaaucugggcucuagaauuuaagagggaggguucuuacuuagagccaggcagcuuugacuuaaagaucucagacugucuacggauacaauucggaaguccagaaacaaaacaaguuaaguggcugaagaacaaagacagaacggcucaggagccuucuuuucaggaguccggcucagagggucgggacucagacaaaugccacaagaggaagagaauggggaucucaccaggcucccguacgccaucaccagcacgacauucacuccagaaagccaguuacuacuagacgccaucgccucucucuccgggaacaccugcuaggacagucccgccgcgcucgcgcguuagcccaggcucugccgaagccagggaaccuagguucccuggagcucuccgaacauuuccauaugguuuucgauuaaaaaaaaaaaaaaaaaaaaaaccaggcuagaguccgucagaaaacaugguggaugggggcgcuaguuaagcaucggaccuucccgucccauuuccccacccccacccccuccgccacgugacuuauguccgcaaagguaccugggagugcggagacgcggaacuacgccaguaagaggaagccgagaccuuacuggagucacgugauggaggcggauccgugcggggcggggcgggggcggggcgggcgcgcggaacucaagagcaguguuucguggcggggaggcgcgcgcacgcugacgugcgcggcccuuucgcgucacgugcugagggacgcaggaaggcaagugggagggggaaggcgcgagagcgagcgcgagagggaaaaggagggaggggguggggaggagggaaucuuauaucacgugacaggggcggcgcggcccggggugucaguguggaggagacugagguaaaguugggagcgcagcggcguuggcggcggcggcggcggcagcggcaacgcggcggggccggguauuguccgcggccccuuuaaauccgcgauccccuuuuuacccucccuucuuuuccucuguccccuccguauuccugucccgcgguaggccccccccacgccgugugucuccccacuguacacccucccuucuggucuugggaacccgggcguccaaccuccccaccucgaauuggccgccggggguuuuguuuauaguuggguucgcggccuacugggccgcgccagagccggggccucgauuugggagcguggccggggcggggcuuggggcagccggagggggggggcauguggcuagagccugaagggggagagcgagaaagagcgcgggcgagcgaggccugggcccagccugagguaggguuguuuaggagggucagugucuuguggagaaggccuccucccuccccaguccucucugggccucugauccggauccggccugguuuugggggcggaggggggguggcgaugggguggagcugccccaaacucccccauguggcccucgguuuggagugcggaggauuaauuuguuccgggugggagguagagaagcgaauggccccaugggcucuagauguggcgcggaggggggugagucucccauccuccgcgcgugggcuucuguccucucuguucauuuccagccucuuugucagcuccucuuauuacccugccuucuuucuuaccgacccuggucguggaauauauuuucgcugcagucuuugacuuccuguugucuauacug

SEQ ID NO: 1521 - RNA, 4246 nt, Mus musculus
ugagaugcaguugccaccgaguccggaacgacaacagcagcaaacagacgagagcacccgggaagagucggcgucgccagugccgggaccaggagccuccgcgagcaagauggccgcucccgagaccgaggccgaggggcacgggcacuagguccggacccgcguaccccuuucccggacgccugcguccccacaaagaccucgugcuucuagcaagacacccgcauggauuauucucgcuguggucacgaggccguuccuauagcgcucuaguuggcccagacugagaacucuggcaucuggcugcucggagcuggaaccucagggaggucugcugcaacaggugcgacccugaccgcuccaugcucgcgggcgcggggaggcguggccucccccgggccggccaccucuguuggcugcugugcgcuuucaccuuaaaacucugguaaguggguacuggggagaggaaaggagaucgcaggcgaaccccauagucuacgccccagaaaccaggacaccucauccacagacguccaaaguggguaugcgcugucuucugcgagcucacuguuguucuuacccccuuccccuuccugcagcgaggcagaggcuccggugcgcgaggagaagcuaucaggugggugauugcccgagaacccuguaccucuauggcuuguuucuaaugucuuuuuaguauacccagaacacagaaaaauaaggugccacauggaaugagggcaagcacuguguugggaagcuagaugggcagagccuuugagagaaauguuuuuugaauggucuucggcuggccguuuuucucucucuccuuuuagugagcacuucaacuucgccauguugguuggcagaagaguuuguggugacugaagaguguacuccguguucuaacuuccagauugugaguauuuggguuguuuguuuguuguuuugguaagcauuccauuaauggcugggcagugguggugcacaccuuuauucccagcacuugggaggcagaggcaggaggauuucugaguucgaggccauccuagucuacagagugaguuccaggacagccagggagggcuacauagagaaacccuuucucgaaaaaccaaaccaaaccaaaccaaaccaaaccaaaagcaugccauuaaugugucuuucuuccuuucuucccagacucuuagguuaugcucaaaucauuuuuuuuuuuuuggucuguuucauuuuauguauauagguauuuugccugcuugcauauguauuuggggugggagagaugcccuaaaaauccagaagaggucaucagaucuccuagaaucagaguuagaaaagauugaguuccaaugugggugcugggaauggaacccuguucucucuaagagcaaccagcaaccaguguucuucaccaccgagccauaucuccagcccucauuuuauuuauuuauuuuauuuugagacagugucucacuauguagcacugucuggucuggaacaacucaccauguaggccaggcugguuuugaacauuguauucguuuucugugggucaugugccacagaagucagaggacaacuuucucucuucccaccacauagaugcaauuugcuaaucuucacuacagauaucuuuacccacagaggcaucucagcagcccucaaacuugaacuuaauuucccucugaaaauaggccuuuuccacacugauggcaguguccugcucuguucauaaauuuuuuuaauuuauuuuuuuaauuagguauuuucuucauuuacauuucaaaugcuaucccaaaagucccccagacccucuccaccucccccccaccccccuacccacccacucccacuucuuggcccuggcguuccccuguacuggggcauauaaaguuugcaagaccaaggggccucucuucccaaugauggccgacuaggccaucuucugauacauaugcagcuagagacacgagccccggggggacugguuaguucauauuguuguucuaccuauaggguugcagaccccuguagcuccuuggguacuuucucuagcuccuccauugggggcccuguguuccauccaguagcugacugugaacauccacuucuguguuugccaggccccggcauagccucaccauaauuuuuaauacauaauaaauucuggaauuucucuuuaugucguaauuguuccuccuuccaccaaccaccuccaccaucuauuagcucugugcuguccuccgccagcucuggcucuuucuggcccgcaggccuucuguuucuuguuuacuucuuccuaaugugcuuuuggauauuucuuuugguagaaaacaacaccugagugugguucuacaggguauguggaaaaaaucacaugcagcucaucuaagaggaaugaauucaaaagguaagaguuguuucucuacccugugguaaccucuucugauccuauuaggaagcuaucucccagucuugguguaguuuggcagaggaggagaggggagccagauuaccccuaguuccuaaccccggucuucagcacuauguuauugguuauauucucugaucaaauaauuuggucaggacauggggaauguagcccauuaguaaagugcuaggguggguuauuccuugacucccagcucucaggaggcagaagcaggcugagaucaacaccagccuggucuauguaggggaggaguuuagugggucaaggcuauaucauaaguaccuauucucaaguaagcaggcagcaaagccaggugugauaacacacaucuuugaucucagcacucucagaaggcagaggcagacauauuucuuucuuuuuuuuuuuuuuuuaagauuuauuuauuauuauauguaagucaucucguuacggaugguuguaagccaccaugugguugcugggauuugaacucuggaccuuuggaagagcagucgggugcucuuacccacugagccaucucaccagccccggcagacauauuucuaagagagccugauuagaugcuucagugauugaaggcacuuagcacuauugcagagaacccuguuucaguucucagcaccuacaaaguuggucugacuccaguucccagguaucugccagcacccucuuuuggccuccuugggcauuaagcacacauauggaugcuagaaguauagaacucauuucagcaaguugucuucuaauugguuguuuguguguguguguguguguguuuguguguguguguuuucagacagggacaauggcaaccucuuccuuggcaugaguaugcacacacaaaauauaaaaaacaaauauaacuucuuuuuaaaaaaggaagaagagcugggcgugguaguacaccuuauaauccuagcauuugggaaguggaggcaggggaguugggaguucaagggcagcuugaacuaccugagacuuuuuuguuuguuuuguuuuugagauaggguuucuuuguauggaucuggcucuccuagaacuugcuguguaguccaggcuggcuuugaacucagaucucucuaccuuugccuccccagugcugggauuaaaggcauggaccaccaccaccaccagcacccggugaaacuuuaucagaaaaaaaaaaaagcaaucaaacugguuaaugcugcucuguuuaucucaucggaggcuacagauuaacuacagacuaacuaguuucucuuauuuucagauaguguuuugggugggcugccaugaagaaugguaauuaagagaaacugacuuucccugggagugacuguccuuuucugcccucagcugccguucggcucuacuggaacaacacuuauucuggaaauuugaaggcguugugguggcuguagcuuuagucuucgccugccuugucaucguucgucagcgacaacuggacagaaaggcucuugaaaaagucaggaagcaaauugaguccauauagcugaauuucuacuguauuaugguggcucuuuacggacuguaucucagauggagaaaguucagcggcuaauuugcacucguaaaccugugguaguagcauuuucaaugacuuccucuucuagaccauuaaugagcacaauaaaaaguaaaauagagcuggacaugacacagacuuggaaucccagcacuugagagaaugaggcaggaggauccuugguaacuuuguaggccgacuaggcugaacuacauaguaagccugucuuuaaagagaaaacggaaauaauaaaggaguaaagaguuucc

SEQ ID NO: 1522 - RNA, 5439 nt, Mus musculus
ggaggggagagggguggggagggggugggaauucccgacgcgaggccggaaccgagcgacagcaauggagugagacccucgggaggugagugaggccucgcuggucgcagggucaaaggcagcuucugaggccucccaggcuaggagcuggggucuccguguuaacauuuccucugcuuccugcgacgcuggcggccuccgaccuggucuccgagacuuccagacgccgcccagugcgggcaaagcucgucccaagccccucuuuggcuauaugccgagacuaccuguuauuuccgggaaauggcccuggggaguggguaguuaagagagucagccagccccgaaguuccccuguuucaaaucaucggugaagccauccgggacuucucuucagcuccaaccucccuuugcuacaugcacuuagcagacugagagaguggucugccuuccuuagggaaccccagcuccaggugcagguccuaccuggagucugcaccucauuuucugcgugcuccaggugaaagaguaaugugagaucuauauuggccuucgcgugccucaguuuccuccuugaugguucgcugaacuuggggagagaaauucgaaggaggaaaugcaauccugauguuggcguggaugagucacuucagcugggaaaggccagaaaguggcugggcugaggggaagugcauuccgcugaccagccuucccuuuuccgugaccccuucuuuccugugaccauucccacccaugcuaguuuucucuguauagguccaagagucaccgaguuaucacagccaccauggggcccuggggggagccagagcuccugguguggcgcccagaagcagucgcaucggagcccucggugccaguagggcuggaagugaagcugggggcccuggugcugcugcugcugcugacacucaucugcagccugguaccugucugugugcuucgaaggucaggugcuaaccaugaagcuucaggugagucuuuucugcuucggagguugggcgaggugacuggggugggggggggggcggcggggggggggagcaggaguggucauggcuucuguugggguagaaggacuuugaagagauucauuugguuauauauaaccccuuuuguacuucacucuuguuuagccucgggccagaaagcccugagccucgucagcugcuucgcaggaggagucuuuuuggcuacaugucuucuggaccugcugccugacuaccuggcugccauagaugaggccuuggaggcccugcaugugacgguaagcauugacuucaacaugugaccaagaguauauuauagaacagcuaauagaaaacagagcuauaaccugggcggugguggcacaccaccugugaguuggaagccagcaaguuccaggacaaccagggcuacacagagaaacccugacuggaaaaaccaaaaaagaaaaagacaaacaugguuauauagaucucuucaggggucaccucagggcugcggaaggccuugguaugugagucugugaauuauggauuucagcaacaggauauucuuacugugcauucuuucccugauacuaaacucugugugaccucucuauauuccuugauauaaugugagcagccucaucaggugugugaacuacucuggguugcaauucccaggaaguuaacaauguuccaagaaucacauuucauacacuuauuugcuugucccuccuucauucucugucuccuucccuccucuuuuucuuuuuuuuugguuuuucgagacaggguuucucuguguagcccuggcuguccuggaacucacuuuguagaccaggcuggccucgaacucagaaauccgccugccucugccucccgagugcugggauuaaaggcgugagccaccacgcccggcuucuccuuuucuuuuuugagacagguucucacuguguaggccuggcacuuguuuuguagaccugccucaacuuugcagugaucuucuugccucugccucccagaugcugaauuacaggguugugcuaccucaccccacauucucuuucuuauuuuucuuucuaaauuuuauuuauuuauuuauuuuugguuuuuugagacaggguuucucuguguagcccuggcuguccuggaacucacucuguagacaaggcuggccucaaacucagaaaucugccugccucugccucucaagugcugggauuaaaggcgugagccaccacugcccagcccuccuuguuuuucuuauuugcacauauuauacauaguaaugggcuuuauuauuacauuuucauacacacauaaaguauucuaacuauauucacuccuauuagauuucuuguuucccucccacugaucauccucuucugaucucucuuuugagugugaguggggugugugugugugugugugugugugugugugugugugugugugagacgagugcuugacuccaugaguuuaauuagggucacuuacaugaacacgagcgagggcgccuuuuuuccaguagggucuaucuacguaauguagacugcgcuaagcucuugguucucccucuucaauuuccuggguuacagguauucaccagcgagcuggagacagaucacugcagaucuggcagcauaggaagcaauuccccggggccagauguucucaagaaagugggaugugggguucaaggcaaggaagucugauacagaguuggaagcagugcagucccagcacuugcaaggcuggggcagaaugaucacaaggaguuggaggccagcuugaacuaugaaguguuuuucuuggcuagucugggcuucacagcgagacugucucaaccccugccugccucccaaacagcaacauuccaaagaacucagcuuaggaaaaccugagacgguuguucagcgaagucaucuuuuuucccuugugacugaggaaguaguaaugggucgugaccccuguauaccugugacugagcgaccuuugucuucauaugacugugaaugucccugugacauguagcuuuguaugugaacauuuguggcaggcccagaugugccccuuuguaugcuuacauguaacaacacugugugcauauacauccaugauucagcuucgggaagucuugacccuuaggaaggacugacuggguaauguguggagacauucuugguggucacagcuuaguguuggugauacuguguuugugacucacaucugauggguagaagccagagaugcugcuuacuuacaguaugcaugacagugauggcagagauauuuaccccaaaauauuauuagugccaaaguuggucugcauguaauacuuuggauaccauuagcuguuccauuaaguguuguucugugguugugccgccaacggacuucaucauggugugaccacagggggcuugucugugugggacgucagauguguauaacagagccucuaccaggcuuugcaucugauuucuucugauuuccugaacucuuguugccaccucuguucacagcuucaguuccccuugcaagaguucaucuuggccauggguuucuuccugguccuggugauggagcagaucacgcuggcuuacaaggaacagaccaguccaccccacccggaagagacaagggcucuacugggcacagugaauggugggccucagcacuggcacgauggaccagggaucccccaggccggcggaacuccagcagcucccucagcccugcgugcuuguguccuggucuucuccuuagccuugcacucaguauuugagggccuggcuguaggguugcagcgagacagggcucgggcaauggagcugugccuagcucugcugcuucacaaaggcauucuggcagucagccugucccugcggcugcuacagagccaccuacgugugcaggugguggcuggcugcgggauccucuucucauguaugacaccucugggcaucggguugggugcagcucuggcagagucagcugggccucugcaccagcuggcccaaucuguucuagagggcauggcagcuggcaccuuccucuauaucaccuuccuggaaauucuaccccaggaacuggccacuucugagcagaggauccucaaggucauucugcuccuagcaggcuuugcccugcucacuggccuucucuuuguccaaaucuaaggugcuucaagagaaagggcaggggagguuggcuaucaggugccccuguccucccucccuacccuucucaauuggugggaaauagaaagaaguggagaagggaaguagugaggaccaaagaguucucuuagauauagggaugggacauuuggacuaugaauaaugagauggaagugggcagagaagaggcuagccccagacccaaagaauaagagauagcgaaguuacuacagacguggucagggacauuagaaggaggcagacugcuacagucagaggccaggcaguacaucucagagacaagcugacagaagaacugagaguuaggcauccagccucuuugcgauaaagauacagaggcuguaagucaaagccaguauccuguugguucuagcccaucucaccacucugauggcugaaaugguuccuccuccuuucuucccuccuacucuuauauuucucucuugucuuccacuaagggacuagugccaaauggucucucugccaguuuucguaauuuaucuggccucuccuguccucaccuuuuuggguugcucuguguagccuuggcuguccuggaacucacucuuguaaaccaggcugggcuugaguuuacagagcuccaccugucucugccucugccuccuuaaugcugggacuaaaggggugccaugccaccacugccuagcucacuagucuguuguuaaagugccaaauacccacccacccacccuuuagguuuguuugcuuuuuuuuuuuuuuuuuuuuuuuuuuuuuuuugacaggguuucucuguauaacccugguuguccuggccucaaacucagagcucagucugccucugccuccugagcacugggauuaaagguguguagcacauguauugcucaccugcccccuuuuugaaagcacagugcugaggugcuggggccugccuagcaccucaguggagaccuauuugcucuuuuauuuaggccccauaguuugggguggggaagaaauauuugcugaacuggucuggagugagagaaaaguagguacugacaccagacacuacagaaaguggacauggugguccauaccuagaaaaaaaccaauaaccugccaaaacuuuauaucugaggaguccgggguggagggagacagacucccucccccaggauuauuuuuggggagggagggcugugcauaggucuguacucuguagaaucuauuuuacuaacugaccuguuuugggauauguuacccaaauaaaagauguuucuauacac

SEQ ID NO: 1523 - RNA, 5439 nt, Mus musculus
guguauagaaacaucuuuuauuuggguaacauaucccaaaacaggucaguuaguaaaauagauucuacagaguacagaccuaugcacagcccucccuccccaaaaauaauccugggggagggagucugucucccuccaccccggacuccucagauauaaaguuuuggcagguuauugguuuuuuucuagguauggaccaccauguccacuuucuguagugucuggugucaguaccuacuuuucucucacuccagaccaguucagcaaauauuucuuccccaccccaaacuauggggccuaaauaaaagagcaaauaggucuccacugaggugcuaggcaggccccagcaccucagcacugugcuuucaaaaagggggcaggugagcaauacaugugcuacacaccuuuaaucccagugcucaggaggcagaggcagacugagcucugaguuugaggccaggacaaccaggguuauacagagaaacccugucaaaaaaaaaaaaaaaaaaaaaaaaaaaaaaaagcaaacaaaccuaaaggguggguggguggguauuuggcacuuuaacaacagacuagugagcuaggcagugguggcauggcaccccuuuagucccagcauuaaggaggcagaggcagagacagguggagcucuguaaacucaagcccagccugguuuacaagagugaguuccaggacagccaaggcuacacagagcaacccaaaaaggugaggacaggagaggccagauaaauuacgaaaacuggcagagagaccauuuggcacuagucccuuaguggaagacaagagagaaauauaagaguaggagggaagaaaggaggaggaaccauuucagccaucagaguggugagaugggcuagaaccaacaggauacuggcuuugacuuacagccucuguaucuuuaucgcaaagaggcuggaugccuaacucucaguucuucugucagcuugucucugagauguacugccuggccucugacuguagcagucugccuccuucuaaugucccugaccacgucuguaguaacuucgcuaucucuuauucuuugggucuggggcuagccucuucucugcccacuuccaucucauuauucauaguccaaaugucccaucccuauaucuaagagaacucuuugguccucacuacuucccuucuccacuucuuucuauuucccaccaauugagaaggguagggagggaggacaggggcaccugauagccaaccuccccugcccuuucucuugaagcaccuuagauuuggacaaagagaaggccagugagcagggcaaagccugcuaggagcagaaugaccuugaggauccucugcucagaaguggccaguuccugggguagaauuuccaggaaggugauauagaggaaggugccagcugccaugcccucuagaacagauugggccagcuggugcagaggcccagcugacucugccagagcugcacccaacccgaugcccagaggugucauacaugagaagaggaucccgcagccagccaccaccugcacacguagguggcucuguagcagccgcagggacaggcugacugccagaaugccuuugugaagcagcagagcuaggcacagcuccauugcccgagcccugucucgcugcaacccuacagccaggcccucaaauacugagugcaaggcuaaggagaagaccaggacacaagcacgcagggcugagggagcugcuggaguuccgccggccugggggaucccugguccaucgugccagugcugaggcccaccauucacugugcccaguagagcccuugucucuuccgggugggguggacuggucuguuccuuguaagccagcgugaucugcuccaucaccaggaccaggaagaaacccauggccaagaugaacucuugcaaggggaacugaagcugugaacagagguggcaacaagaguucaggaaaucagaagaaaucagaugcaaagccugguagaggcucuguuauacacaucugacgucccacacagacaagcccccuguggucacaccaugaugaaguccguuggcggcacaaccacagaacaacacuuaauggaacagcuaaugguauccaaaguauuacaugcagaccaacuuuggcacuaauaauauuuugggguaaauaucucugccaucacugucaugcauacuguaaguaagcagcaucucuggcuucuacccaucagaugugagucacaaacacaguaucaccaacacuaagcugugaccaccaagaaugucuccacacauuacccagucaguccuuccuaagggucaagacuucccgaagcugaaucauggauguauaugcacacaguguuguuacauguaagcauacaaaggggcacaucugggccugccacaaauguucacauacaaagcuacaugucacagggacauucacagucauaugaagacaaaggucgcucagucacagguauacaggggucacgacccauuacuacuuccucagucacaagggaaaaaagaugacuucgcugaacaaccgucucagguuuuccuaagcugaguucuuuggaauguugcuguuugggaggcaggcagggguugagacagucucgcugugaagcccagacuagccaagaaaaacacuucauaguucaagcuggccuccaacuccuugugaucauucugccccagccuugcaagugcugggacugcacugcuuccaacucuguaucagacuuccuugccuugaaccccacaucccacuuucuugagaacaucuggccccggggaauugcuuccuaugcugccagaucugcagugaucugucuccagcucgcuggugaauaccuguaacccaggaaauugaagagggagaaccaagagcuuagcgcagucuacauuacguagauagacccuacuggaaaaaaggcgcccucgcucguguucauguaagugacccuaauuaaacucauggagucaagcacucgucucacacacacacacacacacacacacacacacacacacacacaccccacucacacucaaaagagagaucagaagaggaugaucagugggagggaaacaagaaaucuaauaggagugaauauaguuagaauacuuuauguguguaugaaaauguaauaauaaagcccauuacuauguauaauaugugcaaauaagaaaaacaaggagggcugggcagugguggcucacgccuuuaaucccagcacuugagaggcagaggcaggcagauuucugaguuugaggccagccuugucuacagagugaguuccaggacagccagggcuacacagagaaacccugucucaaaaaaccaaaaauaaauaaauaaauaaaauuuagaaagaaaaauaagaaagagaauguggggugagguagcacaacccuguaauucagcaucugggaggcagaggcaagaagaucacugcaaaguugaggcaggucuacaaaacaagugccaggccuacacagugagaaccugucucaaaaaagaaaaggagaagccgggcgugguggcucacgccuuuaaucccagcacucgggaggcagaggcaggcggauuucugaguucgaggccagccuggucuacaaagugaguuccaggacagccagggcuacacagagaaacccugucucgaaaaaccaaaaaaaaagaaaaagaggagggaaggagacagagaaugaaggagggacaagcaaauaaguguaugaaaugugauucuuggaacauuguuaacuuccugggaauugcaacccagaguaguucacacaccugaugaggcugcucacauuauaucaaggaauauagagaggucacacagaguuuaguaucagggaaagaaugcacaguaagaauauccuguugcugaaauccauaauucacagacucacauaccaaggccuuccgcagcccugaggugaccccugaagagaucuauauaaccauguuugucuuuuucuuuuuugguuuuuccagucaggguuucucuguguagcccugguuguccuggaacuugcuggcuuccaacucacagguggugugccaccaccgcccagguuauagcucuguuuucuauuagcuguucuauaauauacucuuggucacauguugaagucaaugcuuaccgucacaugcagggccuccaaggccucaucuauggcagccagguagucaggcagcagguccagaagacauguagccaaaaagacuccuccugcgaagcagcugacgaggcucagggcuuucuggcccgaggcuaaacaagagugaaguacaaaagggguuauauauaaccaaaugaaucucuucaaaguccuucuaccccaacagaagccaugaccacuccugcuccccccccccgccgcccccccccccaccccagucaccucgcccaaccuccgaagcagaaaagacucaccugaagcuucaugguuagcaccugaccuucgaagcacacagacagguaccaggcugcagaugagugucagcagcagcagcagcaccagggcccccagcuucacuuccagcccuacuggcaccgagggcuccgaugcgacugcuucugggcgccacaccaggagcucuggcuccccccagggccccaugguggcugugauaacucggugacucuuggaccuauacagagaaaacuagcaugggugggaauggucacaggaaagaaggggucacggaaaagggaaggcuggucagcggaaugcacuuccccucagcccagccacuuucuggccuuucccagcugaagugacucauccacgccaacaucaggauugcauuuccuccuucgaauuucucuccccaaguucagcgaaccaucaaggaggaaacugaggcacgcgaaggccaauauagaucucacauuacucuuucaccuggagcacgcagaaaaugaggugcagacuccagguaggaccugcaccuggagcugggguucccuaaggaaggcagaccacucucucagucugcuaagugcauguagcaaagggagguuggagcugaagagaagucccggauggcuucaccgaugauuugaaacaggggaacuucggggcuggcugacucucuuaacuacccacuccccagggccauuucccggaaauaacagguagucucggcauauagccaaagaggggcuugggacgagcuuugcccgcacugggcggcgucuggaagucucggagaccaggucggaggccgccagcgucgcaggaagcagaggaaauguuaacacggagaccccagcuccuagccugggaggccucagaagcugccuuugacccugcgaccagcgaggccucacucaccucccgagggucucacuccauugcugucgcucgguuccggccucgcgucgggaauucccacccccuccccaccccucuccccucc

SEQ ID NO: 1524 - RNA, 9965 nt, Mus musculus
cgacugcugggaagugauguccgcuuccugcccucccugcgugucugagggcguagaggaagcccguaaacaaacuacaagucccagaaggcggugcguccggagucuggaguaggcuggggccgagccgccgggcucgcggaggcggcggcggcugcugcuaaggcugaaggagccgggccgggcccgcggcagaggccguggcuggaacugggaagguggcggggacggacgcggggguaagauggcgacgucaggggcgaacgggccggguuccgccacagccucagcguccaauccacgcaaguuuagugagaagauugcgcugcagaagcagcgucaggccgaggagacggcggccuucgaggaggugaugauggacaucggcuccacacggguaaggggucaugccugggagcccgaucacugaggagcgggucccggagcggagaggcggggcgggggcgggagccgcagggcaggaggcggaacacugcugggacagcgggcgccgccgucuggguggcguggggugagggcccagggucaguuagaugaauuuugccgggaagaggugaacacacuggagaagucgugggaguaguaaagacuggguuggaguuauuuacauaugaaacaggggucgcaggaggagauggaccgccgaaaguccaucggcaggggaauggcccuugucuauccccagccgaguccuuucagguacuccaccgaagcauccucaaucuuggauuauguguugggagcauaguuuguuuuaucccuaaucugacccuuucugaaucugugaucacagugccugugcucuuaugggacaacuagguuccaaggggaaagggccccucgagugguuugaucgggcugugcuggguauauugggacaggaaguccccuccugugucccuucccuuugcuuccuuuuucaaauauuucgugugguuuccugacuugagucaaggugaagaccauugcgcacaguaugggucuugguguauggcucugggcgacugugaggaaagguagagcuuugaaucgccuaauugggcuaaagaaucacccuuuccuuugacuggggaugugcugaacucucuaggcagguggugcuaccuguggcucagugucuggaaugcuuucuagaguccuguaugugugggaaauacuccuuccuaggaaguuacacaaagaagcaucgggccucagacaaguuguuuuuggaagcacaccccugaccccugccuugguuucuugcuucccagggcagguugugagggaauuaggguaaacacucaagaguuugcagguaagcagccccaacuuagggacacaauuauuuuuaaaacagcaggugagggauauugcaguaucuuucauaauaaagagcuugaaggaaacuaaggggagaugauggagcauaaauaccauauuucaaagcucuuuaguucuauauaugacugacugacuguauuuauguguguaucucccucuacucuuugaguccuguguguguuuccccuuugauuuuucuagagaccacauguucuaguuuaugagaguucaagauagauaaauagagaugcaaaucugguguguguguguguguguguguguguguguguguguguguguuuauaaccuccucuuaaccaccaugaggauuaugaacuauugacugcucccuuuaagagcuuuugauuaugguggggguagaguuaagaagaugggagagagguuuauuuccaguggagagcuugaggcucuguacuguggaccagagcgagugugugcacgugaggaacgagaggcugggccgucugucuguguggugcuuucguagcgcuuuccuaccuaguuuucucuugccgauuaacuucucugcggcauggcaaaauggagugaccauacauggccagagccuagauauacaaggaucuugaguuuggcgugaaaggcuugccuugcuaccuaccuggcugacugggagggugugcuagaggcagagacggccaugguggcauagaccucugaggacuuggagucuauucauuaagcccagagaugagcaucacuacccacuggcaucaccgagcugaucuggaguagaagacugguucugaucaguucugagcaucagaguuuacccuuccucgaguacuuuccuccuucccgugcccguaucccagcucuguuuggcugcgagcugugucugagccuuggcaguaguuacguaugucucauacagagguccaugugacauagagagaggcuaacacuauggccaacggaggguucuuuugucucacuuccuuagcagacaucucuacaaacuggcaggagauggcccugcccgaaguuggaauaggcuacugugcccucucccuccucuaccaguucagucuucuuagcauccaguacaagaauacuuggguugcuuaccuuucuuuuagcagaaccgucaucaucacucuuuggguuuuauagucugggaugugcagacucugugcagccugguucuaaagcugggaaagaagcagaucccagaaacuuaauggucuucagagugugaaggaaagaaacuggcaauagcgaaacuuuguuaucgacuccugucuucucaucuucuaauuaaucuuggacacgucuggaagugaaggcagaaagcgccgacuaggccaccccucuaucugugacuugccuccguggggauucccgagagacaggccuuggccaucggggcuuuucaggcaguaggagcucauugauuaggaagccgcagaggggcugggguggguuguuuguaugggucuugcuuuuccccaucacugccuuuguacuggcagauaucuuagaaaacagcagugcauucugguggcagagguggccaaagggaacaguacuuaaaaccuuccuugacauaccuauuucucucuuuuaucucaguuacaggcccaaaaacugcgacuggcuuauacaaggagcucccauuauggugguucucugcccaauguuaaccagauuggcuguggccuggcugaguuccaggugaguggacaccagccaaggaggaguguaggcucucaggcugcuuccccugcugauucaccuguccuuuuggcagagcccccuucacucaccuuuggauucaucucggagcacucggcaccauggguugguggaacggguacaacgagaugcccgcagaaugguguccccacuccgccgauacccccgccacauauccuucaagagugauuuaagggcaaaggaacaggaaggggcucuuuagagacucacagaggggaggcgcuuucuccuuauaugcucauguucaucuuucugcaguucuuuuacccagucgugaaaagugacuacaaccugugugucagcacagacuguugugaugggcagcugguguuucugugguugugcccuccucagugcuggucuuggcuggccuuacuuuugcucacuugauuguaaagcagggcucccugucaccugggcaggagauucagucccuuuucucauucuguugugaacuuugauuccuagagacgcuaccauguuugugucccuuacccuacucaggcauuugcuuagguuguuccaccucuacuaugcuuggccugauuuuucccccuauuuauuuguuuguuuauuuguuuguuuacuuauuuacuugacuuucugagcaucucucuauguaguucugguugugcuggagcuuguccaggcuggccuauguagacuagguagacauccuccuccucugcuuccugagugcuaagauuaaagaggugugccaggccugguuuucuuuuuuguuuguuugguuuugguucuguuuugagaugguuuaauccugcagucugggauuuuucugaaacuugacagaaaaaugagguaggguucaaacuuuuggugacguccuuggcacagccuccuaaguacugggaucacaaguguagaccaccaugccugcauuuauuccauuuuauuguuugcuuauuuuugugguccagggccuaacaaauuagguggccuucauugagauguaacccugguuucucguccuucuucuuuccuucuguucuugugugugugugugugugugugucuguguguguguguguguguauguguguguauguguagagacacgacaucucacuauguugggauuacagcagugagccacuauaugugacuuacuuguauugccacacacugucucccuuauucugucaucuguucucucuacuuuuuuuccuuaacuauaguuaucuacauugacaguucuccauauagcccugccuauuuaucuccucccccagagucuggcuggcgaaggugaguccagagcagguagaauuucucacccauucagucucugacauguucuagaggggcugaggugggcuagguacuaggcuaagguaucaaagguaccuccucuuguaagggccaagcugggaggguggggcggcaggguagguggucagaguccagucuuggccauguugacaugaguggccaagccuccuaauccagcuagcagaaccaauggaauuguagccaagcugggguguguguagggggcggggaggggagaguggcaggugaaaauggcuccuuuuucacaguaguagaugccagguguaaugcuguaaccaugucaugucuuugagccccuccuuucuccaucucgccuccaauauuuguauccagaaaacuugguaggcuucagcauuucuauucagcuugucuuggcagagaggaguuucuguauccagaucucuuagauugagcaggggugggaggcuuauggaucaagggcaucagaaaagcagaaagaggcacgauacugggugccaaggccuuuccguauccacccuggcugccauacguuuucccacccccaugccuuucucauccauugccagcgccuucuuccuccucauaacuuuucuauccuaggaugaugcccuggggcaaccucccagcugagaaggggcaguuguuuagacugccgucugcacuuaacaggugauggcccuugacuuccuuaguccacaucucuucccuguacugucugggggcccuacucuacuucauccccuuuucuagaccaguuugaauauuccacugccaggcaguguuuugguaucuggaagacuauuacugcuacucauuucuacuccuccaacaggacaagcucugacucugcucuucacacaagugugaugaacccuaacccccaagacacuuauccaggccccacaccucccaguguccugcccagccgccgaggaggagguagguggccccagggaguaacuguggagcuuuuuacugaagcagacaaauaaguaggcacugcagccaccccuguuguaucccaugcagguuuucuggauggugagauggaugcuaaagguauguguuccuuaccagcuguggguaaacgaaugccagaugucugggacuuuguauugggucagggaauagucuuggcugccuuugcuucuuguccugccuuccuggauucuucuccagcuuugcccucaccagucuuucucuuucaagucccugcuauugaggagaacgugguagaugacaagcaucugcugaaaccuugggaugcuaagaagguagguaugggcugccggguggguguccuccucuaucucucugcucuccuccuucccugagacagcccuuccagggcucccacugagaucuguccucauuucuaacccccuuccuucucuucucagcuguccucaucuuccucucgaccucgauccugugaagucccuggaaucaaguaagcagcccuguaaagcuggagugagauggaggggagaaaggaagccgauagaaagacugauuucugcucuucucugaccacuuucucuuuaccugucuuucuucuucugucuucccuagcaucuuuccaucuccugaccagccugcuaaugugccuguccucccaccugccaugaacacaggaggcucccuaccugaccucaccaaccuacacuucccuccuccacugcccacaccccuggacccugaggagacagucuaucccagccugagugggggcaacaguaccaccaauuugacccauacuaugacccauuugggcaucaguggaggucugggcuugggccccagcuaugauguaccaggugaguggcuaccuuauccugguuauguuaccacaagguauugagaggcuagaauggugccugggauccugugacugcccacagacccugcaccucauaucuccucauuguaauucucaccaagcaagaaugaguagguguggcuuuuccuagaaaaaaagacggacaauaacccccaaaugaguagugccgaucucauggucagggacagaguagggaggaccuuugucgccauagucuggucacugcuacccauucuggucggaaagggguuugaguucccaucgguaauguuggcaucucugguuuuuugucugugucugcaggacuucacucaccucuuagccacccaucccugcaguccucccuaagcaaucccaaccuccaggcuucccuaaguaguccucaaccccagcuccagggcucccauagucacccaucacugccugccuccuccuuggcccaccaugcacugcccaccaccucccugggccacccgucacuuagugccccagcccuuuccuccuccucuuccucuucguccacuucaucuccuguccugagugcucccccuuacccagcuucuacuccuggggccucuccccgccaccgucgugugccccucagcccccugagcuugcccgcgggcccagccgacgccagaaggucccaacagcagcugcccaaacaguuuucgccaacaaugucacccaccuugucuuccaucacucagguaugcguggccaccuucccuccauaugucucccuucuccuucccgugccugccccugucucauccauccccuuccguuccucugcccugucccaacccaucuuguaucucucuuucccuucuucgcuuaagaguacaagcucugccauuacaccuuuugguuucacaucauaguucugccucuugauacuuggcuuuguucacguuauugaacuucucugagccucagcaguuucaugguuuugugaacaucggaugcaguaacauacacugaguauucggcaucgggcauagcacaggugccaguguagcuuauccauuggccugucuuuguucuuauccuuccuuugccaguuccgcucaucccccaucacuucuguucuggcucaucccucuccuauuuccccuacgucaguggaacucauagagcccgagagucucagaccacagagcucaguccuuucacucuguauaagugaaaaacuuggugccugaacugaaaguaauuucccaacauuugcgcaaaugguggagauggugucucauguaguucaucuggccuugaacucaggauauaguugaggcugaccuggagcaucugauccuugcugcaucugccuccuaagagcuuggacuacaggcaugagcuaccuugccuagcuuucuuuuccuuuuucuuuucagacuugccuccgugcuaaaguuuucaaaucuuucuccuguucuuccuuccccuuauucuuuuccuccucucugccguccucugcccuacuccauggcuguuuccuggauguauguucuguguuccaucuguacccucuccuguagggaagccaugccagggagggcacuucuccuuccacaucuccucuacuucuuccucuccuccccucugguccgugaagccccuccagggcuucagaacaguaguggucauccucccuguggcauuaacagucagucucuagugagcugucacaaggaaccaguuacugauaccagguaccggggauuaggaacagucacuuacggaacggguuuaagauuaaccuugcugggcuuagccucacugagcaccuacauuuuaauaggcauuuuguguaauuuccaccaaccccagagaugugcguggaagccuagggugguguuggcuugggggagaguggggagacaagcagaggcagugcucuugccuccagagugcugagguuacaggggccgcaccaguacacauggcuuggagcauuguuauguuuguauugaggacagguacagcuuacaagguggggaacucuuaagaguucuuuugggggaucacacuaaagaauaaauuuucucccuuuucagggcguucccuuggauaccaguaaauugccuacugaccagcgauugcccccauacccauauagccccccaagucuaguuauacccacccauccacccaccccaaagucucuacagcaguugcccucucaggccugcuuagugcagcccucagguggacagccuccaggcaggcagccacauuauggggcacuguacccaccuggguccaguggacaugggcaacagccuuaccaccgcccaauaaaugacuucagcuuggggaaugugaguaugcaaacucauaguucugaaaugggggaugggggugggcugagggugggucaguuacuugaguggucacugguaugcugaauugggagauauggguggaccucuuuuuccccuagguaacauagcaaugccagcuuggggcuccugucuuccuguguuugaccccuacuccugccccucuguuucugcucagcuugcucuuugaugacuccugccuugacccguucucuuccuggcaugcacaugcucuggcccagcagguacggugcccacacuuucuucgggccccgugcucgcuucuguuggcucugcuugcuaucaccuccuucugucuuugccucucuuccuggguggauggggcuugcuaggcaaaggggacauaucagcagagcuaggcaggacacccuguucugaagcccacuuccuuaaggucugucugugugucccuagcuggagcaauucaacauggagagcccaucaaccagccuggugcuggaucccccugccuuuucugaagguccuggauuuuuagggagugagggaucaaugaguggcccccaggacccucacguccucaaccaccagaacuugacccacuguucccgccauggcucaggaccuaauaucauacucacagguaagggagugugggugcugguggagacuggcaggaagaguugacagccucacugcugugauaggagcuugaggggucuggagguguggccugagauccuuacccaccucuuguacacacaggagacucuuccccagguuucucuaaggagauugcagcagcccuggcuggagugccuggcuuugaggugucagcaucuggguuggagcugggccuggggcuagaagaugagcugcgcauggagccacugggccuggaaggacuaacuaugcugagugaccccugugcccugcugccugacccugcuguggaggacucauuccguagugaucggcuacagugaggggaccucacugccauccuucuucauggcccugucccaucagucuucaucccuucccccuggccaguagagacuacucucugcccccagauccuuuuucuaauaugaaugaaggauccuaaaacugaggaaagggaaggggcuuggccagguggccccugaaugcuguaugucuggugggcuugggggaauucaagggagggccuaaaagcacuuguaacuuugaaaaccgucugucuggaggucagagccuguugggaagcaagguguagagggaaaucuuggagagagggcuuguccagaagggaugggcacuaccagccccucccuauuucucuuccccuugcaauggaagagagagccagaauggauauuauuuuuuauuaaauauauuauauguuaauaaaaaauccuauuaaaccuuuu

SEQ ID NO: 1525 - RNA, 1687 nt, Mus musculus
uaauuauccagugcuuccuccacccuuaaggauccccuuuucguccuauccgccgucaaacauaggacucagugcagggagcggcccccgcaccccgagggcacuacugggggcggagaguuaaaaacacggagaggaggacgcuccggagaagaggggagcauggcgggcaugagguacugagugaaaagggggauggcgagggaaacggggagcgagggaggggagaaagaguaaaaagcgaagacacgaagggacaccagccgggucgcgcgaggccuaagugaaagaccagggcgcgcgcgcgggggggaggggaagaggugaaggggagcgcgaggcgggggcgcgcgggccgggcugggggaggggacgccaggcgggggcgcgcgggcgggcgucggcucgcgggcgcuuccccuccccccgcccuccaccuuuccccucccccaccgccgccuucucgcagccucgcucccuccgucgcuccucaccgcccccgggcgggcuggcgggcuggcgggcuggcggccaggcuggccuaggccagagcuccucaccuggcagcggcggcggaacucccgaccaggucgcuuccucaggcggcugugaaggcgucgaaaaaggaggcggcgacggcacagugggauccagaccccacuggcggguccgggagcgggggugggggagggggcgggccgggucggggagggcgggcgggcggagcagacacugcgguacagacaggggcagcagcggcggcggcggcugcaccggcggcggcggcaccacacaaacaaggacgcugauugggcagcugccaagcgccuugacuccgccuuaaccacacgccacgacggccauuggaggaacuuagccggcuacccgcccuccucuucuugcuccuaccaauugaaagcgggauaccaagacuucaccccacccuugaggaauggguggcuggagaaguagugauuggcguuaagaaaauccaaucauaaauggagaagggggauggucuagcgggggcgcguuaauggguaccucggccagucccagacacauccgggucuucgacagcccauuaagugucgggggucaaaaaaucgcuucaggcugcagcuuuaccuuguagacguuuugguccccuggcagccgccguaccaccuagucucuuaaaaccgggauucuccuuugacaggcucucauucuuucucgucuaaagauggagaccgggaacggcgcugggcucuguguuugggugggugguguuucaucgcgacagaauccaugaauuuaaggacaggacuagcuuuaggagcucuggccuugucuuucugggguguggccugccccguucugcccaaggccuugggacucguguguuaauuuacuucugaccgguccuuuccugguuguaccguaacagcacaaagaaaaaacaaacaauuagcuaaauguacugaauuuaugguguauacucugggaucuggucuuuuucuguucacagugaggauacagcuucccaccccacccuauugcacuagcuaagucaaggcccggguucuuuugcuagccuggcuaucuccuacuuccuccaagagguuagacccgccuacauucuacguuucuagaacaccaugaauauucuuucugagcgcccuagaaaugagaacuaauuaucaca

SEQ ID NO: 1526 - RNA, 4709 nt, Mus musculus
gggccagauaagcuccagcuguuuauuacaaaauaaugacuccauauacaaaagauacccgaaaacccucccuggugcagccaugguggccuguacccuccgagccccucccucaaguggaagguuucagauucgaaggucuccagacaggagggcacuguaccgggcaggugugaggggcagguaggccccuauaucuugguccagaacauagagugggucagacaguacacuggggucaaagcccucauuggccauccuaaccuucugcuguuugaaggucucaguaguggccaaagauuccuggggagagaaggguguuuucagaguuggaggaaauguaguuuguccacucagcucaggugaguugccugagcucugcuuaggggcagguaugggggaaggggacauuauauagaauuaaggugaagccaggcgugguggcgcacgccuuuggcggauuucugaguucgaggccagccuggucuacagagugaguuccaggacagccagggcuacacagagaaacccugucucgaaaaacaaaaacaaaaacagaaggaagaucagugggcgggacaacagcugcugucucugcgauggggguggggauggggauggggguggaggugggguggggaagacuugccuugcaagugugcagacccggauucaacccccucaaccugggagagauccugggagaauguggggaugggagcaucucuaggauccccuggccagccagucuagccuagcuggugagccugucucacagggggcagcugugugcuugaggagaacacccagggcuguccucuggccuccguauucacaugcacacacaugggcauacacacauacaagauaaaagggggagaggcaaggagcaugcgccaaucaggggagcguccuuccuccucacggagaguccucugugggguuccuugguggagguuaagaaccccuaacaguugcagauacaugaaugaaggguuggggcaggaacggcugguuaccuggagccugagaaaccgaggucgggcauacgguggcaaguucucagaaacauggcuguagagcugcaccagguucagagccugcgggggccgcagagccaaggccgccaugccugcccugccuucgugcccuggugggugcagagacacauaagcccuucuguuccuucccaaacacuacuaugugggguaggauacuggguaacucccugucuuucaugucuaagcaccuggcaccgugacuccauagauguucaccuccugaaggaaguccagggucuccaagaccucagccacuucaguuguggccacauucucucccuuccaccuguuggccgagcagggagaaacugaggcauuacaggaguuuugcugaggagauaaauaaguuaggggauaauguugccgauguggucugaggaaguuggaugggguuggacaugagaugugucaccuaguuugaaagucugagaagauuggaaagugacagagagauaccugaaggugucuccaguacgaucguggaagugaagaaagccuugcucaucacagaccaagagguccccaguauugaagaaaacguccccagaccagaagacauccuucagcagcuuguccuuggccagcuccggagccccagcauagcccaggaagggggacugcuggcucacuggggccaccaguaggccuggcucaccuggaagaauuccuggggucaggacugggucacuugccagaaccccuaggcuccgcccccaccucaggugccagguuuaaccuugucugccagcuuugcaccccuccaaguacaaaccuggagauguggucaugcagugccccugggcauuccgaauaggcuccccugucaugacaucguaucgaaucaaggagaaggggaagaugugcugggagggagagccauacugcgucguuagcccccggagccccugcucucgccauccccccuucugcuccagggguccuccuguccacucugucucucaccuuguaaagccaggaagcucgccccacugcacccugccguccuguguaauugaacguagcuacguugcccucugucaugccauacgucuccaguaucugcagagguccaaaucgccgcaggaaacgcucccaggugucugggcgcaacccacugcccacugccaagcgcaccuuauggucacacucugccuugcucugagauggugagaaagaggcaggggcuccagcaccaagcuuccagauccccagugaagcccuguuccuuauccuccagaacauccucccgcugggccgccucuuggccuccauacaugucagggggacuuccaagugacagucuugaugucuccuguugucuggccugcucuguagccuacucaccgggggcugguugacgagguaucggcacaacuccccaauguacuggaacacugucacccuguguuucuggcaaucgucccagaacuggcuagcugagaacuuggguuucagcaccacgguggccccugcccggaaacgggagagaagggagggugaagagaagacuccagccaccauugcucacuacagacgccugcuggagucaugucuuuagcaggcuguaguggccaaguccuucccuacucguguuugcugaggcuaauauuccuuucuagguugauacaacccuucucuuuuguucccucugaaccaugcagccuccacaguggcucgcccugaggcucugaacugugugacauuuccuacuguacaggagggaaugccucacucuaccuaggauucaggacaacucccuggcaaggcuggcauagauucagcacuucagcacuugcuagagcaguggcucaguggcucucaaccuguggguugcaacucucuugacucccauaucauaugccuacauaacaguaguaaaauugcaguuacaaagcagcaacggaguaauuugugguuugggggucaccacacccugaggaacugugacauaggguugcaguauuaggaaggcugagaaccacugugcuagagggaauaugugagaaacugaauaaugcccaaggagagagacuaaccaaugcccaagcagcccacaaugcccagaagggagccagacaugugguacagugggagugcgagguagaucacguccuccugguggacuccacacagaugguagaaucccuggcacuguagaaccuucagaugacugauucgagcagccuugggcaggccugaaggguggcaagaggggcacagucaggaaaagggucugagcuguguccuggaaaaauagguauuuuggggacuggaaggagagaagcugugccugggaugguguccagggugaucugaaagugacaagcgucccaguccucuccccagaccuugccacccucugccucagugucugagaaguauuguauccaguccucaccaguagugccagaggugaagauguacaggcagguguccauuauguucuggggggcagagagguaccccggcacuggcucauccacuuggucugcugcuuccgauagcaaauugcugauuccagcuacauuaguuucagggcccgucgcccauagguggagccccauggcucucaaggccggcagguccggcuccagggacuccaggaacucuacaaggguaggcaaacccagcuucgagguucuccagcuacucuaaagccuuccaucaccugguugguuugcucuguccuugugcaaugcucuagggugaggguggcaauguggggaucccacgucuugccugggaccuguaauccgacggcuuaagaauucuuugggucuagcacaucccuccccaaacccaggccucuuucuuauucccacucacuucugcaccucgggucuagggagcaggcgcgcccucucuggcucgcagccuuaccuguggccagcacgagcgcacucgcaccgcagcugcggaggcagugcagcagggguccucggcguaaagcggugggcacaaaggccgugcgcaggccagcuuuggccaguccgaaccaaauccaaaggaaauccgggcccgcugggaggagcagcgccacggucgccccgggugccagagggggcgcggucgucccucuagcagccgcaucuccagccggaggcgccacgcgugcgccuuccucagugcugccccugcccgagccucggcggcccccgguccagccccgugcgcgcagaaaggcgcgagcaauccgguugcucucgcgcucagccuccgcguagcuaaagcgcugcgcgccguggaugaggaaggugugugucggcugcucccgggccagguacgcgagacgccaggccagacugcacccgcucucagagcuuucggggucggcggccgcugcggccagcgcgcgugcucgaagggcccuuuugcagcggagggcgcgaacugugaaggccaggucggccggcagccagcgcagcugaggccagacgucuagcuucagcagcagaggcaggagcaagaguaagggcagcagcagcaggagggccgccauggugcccuuuuccucuaguccgucccagcagcucacacacacuccaggugguccuuccugaaacacuaagccagcuuugguccggcucggacaaccuuucuucccgggaacguggcgcgcgugcgcuggcacccgcccuucccacccag

SEQ ID NO: 1527 - RNA, 4709 nt, Mus musculus
cugggugggaagggcgggugccagcgcacgcgcgccacguucccgggaagaaagguuguccgagccggaccaaagcuggcuuaguguuucaggaaggaccaccuggagugugugugagcugcugggacggacuagaggaaaagggcaccauggcggcccuccugcugcugcugcccuuacucuugcuccugccucugcugcugaagcuagacgucuggccucagcugcgcuggcugccggccgaccuggccuucacaguucgcgcccuccgcugcaaaagggcccuucgagcacgcgcgcuggccgcagcggccgccgaccccgaaagcucugagagcgggugcagucuggccuggcgucucgcguaccuggcccgggagcagccgacacacaccuuccucauccacggcgcgcagcgcuuuagcuacgcggaggcugagcgcgagagcaaccggauugcucgcgccuuucugcgcgcacggggcuggaccgggggccgccgaggcucgggcaggggcagcacugaggaaggcgcacgcguggcgccuccggcuggagaugcggcugcuagagggacgaccgcgcccccucuggcacccggggcgaccguggcgcugcuccucccagcgggcccggauuuccuuuggauuugguucggacuggccaaagcuggccugcgcacggccuuugugcccaccgcuuuacgccgaggaccccugcugcacugccuccgcagcugcggugcgagugcgcucgugcuggccacagguaaggcugcgagccagagagggcgcgccugcucccuagacccgaggugcagaagugagugggaauaagaaagaggccuggguuuggggagggaugugcuagacccaaagaauucuuaagccgucggauuacaggucccaggcaagacgugggauccccacauugccacccucacccuagagcauugcacaaggacagagcaaaccaaccaggugauggaaggcuuuagaguagcuggagaaccucgaagcuggguuugccuacccuuguagaguuccuggagucccuggagccggaccugccggccuugagagccauggggcuccaccuaugggcgacgggcccugaaacuaauguagcuggaaucagcaauuugcuaucggaagcagcagaccaaguggaugagccagugccgggguaccucucugccccccagaacauaauggacaccugccuguacaucuucaccucuggcacuacuggugaggacuggauacaauacuucucagacacugaggcagaggguggcaaggucuggggagaggacugggacgcuugucacuuucagaucacccuggacaccaucccaggcacagcuucucuccuuccaguccccaaaauaccuauuuuuccaggacacagcucagacccuuuuccugacugugccccucuugccacccuucaggccugcccaaggcugcucgaaucagucaucugaagguucuacagugccagggauucuaccaucuguguggaguccaccaggaggacgugaucuaccucgcacucccacuguaccacaugucuggcucccuucugggcauugugggcugcuugggcauugguuagucucucuccuugggcauuauucaguuucucacauauucccucuagcacagugguucucagccuuccuaauacugcaacccuaugucacaguuccucaggguguggugacccccaaaccacaaauuacuccguugcugcuuuguaacugcaauuuuacuacuguuauguaggcauaugauaugggagucaagagaguugcaacccacagguugagagccacugagccacugcucuagcaagugcugaagugcugaaucuaugccagccuugccagggaguuguccugaauccuagguagagugaggcauucccuccuguacaguaggaaaugucacacaguucagagccucagggcgagccacuguggaggcugcaugguucagagggaacaaaagagaaggguuguaucaaccuagaaaggaauauuagccucagcaaacacgaguagggaaggacuuggccacuacagccugcuaaagacaugacuccagcaggcgucuguagugagcaaugguggcuggagucuucucuucacccucccuucucucccguuuccgggcaggggccaccguggugcugaaacccaaguucucagcuagccaguucugggacgauugccagaaacacagggugacaguguuccaguacauuggggaguugugccgauaccucgucaaccagcccccggugaguaggcuacagagcaggccagacaacaggagacaucaagacugucacuuggaagucccccugacauguauggaggccaagaggcggcccagcgggaggauguucuggaggauaaggaacagggcuucacuggggaucuggaagcuuggugcuggagccccugccucuuucucaccaucucagagcaaggcagagugugaccauaaggugcgcuuggcagugggcaguggguugcgcccagacaccugggagcguuuccugcggcgauuuggaccucugcagauacuggagacguauggcaugacagagggcaacguagcuacguucaauuacacaggacggcagggugcaguggggcgagcuuccuggcuuuacaaggugagagacagaguggacaggaggaccccuggagcagaaggggggauggcgagagcaggggcuccgggggcuaacgacgcaguauggcucucccucccagcacaucuuccccuucuccuugauucgauacgaugucaugacaggggagccuauucggaaugcccaggggcacugcaugaccacaucuccagguuuguacuuggaggggugcaaagcuggcagacaagguuaaaccuggcaccugaggugggggcggagccuagggguucuggcaagugacccaguccugaccccaggaauucuuccaggugagccaggccuacugguggccccagugagccagcagucccccuuccugggcuaugcuggggcuccggagcuggccaaggacaagcugcugaaggaugucuucuggucuggggacguuuucuucaauacuggggaccucuuggucugugaugagcaaggcuuucuucacuuccacgaucguacuggagacaccuucagguaucucucugucacuuuccaaucuucucagacuuucaaacuaggugacacaucucauguccaaccccauccaacuuccucagaccacaucggcaacauuauccccuaacuuauuuaucuccucagcaaaacuccuguaaugccucaguuucucccugcucggccaacagguggaagggagagaauguggccacaacugaaguggcugaggucuuggagacccuggacuuccuucaggaggugaacaucuauggagucacggugccaggugcuuagacaugaaagacagggaguuacccaguauccuaccccacauaguaguguuugggaaggaacagaagggcuuaugugucucugcacccaccagggcacgaaggcagggcaggcauggcggccuuggcucugcggcccccgcaggcucugaaccuggugcagcucuacagccauguuucugagaacuugccaccguaugcccgaccucgguuucucaggcuccagguaaccagccguuccugccccaacccuucauucauguaucugcaacuguuagggguucuuaaccuccaccaaggaaccccacagaggacucuccgugaggaggaaggacgcuccccugauuggcgcaugcuccuugccucucccccuuuuaucuuguauguguguaugcccaugugugugcaugugaauacggaggccagaggacagcccuggguguucuccucaagcacacagcugcccccugugagacaggcucaccagcuaggcuagacuggcuggccaggggauccuagagaugcucccauccccacauucucccaggaucucucccagguugaggggguugaauccgggucugcacacuugcaaggcaagucuuccccaccccaccuccacccccauccccauccccacccccaucgcagagacagcagcuguugucccgcccacugaucuuccuucuguuuuuguuuuuguuuuucgagacaggguuucucuguguagcccuggcuguccuggaacucacucuguagaccaggcuggccucgaacucagaaauccgccaaaggcgugcgccaccacgccuggcuucaccuuaauucuauauaauguccccuucccccauaccugccccuaagcagagcucaggcaacucaccugagcugaguggacaaacuacauuuccuccaacucugaaaacacccuucucuccccaggaaucuuuggccacuacugagaccuucaaacagcagaagguuaggauggccaaugagggcuuugaccccaguguacugucugacccacucuauguucuggaccaagauauaggggccuaccugccccucacaccugcccgguacagugcccuccugucuggagaccuucgaaucugaaaccuuccacuugagggaggggcucggaggguacaggccaccauggcugcaccagggaggguuuucggguaucuuuuguauauggagucauuauuuuguaauaaacagcuggagcuuaucuggccc

SEQ ID NO: 1528 - RNA, 3010 nt, Mus musculus
guagaauucaaguugagucuuuuauuauaaacauugagauugcuguuuuaaauuauauaaauugaaaguaauagauuccuaggauaccauugugauggcuaauuucuucagcuuggccuaaaauaaccugaaauuucugcaaaggauuaacccuaaauguggggugaaagcaucuuaugagcucagugcauggacagaauaaagggauaaauggcagaguccagcauucccuucucuuggaagcuugaucaccucacauucucaugucucaaaauaggccccaaaauaugcaucagugugaccauguccugaacccuuugaaaccauaauaaaauaaauuuuuuuguuaaaauaaccaguacaagcauuuauuuaauaauguugagcaauacuuaauauuaacauagucaagccaggguggccaagaggauaaauuauuuaccuugacuuuaccuaaguccucaguuguaaacaaaguggaguuacagguaaaggaaacugcccagccccaguaauaggaguaacaggaugguuaacacuggcuggcuaagccuggaaaggauggcgcuuaaauauguaacuuuuaaauuuuauuuuaugaggaugguuguuuugccugcauauauaucugcaucauaugugugugugugcugggccaaaaggccagacaagggcauuggguuccccuggagcuggaguuagaggcugcugugagucaccaugugggcgcuaagcacuggacgccaucuggaagaaucaccaguguucuuaaccauugagccaucccucuagcccuuaaaauauguagucuaaacaaaaaaaaaaaucgcaaaagcuuaggacucuuagcugucaaggcucugccuugaccuuggauccucgcuaucuggcaugcucuccuuggguagcaaugaaggcaacaguugcgaaacuuguuaauaggaguuaaccuaaacauuauagaguguaagaugauccuggaaagguuauuaccuucugagaggaacuguggugaagcagagggggagaaauaggaguauacuuucucacuaaaucugguguuuucucaauuuucuaccacacgaugccuaauuuacuuaguauucuuugggggaaauauauagaggcuugagcccggcacucugacacaugccuauuauaaucccagcauucaggaggcuaaggcaagaggacauguuugaggccagccgggacuacauacugagaucuugucucaagauuaacaaaacccaaaagguagaggcucuuucuuggauggacaagcugugauggagguucuuuaggaaauaguccugccguacgcauguuucuugaggcggcuacaugaaugaguacauagugcaaaaaaaaucaaaggucuacagagacuuuccuggaaucuucucgugucuaccagacaaagccguuggagaauuguacuuguauacucaggucacgggcccgugcuuauuugcuuggagaaccaggaggguaaacuccugaauccagcauagcucuccugcgagcuguuuccuuggccacgcugugguuuaaccgccuuagucguuccuguaagacaggaagauggggaaucuaaugacugcuguaaaagguuuuaacugaguccccucugccccuguccccagacuguuuuuucucuguguagcccuggaacuugcucuguagaccaggauggccucaaacucagaaauuugccugcuuauauguccagcuggcuuuggcucuuuucaagccagcccuuuacguuaaaauggacuuguaaaugacagccacuagaaguuaagaauuagaaguuaagaauuggcacuugucuaguuugaggccuaguaauggggugaggggaauaugggccuuuauuaucagauuaguuaacaccacucuuuucccccauaguugcuucacaguguugaagacauaaagcaggauaaacaagaagaaauuuuuuugaaagagggucaugcuauguagcccuagcugauuugauaguccaggcucugcucaaaguucaagccauccuucuugccuuagccuaccaaaugcugaaacuacagcauguaccaccaugcacugcugggauuauuauuauuauuacuauuuuauuauuuuaccugugcauucuguaaaauauuguugaccaagacaacucgucgccuggcauuaagcagcuucuuaacauagggguccagauccagggccacuuucugauccucauugauccggcacaguucugggaagaggaaaugggcaaccaacaucuaauggcucauuuuuuguucuuagggaauggaagagaggaaugggaugaaaaauacucuugcagucuugugugggccacagacaccuucccuucuuccauucuguccuaaaauauccccagaaauuggaguccuuggguaguucugauauugagaagcaagugacagaaacuuagccuaaaaccuggggaaacaaaguucccgaaagugagaucagggauucuagguauccuggcugcucacucaccuguagcuagguugucaauuuguucccggagcucuacuuggcuuucucugcaaagugguacaaaagucuacaacggucagugacugggacgcgggaaacgaauucuacuuauuccccaaauacugagacaagccaaccucaacuucaaggccucacccaggcccuuccgccuauuuacccagucucaacaucagugucucaagaauguaucuaguauuucuucggggccccgccccuacaaagccaguucccuaggccccgcccccagcaacccgguccugcaccugaccgcgugcacgugagagucgagcugcugcaccgcgggucgcaggaacuccaggagccccucggcaaagaggucgcggccugugggccccgccacuggggucccggccccugacacagcagcggaaccagccgcggccaucgcgaacugcccugacgcccucagccugccgcgagggucgccgggaacuccagaccgccg

SEQ ID NO: 1529 - RNA, 3010 nt, Mus musculus
cggcggucuggaguucccggcgacccucgcggcaggcugagggcgucagggcaguucgcgauggccgcggcugguuccgcugcugugucaggggccgggaccccaguggcggggcccacaggccgcgaccucuuugccgaggggcuccuggaguuccugcgacccgcggugcagcagcucgacucucacgugcacgcggucaggugcaggaccggguugcugggggcggggccuagggaacuggcuuuguaggggcggggccccgaagaaauacuagauacauucuugagacacugauguugagacuggguaaauaggcggaagggccugggugaggccuugaaguugagguuggcuugucucaguauuuggggaauaaguagaauucguuucccgcgucccagucacugaccguuguagacuuuuguaccacuuugcagagaaagccaaguagagcuccgggaacaaauugacaaccuagcuacaggugagugagcagccaggauaccuagaaucccugaucucacuuucgggaacuuuguuuccccagguuuuaggcuaaguuucugucacuugcuucucaauaucagaacuacccaaggacuccaauuucuggggauauuuuaggacagaauggaagaagggaaggugucuguggcccacacaagacugcaagaguauuuuucaucccauuccucucuuccauucccuaagaacaaaaaaugagccauuagauguugguugcccauuuccucuucccagaacugugccggaucaaugaggaucagaaaguggcccuggaucuggaccccuauguuaagaagcugcuuaaugccaggcgacgaguugucuuggucaacaauauuuuacagaaugcacagguaaaauaauaaaauaguaauaauaauaauaaucccagcagugcauggugguacaugcuguaguuucagcauuugguaggcuaaggcaagaaggauggcuugaacuuugagcagagccuggacuaucaaaucagcuagggcuacauagcaugacccucuuucaaaaaaauuucuucuuguuuauccugcuuuaugucuucaacacugugaagcaacuaugggggaaaagagugguguuaacuaaucugauaauaaaggcccauauuccccucaccccauuacuaggccucaaacuagacaagugccaauucuuaacuucuaauucuuaacuucuaguggcugucauuuacaaguccauuuuaacguaaagggcuggcuugaaaagagccaaagccagcuggacauauaagcaggcaaauuucugaguuugaggccauccuggucuacagagcaaguuccagggcuacacagagaaaaaacagucuggggacaggggcagaggggacucaguuaaaaccuuuuacagcagucauuagauuccccaucuuccugucuuacaggaacgacuaaggcgguuaaaccacagcguggccaaggaaacagcucgcaggagagcuaugcuggauucaggaguuuacccuccugguucuccaagcaaauaagcacgggcccgugaccugaguauacaaguacaauucuccaacggcuuugucugguagacacgagaagauuccaggaaagucucuguagaccuuugauuuuuuuugcacuauguacucauucauguagccgccucaagaaacaugcguacggcaggacuauuuccuaaagaaccuccaucacagcuuguccauccaagaaagagccucuaccuuuuggguuuuguuaaucuugagacaagaucucaguauguagucccggcuggccucaaacauguccucuugccuuagccuccugaaugcugggauuauaauaggcaugugucagagugccgggcucaagccucuauauauuucccccaaagaauacuaaguaaauuaggcaucgugugguagaaaauugagaaaacaccagauuuagugagaaaguauacuccuauuucucccccucugcuucaccacaguuccucucagaagguaauaaccuuuccaggaucaucuuacacucuauaauguuuagguuaacuccuauuaacaaguuucgcaacuguugccuucauugcuacccaaggagagcaugccagauagcgaggauccaaggucaaggcagagccuugacagcuaagaguccuaagcuuuugcgauuuuuuuuuuuguuuagacuacauauuuuaagggcuagagggauggcucaaugguuaagaacacuggugauucuuccagauggcguccagugcuuagcgcccacauggugacucacagcagccucuaacuccagcuccaggggaacccaaugcccuugucuggccuuuuggcccagcacacacacacauaugaugcagauauauaugcaggcaaaacaaccauccucauaaaauaaaauuuaaaaguuacauauuuaagcgccauccuuuccaggcuuagccagccaguguuaaccauccuguuacuccuauuacuggggcugggcaguuuccuuuaccuguaacuccacuuuguuuacaacugaggacuuagguaaagucaagguaaauaauuuauccucuuggccacccuggcuugacuauguuaauauuaaguauugcucaacauuauuaaauaaaugcuuguacugguuauuuuaacaaaaaaauuuauuuuauuaugguuucaaaggguucaggacauggucacacugaugcauauuuuggggccuauuuugagacaugagaaugugaggugaucaagcuuccaagagaagggaaugcuggacucugccauuuaucccuuuauucuguccaugcacugagcucauaagaugcuuucaccccacauuuaggguuaauccuuugcagaaauuucagguuauuuuaggccaagcugaagaaauuagccaucacaaugguauccuaggaaucuauuacuuucaauuuauauaauuuaaaacagcaaucucaauguuuauaauaaaagacucaacuugaauucuac

SEQ ID NO: 1530 - RNA, 10149 nt, Mus musculus
ugcuugcaccaccucccugagccuagcgggaaguagguggaagggaaggaggucgagggaagggugcuauggugcugggugcugcggugcgggcugagcagggaaagggaaggauucugcccaggagugcuuagccugugcgccuccgacaggggcuucugucucggaacucagugaagaauuucaauaggaguuccacuaugggacccuuagucuggggcucuccgagugccuuuggaucucuuugccuucucagaaggggauuuuucagugcugaaucccccaaguauauuuuguuugcuuuucuuuuuaaucuuuuucaagcagcaguagcagucccucuaacacagacucccaaguagcccucauaauugggagggaugagacccugugguccuuccugaucaggcugugucccagucgcguggcgcuguguugggauggcuagugacagcaggggcgguccccucagcggaggcggaaacuugacacuucagacuugggaguggcucucgccuugccuggugcuuauaaacuucagccucagggcuccagaucgguuagcugcaucccaccuucuuucccggugaguuacuuuuccugacugcagagaaccuggagaccuuccuuucuuuaucagcucccgggucccuccuuccaagcggguucaggcagagauucaggaagugacuuuaggagagcaggcaacgguccccggaggaguauguggguggguggacagacagaaaugaggggacgagugggcauguuucuucccuuccuggacccccgaaggcccugguguccaggccaaacacuuuguggguuguggaugugaggaguuugaagagucccuuucuagaucuugucagucauggacaguagcagggaaggucgguggguucuugugcugagcagacucugaccuccauagccagagguagggaggguauggggcagagaagauggaucuggcccaauugagccagcccugaccucaauugggccuuugccagcucuaggcuucucuacuaggagccuuagccaggauguggggaggguggagacuccagucucaauacaaaucaacauuggagacaaacaaccuccugaccuucaggcagggagugacagagagaaaggaccauuagaacagagccccuacaugggauguuagcacauucagaggacuccaaaggaagacugucacagauagagugguugucccauggaaggaucacuacagagccaucccuaagacagacacuccaaaagggcacucagauagagaugauuucugaugcgaaccucaacugcaauacuguuggaacagacaguauugucauuacccuuccaggcagccacuucacccauucuuggauccuugauuccccuggucuguuucuuuccugucaggucaaucuguguggacaucagcuccugcuuugguauacugauggcagcagagacucugacugaacuggaggcggccauugagacuguggucucuacuuucuucaccuuugcagggcgggaaggacgcaaaggcagccugaacaucaaugaauuuaaggaacuggccacucagcaacugccucauuugcucaagguugguagagggcucuaggucugggcucuaggucuaagauuuucuaugcacgccaggugaugacacugaacagguaaugugacagaaaacagugugagugacugcauguuuaggugguucugugagguaggugccucagguaggugguguguguguguguguguguguguguguguguguaugagcaaacauucuguguuguugcaguugggaacaggcuguuguugggcucugugcuucuguugaacaaugcuguuaaguccugccuaugucucucuggucucauuuucucaacauaaaacuggacccagacuugaauucucgaagauuuacagacaguaaaaacugaaaggaggcuuaacaaaaauaaaacuauaagccaggcaugguggugcaugucguacgccugugaucccagcacucaggaaguugaggcagaaggaucagguuuugaagccagguuagggagacucuuucucaacaaacaauacauaaagguauagugagcuauacuuuugguauacucaggccuguaaggaacaccuaugacuacuuucuacucccugugguauccccuuaguaagggaaucauuccacagauauguguguggagggguuuaacuuacugacucuaaguuuacauccuauucuagucugcuagcaguuuauuuuacauccuuuaugaaaauucacaggcauguaagaguguaugaaugugucugggcaugguggcauacacuuuuaguucuagccccugggaggcacaggcaggcagaucugaauuugaggccuuccugguauauaaagcaaguuccaggacagccaggacuguauggagaaaccuugucuuaaaaaacaacaacaaaaacguaugugauuaugaacuuuuuugagacagucucauguagcuaaggguagccucgaacuccugguucuccuuccugccucuacuucagaagugcugagauuacaaguuuguagucccagucccaacaugaauauggauuaucuuuuaaaaauaguauaguaaaaagauguuuuuagauuuauuuauuuauuuuauguacaugaguacacuguaacugucuucagacacaccagaagagggcaucagaucccauuacagaugauggugaugugguugcuggguauugaacucaagacuucuagaagagcagucagggccaucuuuccagcuuggauuagcuuuuuuuuuccuucccauuuucauguguauggauguguauggguguuuugcucagauguaugacugugggcauugugcucauggaaagcagaagaggguaucaggucuggaacuggagggcaucagggacaucaucugggacugggguuguugugacaugguugugaacugccaugugugugcugggauugaaaccaagcccugcuggaugugggggcacacucacaucuuuaaaacuggcagaggcaggugaaucuaugaguucaaggccaguuuggucuacagaaugaguuccagaacagccaggacuacacaggaaaacccugucucaaaaaaaaaacccacaaaaauuaaaaaaugaaaauaauguguggcuuaagguagccuugaagucaccgugguauccuguuuggccuccucaguguuagucaggauccagacaugaguggcuuggcuuggccaggaccuuuagucucuugacuacuccauuuuuauuuccucccaucaaggucauuuccucauggauuuccuuguucaguucaucuucuaagcaacaucauuacagccaugcuugcaaaucccuugauucuguccuuagauuguugucaggaaggccccacccccugccuaagauucugccuagccugugccugcacuuggagagcugaaucuaccuagaggagcaugcgcgcgcaaccagguugaccuguuucacucuuaaauauagaaccacaaacuccaaaggaagccuuggcagugcuaagcaacucuguauuucccugugaaugguuaggucacaacuuucccuuccucagauuccaggaccucuuuccacauucucccugucaccgagaaacugacucacugagaaaguaagcaaucaagguuuccuguacuucccccaucuccaauucucccaccucguuagcaucugccugccuuccuuccuguccucacaugauguacucacgcuuccacaaccagcauucccucccucucaccugcuuggaauacuuucucccgcagugacuccuuuucccucugcaccagcaggcuuuccuucaggaucauuuguauuuguuuacccugugcuggaauucauaacaaaaucagcuuagaacucagucacuuggcucuuucucuucaccucccguucaaaauacuuuucucucucucuaccucucuuucucaaaagauuuauuuauuuguuuuaugaauaugaguacacggucuuauuuuuuaagcuuauuuuauuuauuuaugagugcucugcuguguguacgacugcaugauagaagagggcaucagacuccuuuauagaugaucaugagccaccaugugguugcugggaauugaacucagcaucucuggaagagcagucagugcuuuaaacugcugagccaucucuccagccucagaaugcuuguaucuuuuuuuuuuuuuuuuuuaagauuuauuuauuuauuauauguaaguacacuguagcugucuucagacacuccagaagagggagucagaucucauuacgggugguugugagccaccaugugguugcugggauuugaacuucggaccuucggaaaagcagucgggugcucuuacccacugagccaucucaccagcccugcuuguaucuuuuaagagauacaaucugauacaagccagauacaauaggcucacacacucaagcuuagcaugaucuucuugguagcuuuaaucuuuuugaagaaauagguuuagccugucacagggcacacagagauucuuauccuucuuggacuaugucucuuaagggguucaugcuugccacacuucucgcagaaagucaggcaggucuuagaaaguucaagauguuccuaggagugccaucaagcacagaaagcuuuugcuuauuuauuuauuuauuuauuuauuuauuuauuuauuuuuaauauuuuuugacgugcuuugccugccugcaugucugugcaccaugugugugggcugguagggcuggaaguaggcauaagauccccuggaauuagaguuacagauuguuguuagcagccaugugguugccagggauugaacccaggaccuuuagaagagcagcuagccauuuuaacggcugagccaucucuguagucuuuuuguuuauuuuuugaggcagagucucucuguuugucucaggauggccuugaauuugagauccuccugccuuuucuucccagguguuaggauuacaggcagacacugucacaccuauaucuuuuucuuuuucucuccuuccuuccuuuuuuccuuccuuccuuccuuccuuccuuccuuuuuuccucccuuccucucccucccucccucccucccucccucccucccucccucccuucuuucuuucuuucuuucuuucuuucuuucauucaucucuuucuuugaaacaaggucucuguguagcccuaaguguccuggaauuuaaugaaccauuuuccaccucuccaguuguuuaaaaaacaucgagacacccccuucccccaguucuuacuguguauucuuaagcuagucuugaucuuacucuaaaacaggcugaccuccaacucaaaucaaucuuccugccucagccuccuaagugcuggaauuacaagagcacccugacccauuuguauuaauuauuuuucagaauuuuacugguggugauaaaucuaucuaucuaucuaucuaucuaucuaucuaucuaucuaucuaucuaucuauuuauuugauuuuuagauuuuuuaaggcagaguaucauuauguagcuuuaguuggucuagaacucacuaugccaagcuggccuugaacuuagagugguccuuuuguccuagacucccaccugauagggauuacaggcauuugacacuacaccuggcucauagcauuuuauuauguuaaaaagagcccaauaaauauuugaauuaggaucacaucaacuacauuuaagggaaaacugucaucuuuauacuacugagucuuuccaagguguuuacuuaaguagacaguaucagaauugaacugaaguccagaacaccugucuaguguuugccagagaauugcuugguaugaauacccacacauagcuggugucaggaguguuuuguguugaagcugggcuugguggugcacacaugcaaucccaggauuugagagguggaggcaggaggaucagauuucaagguuuuccacagcuauccaauggguuuaagaccaguuuaggcuacaugagacccugccucaggaaacaaccaaccuggagagugaucuguguuuuguguugacaccaguuaugguagcacaugacucuaauuccguaucauugcaaaagcagcuuucaaagggaacaagaaagaguuuauucugagccaauuaugaguaaccaugacuagaaauaggaguuggguugccuggcaaagcacauuaaaagguggaagcaauuacacaaaauguuuuugucuuucuuuccuuccucuuccucucauucuucuuuuccacauccuaggcugacacugaauuugcuuuggguuugagaauagucuugagucuccagucuugugaauaccuccugagugcugggauugcaggccugugccaucaucccuaguuuauguggugcuggagauggaacacaggguuuugugcaugccaggugaacucucugucaacugagcuaucuucccagucccgugaagguuuuuuguuuuuguuaggguuucucuauguaauaguccuggaugucucggacucacuuuguagaccaggcuaaccucaaacuuagagagacacaccugccucugucuccugagugcuaggauuaaaggcgugcaccacgacacugggcuuccugugaaguuuucaaugucacagaacagaggaaaucaaggcauuuucugauuauauuggugagggccucagguuaugcacaugucacggcuaagcagagucuggaagucucugcuauagaugcugugugaugacucucuuagcuuuagguuggugcaagcuagcaguugguuaauacuuuccaaagguuuuaccugaugucaagucagauauagaaagugagugcuagccgggcaugguggcgcacgccuuuaauccaagcacuugggaggcagaggcaggcagauuucugaguucgaggccggccuggucuacagaguaaguuccaggacagccagggcuauacagagaaacccugucucgagaaaaaaaaaaaaaaaaaaaaaaaaaaaaaagaaaagaaagaaaaaguggcaucuuaaauucuauagacucuuuaacagaaguguggcuuuuuuuucuccugggaacuucacuugggaagaggaggaagaggaggaggaggaggaggaggaggaggagaaggaggagcaggaggagcaggaggagcaggaggagcaggaggagcaggaggaagaagaggaggaggagaaggaggagcaggaggagcaggaggaggaggaggaggaggaggaagaggaggaggagcaggagcaggagcaggagcagcggcaggaggaucuagaauucaaggccuacuugggccauauagucuuugucucaaaacaaaauaacaaucaaguagaacccaaaguaauuuucugugcuagaugugaagagaaagaaauuuguuuuuuuauuuuccaaucaauuccuuaguucaguuuucuuagagguggcccaaaagugacaucuguguguaaguguaucuaaguuaggguuuuauugcugugaacagacaccaugaccaagguaacucuuauaaggagaacauuuaauuggggcuggcuuaaagguucagagguucaguucauuaucaucaaggugggagcaugauaguaucuaggcaggcaggcauggugcaggaagagcugagaguucuacaucuucaucugaaagcugcuagcagaauacuggcuuccaggcagcuaggaugaggguauuauggcucacacccacugugacacaccaacuccaacagggccacaccuucugauagcaccacucucuggguugagcauauacaaaccaucacaaagugcuaagcuauuucuuuuucuuuuccuuccuuccuuccuuccuuccuuccuuccuuccuuccuuccuuccuuccuuccuucuuccuucuuuuucuuauuauaaguaguauuuaaaaauauuuucuaacugguuauuauucuuauaauuaaaagcuaugauuuuuuugagacauggucucaauauguaucccaggcaggccucaaauuugcuccuccggcuuccaccucccaagugcuggaauuacaagcaugcaccacuaugccaaguuuuguguguaugguacuagagguugaagcuagaccuucaugcauguuaaguaaauugccgagggcucagcuauagccauagccuuuuaaaaacauuugaaacacagucucauuaaauagcucaggcaggccuugaacccuggauucucagccuuagucuccgguagaugagauuacuguccugcuucaccuggucuggcucauuucuaauauuuuuuuuugaggggggcagggugcaggcagggaagaaagauacagagcaguagauagggauggaaucacugauuuagaaaaucuagguucaagcuggagugauagcuuaaugguuaagagcacuggcugcccuuccugaggucccagauuuaguuccauugcuccaugauggcuugucucugucuauacuccaguuagagggaauccauacccucuuuuggccucgacaggcaccaggcacauacauggugcaaaauacucacacuuauaaaauaaaacgagggggggagagggagggagggagggaggaauggagagggagauggagagggagagagagagagagagagagagagagagagagagagagagagagagagagagaccuggacucaaauacagguccuggcuguucaucugggcuuugcaccaguaucugcaguaucugauuuuucugggguuuaaguuucucaucugcuaggcagacuugccacaccuuucuuguucgaucaguggugucuuuauuuaacccauacuuauugaagaccuacucugucuuuuccugucuugaggaacaaacuucagcuguguacuugacacugaauguaugguguuggguaagauagacaagguccuugugucauggaggcugucauccuaguaggucaugaggaucaagugaaauaaugugguauuaccaucccuggaagcaaggaccuaagacugcuugccacucucccuucugcugguaguggaaguguuguacacaagugaacuuaugacacuccuaggaauuugcuuugugucaucuggagaucuguuuggcagaucuuugccauuguccaaaucuugacucaaagguugagcaugggggccggagagauggcucagugaguauucacacugcucuggcaaaggacccagguucaguucccagcacccauguggcaguuuacaaccaucuguaauuucuguucagauauucucuucugaccuuugcgagcuccaggccauacauauguauguauaccacauguuggcaaaaugcccauaccuauaaaauaaaaugaauaaaucuaaaaacucacaccccccacccccacccccagaaaaucucccagcauugagaaucaagcucgauuugaggcaucucucaaucugacauccacuaguuguucagcagugacauuuauguuguaauuguuuaucuggcaacaaaucuuuucaucaugaaggcaggcuugcagaauccauugguuucauagccaugacacuuugucaaaagcacccuagaaaaccagauaaccugguauuuuugcuauuccccugaccuccuggguggugacuaaacugagaaggcaucagggcgaugaaaaugagcagcaauggcgguaguguuuugugaaggaggaagguaguuuacgaucagccauagugucugcucgugucccucggauaugagaccuccagaccaggaguaggugcuggcgcugucugagggaaggcaucugcacuccucucucucccugccccgagagcccugguuucuaaccuuugccuuuuauaucuucuuaggacgugggcucucuagaugaaaagaugaagaccuuggaugugaaucaggacucagagcugagguucagugaauacuggagacugauuggagagcuggcaaaggaagucaggaaggagaaggcccuggggauccggaagaaguaaagcuugcuguccagcaggaccuguugggcagagccaggcagcacuccaccccugcccccaaauaaagcuuucuucuugaaacacag

SEQ ID NO: 1531 - RNA, 5901 nt, Mus musculus
cuucccacagccagcucagccaggcaaggccgggagggagugggacagauucugggagugcaguggggaggaguccuggcuccgcugagcaggagcugcuuggcugucagugccagagcccaggccucagagcccugcuggaggagguggacucacaggaggcaggugagcccccaggcccagcggaggaggucuggggcugcugaagggacucugaagccuuggggugggggucaaggaagggagccugaggagaggugccugccagaaacagggcaggaagauuuugguaaucauuaauuuuccccaaaggcuaguuaggguaugagcaguccgguggcuuugugaaaccuguagaagaguauagacaggauagcaggacccucuccuggcuaagcagccgaccuggcucaucuccaggggcugggacauugggcagaacauuccagggccuugcccacagcuguugcguccucucucaaacggaacagggcggagagugugucuuggugggcguuagggguugacagacucuagacacaggccucacuggacuacggaagcugugaccugggaaaaauaaugguguucagaaggaacugcagagggcccagaaagccuaagaagccaggaaagggaggcaggggcugagguggcuucucuuccaccuggggcacaggcagaaccgggaugcagucuucauuugcucuggguggcuuccuugggaguggccuggggaagccggugagggccccuggaugggagagagggaaagagaaaggaguggagcuucaaacuggcagcuuuuccacucuagaaccuaggcaggucucagcuugacuggcccugccuggcagagccaccugcgcuguaggaguguuugccugcccggcccaggugaggugguggcaaggccaggcaggggugauggaugcuaaggugggcucauccucuacucagaagaggaacccuaggaauguuggagaggccugggguagagguguguguguguguguguguguguacgacaccugauuacaguauuaugaguugggggaaaaaguucgaaggacuuccugcuucagcagaaguuggcugaagauaaaugggguacuuaggcagaucaggacuggcagaguugauguagggugauauguggguaugaugucaugcguccugggagggggcagagguaggagcaccucugugaaccauuagccuucaacacugggaaaagaacgcgagggagcagagagacuggggagauucucuuggaacagucuugcaaacagcgauuacagcccaguucgguuaccguacuagcccugcauguugauagcaguugggaggaaugcguugacugagaaggggauggcugaaugaaugagaugaauguauugcuggauggagauaggugaaugaaugaaaguaauuaacgaggccgucagugaaugaguaaaugggaagaggaugagugaacuggagguagacgagaggaacacagagaaugccacaguuaaaacugaaaagcuuuuuuuuuugagagugaaccauguuaauuuauuggcauagucaauuuaucaacaagauggguaguuuguccucaggaggugagguugauuaaaaucuuguagguuuuagggaagauccuaaguaugagagaugaguagggauggagccaacauuuggaaagaaguaaccacuuaagcguacggaggugaaccugggagagugugguggacauucagaacuccagaccaaggaaagagguggggaccagacuugggggcgggaggguggggcuggaguggcugagauccaggggcauggucagggcaauuugggcuuuuggaaaagucagcaagccaggaucaggugggcggggguaggggguggagugggggagagccuccugguugcucaaugaugaaucaguccaggagacuaugagaacauuggggggaaggguggggccuaaggugaaaggccccuuuaggggaaggcccuuugaagugauuccuuauuucugcuuuuuaggaaggcuucaguguacacugguaucccauguccucauaacccccaacucucauuccaagacucgccugugaagacgcgaccuccaggauaggucugccuaggagaguggcacucuccccacacaccuggagguccucaggccugccuaguuaaaggaugggcagcugcaggagcagguggcugggaagugggugggguaguugagccugucuuuugccccccaggggagggcggaggggaauaaugacaccugacugccccacucugauacucugucuucagaaaacacuucagaaacacacuuguccagaugguuaucucagagcuguccauuuuauuaaaagaaccuggggaggaggcagaucccugggaggagagccugggaaagagucagaccacuacggcugcaucucuggucggcccggugcuccugggauagguggcugcaucaucuguuggguguuucucugucaguuguuugcuuggcugcugcgagaagccagguagggauugggcauaguacuaaggggcaggaggaagcucccuuggaggaaggaacaaaacuuaaugcagguagagggaaaggcacaucagccuuuucggaggcagcagcaucucagugcccuaucccgucccugccuccucuuugcacagagcucauuuggaacagcucuggaaugguaaaggguggggaucggggugaagagguguccaagucucaucuuccucucaagacuugagagagagagagagagagagagagagagaauauagcccuucccuauucugauguagaaucucuaggaacacuaggcauccucacccuacccaaagggcaucagggcagacagauuauguguugggaagccuucucuuccuuauuuguguauguuagagaacuugucuaugugucuuucaaacauuaaaccacacuguuacaccuuuaacaaacaggguauggggaagaauauaguuuccugucguuuuggcacugugucaggcacccuuccagccacgaccagagugguuggauggauuuccuaccagacaugccccagccucaccacucucccucucaacaccuuucuucugcauccuggccuacuuccuccuguucugauuguuccuuaagaaaaagaugcauaaagguguagaagggugaucaggggccuugggcaccuggcauuagggcuggacagagguggaauauuugaacauuuccuuugagcaggguacugggucggguauugugugccaggcaaguuacagagauuaaaaggaggguacuuguauaaucaggauuuaacaaaccuugcccucaaauguacaaauucugcuauucggaccaggaaacagcaucuggauguaagaaacacugugcuggcuuuauagauggagaaauaagaggcagagacuaaccaaaccagcuaauggcccaagcugguguugacgcagugaagacagacauggcugagggaguccagaaaagguguagggacgacagaggucaaggcacguuuccugcaggcauaguuugggagggccaggaugacaggcaagugucagcugagaggaguggguaagggagaagacgcaauaaaggcaaggcuagaaagcauguggugaggacagaugcuagagucuggugaaggagaccaccuuuuugaaucagauggugugugcacaggccuggcccagugacugugucauuuuguguccaccuccccuuccugggaccagcugggugagggcagcaguucauuguugugcuugagggugggaggggaguuugauuugcuaggcugauuuggaggggcucugugcaugggcggcgacacacagacuagauccgccugcucccuucauauccuguuauucagaaggcuguauccgcuuggagugugagugaguggccuuuuguucuggggugagggggugaugcguguagccugugccaggcggcaacuguguccagaggcccagagucugacuccagcuggggcagaacugggccaggaucuuccuuagguaauggggcgaagggugucguugggcccugaugaauaccuaaggaaugguuaugagggaggagaggcugacaggguguggccaggaggggagccacacaaaaucugaucugcuggaggcagaauuugcucuuuucuagagaugggcagugguggucuaacacccugagcucacuaccuuagagccuaugcaagggguagaggugggcuaagguuccuaucccuguuuuguugcuuaggccugaggucucagccaggccucgggauggaagauaaaagccccugcuuuccucugucuugauucuucccagcuaagguugccacagaacaagggaccuguguguguguguguguguguguguguguguguguguguguguagggggcaacaguuaccugcuuccucuccucacaggagccuccugcucucagagggcucugacaggcaucaggccugccuggggcaggggaagggccuggagaaccugucuuggcaguuggcagucuggcuggggaacaccuggauuagaggagucacauagcucuccuuccaggccacccccacacccacuuugcuauccuaugucugcuuucucccuucucugaaaggcaagaagucugaggaugcugucugugugcagggaugucccuucucaucucucuuuucugcuuccuaggcccagagaggagcugaggcagugagauggcugacugcuauacagagcuggagaaggcaguuguuguccugguggaaaacuuuuauaaauauguauccaagcacagccuggucaaaaacaagaucagcaaguccagcuuccgaaagaugcuccagagagaguugaaccacaugcugacgguauccccacugcugcccucugugccugcucuucuccucacagcucucucagugaccccucccucccugugcucugcuccguguucccuccuagccugcuagccuccucugcccugcuagccuggccaagggacucugccuaggguccugucugggccaucccaagcuuuacugauucaaguucuuccacaggacacagggaaccgaaaggcagcugacaagcucauccagaaccuggaugccaaccacgacgggcgcaucugcuuugacgaauacuggaccaugauugguggaaucaccagccccauggccaaccucauccgccaacaggagugccagcaggagagccagcaggagugccagcaggagagccagcaggagagccagcaggagagccagcagggcagcagcuagaggccccucgugggccccuuuucauguccugacccauguccugccaguguucuuuccaugcuuuaaguugacucuuucuuccucccuucucccuccagaccuguuccuacccuugcugaacagcacaagaugggugggucgggggcuaucaaggccacugugguagugcuucccugagcauucaaucccuggauccuguaggcccugggaggggguccccuuugugaaauaucaaugcuguuuggggcccuccccccaagacuucucucacuuguugagucugugugcucucgcaauguuccugucuaauucuugacugauucugggucuguccugaccucuagaggugagcuugcugcuugaggucucccagcuccugacuguggcagcugugguaguggcaguaccagaauuagccgcuucuuuuccucccaaccucuuagccggguagagaggcauucccaggggcuccuguccagcugucucugucugggaaugaucuaaccuggguugagccuccucucugcucugccaccgaaauaaacguugaauuuggaguuuguaacu

SEQ ID NO: 1532 - RNA, 45471 nt, Mus musculus
uccccuacaacacaauuaugcagcugaauuuccuuaccuuuggggaaguugcagggucagcacaggaggagccucauccuggaaaaccaccuuccugagaaugauuucucccugccagguacguucuucuuuuuccuuuuuuuacuuuaaagacucuauuauucaccauggauaugaaugugugacugcguguugguauucgugugggagugugggagcggcccuuggaggccagaagagggcauuggguccccuggagcagaguuacaggugguugcaaugugccugcugugggugcugggaacugaacucauguccccugcaagagcaauaccugcucuuaacuaugcaguuacuuuucuagagccuagcuuuuuuucuuaucauaagaauuuggauuuuuuuguaugcguggacuaugauauacucauuaaauauggauagugaagaauuuauuuuagauuauuacucuuauuuguuuucaggaauauaaguuauauaucauuugauuuuuuuuuuuugagacaggucuagggaacuggguagcccaggcuaaccugaaacuaucacuccuccugcuucaggcuucugagagcugggauccgaagugugagccaccaucugggcuagaaguuauuaauuucuuuccuuccucccuccucccucccuugauccuucauucuccuuuucccuuucuucucacucuuuuuuuuuucuuuucuucaugacauuuucucuguauucuaguuuggccucaaacucuuuucuguauguagcccaggcuagccugaaauucuccauuuuucugccuuugucuucugagugcaggaauuauaggcaugcccgggucuaccugaauauuaauucuuuuuggugguaauggugucaaacccagugcuuuguauaucuaagcacauuuucacugagcagcaucaacuguauuucuccccauuuaauuuuuaugauauuuuauucugacuguugcauccuugaaggucuuuuuucuugggucucaugcagcucacgcuggccuugaacuugccaaguaaccaagaguggcuuugcacaucugauccucccgccucugccucccagaugcugggauuacaggugugugcccccacacccagcucugccauguuuccuggcguucccaggguaacuuuaaagcucuaaaucagauuaugucacuccauuauuuaaaagccuccagucccuucagucuggauuuagaauagaaucugagcucuucgugauguccacagguucuguguugguccuguugaccuucaguuccauaucugcuauucccuccauugccauccguggccaccacagugacucuccuugaccccuuuauaccuagaauacucaucucugggccacugccugguauguucauguguuccacuuccaaugcaagaaacuccacaaacauuagcauguucuuucuggaccauggcaccugguggaugcaagcaccugugauuggcguugcacuuauauguuucauucacagcacuuguccugcaguacuggggacugaacccagggccccagaugugccaggugaacacugcugaaggaccucuucagucuugguucacaguacuuguuauaauuuaugauuauauacgacaugcuuaagggcuuaaaucauguaaagguugacagaaagacccagaaggcuucugagcaagugaauggcagaaucacaauucuguaaugacugcagaacuagagcguccaagaagauccagccacggggaggaugcucucccaggacaggcuggugugaggcaguagccacaggcacagagcucagcuggaugagguuccaaggaaagcgcagcagcaugugauauguacccagugaagacugugguuguuauggugauaggucagcuuggaguucuacccgccaggcagagaugaucccacauuguggcuuacaguguggaaacaggaacaguggagacuccaagagaccugggacagggguugggagcugguuuaguauacauucuggcccucugacuuuuuggagcugucuaaacugugggcugaugagaaagagggagagaaaaagagaccagagagaaaugagcaagagagagauguggaggaagggccaacauuagccuuaccaucugggcuaggaagagaauccaggaagcugcaggaaauugggcaaagcugcagagcaaguguguuugagggguggugcuuuacagccuggccagugugaguucaaguccaggucuacucucaauccacaggcuuuuguuuccagaucugcucaucauggacacaguucuuguuguaagcaugggugagaggauuaaauuagaccagggcuucuuuaacuuuuuucuuucucagcuauuuuugccugaggaauuuauaaaagacccugugcagguagauauaaagucaaauguuugcugaugauaaauuguaaagauauuuauuuuaaaauaauauuuuggcauguauauaauuuuauuaacgugaaagaaaaauugaacacuaaugagaugggugugcuuguuuaguuuuuuauuuaaaaauguuucuuuaugagacuguaauuuaaucacauuucucccuucccuuuccucccuucaccucuuucauagucuccucuccacuuuuccuucaaauucuuggccucuuuuuucauuaaugguuauugcauguauguauguauuugcuuauacauauauauuccuaaauauaaccuauugaagccauauaauguuacuuguacguaugauuucaggacugaccguuuggcacugggcaaccaauuggugugcucuuccccggggaggaccaccugcucccagcuuuccucaauugccuuuaguucuuuguguagggcugagaccuagugggauuauccccauccaguuuggcguguguauugugucaaaucuguucagcucuuguuugggaggucauguuggugagacuuuacagauauagcuucugauguuacuaggagacacaaucucacagcaaacucccugacccucuggcucuuacaaucuuucaguucccucuccugcaauuuucucugaguuuuagaugcaggggaccuuuguagcuuuuuccaccaggacugagcucugcaacucugcaucuuguuuggcuguaguuuucugcugugucuguugcaaagagaaguuuucuugaugagggaugaagacuacacuuauuuguggguauauggacaaauguuuauagguugcuuuagggauuaugcuggcuuaguaaguuagugguuauagauuuuccaccaauaaccaugauuucacuaccauugaauaguuagcuagguuucuaguaucaagcaugauuuccuucuuguugaacaggucuuaaguccaauuggagagcuguugauucccaccaagguaugugugccacuacugcacccaugaguuaucaugccaugcuggucauugauguggcucauaggcauuauagcugggugagauuguuggcuaccucccuccuuucaucauagcuguguaggauuguugguugccucccuccuuuggaagguuguauggugccuucugguaccaugaaagccaguccucaaggaggggacauuuagguuaguuccagucucuguuucugaaguguuugaugucuucggcaauagggauuuaccuuccaccucugggggauaaccaaggguaacaugcuuguuuagucuuacauaaggaauuaaaucucucucucucucucucucucucucucucucucucucucucucucucucugagacaggaucucacuuauauaucacuggcuguccuggaacucacuaccuguagaucagacuggccuggaacucacagagauuuaucugccucugccucccaagugcugagauuaaaacguaugugucacugugcucagucaaucuuggcugaguauacugcaggaucaagucagcaacucaaccagcaaucuucuuuauuuuuaaauauuuuauuuauuuauuuauuuuuagaauauucuauucaaucuucauuuuauuucuucauauaugcguacauuguauuuuuaucauauccaucucaaaucaccuacucuauucccucagauccuuccauacuuuccccuccuaugucauguccuccuccuuccccuuccuccucauauccucaucuccuccucuuccucuucuaaauaacccacuuagucuaauuagugcugcuugcaugcucaugggugggggauuaucuacaguagcaugugcagcuuaccagcagccaccugcccugaagaaauaggacucuuccuccuccagcagucauuguaaaaagauccacaguuggggugaagcuucaugaguuucucuugcauccaugcuggaauguugacuggcuugauguucugcagguaaucauaguugugaguucaggagugcaaaagccaugucaugucuggaagacagcauuccacagugcuucuggcuccuccugcucuuacauuauuuauucccuuccuuuauguuuucugagcuuuggugaggggaaaggaagaguuauaauugauguaaaugucccaguuagggcugggagauuuauuauuagcucuuucacugauuacaaguuugcucaccaaugaaaagugaaguuuuucugaguaaggcugagaucagcgcuaaucuaugauugugaacauaaauauuuugaagguaguuaaauauaccaauuuagcaaaaauaguagcucccccugcuccuacuccagggcuuauaacuuuccuagacaugggcuuuugacuagguauacaauacugaguauaaauuccucccauggacaagggcuugagcccaauuagcaacugacugguuacuucuagaucugucaugccaguaggguacaucuuguuaggcaguugauuaucauagcaugaaugauccuaugaugaguaagaccauuggugucuuuucuuucucaguggccuguauagcacacccugucacucugaaagcuagcuaauagggaagaaacuucuagaucacuucugucuuaguuaggguuucuauugcuguaaagagacaauaugaccaaggcaauuuuaaugagagacaacauuuaauugggggcuggcuuauaguuucaggguucagucuauaaucgucauggugggaagcauggcagcauccaggcaggcauggugcuaaagaaggugcuaaaaguucuacacuuugaucugcaggcagcaggaagugacagugaacaacuagaccuggcuugagcuucugagaccucagagucuacuuucuagugacauaacuuccuccaacaaggccauaucuacuccaacaaggccacacuuccuaauaaugccacuccauaugagcuuauggggccauuauuguucaaacuacuacauguuccaauugguuucucuauguuugaacuaguguauaguaucuucaucgauaacaucuuaccaucuagcugggguagggagauaagagcaacggcaauagucugugcuguuuuaggggggcucugaaguuucccugaucaguaaccacagggacauauccuauacuugguauugagauuguccguaacucaugacuucuaggggaagcacucuccacccaugugucuagacaaacauggugcuggagaacaccuguguucaaacuccucuuaaaguugaaguugagaaaaaauagcuuacauaccagugaguuuccauaagcuuuuuuuuuuuuuuugagucaggguuuuacuagguagcccuagcuaaccuggaacuuacuauguagaccaggauggcuuuaaaauuauagagauccaauugccuuacggaugugugccaucacucccaagcuuucauaguuuccauaaggcacacacacacacacacacacacacacacacacacacacacacuuauacacacauaugucagcaagaaccuuuuccugcuaagccauuuccucuguuucccucugccuuccacauuuuuagagggacaggcucucauauauuuuaguuuagccuugaacuuacuguguagcuuagggagaccuugaacaacaacaacaacgucuccuucuccuuuuccuucuccuucuccuucuccuucuccuccuucuucuucuuucuucuucuucuccuucuucuucaguuuuauuuauuauuauaucuaaguacacuguagcugucuucagacacaacagaagagggcaucggaucucauuauggaugguuaugagccaccaugugguugcugggauuugaacucaggaccuuuggaagagcagucaguaccacuuaaccacuugaacuucuaagccuccugccucuaccccuugagugcuaggauuacaggcuugugcuacuaugccaggcuuauauagugucaggaacuaaaaccaagacugugcaugcuaaacaaacacucugccaacuaaacuacauuuccaggguccucaaauagcaauuauuauuucguuuuuaaaauuugaggcaggguuucgcuauggagcccucgcuguccuggaacuuguucugagccugaccucaaauucagaaaucagcuuccucugucucuugaguaaugggauuaagggaguggaccaccacaccuggccucaagcaacaauucuuaaaaucaaacauccaaccauaauaauauccauaauaauaacacacuaauuuguugcuaauuugcugauggaugaugacaggaaaauauuaaagucuuuguuuucuaggcugaagaucuggcucagcaguuaagagcacugguugcucuuacagaggaguuagguuugguuuccagcacccauauacaguucacaaccauccguaacucuaguuccaggagaucuaacuuuccucuggucuccaagagcaccugcacacacccuucccuguacuuaaacauaguuaaagacaauaaaaauaaaucuuaaaauuauguuucuguaaaaguagaaaaccuuguacauacagcaaaaacauugcaagcauaacuuaagcuagucucaggucugagcaguguguuagcauucauuggugcggugaagucuugcauaccacagagcauuuguuugugcuuggagccccuaagucuacagugaagcugugugaucccacacucugauucauuguauguuagcuuuugaauuaaccucuggauguuuguuccaaaaucuuuuacuauugccaaaguuuuugugacauccccaccccccauuucaguugugacugaauucauauaucccuauguagauaggauuguaacucagagcuugaaaacacagguaauauauguguacacuguuuaguaaauuuaguuucuuuucacuuaccugcugacuguccuuuuuccuucucagaaggacauauucucuguuuuaaagcugggcagguuuguguuguuguucaucacuucauucagggauggucuuguccuaagagccugacucuucagccugggauggugaggucagugucuaucccaggauuccaggaaucagcuucauuucuucccagaaggaaagggaaagucccucuaugaauccagagccaguggugaauaacugggugggcauaaugcuuuaaugcgcucucucucucucucucucucucucucucucucucucucucagucuuaugccaccaggcuaguuuuaaacaugcuguguaguugaaguuggccuugaaccucugaccuuccuaccucgugcugggauuacaggucuccaccaauacauccagagaugugaaugaucuuaaauggccauauuuggguguaugucucuccuuguagcgaauauaacggauucauuuuucuucuuuuauuuuuuaaauauugaguuauaccuuaaauuuuuaugcauaugaguguuuuucuacaugccuauguguauggugacuguggaggucaguaaagggauaugcagcuauaucccuuagaacuggagacagucaguugugagccacaaugugcgugcuggaaauugaacacaaguccuuugcaagagcagucaaugcucuuaaccacugggccaucucugcagcucugguuuccuuuugagugcacugaauucuuguguaugucacauguacuaucucauuugaucuguggcugggauaguauuugucuguuacagaggaggggagcauagauugcagagaguuaccuauuugcgagagcacauagugaauguaguuauuuugacaacuugcuugcuugcuuuaguaaaagacccuaauaacugaguauuugaccuuaaccuggccaaucauagcacucugucucccuggcaacagcgauuggccaauggcagaacauaugaaccaagcagggccaaucagggcuuucuccugcauuaauaagcagauccuagugucuuuuuuuuuuuuuuucgauuuuuauuagauacuuucuucauuuacauuucaaaugcuauccugaaaguccccuauuacccaccccccgccccgcccugcuccucuacccacccauucccacuucuuggcccuggcuuuccacuguacuggggcauauaaaguuuguaagacuaaggggccucucuucccaaugcuggacgacuaggccaucuucugcuauauaugcagcuagagacacgagcucuggggguacugguuaguucauauuguuguuccaccuauaggguugcagacccuuucagccccuuggguacuuucucuagcuccuccauugggggccuuguguuccauccaauagcugacugugagcauccacuucuguauuugccaggcacuggcauagccucacaagagacagcuauaucaggguccuuucagcaaaaucuugcuggcauaugcaauagugucagugucugcguuugguggcugauuaugggaugaauccccaggugggguagucucuggaugguccauccuuuugucuuagcuccaaacuuugucucuauaacuccuuccauggguauuuuguucccuauucuaagaaggaaugaaguauccucacguugguuuuccuucuucuugauuuucuuguguuuugcaaauuauaucuugguuauucuaagcuucugggcuaauauccacuuaucagugagugcauaucaagugacuucuuuugugauuggguugccucacucacgaugacauccuccagauauguccauuugcccaagaauuucauaaauucauuguuuuuaauagcugaguaguacuccuuuguguaaauguaccacauuuucaguaaccauuccucuguugaggggcaucuggguucuuuccagauuuuggcuauuauaaacaaggcugcuaugaacauaguggagcauguguccuucuuaccaguuggaacauauucuggguuuaugcccaggagagguauugcuggaucuuccgguaguauuauguccaauuuucugaggaacagcuagauuauuuuccagagugguuauaccagcuugcaaucccaccagcaaaggaggaguguuccucuuucuccacauccuugccagcaucugcugucacccgaauuuuugaucuuagccauucugacuggugugagguggaaucucaggguuguuuugaucugcauuucccugaugauuaaggauguugaacauuuuuuucaggugcuucucagcccuuagguauuccucaguugagaauucuuugcuuagcucuguaacccauuuuuuaaauuuuuuuuguaccccauuuuuuaaugugguuauuugaauuucuggaguccaguuucuugagcccuuuauauauauuggauauuaguccccuauuagaauuaggauugguaaaaauucuuucccaaucuguuguuggccuuuuugucuuuauuggcaguaucuuuugccuuacagaagcuuugcaauuuuaugaggucccaauugucaauucuugaucuuacagcacaagccauugcuguucuguucaggaacuuuuccccuguacccauaucuucgaggcuuuucccuacuuucuccucuauaaguuucagugucucugguuuuauguagaguacuuugaccugcuuagacuugagcuuuguacacggagauaaaaacggaucaauucacauucuucuacaugauaaccgccaguugugccagcaccauuuauugaaaauguugucuuuuuuccacuggaugguuuuaucucccuugucaaagaucaagugaccauagguguguggguucauuucugggucuucaauucuauuccauucaucuaccugucugucacuauaccaguaccaugcaguuuuuaucauaauugcucuguaguacugcuugaggucaggcauggugauuccaccagagguucuuuuauuguugagaauaguuuuugcuauccuagguuuuuuguuauuccagaugaauuugaaaauugcccuuucuaacucagugaagaauugaguuggaauuuugaaugggauugcauugaauguguagauugcuuucggcaggauagccauuuuuacuauauuaauccugccaauucaugagcaugggagaucuuuccaucuucugagaucuucuuuaauuucuuucuucagagacuugaaguucuugucaaauagaucuuucacuuccuuaguuagagucacaccaagguauuuuauauuuuugugacuauugugaaggguguuguuucccuaauaucuuucucauccuguuuauccuuuguguaaaaggccacugauuuguuugaguuaauuuuauauucagcuacuucacugaagcuguuuaucagguuuaggaguucucugguggaauuuuuaggaucauuuauauauauuaucauauuaucuguaaguagugaaauuuugacuucuuccuuuccaauuuauauccccugaucuccuuuuguugucgaauugcucuggcuaggacuucaaguacuauauugaguagguggggagaaagugggcagccuugucuagucccugauuuuagugggauugcuucgaguuucucucuauuuaguuugauguugguuacugguuugcuguauauugcuuuuauuauguuuagguaugggccuugaauuccugcagauccuaguuagucuuaggguuuuacuucugugaacagacaccaugaacaaggcaacucuuauaaagacaacauuuaauuggggcuggcuuacagguucagagguucaguucauuaucaucaagguggcagcaucuaggcaggcaggcauggugcaagaggagcugagaguuuuaccucuucaucugaagcuucuagcagaauacuggcuucuagguagcuagggugacacaccuacuccaacaaggccacaccuucuaauagugacacucccuaggccaaggauauacaaaccaucacaccuagguuggaagaacaccuggcaaguggaugaaugaauggaugauauuuaauuccuuguggcccuugaggcuggaucaacgaauggcuguaaagauaaguuuauuuauuuauuuugagauuuaugcaucccaaauuggccucaaacuuacuacguaguugaggauuaucuugaaguccuaauccuccugccucuacuuccccuguguaaggaguauaccacugcaucaauuuaugggaugcuagaaacuaaacccaagauuucuugaaugcuagguaagcaggcuaccaacuccccccuccuuuuuaaaaauaaggucucucuguguaaccuuggcuguccuggaacucccucuguagaccaggcuggccucugccuccagcuuggucuagagugcuaggauuaaaggccugugccaccacuucccaacacuuuucuaccuuuagugaucugugagcucuaccugagcuugucacuuagccgaaacacugaguauagccagcagcuccgccuuuuguuacuuuacauaaaaaaccuggguagcaacuuaaaguugaaaagcuucauuuuggcuugagguuugagagggcacagucaaucauccccggaaagcgggaggaagcagugcuaaaucugcagaaagcuuacacucugucagcaaguucugaagcagaggugugaaugggacacugggccgggcucuaacccucaaagccugcccuacuuccucagguugggccucauauccuaaaagcuguacaguuuucaaaacagagcaaccagcuugggaucaauggggacguuuucugucauaacacugaggauuaaaccuaggcaggccuuguauucauggggcaaguauucaaccacagagauagauuuggaguggaaauuuagggguucguuggaaagucaguuguguuggaugguguuuugcuggggcaaacauaagaaagagugucuucccuaaguggacacaagugaaaggauguuuugcugagcaaacaugugaaugaauguuuuugcugaagcagacacaggcaaaaggacauucuguuaaagcaaauacaugaaaggacacguggugaaggauucuuugcuacugacacacaugcauuggucugccuuacauuguguaguugagcacuucugcugaugugcuguggcuucuugucacuucaguggacucaggcugauuggcggagugaugucagcugaggcagacucauauacugaggcaagacacaugcugagacaagaccugugagggacacgugauguuugaggaguguauaaguagaacucgacggauagugaaagaggcugagcuaggcuugcguauagagcgagcugugcaauguuuguuggucccgaaucuucgaugaucuucgcuucacugagagaggcacagcugagaacuccugguguaccuccuggucccuucugcugacucaugccgagguugaggacuggcugucucuacuagguagugcuacugcugcugauucauguuugcuaacccaacucuacugaacuggacugcugauauauccauaaaguguuugcaaauggauaaagcuucugaccugugaacuaaacuacuaauuuccugauaacccagaugagauuugcuucaaagaaccauuucuaaacugguccacuuccccuguauccuuucuucuccacuaccucuggugaguggugggcuagaagggagguuaaaauguuuaaaaaccaucuuuaaaaguaggcuuuagggcuggagagauggcucagagguuaagagcacugacugguuuuccagagguccugaguucaauucccagcacccacaugguggcugacaaccaucuguaaugggaucuucugaugugucugaagacagugacuguguacucacaaagaugaauaaauaauuuuuuuuaaaguaggcuuuaaagaauuaaaguuaaauagaaucuuagcuuuuuuccccccaaucaggccuugaugaaagauuuaaaaugagacucaucuuauuuuaaaguauguguguguguguguguguguguguguguguguguguguguguguuuguguguguguacacgcacacugugguuggucagaagaggcagcauggguucccccuggaacuggugguuguaagaugccugacauaggugcugggaacugaacuccaguccucuacaagcacaguaugagcucuuaauaagucaucucugcagcucccggaagauuaagaaagauuauugcugggugugguggugcacaccuucaaccucagcauuugugaggcagaggcagguagaucucugaaucugaagccagguuggucuacauagucaguagcuggucagccaaggcuauacagugagacuuugucucaagaaacaaacaacaaacaaaaaaauaagaguaaacaauuaaaauaaaauauaauauuuuuacuucuguguauuuaagugugcacaugcgugugaguaccuuccagaaaagaucuucuggcccccuaaagcuggacuuauaagcaguugugagccacuagguguaggugggggaccugaacucuagaccucugcgagaacaacacagacucguaaccacugugccaucucuucagccccugacaggacuuaaguaauagaauuaauguuaauuacugggucgagauucaaguacggaucccagagucuuaacucuuuuuccauaacugaucucugaaaccacuuucucaugaguaacacccuagguuuaaaaucacugcucccgcugagucacuuguuucccuucugaaacuggcuaccaucccuuucuggaacgaggaacuucucugaguucaucggaacacaccaggacauagcucucaaguuaggugcuuccgagaggguugcuaaucacuuuggauuccucucagcaccaguuccaccaagcaacacuguccauuguuggcccucucuucuggcaagcgguggagccuagcuucagucucaaaccugccugacaugaggcuuaugcacuugcugggacagcagccagccucuggcuagggaaggucccaggaguuggcagccaggguacagauguucugagcucuggauucaggcaucagguggcaggacucuggagcuauaggcccucugcagccuggcugugaggagcugugggauguggaagccuggcuccaguccuuuuagcuacaguguggagggaugaugguccagacagugggucuuuucuucuuucuuuucacagguaggacacuuaaaacaacagugagauacagaggucuaauuugauuuaauuuaaacuaacaaaaugcuccucuuugugaucuuagaauguaauaaaucauccuuuuauguguacacagguugacucugauauaugacauagaaaaccgcauuuuguggggcacaguuaaagaauuuucauuacuuggugaugugguaucaugaccuuagcugggaggaaguacaacucagaugcuccacccaguuuaauauuggagucuaucuugacaugacaaacugaaaaaugaggacacuggagguuuaggcauagcucuggauuuacaaguggaugaguaaucaaauauuacccaagaacaaacagacucuaaaagaaaaauaaaauagaaaggagccgaucuggaauucuuggagaaagacucgaaaaauaugcauaguucuagaacugcauaaaugugaguuggcagguuaggaacagcugauauacuaagccaccaacuugauucuuaaaugaaaaugcaggcugagggaguggcucagugguagagcuuuuacccagcaugugugagacccuggguuccaugacuuauaccacaaaccaaacaaacauagaaagaaaggaaguguguguuaccuguuccaccuagguuagaauugcagucuaucuugccacuacaaaaugaacacagagaacacuuggaaguuuaggcauagcuguggaggaagcaggcccuucuagcaaugugaugguaacugcuaugaaguaaucacauggcuuauuuaauuugcuauguauaauuaaaauguauugccauuuaaaacucugacaucuaagcacauuuguacuauuuggcaaugauguagggcagugguagaaugucugcuuagaauguguaaggcucugggcuuuaucucuagcauuggaggggggauggaaaaucgagagagacagagacagaggggggaaugauguuugaauaauucaugcugugaaagcauuugcuaaucuauauuuuuugaagauccuaaugagacagccauuuaacauagguuauauugacucauugguauuagaaaguaagucuacuauucuuucuggggauccuugcaaaaaaagugcauugaacaugcugcgaguauuaggaaauucacguaaagaucucauugggagagaucgauuagcauuuuuaacaagcguucagagucucuggcuuccccuccucacauucacugcuucucugcaaaauuuccaguuagucugaugcuuuaaaaguuguuuggaaaaaaaaaaguuguuuggaugcuuccgcagcaguuggagucccucaaaugucacagcagucuauaagccuguuuccuuguaggauguuuuccuuagcacuuuaaggggaagaagagcuguugccagggagaaauguuuuuuugagaugugguauuugcugaugagucucugacuuggaguacagugagaagagaauaugaaagccuaauacucggagacauaccacauuccuagaugaucacuuaccucugacuaacuggagcuucgugugagugaugguuaagcuguuaaaugacaguugcauguggcgacacgugccagcaaccccaucacuugggagucugaggcagaaggagcuugcauuggaggcuacccaaugcauagugagguccuguuacuaaguaaagaggaagggaggaagaaagaaaggagaaggaaaacaaaaugaaacaagacagaacagagcaagacgaucaaacaaauugaguaguaagacaucaacauuaucuucaauuucaggaacgauuuucuaaguaacacuuccagccugcaacuauccugggaaaaguugucucuguaguuucucucucucucucuaacaaauaaaacugacauuuaauuuuuacaugcauucuuuuacuuuuucucauuuuaaaauauuucauucuuuuuaaaaaauuauuuacaacccagcuguugccucccuccugcuccccauucccacaguuccucaucccauuucuccugcccccugucucuaagaggaugcucccucaccauauauaacagaggacugccuggucugguuucagugagagaagauuggauucaccuaauccuugagagaccugaggagggggaggccugguggcaggggugggggaggaguucuucccaucuuuagcauuacuuaaccuguugcuuuacuuacuuauauauuuguguacacacaugugugcauggugcacauggacaccucucuuuuuccacugugugggaccuucaaguugacagcgagcaucuuaccugcuaaacauuuucacuggcccugcuuuuccauaauuuuauauacuuaaucuguuucugcucuucagugaaaagcaagcauuugacaccaucugagcuucuucaaaaaggcuguucaugaaauauuaaggauuuguuuauugauuaccaagaaggcguugguuaucagagccugggucacaaucgcuccuuuuguggaugaaaucuagguucuugcuuuuuccaggcaggugcucucccacugaaccacagcgaccccauucuuccuuuauauuuucaagguuauuuacuucuccaauuaucuuaugucuuaguuugcuuguuuauuguugaugaagagaugcauuguguuaagcacagggaaaguggcucugagugugccacccuccaguacuuucacgugguccauuucauuguccuucuaauugguuuucacugagaugcaaugguggucuuggugguuagagguuggggaaacaguguuuuucuuuuucugaccacauuccucugaagaaugacucuggugaaugguguaaaaggcuacagagaggcugagaagguaaagaucuggguguugagguuuuggagaguguuaauuauucccaccuucuucccuuugaagcucagagaaagacucaaggagggcucccaaacacaaccauggaccagauaaugcaauuuggagcugaggccauguugugguuugaaugguaauccucucccacaggcuccuauauuugaauaguugguucuuagaugguggcacuauuuugggagauugcaagaccuuuuggaccuggagucuauuuggggacuugaggcuacaggacugggccuuaagaguuauagcccauccacagugacagcaugaacucucaucuucuagauggcgcgcuguagcaaggaacugccucauguuccuccugcccugaagccaucuacagccaugcuuucuuccuugcuggauuagacccacccaaaucaugaaccaaaaugaauccuuucucuuugaaauugucagggguuggucagugaugaggaaauaacuaauacagaaagcuguugcuguuaugaaacugacuauauuguuuguaagucuuugguggugguuuguaagaggaauguggaagaguuuagaauugugguuuagagaggcccuagaacucuguagucagagcuuacugagcaauucugguaagugcucagagcauacuauugauagauagauagauggacacuauuuagauucaugaggauucagaggggaaggaauggcuaggaauggcaguucuuggaagguggaggcaccagaauugggagcccaagaucauccuuagcuacagagcaaguuugaggccagauuggacuacacaugaaauuucucaaaauaggcaaaacaaagaacaacaaagaaaaacaaaucaaacuaacauauaccuuaaaaaaaaagcaaggauuauagcagacacugggcuuggugcuguuuaugauacacccagguaaaggaauuggcugaagucuuaagaguuugagugaaguuggauucagaagcaauagacuacuuugcuugguagagaacauuuccagacagagcagcauucagguugucacaugguuauugaucacugucuuuagcuagguuuccgguaaaaauuucuggagugaaaaaugcagaaaaugaacaguuuuaaugugcacaggagcacgagccaagauaaaguugcagaaggggcagauaaggauuuugcagacaaaguagcugcaauuauaaagacaaaacgcacaauuaaggguaaaccaugcagcuugcuuuugggacaauagaaauggugccuuaaaggcaagaccuuacucacugaaggguucagggcaugaaacuaaaaaccuauuugaaaacauucauuugaaaggagagggucugcaaaggaaagcgcccccucagggugcuuuuugcuugaaaauggcuggcuagggaaauuuucacagacuaagucauauagguacuuggauacugcagccauaguccaagugggucaggcuacuuuucaaguuggcaguaaaaacguggugcuauuucccauguaguacggcuuggcaggcaaacaaaccucaagauucaugggccgauggaaauuugcaccaagauucuacaaagcugcugaggucagggaauguguagcaacguuacagucucugcacgcagcccuugagugggcugugcauaaaguugaagcucaaguuucaauggagauuacgggauguuugagaugccacuaauuuggacuucugcaggcacugagaagagccaggccaagggagaucacacauaugcuacagguugcaggucuugagugacaggacuguccaaaccuguuggaggccagacgacacugucaugagucccagauacggguugugcauuuguuucaagguuugguaucugucugugugaauucuggucuuucuuuagucugcuauucuuuugacguuuucccaucucuuccuuuaggaauggguauguuuguaucauugucugcuggaaguauguaacuuguuuuuugggggguaguucuuagguaaggguuuguuuugagucucagaagagacuuuggacuucugaaaaguguuggaacuuuaagaguuuaagagggacuuuucaaucuuuauuuuauucuguuuuauuauuuucauuuuucguaguguguggggcugugaguauaggggaagaguggggagggagagagcccacgucuggccagaguuccugugcucugggcaggcggacuccggaggacugccagacacuuuccacuuggccccgggugggcaucuggcuguguuaagccucugaccccacacaggguugggggugggguggacaaggggcagcuccugguaccaggggccccggagcgacacucucggcuccggagauacaagagggcaaauggagagagguucccaugcaggcgagaguccuuaguccaggccuugacuugacugcacaggaaggccuuccaucagguugggagauuaugcacugcucauuaggagaaagccuaucccaucguccaagcacagcaggccuugaugaacagagacaguccaugguuuuagagcuuuauuguagaaaggcagggggaaagagagaagguagaaagagagagaaagagagagagagagagagagagagagggagagggagagggagagggagagagagagagagagagcagccauggucaagaggagagaagggggaaaaggagagagagaagaaaggcuagagaguaagaaagcuuaaagggagagagguaaaggcuuagagaguaagagagagagagagagagaguaagaggaagaguaaggaaaguaaaagcuuaagagagcuacauagggcuggugagauggcucaguggguaagagcaccugacugcuuuuccgaagguccagaguucaaaucccagcaaccacaugguggcucacaaccacccguaaugagaucugacucccucuucuggagcaucugaagucagcuacaguguacuuacauguaauaaauaaauaaauaaauaaauaaauaaauaaauaaauaaauaaauguaaauaaaucuuaaaaaaaagagagagcuacguaacugggaggagucuagccugaaggucagaaguuugggacauugucuacaugacuacuagccacgagccucuccugugggggcugugggagcaguaacuuugacaggagacagggguccaggugagggaaugccuucugucccauguaggugggauuaccaccacuagguuucaccggguaucacaaccucagcucgacuggagacuaggccgucugugcauagcccauugccccacaguaguauauacauaauacacaaauauaugugcauauaauauauguauguacaaaauguauauauguauauauacuguaaauauguuugcauguauguauauacuugugugugugugugcacauuugcacacauguagaggccagaggcuaggucugaauguuuuccugaaucgcugucuaacucauuauccagggcaggcugucauauugaaccuagagcucaucaacuagacagacuagcugacuagugagccccaagaauccugucuucugucucccagcacuagcguuacaugugugugcugccgugcccagcaauuuaugaguucuggcaauccaaacuugcuucucauguuugagcaacaaccacucugugggccgagccauuccuccagcaacucuggugacuuuuaaaguuguccugaaugugugaaugcguccuacauuaugggguggccgugagaccaccuagcuugaugcagaauguaaugguuuggaugggaacuguccuccacaggcucauguguuugcaaacuugguccauagcagguagugcugcuucaggaaauuaagaaagcuuuagaaugugggaccaagcuggagggaggcaggccuuaaggauuuauagcccagcccagcuucuguuugaccucuuugcuuccuggcugaugacacgauguaagcaguguccaaugguccuucuaucuucaccgaguugcucuugcuucuauggcuuuccccaucauaauggacuauucuaccuugaaucacuagccaaaaauaaauuuuucuucucuuaaauuuuucuuagguauuuuaauaacagugaugggaaaaguaacuagugcaggccaauaggaucuuuacauuauuuuauguguaugcguguuuugccuguagguauggcucugcauucugugcaugcagugcucaaggaggccagaagagggcaguggauccccuggaaaauuauauggguucuggauccugggucuucuggaagagugccagugcucucaacugcugaacuaccuucccagccccaagaucuugaugucuucaucauggauagcuguguagcuguuuccucagcauugaaacaucucuccaaagcaguacacaagacuuucaugucucaggaaguuccuaaaacaagauucacaaggugccucccugagguguagaaucgggaaagauuuguggggagaggagaccuguugauuugcugaguugccugcaagcagagcaaggggugccaaggaugcaguuucacaaguugucacccaugcggggguggacuuuuugguaaugccuuugacuauccauguuccagugaguaaccuuaacaaacucaccacuucacucaugucucuccaaggaaaaaaaucacacagcaugaggugugacaucuuacaccuccucauagaugggagcugcccaacaacaggccucaugggggugguggaccauuagcagaagaagaaaacacagaaggacaggaaggagcagcgucaggggugaagagaggacgaagagaacacagucuucucagagagauggagagagggcauggagugaguucuggauccugggucuucaguagcucccucugaagaacucugaagagguggguauuaaacugcuccuacuccacagcaagaagggaguuucccauagcacugaagagagcuaauuccauagaaugguaaggagucaguuuucagaagguucagaccugggauagaggauugaguguaucaggagauaggguauuucagggggaaaaaaaagauauuggcugugagggacagcaccugagccuccauucaccauccaccaaacgcuugcuuugugcuaugcacuaagggauggaggguuuugugaauauuucuagugaucuauaucuaucuguaucacuaucuaucuauccaucuaucuguucauuauaacauuaauaaaauguuguuauagaucuguggguaagaggcuucagaagggcacugagaagcagcuaacugcaugcauaagugugcucagauuugcaggagaccugggaaauagagacagaacaauacucagaggaaaugaccuuugagcugagcagaaagggugauuaagaggcagggggugaggcuggagugaugucuuagugauuaagagcaccuggcugcucuucuagaggauccagguucaaugguuuacaacaauuuguaacucuagucccuggagaucugacagcauuuucugguugucuugggcaccauauguauauggcacacagacauacacaucaacuaaaacaguaaauaaacaaaauuuccaaaaauagaauaaaccaagaggcugguggauagcuccaccgaggaagggcuuugcauaagaguacagggcacgggcagagguuugggggcaugaaagaguaugaccuaugccucagcaagguagugugccuaggauaguaugcauucccuugaccuucuaauucaccauguccuuuaaucuggagagaucugagguuuuaaauagguacccugguggcagagccgaggaggguuuagagugaggcccaggagcaggggugggaggagcaucugggugugccugcagcagggccagaugaauuggaagaggccuaaagcagcauggacaggguccagaccuguuuagagacaauaagcagacugaccagacaucugguuagcgggcaggaagcaggagacugggcagaagccaagugucugguuuggaccauuggguggaugguaguguucuuuguggcacaggggaagccugguucauccaucuucagucuccaucauggcccucuggggacuuugcucaguuccuuuucugggucccaguggcgagcuguuuccuguguucacuccucagggguuugaaggcucuguuuuccaagccuguccuccaagcucucauuguuacuccuggggcucagaagagaaguuauuauuugcuaguguaaccagugaugugcuuucaggcauagagauaagagagggaucccugacccucuggcuccuacccccagugacucgugcugucacucagcagccaugagcacacugguaggcaccuggcgugggugagauccugugcucaugaagaagugaauaagaccuuuuuuacugaaaggugggagugugugugugugggagcugacaaaggcuucuuuugaguuuauuucaaguccaggccacaguacauuuguaggccacaggagaaggugccagaagcagcaaugcugagaagacaggcuucuggaccccaguguggcugagaccugaggcuaauuugcugggcagguggagguuggucucagcaguaacuacccuugaggacuccuggggucacuggcgguuggagcgcacaggagaucaacgccacuaaauaggucaucuuuaaaucuucuccccucucuuauucguugggugggaacauuuccgugagcccuaacuuucuuuucuaucaaguagggugaguuuuuccaccuuccggggguugucuucugagcuaggugggauaaccuauggaaagcacuuggcacacaguaguccccagcuacaggaauacucacaccucuugggaauagcaaucaagaaugcaaggcauggguucccuuacgcugaccaugcuaccauccgaagagucauggguaggaucaugaauggcuuaaugcaacuugauaagaaaaagaacuucauggggcuggagagauggcucagcgguuaagagcaccgacugcucucccagagguccugaguucaauucccagcaaccacaugguggcucacaaccaucuguaauggguaucugaugccgucuucugcugugucugaagacagugacaguguacucauauauaugaaauaaauauggcuggagugagcgaggcuggaaaaauauauacaaaaaagaaaaagaagaaaaagaacuuuaaaacuuauuuuaggguacaggggauacuaaaaaugauccuuguggcaaaaagguguaggcuccgagguguggugcuauuuacucgacauugcaaggugagucagcgacagcacacggacuuacacuuggggugcugauagugagaccauuccucuuuucucuguccuaccccugaaaaggggccagugagccgaucugggcagucaucgggcucucauuucugacacucaccuccuauuuccccuauccuagacuaggcguugaaacagguucccaguaucuggcuucccguucaguucaccuaggcuucucagcagggacuguccaggaaaccccuuuugugugaagcaggugugggugugggaaggcucuuuggagaugaaucaccacugccuccuccuuggugaaucauggcuggggcuugggaacagcuagcugguggacaggagggagagcgaagaacuaaauugcaaugauacaucucaaccaccagggggcagaagccggauaggcaaaaccgagccaaccacugcaguaaaacuuguggcauucagaguuugggaguggguggauggaaugugaggcugaaucucuuugucagccucuaaucuccauccuugcccucugggaacuuugcuccuuuucugggucccuguggcaggaaguuuccuguagucacuccucagggguuuguaguucuccaaggcucuguuuuccaagcccuucucauugccacuccugggacucagaagagaaguuauuauuuacuuauuuauuaguggugugcucucaggcagcgagaaaagggacccccuggcuccuaccuacccacuagccccagugaccccugcugccagucagcagucauagacgcugguaggcaccuggcgugggugaggucuugugcucaugcagaaaugaacaagacucaguauucaucggugagcucaccgugaggcagugagggcaagagaaagcaaguaggcagcgaaucugccuaaauaggaagacguuaagacagaagggagggcacgaggagugcuucguaugugccagggcagguagaaacugacucuagcuggguuagagaaggccuuuuauguggccuucaaagcauagaugggaucucagcagaaggagacgccaugugggggugugggcacguucucaccaggaugaucagugaagccaagggccuugguugcaccgcgugcuuguacccguguucagacggugggagaugggagggagguuggaaaucaguggguauuagaguauggaguauuuuacugugcaccuuauggaagagacacacguaguuucugagaggaaccuggcugaugcugguucagcugguggagguagucacugugagcaccagagaguuucuguugaguucuaccuaaaguagguuggugaggagcucccaggccccggggaggagagguacacugaguggcuuugcaaagguuuagaagaggacacuggaggacccaagaccuacuuuaacugugcugugcaggcugguugccaugugagcccuaggcaaaggccugggagucugacucugcuaccuuucagauuucagcagcgucaacaccagcgucucccuaggugcugccaggugaggggcugcacucuggugcuuguggguugggguuuccggcugcugcucuggccccggggagcagggugugccgcugacucaccaccuggguaucugggcuuggaaccacgggugagucacccugcccugggggagcugagagaagcugcuuggugucuggagggggaagagagcuggguccacaggaagggcggugcccaacuggggaugggguaaggagcggaagggggcaguacggaguccgaagucuuaaagucagcuccuccuugaagaccccucccuugggcccagcuaaaggacacaguguuuguuuuucuccauggagaagacacucuggggaccggugagggccugagggagggcauggcuggguccaggccccuguuuucaacucugggcagggcagucuuuccuagccacucacuucuauggaaaacgaagaagaggaagcucaugucucccuuuccuccucuuuggugcucucuugcauucugcacagacucuugcucacugcagcugugucugaugcagagcaaccuccauugcuccuuuugaagcaguuuuaaccagauccagucaccucaauaccucuuuaagagguguucuggugccaggcauuuacagcaaaacaaaacaauaagaaaagauuucuuugacuuccuggcauccucuucuggaugccccagcuguauuuuuggacgccaguuuucuaaggguggucaggacuguuuuucucucuuuccacaugcacgcgcgcgcgcgcgcgcgcgcacacacacacacacacacacacacacacacacacacacacacacgagugagcacaggcugugaaguucccacccacucugugucacugcauucucugacacuggaaggaacugugacucacaggcauaacaugaaaaccaggcuuggaaugagugucuaggcuccagaauaggagcugucuccucucaucccugaccaggcucccuaucuuagucaggguuuguacuccugcacaaaacagcuugcacucccacaucgcuguucaucaccagaggaacuuggaggcaggagcugaugcagaggccauggaggaguguugcuuacucucuugcuuccccuggcuugcucagcuugcuuucuaauagaacccagaacuaccagccuagugauggcaccacucacaaugggcccuucuaccuugaucaccaagugagaaaaugccuuacagcuagaucucauagaggcauuuccucaagggagucuccuuucucugugauaacuccaguuuguguuaaguugacacacacaacuagccaguacacuccccauucccaccacaccucuguuuucuugcuggggccuagaugagcucagguaugcucuugguugggccuggagguuccuccagcuggugcugagaccagugcuaccugggagggaauauaugggguggaaggaggccagauuuugccaagaacagguuaggacaaguucuguuucuccaaaaugacaaauuggaggucaguugggcuggcauauaaaucucuacccugggugucuugaccauuuuaauuccuccugggucucucugcuaucugaucuggugaguaccucuguccuguagaggacuuggguuucuaucuucguuccaucuugauccugguccuuguagauuuucuuugacuugcuggugggaucucucauuugaagggauccucucagugaagauucagguggaagggucuuucccacauucuccuuugagggcuuaggggcuuacucuguugcuuguucuccagucucugugucugaggucucugugucucucaguuuagauaugacuauuuagggaacuuuuuuugggggggggugguuaggccuaggaauaggucauggauaugugagcgguguuuuuauaagaauccugggguuggugagauggcucagcggguaaaagcacugacugcccuccgaaaguccugaguucaaauuccaguaaccacaugguggcucacaaucaccuguaaugagaucugaugccuucuucuggggugucugaagacagcuacaguguacuuacauauaauaaauaaauaaaucuuaaaaaaaauaaaaaaauauuaaaaaacuauaagaauccccaauuugaggcagauacaauggagccggccgguaaucccacucucaggagacugaggcaguaaagucaugaggucaaggucacacuagguuguacagugacaugucacaaucaauacugaguuguucuugcuuuugcaacgucucggauucuuuuaggacuaagaaggcagagagacaggcucucagugcuuagcccugccugggucccuaguccugucuguaguggcagagccaugcccaaggcuaccuccugugcuuuucuaaguagaugagggugggacuagcagagcagggcuggcagcgcaggcuggaggcuuuccugacuccaacacugccuccucuggccuuacucuggaacccacucaauauucuuagaggaauuuggaagaggugaccccugacuucugaccguaucucuucagcuucuagccugaccacaagacacuggccauuuaauuucuucaguucuaacuucagccgaauccuuccuguuggagaggauguugagucacuuacauccugccuaggcccugacugcaaagaaccagcacugugcacacagcuaaagcucagccugguagcaggcacaccugucacucuacgagcgucccugguaugaagaaggaagcacucuugcuuacgggagcuuaagauggcagagacucugaccuagaguuugugaacgguuugaucccgucauggagucuuauacuccugggcuguucugaugauuauugccaggugauucugggagcccauggacacaucugugcucugcauuccuggcacagauaggaauccaacugagacucuagauauccugcaaccccuccccuucucaugccucuccucaucucccauuggacacucaggcuggaagaucuaccuucagagauaggucuucaggacacaagguucugcucuagaugacucgcacagcacaggaaaguuuaacgucugguuacaguguaaaguggaaguguggacccucguccuuagacagccauacuugcagggcagaaugcaggcaggcggugacuugucauuccuggaggggcuuggugacacagaagcaggccuuggagacuggacuuaaggcgucuagugaccugcaauagguuguggaugugauggucuauaccuuccacaaguacgccagucaagaggacgagaggcucaaacacaacaaaggggagauaaaggagcuuuugcguaaggagcugcugagcuauguggggguagugaggcaggccaggaggggagccugggcuagguagggcaagucuguuccugcuuucauuuccaaggugccugcuagugccagugccaggguggcacugaggauuucccaucagcccucauuucacagucccuggggugcccauuaggucuauaugugaaagggcuauugauggcuucagcauucuugagcacaaugcuauugggggcuccagagucuaucugucuaauccuguaauuggcuaguugaauggucccaaacucagagaaagguagcagcuggccaugggucacacaaggacauuauuggugggcauuaauuucucuuuuuauuuuacacauuuauaugccaaaccaagaauguauauagagagaguggauucuagccaagacauacacccuggggcauuugccagagaagcgcugugaccucucaauuugucuccugcccuguacagacuaauggguaauuauagagcuaggucucagaacuuaauguaugaggcaggucuugcccccccccuucuucauuuuggguuaauucuuuuucauuguuuuggcugguauggaaagguuugucuuguuugaauucauccuacugaugggggguagggagggcagugaagcucugauuuucucauuaucaagaugaagcuggggccuagcaaagauuaguuucuucauacucugaggaauacccaggaacccccccccccccacacacacacgcacacacacuccaguaggccuauuggagacacuuacaucauaagucuaucuguccuuccuuacugaccuucuugguaccucacaaggguuucccgcccacgguagaccuggcugcccaucuuggaaauaaaagcugcacgcugaugucagggaagguguuggagguggguugggcagugccccacuccgugaugacuccugucccugucaccuucaggauaacguagaugaugagaaggugaagaaggaaaugaacaaccucgauaaggacagugaccagcagguggacuuccggauguaugcccugguucugguggauucugcuaucugguuuaauaacuuccuugagggguccccagcgcuccacuaccugccguggaucucuugguugaaacaacucucuaucuuuuuaaguuuguauuaaauaaacuuuuguuaguuugcugguggagaguauuauaauggcucagugaugccuugugccuugacugggucaguuaaaggccugggaacagaggagauccugguuucuaacaccuuccguacuguaccccaacuuucugaggccaaagguucuacucuuuuuuuuuuuuuuuuuuuuagguuuuuggaggcaggguuucucuauguagcccuggcuguccuggaaaguacucuguagaccaggcuggccuugaacucagaaauccgccugccucugccucccaagugcugggauuaaaggcgugugccacuacugcuuggccucaaagguucuacucuuugggauuucacaugaaugaaauuuugggaauugagguaggcugguaacauuuuauuugguuaagaaagguauuuuaaaaaggaagauugggagcuggguguggcagugcagauuuuuaaucccagcacuaggguggcagaagcagguggaucgcugugaguucaaggccagugugguauauaaagcaaacucuagaacagccagggcuguuacacagagauacccugacucaaaacaaaacaaaacaagacaagacaagacaagacaagacaagacaagacaagacaagacaagacaagacaagacaaaacaagacaaaggaagguugguggcaugguggugcaaccuuuaucccaguacucaggaggcaggggcaggggcaggggcaggggcaggggcaggggcaggggcaggggcaggggcaggggcaggggcaggggcaggggcagcacacacaaaaaauauaaaacccaccuacaacuacaaucauuuuaucuaccccuccacuaauucuaacuucacagaagggaggauacaaucccagaacauagcacaaacccugacacugaaggcuguaaagggccagagauccugagagcuacuugggguggggguggggguggggguggggauggggguagggguggggaaggaguuguuacccucaccugcucugcaguuuccuuaggauucauuugcagaucacaggcccuaggcacugugcuuguuuuuagaaaaccuuuuuuccuaucugcuuucaaguggguuagcucaguuuugaguuuacucccuccuucucgaucucugauaaaaccccuuaggagccaggcucaaaccaaaaauccuuaugguuucuaccguuuuuuuccuaaggcugucacuuaaguugccacauauucugcauucuaaaguauaucaggugacaguuugaacacauggcuugcuguaccgugacaagggccaccagcuuuccauccuauagacucuaagcccuauauuucacuuuuaccuccauccaauuucaucuuuuaaguuauuacucuugauugaucuuuauagcuacuggcuuuucuaccacuuacacagcauucagaaguuaaucgaggcuugaccugcaauaccuuaacuaaauuaacauuugaauguccaugugguuagacuucuugguggacaguucaaguuugguucagugacuuauagaugcccuacuagcugucuguugcuguauaaugaaccacuccaaaauaugguggcuggaaacauacauuuauaucucucaugguucuguggguagguugggaagaguuuggggaaucuuacuuggggugucucaggcaguuguagauggaaauugaggcuacaguuacucaagggugcucugucagcuuugcacuuggugcugguuguuuuccuggagcucagaacugucagugugcuggcuagauuuaugucaacuugauacaaacuguagucaucagagaggaaggagccuugauugagaaaacaucuccauaagaucaggcugugggcaggccugcagggcauuuucuuaauuagugauugaugggggagggcccagcucaugugagugggcccucuucuggguuggugguccuagguuuuauaagaagcuggcugagcaggcuaugugaaaugagccaguaagcagcgccccuccaugacuucuucaucaacuccugccuccaggauccuguccuguuugaguuccuguucuaguuuucuucagugauggacuaugauguggaaguguaagcccaauaaacccuuuccuccuuaacuugcuuuucagucaugguguuccaucgcagcaauagaaauccuagcuaagacauuuagcuuacuggaucucccuccaacagggugucaagaaugugggcuucucucuuuuaucaccaugaaaaagacccuuuguccuggauagacccugccuuggccuugucugccagccauauaugugcaauaaagacagagcaccaccugagagcaagaggcugucuuguagccucucaguggcuccuuccuccucugcagagcucugucugauguacucuacaaaugaccuucacauacaucagagcuuucuugggaagaaaaaaaaauaaucagaaaagcaccgacuuucaucaucaucaucaucaucaccaccaccaccaucaccaucaccaucaccaucuauuauuuuacuuaaaaaaaaaaaccaaccuuuuuuuccuccaaguuguuaacauacccagcuaaaguagccauauuacauagcuaagcucucaaagauacagguaaaacccugcauagagaggucacuacugccauaucaauaagacaaaggcucuugaggaaaaagcuuuucacgucucaucuucacucugccuucuaacuagaguauggucacugaguauaacagccaugugugaucaggaaucaaugaauauaguguaguggauggugugcuguagguuuaaagaacaaaacaauaaaaggaugcuggauuucagauggggccuggacacaacucgaagagcaugaguguguguguguguguguguguguguguguguguguuugcccacaagcaugcuccugggaauucugaacuacaucuuaagaauguuucagcuuccaguuuagccucuuguacugcucucucuaaggcaucucagaagcuaggggccaugcucugagaagcccaagcuguguggggacacagcuuccuccuaggaaacucugauguguguauggcucauuuguagagcacaucaggcagagcucugcagaggaggaaggagccacugagaggccaugugacagccacuugcucucagugcaucugccuucauucauauagggcugggagauaaggccaggcaggccucugggacaaauaguuucuauucaugguaauaaaaagagagaagcccaccuucuuaacacucuguuggagagggaccugguaaguacaggucaggaaaucaugaugccaguaauuaacauucucggggaaguuuucaaagcucuugaugagcacacuguuauuuuagcuucaugguaaccccaaaggggcugucauuaaccuuuuuacagaugggaaagcugagagaggcagcuuuagccauuugugaucccugcuucugaccaggugcucgagauacuaaagcacuggccauuuaaucuucagugauccugcccuuugcagaugaggaaacagaggcugggauucauaaaauaaggaauagugucagagcaugacccacauuuauaagaaaacuccccaucccuuugggacacugggauggugggcugggccuuguuccucuuucugaaaccauauccagaaaccaucuuugugugaccuggaggggacccaacugaacaggguucagagguaccugucccaucauccugaaucacagggagaugagacccccauucaggugguuggcuagugaccucugauuucuuuuggugugccauaggugcagggcuucucaguuuuggauuuggacagucaguugggcuauuggggccagacuuaccuugcugucucugagguuucccccacuuggagacguucuaaagaggcuauucguuccuucugguaucugucagacugucaccagacuguugaauccugacuaaggagcuucccuauucucugugcugaggcagaggagggucuggacaucacucugcuugucaaggaucuguggccagaucuccccuagucuccugaaauugcuguugggaugagaaacacagaaaccccaccuccugucguaucagcguuuuauuguauggcuccaccccgggcuagggauggacugugccuuuuuuucugugaucuagauggaauaggacaccaagaaacgugguugguaugaguguggucacaagguggugauaugacugugaauuuugaaacuaucugaguuacucuuaucuugguggcuuuagccucgaagggcaaggacagagguuaggguaagcuggucuccuacuagaagccccagacaaacauuuauuaaaugacuaaugugccucugugcagaguucagcagaaacugacccaaagguuaagguagcaaaggagacaagcacaaaugguggaaaucccuagcguuuuuacucguaguuauugcuagagcccaggguugugcuaugaaaccuagguugugcucaaaucuucagcaaucacccugguucagcuuuccuuguucuaagagaacaggcaagcagugccaagcucaaucucaucguguuuuagcuauccauuagacacucuugugggcuggaaggucaguaaaguggcuuucaaguaagaccuugaaaaguacccuauguggcuucuaucauuuuaaaccaaacaucagagaugucagucgcacuagcacaagaccugcccagcucaucaccuccagagcuacugauguucaaagucaacuaggagccagcaaagcuagaauuaaauggcgccacacuuaagagcauguacuguuugugcagaggaacugagcucgguucucauaacccacacggcacucagucauggguucugagaagauggagugagcugguacccuacaguucccaugugggacacuucaucucuccaccaacccacucuucucaucugugcaauggacacagcuugguugucaaagcaagugauaggucuaaccucugcaggcucuugguuuagauucucucuucaccucccaguuccaauacuguagcuucaguucugacucuagcuuccucacuggccucaguaaucagauaccccuuuccaaauguucuccauacauggcucagaagaucagaaaggaugucuauuguuucaguuaaguuaauuuagccuccuggggcuauuggauaugggugguuacucuagacaaagggcuuaggaccuuuugccagaaguaaauaguguguccagauccuugggacacccuaucuuauuuuuccccuugaggugcaagagcagaugcuguccuuuagaagggugauguauuuuccagggaucguaggcgaugguggugauagugaggagagucagagcuuuagcuuguaagaaguccggccagaucggcuagcaucugugcucacccuuugcacacuugaggccaagcuucucagucuccagccacgacacauuuuccagcggucagcucuccuguccucagggaguuaguuaugcaaagugagaagccaugguccuaggcucagccuaagggugggaauggagcauguggacaggaaagagcaagaaagauggaagauagcucuaguccaggccuuggaacugggguccucugcugugcacugggaccacugcagaaaaaggauuuagggaagagucuggaaacuucaauagggcaggaagauuccagaaacuuuguucuuuuuuuggggggggugggguugguacaagggaagagaguuuagagucauugcuaucaucuuuauggaggcaaaagugggcaagaugaccuggugaggaaggauggggucuaaccccuuccccccaguaauccagggaaacucauauuaaauugaacucagaguccagagcacucacauugccacaauaacuaguagcaaaauguauuugcaaaaaaaaaaaaaauucugagacaaggucuuacuacauagcucuuacuggccugaaacuugcuauguagacuaggcuggacuugaacucaccaagaucugcuugccucugccuuuuaagugcugggauaaaauacauguucccccauauauggcaauacuuaggauucuuacgguaggaaucuuugagauaggaaauuaagucucuaacaagguaaagugcagacauggugaaguuaggugcugaggugggguggaguucuaagugaaggcccaauuaagcauucuuuccaugugcauucuccaacuccaugucuccaacaaggcaugccucuaggccucucccagcuuucucucgguggacagagaagcuguguucucaggggcuguggcugugcccaaaaacgugaagggcuguuggauaagaaagugggcucaggagccaggcugcugggcucguccagccuauuaaacauuccuuuguuauugucuguuucucccacuagauugucaucucccuugagagggacugugucuguuuuguuuaugcuauacccccgaugccuaguaucagugccucuaauuacuuguauaaacagugacuagcaagccugccacucauuagucauaugauuccgggcaaguuguuaccucucggaguuaacauuuaccaagccuucacuguauuuuagcaguguuuauuccaugagccuugcuugugcuaacucaaacuccacaagagccuuaugagaugguuacuauuuuuauuuccaucaaugaggaaaaucaggucacaagagcagagaugacaugcuuaagguagcugguagcagaggcuuaacacagaugagauuaagucauugaccuagaagcaaauuaauuguuggucuacucuggccccuccuucugcggccaugugacccucuccguccugugucucagacugcucauaacuccuugccaauaaaacagaguuaaucacaacucauacuuccuucugccuccauugcccacuccccucauccacagccuggcaaccucgaagaggagauugugucccagacaaagcuggguaccgagcccagggugagggccauacaggcaugagguuuuuugucacuggccaggaagccagguuucucuucuccuuccuguauucuucuggguguuguguuuuuuuuuuuuuuuuuuuucuuguggaauggagaagcuuuggggugggagagaacagagaagcagcaggaggguauuuccaugucuggucagugguggucucccccaugccagcuaagaauggcaggggaaaacaaagaauagccagaaaugccaggcagaauuaaaaugaucaaguucaaacaucaaagaccaacaaggaauuaagcccagacaugguggugcacaccucucaccccagaacuugggaggcagaggcaggcagauuucugugaguuuaaggucagccuggucuacagagugaguuccaggauagccaggagauagcuauguagagagacucugucucaacaaacaaaacgaguuccucugugguuggagagauggcccagagguuaagaguacuugcuguucuugcagaggacccagauuugguucucagcacccacaucagggggcuuacaacuaucuguaaccccaacucuguggggacucagugccuguggccuuuauagguaccugcacuaauacagacaacacucacagacagacacauaagggaaaauaaauuacaaucuuucaaaauaaaaucagaucuuuaaaacaacaauaaaccaaaccaaacaaauaaaaacuuguuuaaaaaacaaaaacaaaaccgaaaaccucaagugauggcaaagucugugaagcugagcagggcgggcacccugagggcucuggccauacccacucucaaauuuggguuugaugauuugggggaaaagacacaagaugaagcccagggcucacagaggugauaaguagagacuugauccuggaaccccaugggguaauaugcuuaagccaaaaaacgaacacucugccccaggacugccuggaaagucacucgccccagcacagaacacaacaguggaaccuugugagcucuggagcuuggggacaugccagcuuucucaugaaucugugacccaaguucauccauuaucacuuggagcagaaaggcaagaaaguucaagcccugacagcugguggcugccucagagaacagccuucucucuaggcuucaaaaauaccuccuuuccuccagcgaaauaagcaauucacagucaaaggccacccaacacucagugcucuggaggcugggcagagaggguguuccauggccucagacuccucaccuguaaauaggagccuuagccagaugcucccaaggucuccccugcacagauacucucuggagguacacccuaagagagcccaagauguguccccauuuuguauucuuggucucuucacaauaaagagcucaguagagggauguguguagcuggaagaugcaagcaggaagcuguuaccaguucccagcuuuggggaagggcagaggggggaaugaguaggggagcggugccugagacucugacugggucuuugaugugugcguugcuaggugggcggugggccuguaauagaggcuacugagggauggaggcaggggacccugagggcagccucagcguugaccuacuuggguccuuauaauugcucccuucaucucucgagaggcuacaaauagggacacccaguugguaggcuccuacagcugaagcaacagcagcaguggugaguaugguugcuugggaacugcauugggcucggaguuggggcagcucagaaagcccucaacagguagccuguuccuggagacagggucuggauaugggagcagaaagcugaugugagcaggugauggggacucagagggucccuuguacacuaaggagcuguaaggaaguuuguuuuggguagugugcccagccacgaucuuguacugaugugggggggacaguagccagcuaugcuucugggguagcccuuagugagcuccgugcuuuugcuccuugacucuuugcuucauuccuggggacgaguugggacaggccagggcugcaggagaagagaggauuccuuugagucuucaagcccugugcuucugaaauagcaacugaaguggcgccaggcaggcugggaggaaucagaagggcucagaggagccgagcuccugggaucaccccucuuuccucuccaaggaucauggugcuuuccucuucugggaacauggauccuugcugcagugccaggcuaucacagagaauuagacccccauaaugcuugacacuucagccccauucuccuacuuuccugccagcuacagucuugcuagcuauuugcuccccauagagggaacucaccaggaagagucuuggcucuggcuacccuguguuggaggacucuagucccccgagggagucaggagugagucauuggacucacauggaaacaacuccauugccucccugccagcccaggguucgcccaggcugcaugggcaauggaaggggacaauagauguggggugaaggaaggaauucuaggaaguguuucccuuccaucucagugggggacucuucucaaagccuucugaggucccccgggggaugggaggauagcuaaaggauggaguaggucauagaugaguagaucuauguaugaacugguggacucugcagacgccaccugguccauguuucugacuaggccugugaggcuagauuaucccacuuugcagauaagacaacugagacccagagagaaacaguucgcucagggcuucagagugcacaauagaaugaggguccucaauugcaguuucuuugaguucaggguaggaggcauagugagguggagggguccugucaggccucaccacugccucuggcauuagccucaccaggaucuggacaaagaagcccugggcagggcuuccugugcaagcucuuacaggaugacgcuccaggucuccaaaaggcagaggcuuucuaggaucaagggcagcaucacauggaauggugcccaauaaaagacugagaauucccagguguugugaugggaaacgaugggagggagucagagucagagggaggcucccaguuggggugaaggugguagauauucugcuccugaggaauuuauggugaugucagggaacugaaacuucugucuagaaaaaucacaacaggcacagcggggaggugaauugauuccuugcgagucauacccuuguuuugugacagugaggaugacccggccccuggagcaggcaguagcugccaucgugugcaccuuccaggaguaugcagggcgcuguggggauaaauacaagaucugccagucggagcucaaggaguuguugcagaaggagcugcccaccuggacgccggugagcaccucauaucucuccccacuuggacucugcaaaucguggccuagggccaagcagcagcauaggguagcacaugagcugagacacagggcugggaagggggacugaaaugggugucuuaucagguggguaggaugagguuggccccaugaggguuuugguuuggaauggggcagccuaaccaucggaggggaguggugugggaagcuacuuuggcuccuuauucugguuuccugacccugccuucucaucccuuccacagagugaguuccgggagugugacuacaauaaauucaugaguguucuggauaccaacaaagacugcgaaguggacuuuggggaguacgugcgcucacuugccagccucugucucuacugccacgaguacuucaaagagugccccccugagccuccuugcccccaguagccucugauccaaagguguacgcuaucccagaagggcagggucugcuccaguccuccaucuuuguccuugaggugguccuggguguguagccacacccuucccacucucucugugguaccccuuucaaucuagacuugccaaguucuugaugugcuaaccccacccagcuacccaugagcuuucgaggcuuuccuagggaugucuagcuugugaggggugggacaguagccagccuuugccgcuucucuucuuggaagggaagaacaucucugcucagccaugugcacacaacugggaccgcuguggcaggggccuccucaacucccaauaaagaaaugucuucuuggcuuacuuuuguuuuuuucugaugggacacacugggccuugggaccgaguccuuguuccuuuaugcuccuuacuacuggagguaggaggcuuaccauggaaggcauggacccccaaagcggugucaggcccuguagaaaugcacacauuucaggaggguagggguaacacguguccuaucagaugagacuggagggucucugucucucucuguccccugucuugagauagaaguccuuaucuuggacuuucaaggaggacaaggggcuccuugggagguacuucugaccagaugcugcaaggagaguaugguugugggagcccaaagccaaaccuccaucuaaccuucacucaauccccgaauuuguacccuauccuuagagauuaauccugacucccccuuuuaccuauuuccucuuuaacucucuucuucaagcugaacauucaaccccgaaugcuccugucauuccucaauauccuuacuccagcuuccauccauucgaaaaccuccaggccacacugccacccuaacuccaucauggccuccuagguauagcuccuacuucauaccugggguggucccaaggucccuccugacuugcuagccucuauccugggucuuccugauugugacaagaagcuguuuaggcuggagggaagugcugacauugucccacuggcuggggucaccuccuucguuccugggccacauauuuccagggcagcuccuuaucccuugcccauaacaucuccaucuccuuuccuguggcccacaccucauguccagguugcccguucucaaagcuuccuaaacuucuggcugagcuguggcugcuuggugguguccaccccauccaagucucugccgugcccacuggagcucacucacuacuugauugugccugcuggggagggagcaggaagccugguucccagacugggcuggucgagggugcuaugacauuuacuacaucaaccaacagcaagagcacaguauccauguucccccauccucugcaugggcagggccuggcaggguauaaauaggucagauuguugggcucuccccaaaccucucuauucagcacuuccucucucuuggucuggugaguuguguuggucugauagcacugcuagcggcauuagaggcugaggcuaggguagaagaaaggggggcugcugggggaacagaugucuuuaauaaauccagaugagagauucugauguggagguucauguauguguguguguguguguguuuuucacgagaaugaaaaccaaaaaaaaaaaaaaaaaaaaaaaaaguguauaaauggcuacaucugagcucccggagguuuugagauacugaggcuggcuugcauguugcuauaguguauauugguggugcuugggagucacugucaugcauaggaugcugacucguguugcuggguaauacaagacaguguguggacacucggguacaggaagcaaagcgaaggcaucaguaggccuuuuuguuuuacaguauuuaaauuacaguuuuuauuuguguguaugagcguauggguugggcuggagcaaaugccaaggcgacauugugggagccaaaggacaauuugugugggagucaaucuguuccuucuagcaugugggcuguggggaucaaacucaggcccuggagcuugguggcaagcaccucuacccacugagcuaucucuccagcacccuccugcaggcauucguguuuguagugugucuuauuuuuaauagcccuaugaacauauagcaccuaggccaagaaagccuggcuuccccacccucuccucuugcaucccuaccucugccacuucaucuuacuccuauuaggcagcugggguuuuuccacuuuuuuuugucugccucugggcaggcagccagcagccgcgcccaacgcugggagggagaagaaugggccagggccuggugcuugugguugagcugugggagugaguaagcugauggaaaacugcuguuguugaggccaggacugagaggcacagaaaggugcuggcauggaucuccagaguuugagggguaggcuuugcagguuucagagcccagagcacaugugaccuucuugccaucaaugggucccauuccucugaucuccccagggggugagguccaucucuuagagaguuggcugggauagagcacuuaaaauggggacagaaugagugugauuugggucaugcucagcaacacauauccaguucucaacacacuguuggcguggguuggagaauguuacuuuugugucuccugcccuuaggucucaacgguuaccauggcaagacccuuggaggaggcccuggauguaauuguguccaccuuccacaaauacucaggcaaagagggugacaaguucaagcugaacaagacagagcucaaggagcuacugaccagggagcugccuagcuuccuggggguaaguggguccugccuguguauugcacacgugaugcaucugcaggaggaggcuggggcugguaggcacuagucuugaugcaguacuuagcuauagcuggcauauaucccugcucugggugcuugguacggaaccacaaugaaccaccuacuucacacuagcccccagcugagacaggcuuaggaugaagauaacugaagaggcagaggaaaaccaaaacaaccacauuaggcagucagugucugaaaccacagccuagaucagggcugucuuuccggagaugggcacuagaaaucgaguuuuuauuugugaagacaugaucguggaggcacacaaaugccugcagauuauccucucaauaacaccuuauauuaguuaacggaucacuauuaugacaguuuccuauuaagauaauuaaaacaagcacggggaagauguggucacauccuuucccagcuaucccauguguucaucccauaguuuagccccgaggcuagcaaggagugcuugcaaaccuuccugagcuccugacuggaggcaaauaucugguuugaguuggcuucuaauugcuccucuucuacugccagaaaaggacagaugaagcugcauuccagaaggugaugagcaacuuggacagcaacagggacaaugaaguugacuuccaggaguacugugucuuccuguccugcauugccaugaugugcaaugaauucuuugagggcugcccagauaaggagccccggaagaagugaagacuccucagaugaaguguugggguguaguuugccagugggggaucuucccuguuggcugugagcauagugccuuacucuggcuucuucgcacaugugcacagugcugagcaaauucaauaaaagguuuugaaacuauuagc

SEQ ID NO: 1533 - RNA, 11248 nt, Mus musculus
uucagcacacaagccagaguuucgagucacgugccagaagggaaaacuaaacacggaauuagagaaaacuugaugccucuggcuugcacuggucuccuuugggcccguuagggcccgcuaaacucccucauuccgcuccuaauccuggacaguccaggcaacaggggcguggaaaguugagggggcugggauguucguuugccuugccucaggcgcuggguggggucggggcgugccagcacucccugggcggaccucacggaugcuggccacuauaaggccggccagacugcgacacauuccauccccucgaccacuccuuuggcgcuucgcugucgaccgugcggugagcucucgcuggggggucccucuagggucuuucugcuccugggcaagggguuaagccacuuccuucccccgucagccucugcaggcucaguggguggaaugcauugggauccaaguuuucggagcccagggaggcagggagagccaugauuagguggguuguaucaggcaaacccagaggcuaaugcaucccuauggggcggcaaccugagucugcucuucuggggugcaggaggguuugcccugggugugucaucgucccaguguguggcuaugucaggaggugcccaggggcacucuccauucucuuccuugcucagucauaugcccuaguucucuuggaagcccuggaggacagugcucacagaucccaaagccccuuccauucuuauaucccucaccuaaguugccccggcugccaccuguguuggcuugagacugacugccucaggcagggggguggugagagaacucucugcuaucagcagcacugacuagccccucugucaaacagcuucuucuagcccagugaucagucauggcaugcccucuggaucaggccauuggccuucucguggccaucuuccacaaguacucuggcaaggaaggugacaagcacacccugagcaagaaggagcugaaggaguugauccagaaggagcucaccauuggcuccgugaguagccccugucccgguucccccuccugccucucaucugaguggcauuuaaucacaguuccugaucuuacuuccuguggagggaugcucguaugccuccaugcugcccuguccccugagggaggagcaggggcugaggagaguaaaucaagguaaacccaagcugaaggcccaucuuuggucccaacgagcacuuguuugagagaggacuuccagggaagggguaaggaaucuaggguguuggccaccacugaguguggacuucuccuucuuaauguauuagaagcugcaggaugcugaaauugcaaggcugauggaugaucuggaccguaacaaggaucaggaaguaaacuuccaggaguaugucgccuuccugggggccuuggcuuugaucuacaaugaagcucugaaauaaaaugggaccguugagaugacuuccgggggccucucucggucaaauccagugguggguaguuauacaauaaauauuucguuuuuguuaugccuacucauguguucuggcuucccacugauuuccaguugcuuccugccuugcugcuggacccaccauccaguggucuuagucacaguuaaacucugggaguaguagcucauuggcccaccaggccaggucugccagcugaccaggaaucuuuauggguauuagaagaggaggccccucuaggcaaagccacucuaaacaaaggcucaaucaagugaccuucaggagaaaguggccuuuagaggcaggucugcaguagucccagcagucuccuggcagacacacuuuggucuggguguggugaaacagggaguacuaggugggcccugacguugggcaauccaccuuuucacuguguguuuguguguuauaugagggaggcguggggagaggcacaucugaggugagcagggagggacacaggaugacugaguuuuccguagcugccuguguuccaguuggagguggaggagacuguaggagacggucccuagugucagguaugggguccuuuuuguugagcuaaggagcuggcagcuccacgcacaugugacucacgaggugcucgcaaacagggcagggcuggggucccgagacaugccagaugcggcaucaggccuuucugucaauauugacccagccugucccugcagaaugacucauggggcuacuucccuggaacguaguugaacccucaaucccuaucagaguagauggccaacggaguaacugucuauuguguacaguuaaaucauaggugugggggaagcugugugugaugugucugggugucauggagacagcauuuguugcuauuccuccagggaaggccuaacccaaguuggacaacauccuggccaagccccgaagggcaaagaucuggacuucauguggagaccauagcuguuuucacuucuuacuacccaccccuucuccaauccacuuaagacguuaaauggucuucccaugcucuggguggggcaaauaaacagcaacagcuguauuucuuaaaaaccuuucuucuccagcaguguccuggucuuaccacguuguuggacagccagaggguccccgggugggccacccccauuccaugcuguucaguauaggcucuauucaguggcucuggaaaaguacaccacacccaguuguugauacuuugggguguggagggaucgcccucuuguggacagagagcagguuacugguagggaggcugcgguuggugguggugguggggcgugucaagaaggagugggggguggggggaggagccuggcaggugggcauaggaagaaagucaguuaauuuucugagccuuguggaaggagcaccagcggcaccguggaugggagccaaagcuuaagaggucugggcugugagaggggguuggaauuagcuauucagggaauguaagagucgagccaucguuuaguucucagcaaucaacccuacuucauccgagguacaucuaugauaagcaagucaagggagggaaaguuuuguuaaagacagguggaauccagucccauccugcccuccucuuucugugguuagauggucagacaaucaucuaggcucuuggagggcaagggggaauuuuuuuuucuuuuagguacagggccuggugguggaaggagaugcuuggucccuuaggaggccggcaggcaggcuuugcuguguaucaggaucacaaggcuagagaggagaugaaggugcagagcucaucugcuaaauaaaacuucaccucccugggcaugauggugcacuucuuuaaugccagcacucaggaggcaggcaaauggaucucuguugaguuuggggcuagccuggucuacacagagaaaugcaggccaaucagggcuguauacugagacccagucuuaaugaaaaagugagguggguggugggguggggugggguggggugggugguagggggaagcuuugaaaaaaggaacaaaacaaaacaaagugagauaaaaugaguagcaaaacauuugccuguguuggggguauaguuuaaaacugagacguaaagggccauugacuggaaauuuuggugggggcagaaggcaaggaguggaauuggguguggucagguguagacugacuucuuucauuaguccaaaagauuucagguuggcuuuugagcaucgucuagguccccaggagaggguuggagcuggggacuuuguaguggauuccuucccuguacauggccgaagacuauacccagaggcugggcagagggcaugguccugcucucccuuuuccuguagucagcucuauucuuucuuugcccugccuaaguagcacuaacccuaucaucuaguuacccuuacacaugggagguuggaacaguggcaacuggguccauaaacuggguggucucccagguuggcuguuggcaugggacugacuugggauguauuaucuguccucugccauggauaucagaaacugucaagaacaccagcaccacuucccacagugucuguguuccacaguacuugcauuuguacaggguguuacuacaguuacuguggccucaucucccaaagaauuauguguaguguggguuacuaaaggcuagaguugcagguuguccaccaaggagggacaguagaaguucuuggagggaaugaacucuucugacccaggccagcucaucaaugcuuuccucugcugcuucaggauuuaaugucacucuuucuucuucaugccugucucuuaaauguuuuaauuaaauaucaagaauguacaaacagcuuauagacuacaccaaaaauauaaaaauugcaaaccaaaacaauauuugucaaagaaacaaauauugaggcacaugucuuuaauccuagcaguugggagauagaggcagguggaucccugauuuugaggccagccuggucuacagaguaaguuccaggacagcgagggcuacacagagaaaccuugucucaaaaaaccaaaccacaaacaaacaaaacuaaaaacaacaacaacaacaacaacaacaaaaccccaaaagaccaaccaaccaaauaaaccaaaaaaaccaaccccugaccauuuugcugaggugagucaguggguaaaaacaucggguguuaagccugcugaccugaauuuaaucccuaggacccacauggugaacagggagaacuaauuccuguagguugucucugacuuccacauacaugcuguggcaugugugccuauauaugugugcacacaugcauaugcacacagaaaugaauaaauguaauacaauuaaaaaaaaaaaagagagaaauaggguuagagaguuagcucagcagggaacugaaacuguuuacaguucccacguggggcagccugaacuccagauccaagagaaauaucuggugcccucuucuggucacugcagccaugugcacucaguugcacauuuuauuuuuuccaaaacauauauacaucuaauuaaaaaauaucuuuaaaagauacuauaacagauauaugguugauuacuuuuucuagagugggucaaugagccaggcagacauugguguacugguucaucagggaucuaaugaaggaagcagauuagcagccagaugauaaagaugcccaaggccaggcaugugaggaguaaaggacucuccugccuuuucugagcacuuuacacucaaggaaccuuuacauauucugcuaucugagcccucuuauucauuuuacuuuauacaggcucauguagucccagaggccuugaucuugcuuugugguugaggcacguuuugaauuccugauccucuucccucucacugcugagugcugggagaacaggugcaugacacuauagcuggcuugagccggauccuuucagguuauugauggaagcuucguuaggaagcaugauugauuacaucccuagccauugaccaaguuugccuucagcccuggagguugacaugugaggaugaaaguguuaauuaugagcauccgggucuuucugaugaccaacuccaucuuaucuugggcuacugggcaucucauuaguguacaguccuaagguuacuguugcuguggggaaacaccauggccaaguuguggaggaaaagguuuauuuggcuuauacuucuacauaguaggucaucacugaagaaagucaagucaggaacuccaacagggcaggaaccuggaggcaaaaagcugauggagaggugguggaggggugcugguuacuggcuugcuucccacggcuuacuuagccuguuuucuuauagaacccagaaccaccagcccagggguggcagcuccaccucugugggcugggcccuuccacaucaaucauuuauuaagaaaaaugccuucuccaugggcauggcuugcauaugguacgcuuacauacaugcaaacaaaccaccaauauacauaacauaaaaugauuaauucaggcaugguaccacagacuuuuaauucuagcacucuggagcuaaaggcaggcagaacuguaugaguuccuugcuagccaagguuacuuaagaagaccaucccauaaucagcccccaaacgcugacaccauugcacacacuagcaagauguugcugaaaggacccugauauagcuguuucuugcgaggcuaugcuggggccuagcuaacauguaaguggaggcucacaguuagcuauuggauggaucacagggcccccaauggaggagcuagagaaaguacccaaggagcugaaggggucugcaacccuauagguggaacaacaauaugaacuaaccaguaccccggagcucgugucucuagcugcauauguaucagaagguggccuagucagccaucauugggaagagaggcccauuggucuugcaaacuuuauaugccucaguacaggggaacaccagggccaagaagugggagugugugugucgggggaagguuugggggacuuaugggguagcauuggaaauguaaaagaagaaaauaccuaauuaaucaaaaaaaaaaaagaaguaacacaaaaucaucauugggaaaucuuaggucccccaauuacugguaauuaaaaagauauuuuuuuacagaaaaaaaaagaagaccuugucucaaaauaaaauaaaauaaaaccugaacaaauacccucccucaaguaaauaaauauuaaaaaaaauauacuucaggggcuggacagauggcucagugguuaagagcacugauuguucuuccagaggucuagaguucaauucccagcaacuacaugguggcucacaaccaucuguaaugggaucugaugcccucuucuggugugucugaagacagcuacaguguacucauauauauuaacuaaauaaaucuuaaaaaaaaauacuucagugugagauguuccacaauaaaacuuuuuagaauuugauuggcauugcuuugauuuuguagggugacuuauagagaauguugacccuugaaacccaugaauaugauuuaucuuucguuuguuugaguuaggguuucucugugcagaccuggauccccuggaacuaguucuguagaccaggcuagccccaaauucagagaucugucuguaucugccucucaagugcuggaauuaaaguaauguaccaucauguccagcucaucucuucaucuuaaaggauuauuuucaauaucuuugaaugacauggaaucauaucuaaccuaaaggagguacuuguauuagcuuucugcuacuguaacaaaagaugugaaacaguaaacuuaagaagaaagguuaauuuugguucacaguguuaaagacuuaaguucaugguagguugacccuagaggcagugcacuguaaugggaacauguaugaaauaauuugccucauggccuggauguaagagagaagaggaaggggcuauggccucaauauccccuuuagggguauaucuccacugacaagaagacaucuuacuagguucuacauuuucccccuguguguugagugauaggcaauucuucuaccacugagcuauagcucccacacccuuaaacuacaaauuuugugguuuaaaauauuuguguauuuggucccaguaagucugucucuuguacaauguguacuagguccauagaaaaaaacccaaggucagaggauacuggugugugugguccucaggaaugucaccaucccugcuagucuucugucuucccaggcgccaagccccaccauccuagucuccagccaagaccccacccuucuggucuauguccagcaaagcaucucuucacuuuugagugugugucugcccucuucccugccuggcccccaccuucccaguccacccagguuggguagcaucucaccagcagccagcagcacuugccucagucuacccuccucaggccccagauauccuucuguccaggccuuccccaucuuucaagagccccccaagcuauuccucacccucagccuggaaguggggcuuucaaacuccauuagugccuuugaguugcucaagcuuuuuauagaugucagagaugccaggaaaggcuguccucauugacugcuaauggaagugugaacuguuauuacuguuuuggaaaguaauauaaauuaaauauacaugugccuagcauccagcaucuucacuugugggauccacaucauugaaauaaaagcaucauuccuuaaagauguaaauauauaaguacuucaguggaaauauuaacuacuuuugguggaaaaaaugaagcaggaaagggaguuggcagagggcugcaugaauuguggcacuucucaaaacgauacacacuuaccuuagaaagugucuugagucuggugugaugguacauuccuguagcccuagcacucaaaagguggaggcaggaggacuccuacaagugugaggccauuguagauuaaauagugagcucaaggccagucucaaauauauaucuaaaaucccugucucaaagccaagcggucccaacccucauagacagagcugggggauggggcagaacuuggggagccgagaugggagaggagguggggaagaagcucgcaguggagcucuucuugaggguguggcaggugaacugggagcagagaggaaccugggagccacuggauauuucagggguacgucaagagucaccuagugcccaccccacggcagugccuuuucagaguucugggagcucgacucauuucugauuccagaagaaggaggagggguggagagaccgugggcuccugcuuccauccuuccuccagaggaaaacaagaaucaccuaucaguaggacccucuccugccugcaggcucauuuaggacuuucauguggggaggaucucacaugaugcuuagugaagaggaagugacaccuuuccucucucuacagcuccgaaugcucacguucucccuugggucacucugccucacuccuuacaaaagacaucccggcaggagccucuuggugugcuagaaugaagcucagggaauuuccccaugccuccuugucuagacccagcggggaggaugaucaggauacugauuccccuucuuccuuuuuguauaaaggcugcuacugauuuccucaugaauuaucuacagcagaaguuccuaaccuuuguaaagaacccucugacuccuuugggguugcauaucagauauccugaauaucaaauauuuacauugugauucauaacaguagcaaaauuacaguuaugaaguagcgaugaaauaacuccaugguuggggucagcacaacacgagaggaacuguauugaacguacugaagaguuucagcguuaggaaaguugagaacuacagcucuagaggaagguucauguugacuuccaucugcuccaugcacuuuccccucugggaaaagcauuaacaagcuaagauggacucauugacaccuaugagucauuguaauuucauuuuccagcacauauuuauuuuguguguguguauguguuccccauggcuugcuuucuuguagaaccagggaccacagcccaggaauggcaccauucacaaugaacugggcccucccucauuggucacuaauugagaaaaugcccuacagcugggucucauggaagcauugccucaacugaggcuccuucuuugaugacucuagaugggucaaguugacacaaagucagcacacuacuucacaaagaagaaggugaauggcaugaaaagccauguaguuugcuuucuguguacaaggagacuauccaugucuugguauguuccugagugaauuaauuaaaagauguaucuuuauaaaagccgugugaacacucaugcugagaacaguaugauuuguaauuuuuuaaauguagcaauaacacagguguucaucaacuccuguaugugucaacaaaaugugguauauaccugauggaaugcuagccauaaaaagaacugaguacuuaugugugcugcagaggugaacugaaaucaagugaaggagacagucauuagaggcuagugagugguuucaugucuaugcaauucccagaguggacaaaugcagagacagaaaguguguuagugguugucugagacagagggaaggacugucagugggcaugagguugcuaaagggauuaaaaugggcugauaucaaaucaugguagugguuauagaaugcugaguuuauuaaaugccuuugaauugaagccaaagaugugccuugucaguuaagagcuuuggcugcucuuagagaggacccagguuggguucucagaacccacgauaguagcuuacugauauacauauaggcaaaacacacuuuuaaagauuuaaaaauguagaacucugacauuuuguggauuugugggugcuuuuugaggcagggucucauuauauaucccuggcuggccugaaauucaccauguagccuagguuggucucuaauguguuaucuuauccugaucacugauucagguacuuguguuauccuccccuagcucagcgguccuuacuagcuuagcagaaguguuuuguggguucaccugaucccacacccagaauuuucugaagcugggagggcaaaggggucucagagguuuuguuguguuagaacagucacaguagcugcaaaaugaaacaaaaggccucaagaaacaaaagcaccugcugagugaaauccccuagugaacccagcagcuggaaagcaguaggcaugcugccaaggucaccauagcaaccagaaacagacagaaccuucauacaguuucccugccccugaagauauaaaagacccguggaccucauugugaacuuuuggcagcucuuggcugcucauguugcuugcccucucuucccagguuugacacauuuucccugauugaugcuaucuuuuucaccuuauuggcauacccacauccaaccagucaggcccagcuggcacccuggcacuucuaugaauccucgauuccagagcugcuguaggagcccaccagggaagaacagaaggaagacuucaaagccugcucccuggcccuggccugcagcugugcuccagaugucccugguuucuucagaaguucuuccugaagacuuaagugucuggcuuuuagcuggcuugcucauugaagaaggaagagugccuuccauaaucaccagggacacagagaggaagguccuugggucuuaggcaggaagcuugcuggauuccgggacuugagcagcugcaggugggggaccugugcgcaucucauccuucaagg

SEQ ID NO: 1534 - RNA, 11248 nt, Mus musculus
ccuugaaggaugagaugcgcacaggucccccaccugcagcugcucaagucccggaauccagcaagcuuccugccuaagacccaaggaccuuccucucugugucccuggugauuauggaaggcacucuuccuucuucaaugagcaagccagcuaaaagccagacacuuaagucuucaggaagaacuucugaagaaaccagggacaucuggagcacagcugcaggccagggccagggagcaggcuuugaagucuuccuucuguucuucccuggugggcuccuacagcagcucuggaaucgaggauucauagaagugccagggugccagcugggccugacugguuggauguggguaugccaauaaggugaaaaagauagcaucaaucagggaaaaugugucaaaccugggaagagagggcaagcaacaugagcagccaagagcugccaaaaguucacaaugagguccacgggucuuuuauaucuucaggggcagggaaacuguaugaagguucugucuguuucugguugcuauggugaccuuggcagcaugccuacugcuuuccagcugcuggguucacuaggggauuucacucagcaggugcuuuuguuucuugaggccuuuuguuucauuuugcagcuacugugacuguucuaacacaacaaaaccucugagaccccuuugcccucccagcuucagaaaauucugggugugggaucaggugaacccacaaaacacuucugcuaagcuaguaaggaccgcugagcuaggggaggauaacacaaguaccugaaucagugaucaggauaagauaacacauuagagaccaaccuaggcuacauggugaauuucaggccagccagggauauauaaugagacccugccucaaaaagcacccacaaauccacaaaaugucagaguucuacauuuuuaaaucuuuaaaaguguguuuugccuauauguauaucaguaagcuacuaucguggguucugagaacccaaccuggguccucucuaagagcagccaaagcucuuaacugacaaggcacaucuuuggcuucaauucaaaggcauuuaauaaacucagcauucuauaaccacuaccaugauuugauaucagcccauuuuaaucccuuuagcaaccucaugcccacugacaguccuucccucugucucagacaaccacuaacacacuuucugucucugcauuuguccacucugggaauugcauagacaugaaaccacucacuagccucuaaugacugucuccuucacuugauuucaguucaccucugcagcacacauaaguacucaguucuuuuuauggcuagcauuccaucagguauauaccacauuuuguugacacauacaggaguugaugaacaccuguguuauugcuacauuuaaaaaauuacaaaucauacuguucucagcaugaguguucacacggcuuuuauaaagauacaucuuuuaauuaauucacucaggaacauaccaagacauggauagucuccuuguacacagaaagcaaacuacauggcuuuucaugccauucaccuucuucuuugugaaguagugugcugacuuugugucaacuugacccaucuagagucaucaaagaaggagccucaguugaggcaaugcuuccaugagacccagcuguagggcauuuucucaauuagugaccaaugagggagggcccaguucauugugaauggugccauuccugggcuguggucccugguucuacaagaaagcaagccauggggaacacauacacacacacaaaauaaauaugugcuggaaaaugaaauuacaaugacucauaggugucaaugaguccaucuuagcuuguuaaugcuuuucccagaggggaaagugcauggagcagauggaagucaacaugaaccuuccucuagagcuguaguucucaacuuuccuaacgcugaaacucuucaguacguucaauacaguuccucucguguugugcugaccccaaccauggaguuauuucaucgcuacuucauaacuguaauuuugcuacuguuaugaaucacaauguaaauauuugauauucaggauaucugauaugcaaccccaaaggagucagaggguucuuuacaaagguuaggaacuucugcuguagauaauucaugaggaaaucaguagcagccuuuauacaaaaaggaagaaggggaaucaguauccugaucauccuccccgcugggucuagacaaggaggcauggggaaauucccugagcuucauucuagcacaccaagaggcuccugccgggaugucuuuuguaaggagugaggcagagugacccaagggagaacgugagcauucggagcuguagagagaggaaaggugucacuuccucuucacuaagcaucaugugagauccuccccacaugaaaguccuaaaugagccugcaggcaggagaggguccuacugauaggugauucuuguuuuccucuggaggaaggauggaagcaggagcccacggucucuccaccccuccuccuucuucuggaaucagaaaugagucgagcucccagaacucugaaaaggcacugccguggggugggcacuaggugacucuugacguaccccugaaauauccaguggcucccagguuccucucugcucccaguucaccugccacacccucaagaagagcuccacugcgagcuucuuccccaccuccucucccaucucggcuccccaaguucugccccaucccccagcucugucuaugaggguugggaccgcuuggcuuugagacagggauuuuagauauauauuugagacuggccuugagcucacuauuuaaucuacaauggccucacacuuguaggaguccuccugccuccaccuuuugagugcuagggcuacaggaauguaccaucacaccagacucaagacacuuucuaagguaaguguguaucguuuugagaagugccacaauucaugcagcccucugccaacucccuuuccugcuucauuuuuuccaccaaaaguaguuaauauuuccacugaaguacuuauauauuuacaucuuuaaggaaugaugcuuuuauuucaaugauguggaucccacaagugaagaugcuggaugcuaggcacauguauauuuaauuuauauuacuuuccaaaacaguaauaacaguucacacuuccauuagcagucaaugaggacagccuuuccuggcaucucugacaucuauaaaaagcuugagcaacucaaaggcacuaauggaguuugaaagccccacuuccaggcugagggugaggaauagcuuggggggcucuugaaagauggggaaggccuggacagaaggauaucuggggccugaggaggguagacugaggcaagugcugcuggcugcuggugagaugcuacccaaccuggguggacugggaaggugggggccaggcagggaagagggcagacacacacucaaaagugaagagaugcuuugcuggacauagaccagaaggguggggucuuggcuggagacuaggaugguggggcuuggcgccugggaagacagaagacuagcagggauggugacauuccugaggaccacacacaccaguauccucugaccuuggguuuuuuucuauggaccuaguacacauuguacaagagacagacuuacugggaccaaauacacaaauauuuuaaaccacaaaauuuguaguuuaagggugugggagcuauagcucagugguagaagaauugccuaucacucaacacacagggggaaaauguagaaccuaguaagaugucuucuugucaguggagauauaccccuaaaggggauauugaggccauagccccuuccucuucucucuuacauccaggccaugaggcaaauuauuucauacauguucccauuacagugcacugccucuagggucaaccuaccaugaacuuaagucuuuaacacugugaaccaaaauuaaccuuucuucuuaaguuuacuguuucacaucuuuuguuacaguagcagaaagcuaauacaaguaccuccuuuagguuagauaugauuccaugucauucaaagauauugaaaauaauccuuuaagaugaagagaugagcuggacaugaugguacauuacuuuaauuccagcacuugagaggcagauacagacagaucucugaauuuggggcuagccuggucuacagaacuaguuccaggggauccaggucugcacagagaaacccuaacucaaacaaacgaaagauaaaucauauucauggguuucaagggucaacauucucuauaagucacccuacaaaaucaaagcaaugccaaucaaauucuaaaaaguuuuauuguggaacaucucacacugaaguauuuuuuuuuaagauuuauuuaguuaauauauaugaguacacuguagcugucuucagacacaccagaagagggcaucagaucccauuacagaugguugugagccaccauguaguugcugggaauugaacucuagaccucuggaagaacaaucagugcucuuaaccacugagccaucuguccagccccugaaguauauuuuuuuuaauauuuauuuacuugagggaggguauuuguucagguuuuauuuuauuuuauuuugagacaaggucuucuuuuuuuuucuguaaaaaaauaucuuuuuaauuaccaguaauugggggaccuaagauuucccaaugaugauuuuguguuacuucuuuuuuuuuuuugauuaauuagguauuuucuucuuuuacauuuccaaugcuaccccauaagucccccaaaccuucccccgacacacacacucccacuucuuggcccugguguuccccuguacugaggcauauaaaguuugcaagaccaaugggccucucuucccaaugauggcugacuaggccaccuucugauacauaugcagcuagagacacgagcuccgggguacugguuaguucauauuguuguuccaccuauaggguugcagaccccuucagcuccuuggguacuuucucuagcuccuccauugggggcccugugauccauccaauagcuaacugugagccuccacuuacauguuagcuaggccccagcauagccucgcaagaaacagcuauaucaggguccuuucagcaacaucuugcuagugugugcaauggugucagcguuugggggcugauuaugggauggucuucuuaaguaaccuuggcuagcaaggaacucauacaguucugccugccuuuagcuccagagugcuagaauuaaaagucugugguaccaugccugaauuaaucauuuuauguuauguauauuggugguuuguuugcauguauguaagcguaccauaugcaagccaugcccauggagaaggcauuuuucuuaauaaaugauugauguggaagggcccagcccacagagguggagcugccaccccugggcuggugguucuggguucuauaagaaaacaggcuaaguaagccgugggaagcaagccaguaaccagcaccccuccaccaccucuccaucagcuuuuugccuccagguuccugcccuguuggaguuccugacuugacuuucuucagugaugaccuacuauguagaaguauaagccaaauaaaccuuuuccuccacaacuuggccaugguguuuccccacagcaacaguaaccuuaggacuguacacuaaugagaugcccaguagcccaagauaagauggaguuggucaucagaaagacccggaugcucauaauuaacacuuucauccucacaugucaaccuccagggcugaaggcaaacuuggucaauggcuagggauguaaucaaucaugcuuccuaacgaagcuuccaucaauaaccugaaaggauccggcucaagccagcuauagugucaugcaccuguucucccagcacucagcagugagagggaagaggaucaggaauucaaaacgugccucaaccacaaagcaagaucaaggccucugggacuacaugagccuguauaaaguaaaaugaauaagagggcucagauagcagaauauguaaagguuccuugaguguaaagugcucagaaaaggcaggagaguccuuuacuccucacaugccuggccuugggcaucuuuaucaucuggcugcuaaucugcuuccuucauuagaucccugaugaaccaguacaccaaugucugccuggcucauugacccacucuagaaaaaguaaucaaccauauaucuguuauaguaucuuuuaaagauauuuuuuaauuagauguauauauguuuuggaaaaaauaaaaugugcaacugagugcacauggcugcagugaccagaagagggcaccagauauuucucuuggaucuggaguucaggcugccccacgugggaacuguaaacaguuucaguucccugcugagcuaacucucuaacccuauuucucucuuuuuuuuuuuuaauuguauuacauuuauucauuucugugugcauaugcaugugugcacacauauauaggcacacaugccacagcauguauguggaagucagagacaaccuacaggaauuaguucucccuguucaccauguggguccuagggauuaaauucaggucagcaggcuuaacacccgauguuuuuacccacugacucaccucagcaaaauggucagggguugguuuuuuugguuuauuugguugguuggucuuuugggguuuuguuguuguuguuguuguuguuguuuuuaguuuuguuuguuugugguuugguuuuuugagacaagguuucucuguguagcccucgcuguccuggaacuuacucuguagaccaggcuggccucaaaaucagggauccaccugccucuaucucccaacugcuaggauuaaagacaugugccucaauauuuguuucuuugacaaauauuguuuugguuugcaauuuuuauauuuuugguguagucuauaagcuguuuguacauucuugauauuuaauuaaaacauuuaagagacaggcaugaagaagaaagagugacauuaaauccugaagcagcagaggaaagcauugaugagcuggccugggucagaagaguucauucccuccaagaacuucuacugucccuccuugguggacaaccugcaacucuagccuuuaguaacccacacuacacauaauucuuugggagaugaggccacaguaacuguaguaacacccuguacaaaugcaaguacuguggaacacagacacugugggaaguggugcugguguucuugacaguuucugauauccauggcagaggacagauaauacaucccaagucagucccaugccaacagccaaccugggagaccacccaguuuauggacccaguugccacuguuccaaccucccauguguaaggguaacuagaugauaggguuagugcuacuuaggcagggcaaagaaagaauagagcugacuacaggaaaagggagagcaggaccaugcccucugcccagccucuggguauagucuucggccauguacagggaaggaauccacuacaaaguccccagcuccaacccucuccuggggaccuagacgaugcucaaaagccaaccugaaaucuuuuggacuaaugaaagaagucagucuacaccugaccacacccaauuccacuccuugccuucugcccccaccaaaauuuccagucaauggcccuuuacgucucaguuuuaaacuauacccccaacacaggcaaauguuuugcuacucauuuuaucucacuuuguuuuguuuuguuccuuuuuucaaagcuucccccuaccacccaccccaccccaccccaccccaccacccaccucacuuuuucauuaagacugggucucaguauacagcccugauuggccugcauuucucuguguagaccaggcuagccccaaacucaacagagauccauuugccugccuccugagugcuggcauuaaagaagugcaccaucaugcccagggaggugaaguuuuauuuagcagaugagcucugcaccuucaucuccucucuagccuugugauccugauacacagcaaagccugccugccggccuccuaagggaccaagcaucuccuuccaccaccaggcccuguaccuaaaagaaaaaaaaauucccccuugcccuccaagagccuagaugauugucugaccaucuaaccacagaaagaggagggcaggaugggacuggauuccaccugucuuuaacaaaacuuucccucccuugacuugcuuaucauagauguaccucggaugaaguaggguugauugcugagaacuaaacgauggcucgacucuuacauucccugaauagcuaauuccaacccccucucacagcccagaccucuuaagcuuuggcucccauccacggugccgcuggugcuccuuccacaaggcucagaaaauuaacugacuuucuuccuaugcccaccugccaggcuccuccccccaccccccacuccuucuugacacgccccaccaccaccaccaaccgcagccucccuaccaguaaccugcucucuguccacaagagggcgaucccuccacaccccaaaguaucaacaacugggugugguguacuuuuccagagccacugaauagagccuauacugaacagcauggaauggggguggcccacccggggacccucuggcuguccaacaacgugguaagaccaggacacugcuggagaagaaagguuuuuaagaaauacagcuguugcuguuuauuugccccacccagagcaugggaagaccauuuaacgucuuaaguggauuggagaagggguggguaguaagaagugaaaacagcuauggucuccacaugaaguccagaucuuugcccuucggggcuuggccaggauguuguccaacuuggguuaggccuucccuggaggaauagcaacaaaugcugucuccaugacacccagacacaucacacacagcuucccccacaccuaugauuuaacuguacacaauagacaguuacuccguuggccaucuacucugauagggauugaggguucaacuacguuccagggaaguagccccaugagucauucugcagggacaggcugggucaauauugacagaaaggccugaugccgcaucuggcaugucucgggaccccagcccugcccuguuugcgagcaccucgugagucacaugugcguggagcugccagcuccuuagcucaacaaaaaggaccccauaccugacacuagggaccgucuccuacagucuccuccaccuccaacuggaacacaggcagcuacggaaaacucagucauccugugucccucccugcucaccucagaugugccucuccccacgccucccucauauaacacacaaacacacagugaaaagguggauugcccaacgucagggcccaccuaguacucccuguuucaccacacccagaccaaagugugucugccaggagacugcugggacuacugcagaccugccucuaaaggccacuuucuccugaaggucacuugauugagccuuuguuuagaguggcuuugccuagaggggccuccucuucuaauacccauaaagauuccuggucagcuggcagaccuggccuggugggccaaugagcuacuacucccagaguuuaacugugacuaagaccacuggaugguggguccagcagcaaggcaggaagcaacuggaaaucagugggaagccagaacacaugaguaggcauaacaaaaacgaaauauuuauuguauaacuacccaccacuggauuugaccgagagaggcccccggaagucaucucaacggucccauuuuauuucagagcuucauuguagaucaaagccaaggcccccaggaaggcgacauacuccuggaaguuuacuuccugauccuuguuacgguccagaucauccaucagccuugcaauuucagcauccugcagcuucuaauacauuaagaaggagaaguccacacucagugguggccaacacccuagauuccuuaccccuucccuggaaguccucucucaaacaagugcucguugggaccaaagaugggccuucagcuuggguuuaccuugauuuacucuccucagccccugcuccucccucaggggacagggcagcauggaggcauacgagcaucccuccacaggaaguaagaucaggaacugugauuaaaugccacucagaugagaggcaggagggggaaccgggacaggggcuacucacggagccaauggugagcuccuucuggaucaacuccuucagcuccuucuugcucagggugugcuugucaccuuccuugccagaguacuuguggaagauggccacgagaaggccaauggccugauccagagggcaugccaugacugaucacugggcuagaagaagcuguuugacagaggggcuagucagugcugcugauagcagagaguucucucaccaccccccugccugaggcagucagucucaagccaacacagguggcagccggggcaacuuaggugagggauauaagaauggaaggggcuuugggaucugugagcacuguccuccagggcuuccaagagaacuagggcauaugacugagcaaggaagagaauggagagugccccugggcaccuccugacauagccacacacugggacgaugacacacccagggcaaacccuccugcaccccagaagagcagacucagguugccgccccauagggaugcauuagccucuggguuugccugauacaacccaccuaaucauggcucucccugccucccugggcuccgaaaacuuggaucccaaugcauuccacccacugagccugcagaggcugacgggggaaggaaguggcuuaaccccuugcccaggagcagaaagacccuagagggaccccccagcgagagcucaccgcacggucgacagcgaagcgccaaaggaguggucgaggggauggaaugugucgcagucuggccggccuuauaguggccagcauccgugagguccgcccagggagugcuggcacgccccgaccccacccagcgccugaggcaaggcaaacgaacaucccagcccccucaacuuuccacgccccuguugccuggacuguccaggauuaggagcggaaugagggaguuuagcgggcccuaacgggcccaaaggagaccagugcaagccagaggcaucaaguuuucucuaauuccguguuuaguuuucccuucuggcacgugacucgaaacucuggcuugugugcugaa

SEQ ID NO: 1535 - RNA, 1060 nt, Mus musculus
cucuggaagggaagagcguugucuccauagcccgaggcugugggcagcuggccaagcuuuccucuauaaaagcagcugacacuuagccucacauauccuuugucagcuccgucuucaagacaucguguaaguagggcuaugugacugucucacaguguaggcucuccuuagcgaggguugggggauagaguagccuccucugagagggcgagaaagcguggggaagucuccagcaccgaucaaaugcuugaggauaaaggaaguggaauggcguagagccuucuagcagugucuagcagaagagggcaggaaguguuuaguguggagaauuugcuacacuuguguguguguguacuaaagucucuccaaugcucucuccuaccccuucccaucagagauagagccauuuucuggguuuaguuaucugagugguacaggccaggucaaagcccauucuuggguuaaaaaccugaaugcccacucaguugucacccugccgugaguaacugcagcucccaucccucugcgacuuuuccuuucaguugaaaggaaaucuuucgugacaaugccgucugaacuggagaaggccuugagcaaccucauugaugucuaccacaauuauuccaauauacaaggaaaucaccaugcccucuacaagaaugacuucaagaaaauggucacuacugaguguccucaguuugugcaggugaggaggugcuauguucucaggguuuucuaauggugcugggauggcuagcccuccaaguugcuuucugcaguuagccaauacuuauccacagauaguccucgcuuacuuuucucugauacagucugaacucaccccccccauucuucuugacagaauauaaauaucgaaaacuuguucagagaauuggacaucaauagugacaaugcaauuaacuucgaggaguuccuugcgauggugauaaaaguggguguggcaucucacaaagacagccacaaggaguagcagagcuucuggccuagggcugggucccuggauaugucuacagaauaaagucaucauaucucaggucug

SEQ ID NO: 1536 - RNA, 1060 nt, Mus musculus
cagaccugagauaugaugacuuuauucuguagacauauccagggacccagcccuaggccagaagcucugcuacuccuuguggcugucuuugugagaugccacacccacuuuuaucaccaucgcaaggaacuccucgaaguuaauugcauugucacuauugauguccaauucucugaacaaguuuucgauauuuauauucugucaagaagaauggggggggugaguucagacuguaucagagaaaaguaagcgaggacuaucuguggauaaguauuggcuaacugcagaaagcaacuuggagggcuagccaucccagcaccauuagaaaacccugagaacauagcaccuccucaccugcacaaacugaggacacucaguagugaccauuuucuugaagucauucuuguagagggcauggugauuuccuuguauauuggaauaauugugguagacaucaaugagguugcucaaggccuucuccaguucagacggcauugucacgaaagauuuccuuucaacugaaaggaaaagucgcagagggaugggagcugcaguuacucacggcagggugacaacugagugggcauucagguuuuuaacccaagaaugggcuuugaccuggccuguaccacucagauaacuaaacccagaaaauggcucuaucucugaugggaagggguaggagagagcauuggagagacuuuaguacacacacacacaaguguagcaaauucuccacacuaaacacuuccugcccucuucugcuagacacugcuagaaggcucuacgccauuccacuuccuuuauccucaagcauuugaucggugcuggagacuuccccacgcuuucucgcccucucagaggaggcuacucuaucccccaacccucgcuaaggagagccuacacugugagacagucacauagcccuacuuacacgaugucuugaagacggagcugacaaaggauaugugaggcuaagugucagcugcuuuuauagaggaaagcuuggccagcugcccacagccucgggcuauggagacaacgcucuucccuuccagag

SEQ ID NO: 1537 - RNA, 257 nt, Mus musculus
agaacuuggcgcucagcaugccgaugguggaggagcuguaccgcaacuacagcauccucgccgaugccacggagcaagugggccagcauaaagaugccuaccaagugauacuggauggcgugaaaggcggcaccaaggaaaagcgauuagcagcucaguuuauaccaaaauucuuuaagcauuuuccagagcuggcugauucugcuaucaaugcacaguuagaccucugugaggaugaagaugugucaauacgacgc

SEQ ID NO: 1538 - RNA, 2907 nt, Mus musculus
uuuagucaaaaauaccaaagccuaugugcuuggcccaaguaguggcacuauuagagggugcagcccuauuggaguaaguguggccuuauuggagaaaguuuuugacugucggugugggcuuuaagacacucauccuaguuccuuggaagccaguaugcugcuagcagccuucagaugaagauguagaacucucagcuccucuugcaccaugucugcccagaugcugccauguuccugucuugaugauaauggauugaaccccugaaccuguaagccagucaaaauaaaauguuguucuuauuagaguuaccuuggugauggugucuguucacagcaauacaacccuaacuaagacauccuaugucaucaacugauuccuuagguucuucauucuuugcuucuacuuuccuuuccucaacuggaacauuagugguggaugagucaggacuaccagcaggcauggcuccagcugcugaaccaggugcaccagccccuaagugacagaugaaccucucaaucuugauauuggccagggccuuuggaaacaaaccaggccagaaagauucaacauugaaaucagcaucuuuaaugagggcauugauuucaucuuucaugaccuucaccucuuggucaugcagaaugaggacaaaguagaugcaccccuaaaauuauuuuggugauacuuuacaacuguaauuuucuacuguuacaaaucauaaugaaaaugucugauauguagggcaucuaauauguaauccucaaagggguuguuaaccacauguugggaaacucuguuuuagauaaucaugguugcauuauccuauagucuaauccaucgauuucuucuuuuuauuguuauaaauaacacuuaauggcacaguguuuguguucuucacaguacuugucuuguagggucacauguugugguaguuuaaauaaaagcgguccccauaaauuuauauauuguaaugcuuggucaucaagaaauagcacuacuuuagaggauuuaugagauguggacuugguuuuuuuuuaauaaauguggcaaggagacuagauagggauagaguggaagcucagggguaaugacuuagcuauaaaucaagucuaguuuuuguugcacuaaaacuagagaaaaauauuucugcacuauggaugaccaccacuuacuuuuggaagauuugugggagcaauucaaaugauuauguagauuuuguggcuaaacuacaggacaaucugaggcaacagauucccaaccuuaggguuguguacccuuucacgggcuggccuacaaacuuguaaaacuaagauaauuacauuauaauucauaacacuagcaaaacuuacaguuaugaaguagaaacaaaaauaacuuuaugaaugggagccaccacaacaugagaaacuauguuaaagggccacagcauuaggaagguagggaacuaccaaucuauggaaacuauacuccaagcugaucucagggauauacuagcagagauucuggcuuuugguaaugccaguucagaaugucagaggguuguaucccaugacaagauacacaagaucuuugaaagauuauuucagagccugccuagaugugucuuucugcugugcuauaugucugcuuugucccuaggaugcccaagcacugcaaggcaagcugcucagaugagacagaacacaaucuguaauagggaucacaguccguguuuccccaguugagaaacagcaguggagucuaaggaauaugcugugguuccuagucacuuauguacccagauaccacuggcauccugcugaaagucuggaaccggggguggggucggguuuggggagggggugucagcaggucugugcuuucccucaggaugucuauacaucaggaaggaaacagaaggcugaccagaggaauggggcagaaucugguugguucugagugagugccaagaguguggaggggcuggaagacugaaggccuucucugggagacugagguguuacuuguuaugauaaaguccuccuucgucccccuguggggauccuugaugaaggagauggucauuguuuguccaaacuguuuuaucuugcucaggauaaaccagggauuaaauguguuuugccagaagaaugcccaggaagggaaggaagcucauuggcugaugaauugaugaacacuuaaggcccaucuagauaccucauguguauggauaacuccagaauuuuaugcuacaggacacuauuaugguccucucaguauggugucauuguuacauguuccagaucaaguaguuggcagggagcuggccccacacccagcagucucaauucugagauuccccaggguuuuaagccugcucagcccuacuaguucuucuguccaguggcauagucuacuuacuccacagccucccucacuuauaaugucacuguucuagaugucuccaggaaccaaaagugaaaacaaauauuuuacuugugacaacaugugucaaauaaaaaaggaaugggggaaagaacagaaaagaaaaagaaaaauguacaacaugaaauaggcaccuguauuaugggcccaauggggaaaaaaagguauugugauacuuggugugaguccaaauuuguucaacuuggcaaucauuugaaugauuugagauacucagcuuucagcccucuccccugaaccuugcccaacaaagcugggaaaucaacagaaugaaaauagagacauccacuaaagucaucaccauuggguccugggagccucuaacuucccuggagucugggacuuucuagcgucuacucccaguuccccauucuccacugcugcauguuuuuauucaauuucuugacccucuguacuucucuccugucccuuccaauaccugauccugcaauagagcaauuugcauu

SEQ ID NO: 1539 - RNA, 1643 nt, Mus musculus
caagacacuugguacucaagcucuggacuaaggagaaccuggugagucugacuucccaaauugauuugugcuuaugcuuucucauauacuuucauuugaagagacauggugguuccaaacucugagcaaguguaaaauguuagguacugagcuggagacauggaugagugauuagagcacuauucucuuccagagguucugguuucaguuccuaacaaccacauggugaccuguacugcuaucugaugcccucucuugauauacaggcauuuaaacagauacaacucucauagacauuaaaaaaaaaaaacuuucaagaaaaauguuagcuacugacuggccugaauuuaagcuguguaguaaagugacacacacuauuagguuguuuuugcuuugauguguaggugguugaugcccauauggaaaaucacggcaaucagaaugguugauuugaaaaagaugucagaacauugaauuuucauuuucuuacauuuuguugcccuuuacaaaggcuuaugucuuagcaaacauuagacuuuuaauuuuccuagacaucccccaaugugaacccuauccuuuuggauuucacaguugcugauaguaauaaugauugguuuugaaauuacuuaugguuucagaaaguggguuugauauucuugaacacauuauuuuguauaagcaauguuacccuguucuuugauaaagaguuauuucccaaugugggguauguaaccaaagaaggccuuucaaaauuaagugaaacaaaucacuaaauuggaaggaacauauaagaagugcuaauaggagaaguauuggggggguuaauguguauauauuagagaauuacuauucaauauucuauaaacuugagcuuucuauauaugagaaucacaucuucugagagaaaacugucauguaaucuuuuucagaaccuaagacuucagcauaaugucuuaccaacagcagcagugcaagcagccuugccagccuccuccugugugcccacccccucagugcccagagccuuguccucccccaaagugcccagagccuuguccucccccaaagugcacugagccuuguccucccccaaagugcccagagccuuguccucccccaaagugcccagagccuuguccucccccaaagugcccagagccuuguccucccccaaagugcacugagccaugucccccucccucauaccagcagaaaugcccuucugugcaaccuucuccaccaugucaacagaaguguccacccaagaacaaaugagguccucagcagucaucaugacaaggggaagagaagaguauccaucucauguacuuccauagcaacaccuccaucuucccuccaaagccauucauggaugccaagaaaccccuguacuucagccuuccaccuccaugugccugugauaacuccugaaaggaaagucauuucccuguuuuugcugucaagcagauacugagaauaguccuuccucagcgcuucacugucccagaugcucagaaggaagaguugcagcagucuacccuguucccacccaggacauuuuucaaaucuuucugacauuuugccauaguaguggucauuguuucuuauuuccugaauaaaaagaacaaucuuguugauuguau

SEQ ID NO: 1540 - RNA, 1643 nt, Mus musculus
auacaaucaacaagauuguucuuuuuauucaggaaauaagaaacaaugaccacuacuauggcaaaaugucagaaagauuugaaaaauguccugggugggaacaggguagacugcugcaacucuuccuucugagcaucugggacagugaagcgcugaggaaggacuauucucaguaucugcuugacagcaaaaacagggaaaugacuuuccuuucaggaguuaucacaggcacauggagguggaaggcugaaguacagggguuucuuggcauccaugaauggcuuuggagggaagauggagguguugcuauggaaguacaugagauggauacucuucucuuccccuugucaugaugacugcugaggaccucauuuguucuuggguggacacuucuguugacaugguggagaagguugcacagaagggcauuucugcugguaugagggagggggacauggcucagugcacuuugggggaggacaaggcucugggcacuuugggggaggacaaggcucugggcacuuugggggaggacaaggcucugggcacuuugggggaggacaaggcucagugcacuuugggggaggacaaggcucugggcacuuugggggaggacaaggcucugggcacugagggggugggcacacaggaggaggcuggcaaggcugcuugcacugcugcuguugguaagacauuaugcugaagucuuagguucugaaaaagauuacaugacaguuuucucucagaagaugugauucucauauauagaaagcucaaguuuauagaauauugaauaguaauucucuaauauauacacauuaacccccccaauacuucuccuauuagcacuucuuauauguuccuuccaauuuagugauuuguuucacuuaauuuugaaaggccuucuuugguuacauaccccacauugggaaauaacucuuuaucaaagaacaggguaacauugcuuauacaaaauaauguguucaagaauaucaaacccacuuucugaaaccauaaguaauuucaaaaccaaucauuauuacuaucagcaacugugaaauccaaaaggauaggguucacauugggggaugucuaggaaaauuaaaagucuaauguuugcuaagacauaagccuuuguaaagggcaacaaaauguaagaaaaugaaaauucaauguucugacaucuuuuucaaaucaaccauucugauugccgugauuuuccauaugggcaucaaccaccuacacaucaaagcaaaaacaaccuaauagugugugucacuuuacuacacagcuuaaauucaggccagucaguagcuaacauuuuucuugaaaguuuuuuuuuuuuaaugucuaugagaguuguaucuguuuaaaugccuguauaucaagagagggcaucagauagcaguacaggucaccaugugguuguuaggaacugaaaccagaaccucuggaagagaauagugcucuaaucacucauccaugucuccagcucaguaccuaacauuuuacacuugcucagaguuuggaaccaccaugucucuucaaaugaaaguauaugagaaagcauaagcacaaaucaauuugggaagucagacucaccagguucuccuuaguccagagcuugaguaccaagugucuug

SEQ ID NO: 1541 - RNA, 1397 nt, Mus musculus
cuuuuuuuuuuuuuuuuuuuuuuuuuuuuuuuuuugacagguacaaggaaggacuuuauuagugaggugggcaaaucacaaucaccacuacggaaucacacagcuaccaauuccaacuuggggacggacacugaauaauuuagucuagacucauaucuucuucuucgucuuucuugucuuuugugucgcccuccuuuggguccgauuuggcauuguucugcauggcuuuggcaaaugcuuccacaucaccuuuguuggcggccucaacagccucugcaggaaggccgaacuggcucaugagagggccaagcuguccugaggccaaggccgcacugaacauacccagggccugcuggaacuggggcgagguuaauguguucuggcucucaucugcagucuggggcagagacuccccagagggcagguagggcagcaggcgcuccugaacgucugcauuggcaaggaugggagccaugaucucuggggucagcacacucgccagauccacuugcuggcugccuccuggccaugccggcacguucauaguggccagaaugcucuggaggucgcucagcuggaugggcugggucgggcuggcugcugugcugguuccauuaccugagcugggugcggggcuugggcugguugccgaggcagcugcuggggcagaaggggcugggguggcgcgagcggaagagguggaggaggauggggugacggcugccgacuggcuccgggagcuggaugaagagcugcuggcuggagguccacugcuccccagcaagcuggccaggccuggcccagugagggccccaaguccacccaguccucccaggccggcugguccgaugagcugcauaagcuggcugugacucauguuccccaacaggcucugcaggccacccucaccgcccagugcugaaagcucauggccacuacucccacuugcucccagugacccaggcauggggggguuguucagacacucguugacuuuccggcagugcuccucaucuuggucagucuugggcuccugcauccagaagaagagccgcuuggacccugccuuaaacuugagcacguagacccucccacuggggcacugagguacccgcuugaacucacagucaucaggaaagauaaucaagucauccuccacggucccagagguccugucuuuccaacagaagugaauaagggagucguccgucugcuggauguacacgagaccuuuccguuuaucuggggugaccguaguuccuuuuaaugacauuuuuccugcccggaacuccaccaaauauuugguagaagacccccgagagccgggcaccaggcuugggaacagagcgccugaagucgucauccuggcggugcucacacucggccuaggggccugg

SEQ ID NO: 1542 - RNA, 1348 nt, Mus musculus
caacacacuugguacucaagccuuggacuacagagaaccugguaagucugacagucugaaguuaucuguauuuauggccuucuggcauauuuuaaauuguagaagcaguuuggugcuuccaaauugguaucauggauuaaaucacaguuauaaaugugaaauguaauaauguuguagagugauacacuauguuaucuuguuuuugcuuuugugacuagguguugaugccuauagaaauaccaagacaauagggaaggguugcuuugaggaagguggcagaacauagaauuuguuauuuacuugcauuuuggugcccuuuaaaaaagacuuauguauuagcaggcauuagacuuuuguauuuucucaggaguccuuuuauaagaacccuaaauucuggaauuucacaggugcuagucgugaaaaaaaauuggauuugaaauugcuuaggauuucagaaauugggacugcuauuaucaaauauguuauuuuuugcaaacaaugcuacuuuguucugugcaccagagauguuucuggauaugggguauguaaccaaaccaggacuuacaaaguuaaaggaaaaaaaaaucaugaaauuggaacggaauguuaagaacauccuaacagaacagaagagcugggggauuaauguguguguaugagagaauuacaaugccauauucuaaaaucuugagcuguuucuaugagaauaaccuuuugugagugagaaauaucauuuaaugucuuucagauccugagacaucauaaugucuuaccaagagcagcaguguaagcagcugugucagccucuuccuguguacccacccccaaagccuuguucuccuccaaagugcccugagccuuguccucccccaaagugcccugagacaugcccuccucagccaugccagcggaaaugcccuccuguccuggaggcaccaugccagcagaaauguccauccaaaagcaaguaaaagcuuuagcaaucaucaagaccaagagaagagaagagaauccauuguguacuuccauaacaacaccucuaucuucccuucacaaccucucauggaugcagaagaaucuucuccacccuucaccccccuuccaugcgcuagugauauucucugauugggaaggaauuucccugaauguauuccucugcugcugucaagggacuguuggaaaugguccuuccuuuguggccuaguauuccugauggugagaaggaagaauagcaaguggcaucuuaaugccuguagaggggcuuucucaguuugccucucacuuggccaggagugagacaauucucacugauguuucuuuuucugaauaaacaauuucagugauggua

SEQ ID NO: 1543 - RNA, 2061 nt, Mus musculus
gugccagaggaauuuucuuuuaauugcuugggaagggugaugggaaagggcgucugggcgugccgccuagguuuccagcagggugauguagacacaugucagcgaagaugauuagacaguuuagaaguagauucuugucagagauggaaacugcaacugcuaauuaagaagagcuugggaucgaggaagcuguagacuacuaaaugcuucuuuuccaagucugaaguauggcugcauccagaagcaggggugagcccacagauggcugauaauggagggaaugccaggugcugaccaagaaagacaaacuucauguucugucuuccugggaguucuccucuggccgaaagcugaaaguucacuucugcuuggacuucuggcacugcuggggugguggacacuucugcuggcacuugggaggaggcuggcaaaccugcuuggucugcugagguggggggcagcacugcugugggggagcacacugcugggguggagggcagcauugcugugggggagcacacugcugggguggggggcagcauugcugugggggagcacacugcugggguggggggcagcacugcugugguggggcacacugcuucugcuucugcugagacauucuugauuuccaacuagaaacaaacacaaagaaugaaaaagacugauccuggggccaggugacuuuccugucaaucacaugcuauugcuugaccaugaccucauuguuucauguauuugggggaugugugugugagugugugugugugugugugugugugugugugugugugugugugugugugucugugucugugucuggucuguuugucugugugaguguugcugugugugugacuuugguacauauguguauguguguauacacuuccauacuugcuuacauuuuuacauguuaaauuuaauuaaaugcguguaaacuguuucagcuuucugaaaaaaaaacaaggggucgaugaagggaggaaagaaagauaaagaaggaggaaaauguaaaaaaaaaagagagagaagaagaaagacaucaagaaagagaaaggaaagaagaaauauagacagauaaauagcuauauauguuauaacaaaaaccguggcucccaagacagaaguucauaagaacugaauccuuucuaaacuccuacagccuuuugguuuucauccauguguuuuucuguaccacagaaacccuucugggguugcuguuuaaaugagcagauaaugcauccaagcuugccaauauguguugauguguguacuagcacucauacauagagguucuaacacuuacuuagcauagugucaacuuagaaaguaaauguguaaaguuuuaaaauaaacaucuuaaccauucuaaaaggaaauuuuuagaacagagagacccagagguagaggcaaugaaucauuugguuccagacccuugaauauucagcaauucagaaaagcaaggaggcacagaugcacaggugggaguaggaggggucucuuggucuacagaacagggaccuuuuaaagguuucauuguccugucccugcuagucuguauuucugggcuuccccuccucugaucugagccauccaauuucuuuucuuuccuggagguugauuuucucccugaagggugguccugcuagugacuacccagagcuugcgcuccuugccuucggacuccuccuuagcaucuggcaugcuacaaucccacaccaugccaguagggccuguaggacacuauuuuguagggucuucuucuguuucagcccagucuccccaaaucuucagucaggugacuugcaggaucaagguagacugguauaaaaugauagggaagacgcagguguccagacaaagcuucccuuucugaccacccagagcucccaccucuacuccaaggagaugaacuauacagggagccaggcggcggugaggaugcuaccucaguggacuuaccagaguucagcagacuggagugcagagauagagauguuugggacacucucaguuggcccaccuuuuauagaugucacaucucugcccaaggccaug

SEQ ID NO: 1544 - RNA, 5210 nt, Mus musculus
cagagaaucuugggggagaguauuaugaugucauaaaagagcugagaguuuagaggggagggaagcagagcacuugggucagaagacuuugacuucugauagccauggacucacuagacugcugaggaagacccagcaucuauucaaucugcugaaacauccaggaaacuacuuuuaacaccgagaaucaaguauggaaaugcugaacuaagaagagcccaaggaagaacuguguugccagaucagguaacacauacaagccuugucuuguugggucuucuuuuucugacuuguuccuuuagucaucauuuaaugauguccacauaacacuacauagcauguaagauauuaaaacaguagcaagacgaaaauaucugugcugauuaaagagaagcagaaaaucaacugugggaguacgguuauaaaacacuaacagguuaacauuuggugaaaggaacuuuaaaacauacagacuuagcugacgggucaaggaaguuuauuugagugauacuuacagagauccucugauuugaauaguauuuagugagagguuagagugaagaugagagagauucuuaauaaugggaagccauucaaugauccuaaaagguugcaagcagaauccaggagccaucucuucugagccagccugcuaaucuugagagaacaguagccauagugagagaggaugcccagagagggcagcccuacuaggguuuuaaugaacuuggauugaggucaauccucacuggagcauaauagagaaggacuugaagcagcagcccuggaccugcaccuugggguuaagacaguggacacacuucugaggcagcuugugaguagcugccuuaagaaggggagauauggagucaggagaagcuuguucugaggugaagcagcagguaguaguaagguuuuacauguaggagucuucaagaggguuaacuauaccugcaaaaaaaggagaaauaccccucuggaggggaagaggguagucagaauccaacuaaacaaaguauaacagacuucuuguuccaguccauaagaugauggcugcagagcugauuugggauggacuuguauccagugugguaagacugcucagggauuugucauugucuccccaugcuauagugaacuagauugucucuuagccuauuugccaaaugguguguguguguguguguguguguguguguguguguguauguguguguguguguguguguguguguguguguguguguguggugggguauagcuagagaggucuguacugggauaagaaaugcuguuauagaaacagccugucuagaccuagagagauggauggauccuaacaaucugaacuucucaggcacaaggaaggucugaauuguucuuucaguauacuguccuucaauuuagaagagagggagagagagagagagagagagagagagagagagagaggugggggacagggagagacagagacagaggcagagagacacauagagaaauagaggagauagguagagacaaagaggcagagagaauaaauaguggagcaggauaaacucagagaagcuauagagaagcaacacaggguuuugaucguccucugagacugcccucagguugaagcccuuaaaggaguauaugcaaacaaggugaagaaacagauaagggacuucccacagauauauaccuccuaacucacugcauaaggcugcauaagcuccagaacaugaacuuugugcagaauuacucaauuucucucuuucucucucucccucccucccucuccccccccacacacaaacacauucacacgcacauucauacuuucgcucucucccuccaucucucucuuucucucucccacacacacacacacauucaccucucucucucucucucucucucucucucucucucucucucucucucucucucucucacacacacacacacacacacacacacacacacacacacacuuauauuuucugugaaauaucuuuaagccaagaugguagagacuuagacacaccucucuuuuuccuggcugcccuagugucuucugcuaugcuaauaugucugucauuuucuguuugucuccuuauuacugaccucaaucucaggcaagucugggcauugcuaggcagcuaugccagcucagccccuuugugacaucgccugcccagggagggauuggaugacuuaucccacccucaccccuuaguaaugcugcuccaggaucaucuuuuugauaaagaaguagaaguuucuuaacaaagaacaaaaagcauuuauauuugguaggcuuaguuacaagagaaaaaaaaaaucugucccucaaagucacacccuuuccaaauggaaacaguccugacaguucagcuucaucacuaagggagaaacucaggagugugaaggacugauauccaguagauuuucucccuucacauuuccgucacuauugcuacuauggaccaggggauucagaacauccuugggccuaugaaagucuucacugucuacauccaggaauacagaagaucuuccucauaugccagcgauucuuccuacauggaaagcucagaguaaggaucacaaaguugaguggagagagaacaggugggacuuggcaauuagcuugacagucagaaagucacugugcccacaggguggagguaucagacacaccuaggcucauugagacccaguuugucaaguguaaacuggauuuaggucgagcucccagauggaaaaggaaugagucuaagaaccugacacccauccuccaggacagccaaggccuugugucugcuaugaugucauaaaaagugacuuauggcaauauaggucaucuuaaaggugucuuuaguaaccaccaaauugaagaacucugcacacuuccagggcuuucuuccuaggguaauaaguaauaucugguaaaaauaauuuguaguuucugucuccaggaguuccugaaucuucuggacaacagaacaagaagauagucuaaguauuagggaaaggaaaggauggaauauagguggaaggguccacuccaggagacuaaaaccuuagcagagcagacaccauuagaggaguucuucacccaggucucaacugaagacccuaaugagaaaguguaauuaaucucaacuugaucuagcucacaggcacucucacaaagcucaagcuaauucccuucuuguaucaugauaaaaugaauuguuauaaaagaacaugaacagacacacacacacacacacacacacacacacacacacacauggauaugcauauauauaaacauaucaauauuuggcaacauuuuaaaaguuugugccagagggugcuuuuugaaaaaaaacucccugugggugccacagguugggagaguggcuguacacuuaggcagucacuacuccaacaacaucugccuccaccugggugacagugcucugacaggccugguaccuacccaacauggaugugugguugucugaacugaguaugcauuaacgguguacaaaaacauccugauuccuuacauaucuccuuuccaguuacaugacaacccuagacucucugccuuuggauucuuagucacuuuuugaccugagcugaaacaaaguuauuugauguuucacuauuuaccaaagaauaaaaucacuguaaaauuuuugaaugguuucguuugaggucucuccaaggucaaguuccuuccuccuaacccuugaugcugcuuccuaagagaaaacagcuagcagaugugaauggagcugccucaggcuauggcuuauagagcuaaaccuugcacuuuagcccuuguaaugcuuggggcccugacuuaucagugucuucuugcugacacuagccaguggcccauguuacaaggcuaauggcaugaucugggucuuucauaaagccaagugguggcucugagaauccuauuuuaccuagguuccuagaaaccacauuuagaccugaauauacacaugaucuagguaagacagaacauauuuuaaaucuauuuacaaaccacugaaguagaugucugaauuucaguugccuucauauuuaaaguagugaauaaagugcucaccuuuuacauugguguaaucauaauuagaugagauaaaacuuaugaugugacucaaaaucagccuaaaggucucuuuacccuugacuaagaaucuuuaagcaaauuuaucacauauucauaacuuuauauucuuuaucugaaaaguggcuaucuaguaaggaucagacauguaaacacccgugacagcauggaugggcacuaucuguguggccuuugagagggccagcccuacucaaccaaggucuuaguuuuuacccuggagauuuagaugcauuuugagaccaaagaagaggauagcauuugaaauguaaaugaagaaaauaucuaauaaaaaauugaaaaaaaaaaggaaaaaaaggucaugaugaaagucgacuuccagauagucauuugaauauuuuuuuuuaucccuaggaacuccaacucuaaagaagaugagugauccauccaaaaccaaccagugccccccuccaugcugcccaccaaaaccauguugcccaccuaaaccgugcuguccacagaaaccaccuugcugucccaaauccccaugcugcccacccaaguccccauguugcccuccaaagcccugucccuguccuccccccugucccugucccuguccagccaccuguccuuguccgcugaaaccaccaugcugcccacagaaguguucgugcugccccaaaaagugcaccugcugcccacagccaccuccuugcugcgcucaaccuaccugcugcucuucagagaacaagacugagucagauucugauacaucuggccaaacucuggagaagggcucucaaucaccacaguccccaccaggugcucaaggcaacuggaaccagaagaagucaaacaaauagacugucccugacaccaugcccuuuuucaaaggguauaggauuacuacaggucaggcuaagacuauguuguaaagaugcuguuuucacaauaaccaacaaguccacucaaccauaagcuaccauuucgaccuaacuguaggcuacuauugcaacuggaaauggaagguagaaaaggauagaaacaucuugucuagugauccugacauuuagauagcaaagaaauaaaagagcaaauaaaaaga

SEQ ID NO: 1545 - RNA, 1705 nt, Mus musculus
cauucauacacauccugaggugcccaaggaucuuguacugccugucaucuugguaaguguucacuggggacaagagcauggccuguaccagaaggaagcuaagaggagaucuggaggacucaauagccuacagaacugacgaacauagaacaugggaugggggauggaaguguugggggaagguaguggggaaauacacuuugauucuauggaaagcaguagaaggagcuggguacuucugauuuugaaucagaagacaauaauaugcccuuucauggaguaacccuucaggaaaggauccugaaauacagaaagcuuuugaccuugguaggcuucaggaggaagaggaggggcuucugguaacacagcccugggauaacuuaggaaaaaaacuaacaaggaggacagagcagccaugaauuggaauuucaucacaggcugcucagaacuuuuaagacauaccagcacaagacuuuuuaugucaaugaccagucaacaugggauguuaaguugaguucagacuuucuggaaaggagggaacagaccugguucaugcuuucaggaaugagauauguauuuuaugaaauggcauuagaacacugaucaguaaucaccauuuucuucucugaaaaaaauucacuauuauaaucaguuucagaagcuugaggaaucugugaaaaucucauccgaaucaccauauggcauauugccauagaucaaguccaauggcauuuuaaaacaugucauucagaauuguuacuuggaggaggaaauuauucugaauauggcuccagacuaugaaaucucucaacuugggggcuguuauaggagauuguauuuuuaaaaagaauaagaaccuguuuuguuuuguuuuuuuccugucaaagcuuauaagaugauuugaucuguaggccagaucuggggguuugauagaaauaaaauuacugacuaugggguuucuaugacuaucagugguauuuagagguggauaggaugaccccaggauccugguucuaauuugcauuaugauucuuccacagccccagagcauucaccagcagagauguccugccagcagaaccagcagcagugucagcccccucccaaguguccucccaagugccagaccccaaaaugcccuccaaaaugccccccuaaguguccucccaagugccccccugugucuuccugcuguagccuggguucuggggguugcuguggcuccagcucugggggcuguugcagcucuggaggcugcugcagcucugguggcugcugcagcucuggggguggaggcugcugccugagccaccacagaccucgcagaucccuccgucgccaucgccauagcucuggauguuguagcagugguggcagcaguggaugcuguggcagcagugguggcagugguggcugcuguggaagcagugguggcagcaguggaugcuguggcagcagugguggcagcaguggcugcuguggcaguagccagcagucugggggcugcugcugaccugagcaacuaacacuuuagacuuccauucaggaggaagccauguucaguggacccucccuggccugcucuucucuccugcugcucucuguguccugggcucaaagaugcuguagucuugugagauguccccuuuugaaggaccuguauucucagggacaaaguaauaaagugcuucucucacaaucuucu

SEQ ID NO: 1546 - RNA, 1902 nt, Mus musculus
auuuucuuuuuuuuuuuuccauucauaaaacuuuuauuccacuuacaugaacuuuaauacauguguucuuaacaauuaugcuuggauuguucaugaaaauuucuuaagacauuaaaacaaagcuagccgucaucucaaguuauuucccuguuaacuauuuuuacagcacaugcauguuaggcaaguaucaaaaagaaaaaaaaaaucacaaaagcaaaaacaaaacaaaacaaaaaacuuaaaaaaaaaaaaaagaaagaaagaaaaaguuaaauacaugggauuuuguuuaccgcugugcuugauacguauggagccgggcacaccaagcaacucguuuuuacugcaucuuuacuuuuacauuuguucuuagauugccuaaaacauuuaaauacaaauaaaauguguagcaaaaauaaugaaagcaaacagcagguaacuuuacaaauaauggaaugugaaccguuucugcccuuaccagaguaaauugggucacgacuuugucuagagacaucuucuggagcuguggucaagagugugcacgcagacacacacgauccuagcgugcauccacaggguguuugugucacagccucacaagugcuccaggccuuacaguacccacaaagacuacacucaugacuggaacccauuauccugauuauuccccgccagcacacaccaauauguaggcaguuuucuuugcuuagacauggaagcaguuuuaacacuggcccuucugaagccacaauguaccaaaaguacuaugccaaacauguguaacucauguaaaaauuccacaucccauauuggccaccucaagaugaaaaugaguaacucccuaaaguuaacuggcucuacuccccuaauauuaaaacauaaaaccacaugggaaauauagaaauucaaauagaaguaacauaaaccugucauaaaucguaaacaaaaaaacuaucugugggacagcauggaugacaaauggucuacuguguaaauuuuagaaugaggcagacaaagguuggaaggccgguuaauuuuccccuccuucuccugcuucugcuucaucuccuuggguauccgauguccacaauguuaaguugucucucaguaacugcauuauuagcgugcugucuuuguacgacucuucacuuaauguaucaaguucagcaauggcuucaucgaaagcuguuuuugcaagagagcaggcuuucucuggggaguucaggaucucguaauagaacacagagaaguugagggccagacccagucugauggggugugucggcugcaucuccuuuuugcugauuucaaaugcuucuugguaugcuugcugugacugguccacaauuccuuucuugucaucaccagcagcaaccucggccaaguaacgguaguagucacccuucauuuucaaauagaagacuuugcuuucugguugcgaagcauuggggaucaagaacuuuuccaaaagagacaguacaucguugcagaugucacgcagcuccgucucgaucuucucucuguauucucgagccaucugcugcuuuuucucagcaccuuccgucuucugcucaauacuugagacgacccuccacgaugaccuacgggcuccuacaacguuuuuuauaagcaacagagagaagguuucucuccucauucgacagcucagcucccugcucagugacagacuucaugcaggcugccaugucaucauaucgcucugccugcucggccagcuuggccuucugcaccagcucauuuuuauccauaacuggauauucuguguccggaguggguggcggcacacggacgcggcucggcagucucugggcggcggcggcagcagcgguggcggcgaggcugagacucugucccugaucuggcugcucacaggcucucucu

SEQ ID NO: 1547 - RNA, 967 nt, Mus musculus
cauccacagccugcucagaaagucuccuaucaccuucccaucugguaagcgcaugucuggggccauucaucaucugggacugugugggacagcaugccugccauaucugaucucuucuagacccuaggaagaggcccagaauaggccauggugggggggauaauagcgagggaggaaggaguguuuggcuuacagucagggaucuaggaguccuauaagucacauuguucugagugcauuuauuagagaugcucguggaucuaccuuauagucuugaaaauguuuuauuuggauagacaugugccuucgugguccuauuuauuucauagagaucuuggcuuaggaagcagauaggucagggaaagcauguguuugacagacugucaguagacacucaccagaagcuucucccuauaauguuucuauccuacucuucuagguccaguuccugccgagauguccugccagcagagucagaagcagugccagccuccucccaagugcccuuccccaaagugcuccccaaagugccccccaaagagcacaacacagugucugccugcagccucuucgugcugugcuacaagcucugggggcugcaguguccccagcucugagggaggcugcugucugagccaccacaggcgcaggucccacagaugcaggcgcaggagcuccaguuccugugaccguggcaguggucagcagucuggggguucaggcuguggccacagcucugggggcugcugcuaacuugcauccugaguuugagacaaaaggguuuggaguacugagcaguagugccauguuggcuuguucuuucuucagauaucagaaucugucuugggcucuguguucuugagcucuucuaauggauuucccaaaagccugguugcuucuccuucucaugguuccaucaccuguguccaaccauguagaugaauaaaauucuuucucaauaucacca

SEQ ID NO: 1548 - RNA, 5811 nt, Mus musculus
cccgaccgccacuccugucccagccaccgucagccacagucgcagccggaccucgcuccucaacuugguaagcauaaguuuuugaacuuuuuagauuuuuuucuuuuuaaugaaaacaacaaagagcuacgcaugcucuuggcuggguguaucuuggacuaacguguggacguggcagaaaauggaucgggaagaugaaacugugggaggcaauuagagaagaguggagggcacgaggaagcccuaaaauuacacccuaauaacagccuguggggagaaacggcggucuuuuguucucccgggcaaaauaaguucuaggcugggugcggcugccuaacuggccugagcccgggcugggugcggccgcuagacucccuggggccgugagccccugaacccaaccaguggcggccgccagagagcugcagacucagugagaacuuggggcagcgucgcuaggcguucaugaagacuagaaagaaagcgguucagaacguagccuuccugaauucugggggacucagcugcggggaaaccgcaggcaaacagccaagacauacagaugagaaaccggagccuguugcagccauuggaaccacagacaggaaugugggaggaggccagucccucccagcucgcucuuuuccucucccccuuacuccacucccagccaucuuuuuagccacucccuacaucaccugccugucuccuaccugcuacuucaguuccccucguuucuuuaaaaaauguuuccaguaauucacauccccuccaaaaucuaccccuuccuuugacucuucaaagaggaucagcaaauguuggagagaggcccaagugcguuuuugcccuagucccaaacuaauuauagauuuuuauguuuuuaaaugguuggaagacauucaaaaggaaaagaaucccuuguaaugcaugagaauggcaugaaaaucaaauguauagaguuuacaggcaccgccacacccuuuugcuuuauguauccucacccuugcugccugacuauggcaagagugauaagaucuuauggagcauaaagagcuaaaaaauauccacagcugucccuuuauugcaaauaacagcaacagaaagcuugcggaccccugcuuuggugugucagucuuucaucacuuccuacuuauuguuuccuucuuccccuuuucaucacacaggguaccuagggcccagcaccaacagguuaugaggugaaaggagauagaugagacccugaacacuugaaggaagagcuuuggugcugguugagaaagagauaguuggugugguucccucuuuuucacauauuucugucaaggggaagcuucccuggaacguuggguguuuagguugcguuuuaaaaggaucucacugcguccuuucacagugggguuuuccuugcugucacuguucccaucaugcaaaagggcgauggugugggccgugcccucucuuucagccgcugcuccacaugggcaaaaccuucccaucugagcccucuguucuaagggaaagaagaaaggagcaucuauaggccuggaaccuccuccccagucuagcgaguccuccgugccaacucuccugcuaucaugugacacacuaauaaggcagcuagauuuuaguucugauaggaagagcauguuguguaaacacuuguuucuaggcugugguguuugguguuucccccccccccccccccuaacuuaccaauaguuuucucuccuucagacucuuuagaaagaacuuaucuccagaagaagguucagguacucugggcauuccuaggugcagugagccacagcagugcaauuuugauaauaagcugcuuaagauagguguuaggaacggggcaugguggcgcacgccuuuaaucccagcacucaggaggcagaggcaggcggauuucugaguucgaggccagccuggucuacagagugaguuccaggacagccagggcuacacagagaaacccugucucgaaaaacaaaaacaaaaacaaaaacaaaaacaaaaaaaaaaaaaaaagaaagaaagaaagaaagaaaaagaaagauagguguuaggaagagaggcugcggggcugccagcuuuugucaucuuuagcaugugcuguugcacagccugaaagcuuccaacuuucguauccagaaaguccgucuuagagagcagucaaaaacuaaauacuaaauuacauacauacauacauacaaaucauaguuaacaucaagcgagaaagugucagggugugguugacagggucuaggaaacccugcaguugcgcugcuacccacuagggggagcacaacggaucaauucuggauucugggaacagaucucaaccaggaugacucaacucaguagaauuuccuuuaggaauucugcugugggaaaagcagaguccggcacagaacuugaaugaugcucuuccuggugcaaccacagcuuugguuuaacucuguguuaagacauuccagccaccauuccuuuggaaaugaguggcguuuggaugaaacaaaggcagaacucuguagaaaggaaccuuguagccgagagccuaggggugacgcuacccugauaguugcccucucaugccuuaguucugcacaaguaaaauuagugacgucuagcuuucugcuuuacacacacacaauaaaucuauaguuucacuagguagcccagguuaacccaaacucuugauccuccaaggguauaugcacccccacaccuugcugaauauacuuucgaacgucuaaaauguccucucuccucccccccccccccccagugcacgauuacagaugugcuguucauuuucuucagagaaauucaugagaauuacuuuagggcaucucauucaaucacaguagccucuuguggaauaggucacucacuguaaucucccuccaaaguucagaacaugugugugcagauuccuauagucauaugaacagauuauucauauguuuucucacacugucuaagaauaucagaaaaguucucccuugucugagucaucuaguguuucuaagcacucggaguucuguguggaauaccuuacugcaugcacuggagcuaucaaaaggaagcucacaaaauaucacuugcuguuugccucucugaccccugauaaaugaacaagacugcaagaaacugcuucagccaaagaugaggcacugcgcuccucuggcacacucuauucucuagccuuccuaauucucaaauaaggagaauauauuacaauaaagaagauuaaauuuggauuauaauucaaaauaagaaaagaauucaauaggggcaaagaaaaauauaggaaaaauaguuuacagcgauuagaccaauauuuauauuacaguaaauggcucaaaacuaaauacugcauaauucuauacacuagaaaaaaauuuaaauauaaacauacauguauauuuaaaucaagaaaauggaauaaaagggcauacguuaauauucaacccaagaaaacugggugaaguacacucuuuagguacaguaauucucgaaauauuuuuaaccugagcccuccauuuuuguuuuccccagaagcaaaaaugccuacagagacugagagaugcauugagucccugauugcuguuuuccaaaaguacagcgggaaggauggaaacaacacucaacucuccaaaacugaauuccuuuccuucaugaacacagagcuggcugccuucacaaagguaucugucccagcccccauacccugacugcuuacugcacugaacaggagcccagcagaauggccuugcaugaaacagccuuacuccagucacaugguuguaacuaaacaucuuacucacuugaaauauggcuaaugacuuucuaaauugaucuaaauguaaauguagagaguggcuguguguguguguguauuauaggacauuugaacauguuucuaguuaggguguggcucagcccuuaguacacacuuaaucccuugagaagagagaggaaaggggagcuacuugaaggagagacagacaguacaagaagagaguacagugcaggaauacaguagaguucauugagagcagugcaguagcguugagagggagaguggagcagcagagagggaggaggagacaguuuaacugggauaguuguacagaaacacguugcaagagagaacaagcuggacacagguaaagacagaaugagcaagagaaugagaaggagccagaagauuagaaaagauugcuagauuuaguuugaaaccaagcggagcaauucggaggcugacagaaaagcuaaguugaauaagucauuugggugagcagcuagagccagaacaguugaguugaccagccaccuggaguucagaaagaacuagaaggggugaacuuacugagcagcaagucucagaggcugaaaacauucuaggccuagauaagauaguauggaggcuagaggcuuccaggaugaggccuaaguuggcaggcugaagcaguaagccuucaagaugacaauuacaucagauuauguaacguguguauguguguguguguguguguguguguguguguguguguguaugugucuguguaucuguguguguguaugugugugucucuguaugugugugugugugugucucugugucuguguguguauguguguguguauguuggagauggguggaagaugaagcuucuuauguaacgugugugugugugucugugucucugugugugugugugucucugugucucucuguguguguguguaugugugugugugugucucugucugugugugugucucugugucuguguguguguguguguguguguguauguuggagauggguggaagaugaagcuucuuauuuaacgugugugugugugugugucugugucucuguguaugugugugugucuaugucucuguaugugugugugugucugugucugugugugugugugucuguguguguaugugugugugucucugugucucuguguguguguguguguguguuggagauagguggaagaugaagcuucuuauuuaacgugugugugugugugugugugugugugucugugucugugugugugugugugucugugugugugugugugucuguguguguaugugugugugucucugugucucugugugucugugugugugugugugugucugugucuguguguguguguguuggagauggguggaagaugaagcuucuuaggcaggaccuguaacuuucuaccucaagccacucacugccucgugguuuauauaugggaguugcauccaacacuuuccaaaguugaauaacccuuaacgucacagaaagaacauaggacaaggaguaaagaagucuggauuuguguccaggucugcugcuaaagcaggucgcucucaauaaccccuucccggacuuucuacuccacugagaauaaaauguggcagcauauuaagaggcaccgaagaaagugaaauauaaagaugucauuguuuuugcagaaccagaaggauccugguguccuugaccgcaugaugaagaagcuggaccucaacugugacgggcagcuagauuuccaagaguuucucaaccucauugguggcuuagcuauagcgugccaugauucuuucauccaaacuucccagaagcgaaucuaauccucuuaguucccauccaaccaccaagucaucaccucccccgaccccauccacaccugcacugagcccagcacaccuaccacaacauguaucccacgccugcuggcaaaaauaaaacaaugccauuuuuuuuuaaauguacacugagag

SEQ ID NO: 1549 - RNA, 5811 nt, Mus musculus
cucucaguguacauuuaaaaaaaaauggcauuguuuuauuuuugccagcaggcgugggauacauguugugguaggugugcugggcucagugcagguguggauggggucgggggaggugaugacuuggugguuggaugggaacuaagaggauuagauucgcuucugggaaguuuggaugaaagaaucauggcacgcuauagcuaagccaccaaugagguugagaaacucuuggaaaucuagcugcccgucacaguugagguccagcuucuucaucaugcggucaaggacaccaggauccuucugguucugcaaaaacaaugacaucuuuauauuucacuuucuucggugccucuuaauaugcugccacauuuuauucucaguggaguagaaaguccgggaagggguuauugagagcgaccugcuuuagcagcagaccuggacacaaauccagacuucuuuacuccuuguccuauguucuuucugugacguuaaggguuauucaacuuuggaaaguguuggaugcaacucccauauauaaaccacgaggcagugaguggcuugagguagaaaguuacagguccugccuaagaagcuucaucuuccacccaucuccaacacacacacacacagacacagacacacacacacacacacagacacacagagacacagagacacacacacauacacacacagacacacacacacacacagacacacacacacacacagacacagacacacacacacacacacacacacacacguuaaauaagaagcuucaucuuccaccuaucuccaacacacacacacacacacacagagacacagagacacacacacauacacacacagacacacacacacacagacacagacacacacacacauacagagacauagacacacacacauacacagagacacagacacacacacacacacacguuaaauaagaagcuucaucuuccacccaucuccaacauacacacacacacacacacacacacagacacagagacacacacacagacagagacacacacacacacauacacacacacacagagagacacagagacacacacacacacagagacacagacacacacacacacguuacauaagaagcuucaucuuccacccaucuccaacauacacacacacauacacacacagacacagagacacacacacacacacauacagagacacacacauacacacacacagauacacagacacauacacacacacacacacacacacacacacacacacacacauacacacguuacauaaucugauguaauugucaucuugaaggcuuacugcuucagccugccaacuuaggccucauccuggaagccucuagccuccauacuaucuuaucuaggccuagaauguuuucagccucugagacuugcugcucaguaaguucaccccuucuaguucuuucugaacuccagguggcuggucaacucaacuguucuggcucuagcugcucacccaaaugacuuauucaacuuagcuuuucugucagccuccgaauugcuccgcuugguuucaaacuaaaucuagcaaucuuuucuaaucuucuggcuccuucucauucucuugcucauucugucuuuaccuguguccagcuuguucucucuugcaacguguuucuguacaacuaucccaguuaaacugucuccuccucccucucugcugcuccacucucccucucaacgcuacugcacugcucucaaugaacucuacuguauuccugcacuguacucucuucuuguacugucugucucuccuucaaguagcuccccuuuccucucucuucucaagggauuaaguguguacuaagggcugagccacacccuaacuagaaacauguucaaauguccuauaauacacacacacacacagccacucucuacauuuacauuuagaucaauuuagaaagucauuagccauauuucaagugaguaagauguuuaguuacaaccaugugacuggaguaaggcuguuucaugcaaggccauucugcugggcuccuguucagugcaguaagcagucaggguaugggggcugggacagauaccuuugugaaggcagccagcucuguguucaugaaggaaaggaauucaguuuuggagaguugaguguuguuuccauccuucccgcuguacuuuuggaaaacagcaaucagggacucaaugcaucucucagucucuguaggcauuuuugcuucuggggaaaacaaaaauggagggcucagguuaaaaauauuucgagaauuacuguaccuaaagaguguacuucacccaguuuucuuggguugaauauuaacguaugcccuuuuauuccauuuucuugauuuaaauauacauguauguuuauauuuaaauuuuuuucuaguguauagaauuaugcaguauuuaguuuugagccauuuacuguaauauaaauauuggucuaaucgcuguaaacuauuuuuccuauauuuuucuuugccccuauugaauucuuuucuuauuuugaauuauaauccaaauuuaaucuucuuuauuguaauauauucuccuuauuugagaauuaggaaggcuagagaauagagugugccagaggagcgcagugccucaucuuuggcugaagcaguuucuugcagucuuguucauuuaucaggggucagagaggcaaacagcaagugauauuuugugagcuuccuuuugauagcuccagugcaugcaguaagguauuccacacagaacuccgagugcuuagaaacacuagaugacucagacaagggagaacuuuucugauauucuuagacagugugagaaaacauaugaauaaucuguucauaugacuauaggaaucugcacacacauguucugaacuuuggagggagauuacagugagugaccuauuccacaagaggcuacugugauugaaugagaugcccuaaaguaauucucaugaauuucucugaagaaaaugaacagcacaucuguaaucgugcacugggggggggggggggaggagagaggacauuuuagacguucgaaaguauauucagcaaggugugggggugcauauacccuuggaggaucaagaguuuggguuaaccugggcuaccuagugaaacuauagauuuauuguguguguguaaagcagaaagcuagacgucacuaauuuuacuugugcagaacuaaggcaugagagggcaacuaucaggguagcgucaccccuaggcucucggcuacaagguuccuuucuacagaguucugccuuuguuucauccaaacgccacucauuuccaaaggaaugguggcuggaaugucuuaacacagaguuaaaccaaagcugugguugcaccaggaagagcaucauucaaguucugugccggacucugcuuuucccacagcagaauuccuaaaggaaauucuacugaguugagucauccugguugagaucuguucccagaauccagaauugauccguugugcucccccuaguggguagcagcgcaacugcaggguuuccuagacccugucaaccacacccugacacuuucucgcuugauguuaacuaugauuuguauguauguauguauguaauuuaguauuuaguuuuugacugcucucuaagacggacuuucuggauacgaaaguuggaagcuuucaggcugugcaacagcacaugcuaaagaugacaaaagcuggcagccccgcagccucucuuccuaacaccuaucuuucuuuuucuuucuuucuuucuuucuuuuuuuuuuuuuuuuguuuuuguuuuuguuuuuguuuuuguuuuucgagacaggguuucucuguguagcccuggcuguccuggaacucacucuguagaccaggcuggccucgaacucagaaauccgccugccucugccuccugagugcugggauuaaaggcgugcgccaccaugccccguuccuaacaccuaucuuaagcagcuuauuaucaaaauugcacugcuguggcucacugcaccuaggaaugcccagaguaccugaaccuucuucuggagauaaguucuuucuaaagagucugaaggagagaaaacuauugguaaguuagggggggggggggggggaaacaccaaacaccacagccuagaaacaaguguuuacacaacaugcucuuccuaucagaacuaaaaucuagcugccuuauuagugugucacaugauagcaggagaguuggcacggaggacucgcuagacuggggaggagguuccaggccuauagaugcuccuuucuucuuucccuuagaacagagggcucagaugggaagguuuugcccauguggagcagcggcugaaagagagggcacggcccacaccaucgcccuuuugcaugaugggaacagugacagcaaggaaaaccccacugugaaaggacgcagugagauccuuuuaaaacgcaaccuaaacacccaacguuccagggaagcuuccccuugacagaaauaugugaaaaagagggaaccacaccaacuaucucuuucucaaccagcaccaaagcucuuccuucaaguguucagggucucaucuaucuccuuucaccucauaaccuguuggugcugggcccuagguacccugugugaugaaaaggggaagaaggaaacaauaaguaggaagugaugaaagacugacacaccaaagcagggguccgcaagcuuucuguugcuguuauuugcaauaaagggacagcuguggauauuuuuuagcucuuuaugcuccauaagaucuuaucacucuugccauagucaggcagcaagggugaggauacauaaagcaaaaggguguggcggugccuguaaacucuauacauuugauuuucaugccauucucaugcauuacaagggauucuuuuccuuuugaaugucuuccaaccauuuaaaaacauaaaaaucuauaauuaguuugggacuagggcaaaaacgcacuugggccucucuccaacauuugcugauccucuuugaagagucaaaggaagggguagauuuuggaggggaugugaauuacuggaaacauuuuuuaaagaaacgaggggaacugaaguagcagguaggagacaggcaggugauguagggaguggcuaaaaagauggcugggaguggaguaagggggagaggaaaagagcgagcugggagggacuggccuccucccacauuccugucugugguuccaauggcugcaacaggcuccgguuucucaucuguaugucuuggcuguuugccugcgguuuccccgcagcugagucccccagaauucaggaaggcuacguucugaaccgcuuucuuucuagucuucaugaacgccuagcgacgcugccccaaguucucacugagucugcagcucucuggcggccgccacugguuggguucaggggcucacggccccagggagucuagcggccgcacccagcccgggcucaggccaguuaggcagccgcacccagccuagaacuuauuuugcccgggagaacaaaagaccgccguuucuccccacaggcuguuauuaggguguaauuuuagggcuuccucgugcccuccacucuucucuaauugccucccacaguuucaucuucccgauccauuuucugccacguccacacguuaguccaagauacacccagccaagagcaugcguagcucuuuguuguuuucauuaaaaagaaaaaaaucuaaaaaguucaaaaacuuaugcuuaccaaguugaggagcgagguccggcugcgacuguggcugacgguggcugggacaggaguggcggucggg

SEQ ID NO: 1550 - RNA, 10076 nt, Mus musculus
cuccaggcuccucccgcuccggggcgccuccgcccucuguacccgccucgcguacaaagacgcgcggucuucggcacuagccucaucguggugugcccagcucuuccaaggacugcugcgcuucggggcccaggugagucccgcaccuaauaucugcccucugggaaccccacacccgcuugcuucggccuccagccaggcuucgcgaggagccgcgccccgcgagccuggguggggccaccccuccagcucgcacacugcuucggaugcccccagacucgcuggggcggaggccagucuugucuggagcuaccccauccuggcguuggagccgcuguucuguucuccuuuucggcaugugguucuucauucucaucuuuucuacuuugcaacuagucuuagaguuaacuggaguuuagcagaaccugcuugcgcucuguccuaguuggcaguuccaugaagcuucaggcuacaggcagagcucaggcuguuugagccgcuuuggccagggaggacuggaggcuuggcagcuggaggauucccuuucugaaggacccugcucugcuuguugccuuagccucagugcaaauuccagguugcuucggaaggaucuuuaaaguaggacuuucugucucucuaccaaguguuccucuagcuacucggauuaaauaaagggaaccagagagagauggaacgagagagcaggcuuggugaagaaucuucagucugggauuaauuuucauguggugcagugagagggacguaccugcuucacggccugagcuuggcaacaggaaugacugaccucuuuccuagcccugccugggaggacucuggagaaauugcugaguggguggcaagcaaaacagaaaugugacagaccagcagagcccggauccacauucugaaauccacaggacccaccucccucauuuuccuacccccaccccccaccccaggaaagccagacacauucugcaggguggggcuagcacaaaggguuccuggauucuccuagugaucuguggccugugacucagcugugagaccuuggguguggccuagcugguugcugauucucuguggaugguuugaacagaucgcucccugaaggaaaagaggaacugugccaucuuccagggcauuuuccaagaggaaaugagucacaacuaacuggccaccaaccugcaggagggguuucuugucugagcugccuggaagggcaguaauuagacuggcagaaccauuccaagucugucucucucccccccgccccccccauuccccaagcuucaguuucagcuuccaggaguggauuuuugcauguuauacuucaaauuagguagaaacucucugucagagagcuugccuucgguguguuucagcaaauugcaaacgauaaugcccgacguuggagcaggaaggaggaguucauauaacucccugaaauuucauuuaccuuaguccuccucccauugccuaugcacugucacugacagucuaagaguaguguuguuuguuuguuuguuuguuuguuuguuuguuuuuggucugcuuggcauagagcaguuauuuggguuccccuaauuucugagugaugcuguucccuggcuuuuccuaaauacaacaucaaaugggccguuguccucuuaugccuggccucuggccagccucugagcagucaccccaauguggucaggcccugggcuggguggggcugaggcuggauaccucccugcuuucuacugacaggagagagagagagagagagagagagagagagagagagagagagugugucauggagucaugucuccccaccucccagcaaauacauaaguauuugauaugccuuggacacauuccauucauuuaagccuagcuaagagaacaauaggauucuuucagaauuaugaaauaaauuaaugcucacagugcuggggaaagaugggcucucaggauucacaacuuaggaaucacaccucaaaagcaaagggaguaacaggcuuggcagugugagggucuagcucuucaggaccaccaccccuggagggaggcagggagggacugauugacuuuuaaagacaacuuucaacccuucaacuaaauaauucucacuuguccauguagcugauguuguugguuggguugcugacucaugacaaccccucauggaaaaauggaugcucuugguugagcuagaguucuuucuuccuauugaauugcaucuggagcuuccuuuagcagaccaugucuguaguaugcaaguuuuaguuggugagaaagucugagcuaaaauccauuguuuucauuucauuccuaccccaaauauacuguaagggucagauucaaaaauguccucuggauucaauuaaaaaaaaaaaaaaaggauuggucuucaaauucuccuaaacaaaagaacagaaacucuacaaacguuuuaaaauaauggauguuuguguucacugacacccuaauuaauucuggguggcuucaagaaaauuaagauauggaaaaaauacagaugaacaaaguaaaucaggccuccagcuucugagauuuguagccuagaccugggcauagguccagaacagacauuugggauugcuuaggaagagggauucccacccuacgccccucucuuaaagaccgacagaaaauaagaacauuguuggaauugaacaccauaggaaaugugugcaaaguagguguuugcuguaaaggaaacaaaaacaggaauuguuuccuucagaggaagagacaguuaagacagguugcucaggcuaacgugaaggguguaggcggacaucagaauaaaaacgguucaguaaaaggugaguggguaaggccugggucuuuccugcagagcuggccaagcaguggcuggugugaugaaugaaaccaagagaaacugcagaagugagaagccuguggaucugaccagaccugcuuaacaggacacuuaguuuaucccuuuguuucuggaauguacucuauacucugccauuccauucagaggugaacccugcugagggcuccacccccccccccccuucccagaacucauccuuuagcugcugugcucugagcugucaacugccuaaagacaauuucaucuguaucuccucuacuuugagucauucauuuaacaaaugucaucuaguggucucaacuaaagcagaauaauaugugguucuuaacuaagacaguucuggaggcgaggcagacaggugaacagguguauccgacuaaauauaucagguagguuuccccaacucucagaccagugcccucaugauaacguguuacccaaucagaaggggaaggcccaccccaucuggagugaaguuuggggggguguuagguggaguagagaugccagauucaaguuccugaaaagcuuucauucuaguaacugauuauagagcguagugaccccuauaaugcacgcaaugggggauugguuaggaccacucugccagagaaggacaauaugaugcauuuguuuauccaggagaacagcauuuucacauuucuguuacacguguuuguuuguuguuuugauucuugacgaagggucuauacaacccagccuggcugauaacuccauuucuccugucucagccccaucucacuccugaguccucaguucguaguucuugggauugcccuuaccacaccuggauuuuuugcauuacuguaaaccuuucuccagaguaacuccuuucuuauagcccuggucagugccuucugggaucaaggucauaugcugugaauuucaacucuguuuucacuuucuggccagauucuaucucuguguuauuauugcaaguaucuugaacuagcagggagucagugggcugcucuguguguggaauaaaacaggggaguuggggauggaggaccuggggcagaggugaagcuucagggaggaacauugucacuucauagccuucuggguaaggcaggaagaaguggacuaaccucagaccuuagcucucagcaagguagccugacuucacccuccugaagaggacauucaagugaggccaggauuuccucugcuuacagcuugcauuuccuaggaguccuaaauuggccuguuuagggggaaacccucuuuagcucugcaguauacucuccaguauacucuccugaugccugggaggaaauacacuggauauccaccugguucuaacaguugggaugucuggaaucuggagucuuugcucugagaggaggucagaaagcucuguggcucugaugugggcacagacuuuaaacuucauuggcaucuggcuccuuuccugaaugauugaaggacugagguggcaucccauguccuucauuaggugacugaaauucaguucucuuaaacucugugcuuuaaaauaaauccaggcaagguagacucucugugagccagccaaugccauuagaaacccauauccaggauuggggagguggggcagauccaaggaguauaagauaggaaaaggggaggggcuccccuggauuucaugccauugugcaccuugaaguauaaacuugcugcuguccacaucaugcagaugaaucaggccagauccucacugacgguguucucaggugugggauuccuuagcggguucuuauaauuuuucugaggcaaagagguagaauuacagcccuuaaauauaacucuucaauuuuuuaguguucagcgccacaucuuugacucuguaaaagauaguauuuagaagccaggccuaauggcucagacucagcuacucaacaggcagaggcaggaggaucucaaguuaaggccagucuaggcaaguuagugagaccugugaaagagggucaggguguauauauaguucagcgauagccugucuuagacccuagguaggguucagugcguguguguugggguggguuacagaauuuagggaucugaacaggcauugucagcagcaggauucagaccaaaguaugcccuagguuccuguuguuggucuucagcaggagaaguugccagcuucuccuauuugcacucaaaacucuauacggacacugagcuccucuuggcacugggucuggccgaaacauuugccccaguucauuguaccaaacacagugaccuaacauuuccuuuccucucuuuaaacucuucaugcugaaaggcccuuggucucucauugcaccccagcuugugaggaaaacgcuucugcguagucauaccaaaaguguaucuggcuccugaaggaguuuguacauauauggguacucguuccuucucugcugaacuugauaaugaacauuauggaguguguacucagacagaguggcugcguuuuacugcuagagcaugagcucaguguuuguagagugcacacagcccacagacaaacccaucuauaagcaaguuucuaaucucuagagucagacugguccaggucccugcuucaagccuggguggcugaggcuucuauagugaccaaguuggacuuguggcuuguugguguucagccauuucaaagaauuacauguucugugccaagagaaauaaggaaacaucucuuuaacucgguacuuuguaguuaaaaagagcaucucuaguccuacuuucccagaaaauuagaucuucuuuuucuugauuaggagcauauagaguggcugacaggaguaaaucccacauucugagauccaauaccugaagugucuguugcuaccaacaaaagcccccaaacugagccuuagauugauuaaauuuuaugggaaaggugauuagaccuucugcuuucuccuuucccauuacugucuaaagauuuucauaccugugguuuaaaaguuaguucaaacucucuuuauguccuuuaacagguuucgacagacucuucaaaaugccaucccaaauggagcacgccauggaaaccaugaugcuuacguuucacagguuugcaggcgacaaagaccacuugacaaaggaggaccugagagugcucauggaacgggaguucccuggguuuuuggaaguaagugcugaaagucucagaaccagauauaaaaaucagagugcccuucccuuucuucuaucccuucccuguagggucacuacuugggcguguuucacauccauuuacuugguagauaguaccuacuguguguuaauauaucacaggggcagcaaaguggaaaagauuccaccccuggcuucaaagaacucucaaucugcaggugaaaauaccacacccauuggcacaucaugaggggaaaggcuuuucaugagugugugauaagccagggaugcugcaccuuaggucuauaaucuucauggcggaaguuccacauucuggucauaugccacugggaaaaacuugaaucuucccuguguguggcugugaggugcagguugagucuagggccccauucaggcaaagcaugugcucucuuggagagcgccccucuacucaaaucuucuuaaaucccuuugaacaaaaagaauuuucuucuuuuuccagcucuaacccauaaagggaucauguuaguugcuggaugaauaggaacaaagugucacuccagaaauaauugcuuuuuacaaugucaguaucaucuuaggagccuggaagcacagccuaguuuauagcccacuuugggaagauugaacaggacuucucauuuaugcuagccaagccauuaagucacuaggcauaguuguccuuugacuuucuaggccuucaagaaacaguugcugaauuuaauauucauguaagacaaaauauugcuugacacaguaggacauugugauauagucccaucuuuuccuggaaagaaaggaugggucuuguacugagugcauuagucccugaaggguaaagggaaaugagaguagaucgcuagaucccaucucuugucaucuaccugauaaauagcacacuaccuaaggcccugguuccuacucuaauaaacacagggcuuugcaggagacuguuuuuacccaucaucaacaucaguuaaauagguggccuggcuccuccuauuaagcugcagucaccccaguacuagcucagugagcuaguuccuuugcuauacugugaugaagucccaaauaagcacagagacgcgcuagcuguggacuaacagugaccaguggcuuucacccucuaguccugguucacaugcccacuuuucacuugauaugauucuucuagauaaacaugaagugcaagaacaaaauguguucuuuguaagccagcccaucacaucugcagagguauucucaauauuaaaauauucacucaucacaugugaccaaagacacagauccuuccauagccaagguucugugacaugagaagcacaaaggaugcaugcaagggugugugugagccaaggcagagcagccuacuccaggcacagacagggccguaauucuagauguguacucacugcauuaacagaccauuuuguuucuaaaguagauggcuuaugucauccaaauuucacucauucugaccacagccaggaagcugggggugaggccagaauuagcuacauaaugcagguuucaguuguuagcuuagaguaggaguuugcagucuuugguagacaauaugacucuaccauaagagcucucuuaugcauccagcacacuuaaauauugcaugucagucggcucuucccuuaaucauucagucauuggaauucauagggacuuugugccucuuaacagccucuacugcguuagagguuauuucucucugagacagccuggaccuaucuauaggaguaaccacaguuuugcacuucuaaccagcaaaaggaauaaucaagcuaaucaccauaggaacaagaugcaaguccuggcaucuaucuauuucugucccacacacucaugcuaugcaauuaaggaguuuuuuugauucuaccauacauauucauuggaguagaucugugugugugugugugcaugugugugugugugucacaaauuuggcccaaauuugauguuaaauaucaucccucaaucacucucugccuaaaaauauuuuuuacauuaaguaauuuauguauuuauuuuguguguauacuauagcaugcaugaggaggucagagaacaacguggagaaguagaugaucuccuucuaucgugugggcuacagggauuuaguuuaggucaucaaacuuagcagcaagcaggcuuacccacugagcuaucucacagggcuaucacauuugaaauaaggucucugacucaaccuugagcuggccaguuuggcuaagcuggcugacuaguaaguaagccuuggggaucuuucuguuucugccucccuuugcugggauucuaggaauggaccagcuuuuacgugggugccgugggcgcaaacucagguucucauucuggcaccuuaccaacugagccacccucccagccucacacacuugguuugaaaguuguucaauguaugagaauaagauggcauacguuuaccaacucaaagacuggaaagaggcagaccauguguuuagcauuucaguucaugaagaguggaaggccuucuagagaggauacucaacauccaaacgccugucuucauaguuauaguggauaugugaagacaaacuaaacugugauggacucaggugacauagcugauaugacauacaauagcacccuugguugucucagcugcacgaaggagaaaaagaagacuucuccgagucuucucuaaaagcaaaacccaguguccucauuagcaccagcuuaggacuaauaccgcagggagugcaccugaaacguaucucugaguaaucugaagcucucucuucaucaagagagaucccuuuuaaggaucugaccauggugucaggaaugaaaauuugcuuuaaaaaaaaaaucuaaguuugaaguagaaaauggugaggauaguucuuaggcacaaucuaaauaugaaguuacugaaaaggcacucuaaagaaaaaauuaaaaaaacaugcugaugacuuaacaaaggucacuuaggaccuaagacuagaacaggaggacuugagagauuauccuuaugcacguggcugucagaaguuugaaucagagaagauaauagucgccuauguuuuaacaucauuaacugacauuguuugccuuuguucuaauuauuuacuuuuuuuuuuuuuuuuuuuagaaucaaaaggacccucuggcuguggacaaaauaaugaaggaccuggaccagugccgagauggcaaagugggcuuccagagcuuucuaucacuaguggcagggcucaccauugcaugcaaugacuauuuuguaguaaacaugaagcagaaggggaagaaguaggccaacuggagcacugguacccccacccuggugcguguucacccacggggucacuugaggaaucugccccacugcuucuugugagcagaucaggacccuuaggaaaugugcaaaugagauccaacuccaauucaacaaucugagagagaaaacuuaauccaauggcagagaagcuucugaguuuuauauuguuugcaucccauugcccucaauaaagaaaguccuuuuuuuaaguucugaauuugacguagaguguuucuugcuccuucugaaaugcuugcucccugcuucuuugagucaggaagagucagcaugaccuugggcaaucagcauaccacaggacugucucuccauaggaccagugaaaugggaaagcauucuccucucaggcuuggaucugacuuuucuauuuguuuuucaaacuaugucuaagugaagaaccaaaccucaaagcguuccaagagggcucuucaagaauguaaucuaauucuguaacuccucagcauagucuuacccaguuaaaugagugccaugguagcuagcaccuuggauacccaugauguaugaauccauuuucucacugcaaaaacuacaacaaaaucuagagucaaaauaagccuaucagaaaacgagccaaaguucauguggugguggcacauaucuuuaaucccaggaagcaggggcaggcagaucuccaagguugaggcuagcuggucuacagaguaagucucaggacagcuagggcuacac

SEQ ID NO: 1551 - RNA, 1100 nt, Mus musculus
aauggcaggggacauggaauucaagagcuggggcuacacacagaucaauguccagaaauucugcuauaauuggaccauuagcaacuuuucauuuugcaugggggcacaucagaaaaguauuaccagcccaguguucucauuagaggccaguaaggaaguggcaugguguuugagguuguacccaaaugggguugaugaagaaagcaaagauuaccugucaguuuaucuggaguugcucagcgcucuggagagcccaauucuggcaaaguucgaguucuggaucauaaauucccaaggagagaaauaucaaaguaggaagaucuccaauguccaaugcuuucugcaauacgaacacaggggauucaaaaaguuucuccuucgaggucuucuccuuucccauaugaauugguuucucccugaagaccaguucaccauaugcugcaaggugagcauaguuggaaccguauuugacaugccuguacagaagaggacaccugcaaucaaggacccaaggcacauguugacagaugaucuaggggagcuaugggagaauucccucuucacagauugcugccugcugguagcuggccaugaauucaaggcucacaaggcaauccuagcagcucgcucuccaguuuucagagccauguuugaaaaugaaaugaaggagagucuaaagaaccccauugagaucauggaccuggaucuugaugucuuuaaggagaugauggguuucaucuacacagggaaggcaccacaccuccacagccacuccauggccugugaugugcugccagcugcugacaaguauggccuggugggccugaagguccugugugaggauguccucugcaggaaccucucugugaagacugcugcacacacucucauccuggcugaccucaacagcacagagaagcugaagagucaggcccuggauuucauugccauucaugccugugagguuucugagaccucagaguggaagucaauguggaagucccauccccacuugguggcugaagcauuccacucccuggcuucugcaaaguguucuuucuuggagccaaauguggucuuagaaucuagccagcuaugau

SEQ ID NO: 1552 - RNA, 1100 nt, Mus musculus
aauggcaggggacuuggaauucaagagcuggggcuacacacagaucaauguccagaaauucugcuauaauuggaccauuagcaacuuuucauuuugcauggggguacaucagaaaaguauuacaagcccaguguucucauuagaggccaguaaggaaguggcaugguguuugagguuguacccaaaugggguugaugaagaaagcaaagauuaccugucaguuuaucuggaguugcucagcgcucuggagagcccaauucuggcaaaguucgaguucuggaucauaaauucccaaggagagaaauaucaaaguaggaagaucuccaauguccaaugcuuucugcaauacgaacacaggggauuaaaaaaguuucuccuucgaggucuucuccucucccauaugaauugguuucucccugaagaccaguucaccauaugcugcaaggugagcauaguuggaaccauauuugacaugccuggacagaagaggauaccugcaaucaaggacccaaggcacauguugacagaugaucuaggggagcuaugggagaauucccucuucacagauugcugccugcugguagcuggccaugaauucaaggcucacaaggcaauccuagcagcucgcucuccaguuuucagagccauguuugaaaaugaaaugaaggagagucuaaagaaccccauugagaucauggaccuggaucuugaugucuuuaaggagaugauggguuucaucuacacagggaaggcaccacaccuccacagccacuccauggccugugaugugcugccagcugcugacaaguauggccuggugggccugaagguccugugugaggauguccucugcaggagccucucugugaagaaugcugcacacacucucauccuggcugaccucaacagcacagagaagcugaagagucaggcccuggguuucauugccauucaugccugugagguuucugagaccucagaguggaagucaauguggaagucccauccccacuugguggcugaagcauuccacucccuggcuucugcaaaguguucuuucuuggagccaaauguggucuuagaaucuagccagcuaugau

SEQ ID NO: 1553 - RNA, 2132 nt, Mus musculus
cuagagacaaacugauguuuuauuaacaaaaauaaauacaugccgggcagguggcaaggaugaagucugcagacccaguggaaaccucccaagaaagcuguggugucuaucagucuacaggcugagaugaguaggugccagggaggacccagggccuagaccuccagccagugggggcagcagggcgaugaggggcgucucacauucccccagcagcacgucccugcgcagccccgcgccccuguccagcacuuuggcccucagacugcggacggccagauccggcgggcgcagccccucgaagaagaagucuucguugaagauaggguugcagcugcucuggaccacccggcuccgcugagcuccaggccuaacgcgcggcugcagccgcagaaucacgcagcagccgccgccaccgcucccggggcggguccgcggccgaggcagccccucggcgcucaccaggcgcagccucagccgcccgggccccgccugguacucgguggacaggcgcagcugcccgccgcggggccccaggcgcagcacgcuguccuuggucggccgcaguuggcagcagaggaaguccagguggaagagcgguggcgcacggcgcggcgcguacggacuaguguccgccgagcuggccucgucgggggacagggacugcggccugggcgugugcggggagccgcagggcgaggaguccggcgacgaggccgugucgcugucuggggcccggcagaggcggaggucgggggccgagacgugcagccgugacugcgccggggccaggccugcagccaggccgcgcggcccguggaacaaggacucgcggcgacgcgugugcgggcucucgggcaggaaggcccagcccucgcggcccgccaggugcggcagcgagcaggccaccgggagguuccggccgcccggguugcgguccacccugcccucggcgccucuugggucccggagccgaggcgguaugaagaacugugggaugcggucgggggugaggacauuaggguugcagcgcgagggcgagccccgggccuggcgcuuggggaccaggcuggggugcgccugcagcgcccgggccucugcgguccguacccuauaaccggcuuucuccaagagccacaugcaguggguggggguaaaggaacaccgaggcggagaagguccaaguucagccucccggcuggaggcucuggccugaggugcgcugagagaacagaagaggaugcgaaucgaugcugcugcggagagcaaacacuuagcugucugccucuguggccuuguccccacacucauggggcacgagucuggcauauauaagcagguaaaagaacaggugaagucuggaaacuggagaaauggauuacgagaccagacagaagguuuuuucagagucuggagauggcucaaugguuaagagcacuuguugguccagcagaagcuguggcucccagcaccccuaugguaauucacacucauccacaacuccaguuccaagggauccaacgcccucuucugaccucugcaggcaccaggcaugcacguggugcacauacauacauacauacacacaggcaaaacauucacauaaaauacgucuuagaaauaaucuuaaaaugauuuucagaaggaggccuuguauggcuaaguauuuagacuuccuauugcuaaggauguuccacccacuucaguguuagagggacuaacacccguacaaccuaaagauuuguagucacaauuacagacccagauauuaauucugcucauauauacucuaguuccauaaggucaccacggcccuaaguagacuggcuuucuuguccugcaccuagaaucuggucuggggcccuggaagcucauugcuugugcaggcggcuguuguguuagcuucucugauuugacuuaucuuugggcacuagccccaccuaacucuugucuccuccccaaaucacguucaccuucucaaauugcuccugaaaaggacucacuucugcuccuggcagccggaaacacaccugauugcugaccaguagacaagcagggccaguccaaggagauucccuucuuucgaugaggcacagacccccucuccccuccucuuuaucccuagcuucuca

SEQ ID NO: 1554 - RNA, 14912 nt, Mus musculus
gccugccugccugauuucugucugucccaggcuggccucaaacuccugaacccuuugccucaaucccccaagugcuggaauugcagccaugugcugccaugcucugacuuccugugaacuauuagaggcugugcuaagaagagaagagugaggggcaguggggugagcugugagguuugacccauggcugcagguucucuuuugcccuuuuauuuaccccuuuccuuccucuucuuacuuccuugauuucuuucucauuuuucuguauugguguagagagagucauauacacccuugccaaguguuuugccacugagcuacauccccaggcugcaguccuauuuucacugaacaacucugaccagaggccagaucauaacuggagggggcaaguuucuaaggcuugguggagaggagcuaccuacaagcagguggguggugcuauaccacaugaucgcugugggccaacagcaguucuuaggaaagaaauugacuuucagaccuucugcuggauggaucacuacaacggccuguuugauacucuggaguuagacaaauguucagcuuccguguuuuucucuuuucugucauugugacccugggaaaaggaguuagccuucaaaauauccaauucccugccuacaaaauuauauccugccccacaggguuguggagaguaaggacagcaguaguauuaaagccagcucccagugucccugaaacuacaagaccccagccuuagagggguguggcuggacacagggagaggccuccugaccagugcuugccucugcacucaccugcauauccuuuccccugggcuugauguggaagaacauucuagaauuaagccccaaagaugagcagguaggaucaugaaguuaugggcaagaucugaacacagagaagacuuggccuuccacgaaaguuuugccaaacuauagucucucccucccucccccuuccccagugugagcacccuacucucaaccuucuacgacucaugguugaugcuuucaaauguuuuuucuuuauuuagacagaaaagaccaacucuuuaaaaguaaaacucaauaaauaagaguagagaacugucagaaauugauucccccuucuuauccuuuacccuccccaccccaccccauguuuuuuucccuagaaccucuuccuaaagaaaaugaucagguaauaaaccccuuuagcccuccccauacccuucccccaaauacccaauuacccccaaagcaaagggagaaaucaagagaggaaaaaaagaaaaaaacaaaauccaagggcagcauugucuaaacucccagaaagagagauggcagcgucuggcugggugggcugauuaaagcccugguggucaugguauuuacauggaggggccagcagagacuguaaacauauuuagggacucagggagaggucuuuuccucaugaaaggagggucucugugacugacuggcagagaggcagcccucaggcccccccccccccacacacacacccuccuuggagggggcucuuggggaaggcagugaguuuuagggcugagagcccgggguuuggagaucuccuaccucuagcugaggguggggagaaacgugggagccagcuucugagaaggcagggcuucugagaaggcccugccguggggagaggcaagggggagggugcuugggaaagaggagaguguccugcugcccuuccgagccugcacagcuacugcaggccacugaggggaggcaagggccagcagugggcacagaggcucauccaggagccuuagcagaaggcagaugccccugaaccuucaagccuauuccuugcuuccucacaaaggccaaaagggcacuggggaggaaauaggcucuugaagccagggaagcaaaaccauggcccuucagagaggcaagauggugggagugagccagguccugggcccucggaccaugaagcagcucuugccccagaguccaaucaaggccuggggcagaugugcagagaaggccagggccagucauaggaagaggguauacugaagugccccuuccucugguaucuccagaccugugaaggaaggaaauauaggugaagcacagggaagguuuccaguacuggucacagguucuggguaagguugggguggcagggagugauggcaccuaugauggggccuccugagaaaggcaggccaucagaaaggccuugucccagcagacccaucugcucaccuccccaucccuccagcuaugagggcauagagcaaggauagagaaacagggcaggaggcauggaacaguacagaaacugaagcuauugggaagaaguaggucaaaaugacuggaagacagcuagauggagagaagggcgaagaaaugagacagacaggcaggcagaaguaacuagaagggaggcgcugggggugcauggacaagacagacacccggcgaggggagcauccgcagagacugggaugacucagaggggcuuagggauggagucucaugggugacaccacucccagcccuuagcguucucauuccuuuuuggaaaggaacauaggaagcaaaagaacaaugcacagaccacagaccacagucaccaaccacuguugaccacgcacaucccgcgagcugccccggcccugagccugggcugggggcuguuucccuccauagccccuccccagauaacaaacaauuggcuccaaagacaacacgcucguuccaugcaacuuacaggggcccggagcagggguccgggaugggggcuucagccgacaauggacacggacccugggcuggggacccccaggguggggggaguuaagcagccaggauuggggggaaaggggagaaacagaaauguggguauuguucuuggguugugauuuuucagguuugguccaagggagauuaaacaaaguuaggaagggcuaccggucugugccccaaggucagauggcagccuacaaugggcuggggacuccucaguaugauucuacuuccuccuccaaaccaagccacacccacucccaucugucugguguucugccccaagguccacugcccugggaaaaccaccugcaguucagggcaaugggaacugcugugucucugccucucuggagaucagguuucaaaaucaaguugcucugugacccuccaguucuccaaaccagucuccuggcccccaaaaccuacaauacuaauuccauccaacccaaaagaaaaccagaaagagaaagacacagacacauggacgcugaccagacaaacaagaccaaauacuguggaaaacucuaggagcagacacagguguagacuugucuccucuggggugguuguguguguguguguguguguguguguguguguguguguguguuguacauaugcacacacaugucuauguggguaggagacacaacugacugaacaauaauagcuggguaguggcccaaaucccuuuuccucguguccagcaucaggguggggugggugguaaugaagggguagggcauucacuuaaggggucuggcugcaguguguggauccggacauugaggucacagaacaggagcagcacccaccugaagcccuuaguagggccuguuugcauccuuaggccgcuuuagcuggacuuugaggcgcuucaugccaaucuggaaaccguucauagccuggauggcagccugggcacuggccggauugucgaaacucacaaagccugaggugagaagggcaugaggccuggcccagcccuccaucacuguccugccugccacagggcccacuugugugguuucccacccuacuucuuccgggcaucucuaauaccaugaaaccugccuggcacauaguaggcauucagaaaucguuuguugaugauagauuuaaugagugaauccaguccagccauucacacaaacuaggauguacuuuccaguauucuuugaagaguggccccuuccucagccugagagcucucaaaaacauuccuuuuggaagucccauaggugauuuuugaaacaagggacuguaggacgcuuccaaagacaggaaaacaacagaaagaaaccuauguccuuuugaaaucuaguauuuccacacuacaugaaaggagguuggguuccgugugugugugugugugugugugugugugugugugugugugugugugugagagagagagagagagagagagagagagagagagagagagagagagagagaggaggaggauagaaucuaggaccucaugccacuaaaugcacucugaucucugaacuacaaucucuagccccaaggcugacucuuaaggaagaugaagcugugacuuuucuaggcuugaguggaaacuaugggaugguggguguggcagagaugguucuuuuuuggccuuggauacacaggcuuucaaauacagaguucguugaggcccuaaaugccuucagaugugacgaacucaguccuaagaguucaaacaaaaauguccauacucugucuuuuggaucaucauauucuuaccaaaacauuugcucugauugguggcccggucaacaaagacuuuggcugagaugacaugaccaaaagggacaaacaucuggaggaucucugagucugugaacuccuggggcaggugguagaugaagauguugcagccaucagggccuggguggcagcagagacagaagggguagcucagagacugggaagugcagacugcauuggcagagaugagggugacagcggccaccaguccuggccccagcagugugggccagggcuccccacuccuucaguccucacacacaagcccagagccugggaaagagccaucgggaguacccaagcccacacaugggcguucuuaucccugcagguucucagcuaucaggacccugcccuaggcuggcaccuucccguugcugcugcuguugcuguugcugcugcugcugcugcugcuguugcugaggugguggugggggcugcugggcaaccagggcuggaggcugcgggaacgcaggugcaaccaggcuguaggcugcgggguacgcugcugagguggugaagacagagaaagcuaauggguuccccugacucggcacaaccaaccuagucuccccccucagcccaaaccaguggaauccacaggccuagaggacgucagggaugaggcuuccucagacaaguccugagugugugccacucucacaagcacagcuucucaggaaggccugagggugugguuggcagagaauggagaagcucagacuauaguuccuagauggguugcccuaugcgaguccgcccaccugggcagggccugggcuagagagccucaccuguguagugcugcauuccugcauaggccugcuggagaggguccacgggggcugccgggcucugggcugcagagagcaucacaagccaugagugggccugggacauuaugggaaccccgccagcacuucucucagcagacagagccucaucugggggguggggugagaugagaagggaaaugcauguggcaguaggcaagucccgagacugacaugccacuuuagucaccaugcuaagaaggccucagcugcccuagccaagaacccaaagaaugccugagcucaggagccaugccuuuaauuccaugcucagggaagagcuaggcagaucuuugugaguucaaggccaaccacacagagagacccugucucaaaaaaacauuuuacaaacaaacaaguaagaaagaaaggaagggaggaacccgaggagcauuuccgcccaggaagagagcaagaaaaagcaccuuaagcccugagguuggagagggaaggugagccauggcugccagcaaugggaguaguggcccggguggcugauggagcaaggugggcaggcagagagccccaccuggguaagggugaaccccguugggauacagagcauccggggcaggcugcccuguaggcugggugggcaccgggcuguagccguugacgcccaaggcagcagggauggcagagacgggcguggcagcaauggcaggaggggugcugguuccuaggaaggagaacaugacagcaacagagcagagaggcaggcacacagaugcagagaaaaucuggggggugagguggggggcagaguggagcagaaggcccuucucuggccccugagcaccuccugcaccccaugguuucccccuggucacugucaccauguugucauucgcugcccagcugccuagcacaggccuuaccugaggauggagugauggggguggcgaugaggccauuggcacugauggcagccaugugcugcaucugcacggcagccaugguggccauagggcugagguaggcacugugagcugcuaccagggccgccugcugcugcaucagcugugggauggggagaggagaguagggcccggcccccagcaccugggcuuugguguuuagagggugggucuggaaggacauggagaugagcaagaucuagcacugagggugggaggguaugcuuacggccuggguguaggcgcuguaggcuccaaacuggagggcgaucgggcugaacaugcccagcuggguagccaccugcugcauucgacggagaccucgcuccuucuccgugucagcaaacuuuaccaccaggcuggaugaggcacccugggcaugggccccacaugucacaggaagagucagaaucugcucccugggggaccucgucuggccucaggccuccuugggagcacagccauuacagugcccaauccaaauggggagacccuaaucccaccaccucccugcaaugggauauguaaaaggcuagauagaauugaggaaugugaacguaagugcaaaaaaacaaaaaaacccaaacugaagcaaaaaaaaaaaaaaaaaaaaaaaaaaaaaaaaaaaaccagacaggccuguggaaauagaaaggauggcacugagagacgucugugcuggcaauccacagcggauuagcuguggggaauguuaagcugccccaucucccugccaugauucuggacccacgcccaggucucauggagugcucagugggugccacagcacauuuuaacguuagccugagccaaaucaaaucuaaaucggaauauuggcaaguauuguuagagaguccuagacucagaggugaaggggcccagccagcugauucaguucuccgucugaugucugaacuuuugaguugugagaggcccacaucuguuugaagcaacucguuagguuccagcugggauuccagcucauacgcaacugaacgaacacuaacauuuagggacagcagguaucaacaugugcugugcagagguggggccucuaaaccagggucccgacaccccaagagaugagguggggucgggaggguagagaagcgauaggagcuaagaggggaggcuggagaggagcggaagggaauuggacuagagaagagcagcagcuaugggagugugguauuugauucguugauucuuuugggaaaguucauuacaaguccuauccugaauggaagugugcucugugccagggccuggcaagugugccagugggagagagagacaaggaaggaggggacuggggcucaccgguaggguccggcugcugugaaggguguugauggcugccugggccucagcgugagucuggaacuucacaaaggcacagccuagaguaaguggaugggguggagaagagcgguaagugccuaccaugaaggcacccuacuggguccugcagugaagggauaaggcagagggcuaccuuugcugguaccgucuggcccccggagcacagugcacucgucuauagucccaaaugguucaaacaucuuccggacauccucaucugucugcugcuuuccuagcaugcccacaaagagcuuccggucuucugggggguggggcguaggaggggaggaauguacggggccuccugaccacuuucccagcccuccaccuucacgcaucccuguugcuccugacaccaccucccccauccugggaaacuguggcucgagggugugaagaacugauaguugggaauuagaguucaguaacaugcagaacucagcucugaaggacgugaacucuacuuggccuccgcuuuguaaucucugcaaaugggccagaucuccuaccuucaccacuccuaccgcccacuccuuaacccaaccucagcagauaauucuuuagcauuaccagacuuccuuccucaagaaaggcuguccuucagcuccaucaagcccugggccugggggguaggagaaaaggggcuaaagccaaaguuauagaaccuaccuccucgacucucgcugucggcuggcuugaccuggaucggccuguucaucuauaggagagaaaaaaagcaagcugccagggccuccucagagcauccggagggaugaagggagcggaguugccuccacccucucaguugauggaaaggaaaggguaggcccaaccuugucuagaauucaaaccugaagggauuagagaaauuggggagagggaugcguuggaagauuucauggggugcagcucugggcucaggcuggucucagaaugggucacccauagguguugcucucuuaggugaggaaggccugcucuugggaccuaggucuugagucagagcucaaccaaggaaccggucaaccagagcugccuccauucugcaaaguaagcgcaaacaggcuaucucauagagaacccccaaggaaggcugggggagacccaacagaggcccagaauuccuucuaaccacuggaggugugucugccucuuucugcuccccuacaccccuugaccccagggggaaggcacucgggcagcacaaagggagcagaugcccagucuccguggcaacgggagaaugcgcaccauggcaaccgcccacucagccugauuuauccguccccgucgcccuggcgaccguggugacgucaucacuucugccucuccacacacaucagaggaggacuggaggggggugggaacaggguuugcuggggguagaguauugggugggggcugggaggugggggaggggcccaagaaagcauccuggucuuggagagagguggagcgaguccuacagggcccauacuauucccggucucuaguuccugcgucccgccuccacaaccaauccuuccuauccgaagaaccaagaaagggcuaaagaagcgcugaaggagcggaggcuauccguguuccuuugcaauccucccugacucggaaguccuccagagcucuauccucucccugauacccacaguaucacucuuuguucagucuucaaugugggcagaaaauuuucuaguucuauucugugucuuguuuggugaguggacuugggaaauacuccuacagguugaucuccuuaaccaagauggcgaguaacuggaaaauagaagcaggcagcguuccgccucugaacuucucuugcuauugaggaggacucuggcugcuagggucauacccaguccccucacucaugugaugaugggacagucuuaauuccagggaccaaaaccauaaaagaggcauucauuuacuugcuaagagugaggcuuagcuuaggguacucuaaggaaagucacuuaacuaacuggagccuugccccucacuggcugugucccuccaggcuccaacuuccucuuccguuaaacaagaggauagaccaggaagucugcagccagaugcuacucaacuuuggugcucucaaauuuggagaccuugagugacauccgcuaacauggagaaauaaauacagcuccuggcuggacucugccagccagguguucacagccuuggaucaaaccugagacucaucuccaaugauguuccugcucagccuuccuuccccccaaaucucugcaucugagagcagcugguggggggugggaggucaccggcacauaaauccuccugccaaucugcccccagcuuuaccuucuaccaaucugggauuauccuaucugaaauucaaucuccuaaagugugugugugugugugugugugugugcgcgcgcgcgcgcgcgcgcacgacgcaccaggggaggucuauaggcuagaaacuuauggccauucaucucuucuguacugaagccaaaacaggaacuucccucccaggcaccagcacagcuagccacacccaucccucaagauagaaugagucagaaccagggccacagcauggggcaaucuuagauuggcacuuugcccuauccaacaagucucuggcaaguugcuguucucucagagaccgagaacuugggagagaaaugaugugauacccgcccugcacaggcuuccagcacaaaaauagcauaucaauaaauacccacggcugaugcgcacucacacggagacacagcccagaccacauuauggaucuuguggacagaacuccccacucucacagaggacuucucaguacuccuaaugcccauuuucagcccucccucccuggccuggcacuuccugugggaagcucagcuuuguuagcucaccugggcacaccugcccccuccccugaguccagcuguacuguguuuaccuggcaaccggcaggcaccucaucccuagcuuccacccaccaggugauaagcccucccaagggcugcccaaagaagaaggggcuauuuauaccccagccagggaucucuaaucugcuuucccuaacaggaccacuguucagguccaucccccucauuaacaguccagaucccaccuccaaaaagagcuuguucucucacagaaucuaauucucuugaugagcaggucuggagcccugccccuccuggcuccacaguugguccuggugucccagagaccauuaucccugccucgagaugaugggaaaacccacagcuucagagugggaguuugauccagaacagaugggggaagauaagccaggcagaggcaucccucauaaccaacuuccaagaggccacacccuacucagaacagacccaggaaccugccacagagccauccuggggacucuugcuggagaggagugaggcucaacagccacaggccacuagauucugggugauaaggggagcaacacaggcaggcuaaaacugcaugaguuaaaauagaccuugcaggaagguuugcagauuagacaguaggaaaaacuuacugacagaacuauacacacacacaacugagggggccacuugguaggguacaaaggcaaaauuuguuuauagguaucucuucccuuaacugaccugagucaccuuucucaaccccuuagugugagauuccugcuaggagaauggaacccuccuuuccuaauagaaacuuuaucagucccccuggauucuguccacugugacaaaggccauugugggaacuuagugucacuugggaagccuggagcagagugacagagccauucuuaccggguagccuuuccuggcuccuauguccagcccacuggcuucucaggacagcuuaaccugagcuucacgggcagcuggaggagccagaugcaggggagaugugccuagcugguacugugcuuuugggcgccugcccaucccuacacugccaagucccuacucuggccucuuaugggcuccuuccccugauucuccaguuccuguaggaaacccacaggaacagagguaaaaccugauuagugagggccuucuggaaagaaaaaagagggguagcugggacucagcagcucgcauguaucccuaaccuggccugucaggugcucacaugcaugugugcaugagcgagugcaugcuuacucuagaccccugugucuguccacacccaugcucccucccuccacucugggcaauggcaguuccuguugguugggauaagaugguugaggcgggcuacaggaggaccucaagagagucugaaguuggggcaguuuaaguaguuuuuucauuuuccauagcuccaccccaucuguuuugucuguuuccucucaggaggauggguggucaguaccauucugugucccaugugggaaggaagcagaggcuaggacagaugucuccagccccuagacagugcugggacucaaucugagagaaaacagaagcagauagauggccaaaaggaccaggaggcuucuugaugucuguucucaguuaccaacccaggcuuguagaagacugucucagaagaagaagaagaagggggaaaaagucacuuugcagaagggaagccacuucagagccaucucuacuccccaggcacaccugguagggucaagccugaucuuccaugauggugucggcucguguuugcuguccccaaacucccggccuucucuacuuugaugcccuguggcucuguuuuagaguguuuccugagagucaggcaggggagccugugugugaucucagacagcagcacagaacaguccagcaggcccagcugcugguucucagggcagcagcgccccucccccaucucacagcccagccugucuuagcaccacaaaagagcgccugggugccccgugcuccaucugacacaggugacccgucuacucuaccuuccucccauacagcuaagucuucccucuugcauggccuggggacacacuggggcgugggggaggagcaugcgcuccucagaaaaggucacuccaccaaucauuccuguuucacaccucuacggagggaaagggaugcuuacagggacuucagugaugaagagguggaaaauagcucgguguccuaggagggcgauggguccgaagccacuccuaaggcuauuggggggggggggaaggugggggcugaccgugcugagcauagaacucaccccugggagagucuucuguucgugcagggcacucugggccuucagggcugaaucgcgagcacaguacgucaggaaagcacauccugaggacacaggcagagagacagugucaggugaguccucauguuccccuuccuaaggggcuucccugccagaccaaggaccuggaggagcgauuuuccccuucuggacaucucuaccugcuuggcuggggagggaggaggcauuuauccagagguuuaaaaauuauacccuaucucugggucagagaccuggaggugagagacgugggagagcauuugcucuguugauggaacuggggacagaaagagcugugaucuccaaacaaguaguagugugcgcgcgcucuugcucgcucucuuuucccuuuucucccucaccuccccgcccccgucccaucuugaccaucaucacccucucuuccauuuucccuacuucucgaaucuccuagacuucacaagagacaggugcgcagagugcgcggagaaggaagcgacagccggaagugcuuuuuccccagaacccaaagauuucaggaagucuuguggcccuggguccccggagcuuggagcucuccaagugcugauccaagccagcucugcuuagcagcacagcgcuuggagagaccucaggaaccucuuccuaauaacuuucuaaaaccagucucucuuguccaugcuccucuccccggcuccuucaucuuaguccuggguugcccugguuugacuguggccacucuuucuagguuaaacacaccugaccagccaucccaacauuaucuggggcuucucacauugucagucuugaucaucuccuaaaacuuguccuucucauccuucuguucaucccaugccaccaacgcccuccuccaucucgugcagaguuccccuuaguuuuucaccuuauggucccugucucucagcugaguucucacuuaguuccuuuauccaguccuucagccccuggacucugcuuccaaaucagcccuuuccagccacuccauccccccagccuccuccauccuucuugccuagcaggccacucagugccuccucuccagccuggccugaccccucacccuugugcagcccgguguacuuguccuugaugacagucagcucgaagauccgaccaaacugcucgaagaugggcuucagguccuuuuccuccagaugccucgggaucugccccacaaacagcuugauggcaucuggcuccuucauuggggcggcccaggaggaggggccgggggugggggagcagggagaggaccaaagacaagggaagcugcccaaccaggaggcaggugguagggcccaggggcccagcagggccagcuuuuccuuuggcccccaaccacacugcugagcagaggagggcucuucacacaaaggaggccuggggaguugagggcuaggggucaggggucuaggcagacagugucaggccaccaggggcauagcccaagcaaaggaucucccucccagagaucuggcaaauaucccaggcugagggucagggugaccaaacccuggggcguuugggugguagcuggaacgguggagcucagagggcgggagcaaaggcacagaugccaaaggagaugggguaaagucagaagagggcgauaggaaagaggcugaggggcuaggggacugcuaugguugccagcagcgucaugagggggucccugcuccugauguggggcaggugacucucucguuggcuuccuagggaagacaccucccuguggcugauccuucugcuggguccgaagaucccugaugccaaaugcuugaucucugauggcggcagggcuucgggggucccuucugcccuguccccuucagguucucccuagaccccccccucccacccccacccuguaugguuccccggccugggcuguugccggcuacucccgacacuagggcugccugcuuucccggucaccugggucccggagcucugcucuccggccgcgcucuccucaacaaaaaccuccccccccuccacacccccccuccccacuccca

SEQ ID NO: 1555 - RNA, 319 nt, Mus musculus
uuaggaucaggggcuggagaaggggcuggaggcuccaugucaggccuggaagguggcaaaaagaagccccugaaacagcccaagaacaggccaaggagauggacgaggaagauaaggcuuucaggcagaaacaaaaggaggagcagaagaaacucgagcagcuaaaagccaaggccgccgggaagggcccccuggccacagguggaauuaagaaaucuggcaaaaaguaagcuguuccucacaucuggggugauggugacccuccucuuccauuccuauuuaaacagcuggauucccugucauaacaucuuugccauug

SEQ ID NO: 1556 - RNA, 509 nt, Mus musculus
cucucccagagcaauuuuuuuuuuuuuuuuuuggcaguucugcaacuuuauuugacaugagguuaguucucauccacauugaccgucuguagauuuuugaaugugguaacaggcauguaaguuaccagcguguagagcuuguuuggggaauccucauccucauuacguuuucuggacaagcguacucggaugcgauauggaacguuccuuauucccuuggcccagacggcuuuuugagccuggugucaaugcgcacaucugguguucccauuuccuucauggcaaacuuccgaauuucuuugagcgcccgaggagcacgcuucuugaagcccacuccauggaugcgcuugugaauguugaugguguauucucgggucaccaccucguugauggcagaacggcccuucuucuucucgccacccuucuuugcgggagccauucugccgggcccaaguaggaaaggaagggcgcgaggguuugugggaaggaaagucgcguagccgucccag

SEQ ID NO: 1557 - RNA, 509 nt, Mus musculus
cugggacggcuacgcgacuuuccuucccacaaacccucgcgcccuuccuuuccuacuugggcccggcagaauggcucccgcaaagaaggguggcgagaagaagaagggccguucugccaucaacgagguggugacccgagaauacaccaucaacauucacaagcgcauccauggagugggcuucaagaagcgugcuccucgggcgcucaaagaaauucggaaguuugccaugaaggaaaugggaacaccagaugugcgcauugacaccaggcucaaaaagccgucugggccaagggaauaaggaacguuccauaucgcauccgaguacgcuuguccagaaaacguaaugaggaugaggauuccccaaacaagcucuacacgcugguaacuuacaugccuguuaccacauucaaaaaucuacagacggucaauguggaugagaacuaaccucaugucaaauaaaguugcagaacugccaaaaaaaaaaaaaaaaaauugcucugggagag

SEQ ID NO: 1558 - RNA, 27594 nt, Mus musculus
auuucauauagauaugccauuuuuaauauuuaauuuaaaauaaaccaaggcuggauugggagaaaauaucugauuugcagaauaucuucuuuuaaaucaugaaauuacaagucauugaugagaccagaacuuacuuuggagauaagaggcgaaccauccccauuaccuucacccacaagagcuuggcacaccccaaaacucaaaggaggaauacauucuccaggaccccuucccaucucuacugagagucagcuuccaaccccaggcgaggcucugaaucagggcccacuucuugagaaaagcaaggaucuguugguucccacagaacugggcacaucugagaagccauaaggaggccacagggacuagauguuuggacuuuagaaccuguaucaacaguugccaugguucccagguacaaccaccuuauggcagcauccucagucacagagggcaaggaagauggaaacccugagcagaaccaguccccaccaccuuaccaggcguaucaaagcccuucucccaggggcugcuuggcagagcagccuguagcugcucagucacugggguaggaggacaggcugagggcccccaaugaggaaaggcuggucuuuggagagguaugaaugugcagguuuauaaaaggcaagaacagcauccucauccaucucacacugguaaggcacugagaguaaagcagcaaggcagggauggaaaagaaagacacacgaucuccuggacccagugacugggggaaaacaaaaauauugcaacugaagagaugcaaggaccuaugucugugcaaaaagaaguaucugagaaguggguagcgccacgccugcauguccauuacccauaauguucccucccugcuccagagugggagggaaaacaguugcggggauccagggagcagaacaacauuggguauuucccugagccauaugguuaaauauuaaagaaauaaagcuuuacauacauggcaauauccaucccuuccuguccuucacagucccagucaguguauauucugaccauuagucccacuguaagggaugauggagagguccuauaggaaggacugacucagcaggaauaaacacccacuccuccagugaaaaggacaagugcacccauccgcucauugcuaaaguuuaucaccaucacucugaccuguaccagucuuaagucugaauuggaucacuuguaggaaaaaaaaaaaaaagacucugaagcaggcaagacagagcagagcagagcagggcuggcugggauccugagcagagccugagcuaacaugagcuagucugcagguugcucucaguaagcagugaugcaauggaugaggggucguagacguugucaaacuccucaucagagcucagccccucuuguuugagggcugacucagcagcugagcgggaagcuuuccgccugagucagagagaaaaggaacagacugagacaaucacacuuucguacuaaagaagucauucuucuaagaccuaauacuacucacauggucuccugcuagucagggaccuaggaagauaaagugaaggacagaggcuaagauacuaagaacuaaccauacugacuucuaggcaggauaagguacuacauauuuccccagcuugggagggaccacucccuacuccccaagagcgcggugcagaaggggguacagaagggcugccauaucauaccaggcauccuuuuccaaggauuugauccgggcuuggagcuguucauugaccucaugcuguuccuccaguucccgcugugccuucuuccucaggcuguccagccgcucaauuuccucuucugcuucauccaccugccgcuucaaagccuucacccucaggguuagcuaagcagaguaccauguccgcacauuacaaaagcaucaacuaccaagggaugggaccucccuugcaaugacucucagacaauccauauacucucccaccuccccaacucgcacuguaaccuuguguaaauucuccaaucucagggaaauuucugagaaggguuagggagcugagaagauagugcagacaaugaaaugugugccaugcaagcauagaaucuaaguucaaucucccuaggguacacuagccagccagacaaccuuaaccuauuuggcuauuuggcaaauuccaaaauuuuuuugagacuuugccucaaaaaaaaaaaaaaaaaaggcuggaauaugcugagggauaacacccaagguuguccuccagccucuaaacacaugugcacauuuguacaugugcacacacauaugcaccccacacaagcacaacaugaaagcuauucaaugaaguaaugaacauagaacacuuagagaaaccaucacacucaauagaggucaugacuacucuugagcuaaucuugguccuuccaaaagcaaaauguaaguguggaagacuuaugggggaugguggccuccccuggccuaagagaacccugggugucaugucgucaccugguccuucuggucguugacaugcugccguucaucaucaaucuggauggagagcuccuuaacccuccguucuaguuugcgauugguggacugcagaacugucuucucucuaagagggagaaggaagggaagggcgcucuauggcuguugcuauugcuaaggaagucuuuacuuagcacuguacugccuccaaagacaucucuguccugagcgucaccaguagauggggaagauccaggaagacagaagccauucacaccccagaauuuccacagcucuacucucuaucaggaccaagagggacuccccgaagaugaggccagguuggccagaugugagauggaggacagaggaagacccagagaagaaaagcccagaggacgaaagggagggugagaggucugggugacagguucauaucaccucucuucagcuugcagccgcucuugcagcagcugauucugggacucaagcugggagaggcuagcgcuggguuucuggaagcccucugaacuggccaaccgggucuucaaauccuuguucugugagagacaggaagaucccaugguuaacucgccaguugguccucugacugguccccugacucuauucccaagacuccuuuucaccugucucuccaaggagauuuugucacacuccaaguccugucgagcagaucucuccugcaugagcucuguccucaguugauccaccuguuagggaugggcgaagggaaucaaacuuggaaaagacaaaggcuaaaccagcaaagugaaucggcagaagcagauuccugacggacacucugaaccccgagucucccgaguucucagguaacuaagaacucucaaccuagaauccagcauuccucucucaggguucccuggccuaacgagauuugagaaagccauucccauugccaugaagcugccucacgaugauggacuguaucccuguaaaucaguuagauuuccagcaagaagcccugaaaggcugccgcacaaucugugaaagugaagcuuaaguugcacugaagacccgaaaaugucuaaaguacugggaacaugugggacauuugcaguagaaagauggagguagccagaggagcuggugagagaaguaugugugcugcagguagcagaucuugagacuauuagagccagaugaugucaccaugagacuuggauuccagacgugggcguggagcuuacacuuaaaagacugcuuugaggcucagaagagauuuugaacucuggacuucugaauaggggcuuuggaaauuggacugaaugcauuuugcauuaugauagggauagggauaugggaagagagacaagggaugaacuacuauaaauuaaaguguacaaugucugcaaguuugccaugguggugcaccccuuaaacccaguacuuggaggcaagcaaaggugaucagaucucugugaguuuaaggccagccugcucuacauagcauguuccaaggucaaccagaccuauagagagaccaagucucaaaaacaacaacaacaaaacauaaaaagugauugggugucaagguaaaagaagagauuagagcuauucaaaugggagaaagauuagauuagagcuauucaaaugggaagagccuucauguaaaagaaggcucuggaaacuccacagccagcacuccugaauucaaaguccucaguaggguuagagcagccgaggccaccgggacccuuuccccagacucccguucuuggcuuccuuccuccagucuaccuuuuccaaagcagacgagagccugaagcagacucugccuugccagaacuguccagguuauggaucacaggagagcuaaggugucuuugacagagcugggguguuaagugagaaggcacagugaggggucaggaggagucaccugaucccggccacgguucacccgaucuguuaacaguuccacaguguucuuuucuucaucuaacuccgcuuccagccgcgagacuuucuccuguggcaggagaacaaaaggccaauucugucuuuaauucugcacccuagaauggcaaacccagaccaaagccucaucaaaacuucagccccacagacucuucucgcugguacuuuccagaacccuucugguccuugcuccagcuugcucagugcugccauggagccagcgcccucugcugaccaggaaggcaaacccuagaagcuauuucuucugggagaacuaucucccuaauggaaaaccucaaaguaaaauuuaagucugcaagcagcuauuucuucugggagaacuaucucccuaauggaaaaccucaaaguaaaauuuaagucucccagcagaagccaagauggaagggcucaggaggcauuuccaaaguguggagcaaauucaagccacacaguaccagguagaagcuaagagcauagauuuuagccaaccaccuaggccugaaaaucagaccuaccgcuuucuaguacuagacucacuucacuggaaaguuaauuaucucugugccucaguuuuccuuaucuguaaaauggcgacuagacuaucuaccucacagggugacacagaggaugagaugagucuuacaugccacacccacagugcaauauacccuuguugcuauuauucucacuuccaaguacagcaaauugaagacuaccauucaacauguagaacucaggucuagaaggucagugcuaccacuguccaaacgcaacagaggacaaaaaucaaaaauuuucaggacaucuauaaauuucuuaguaucugcauuuaguucacaauugcuaaaacacuguaaccgaguaaaaccaucaguuguggcuucucgauuuuguucucuaguacagagaaaggcuuggaauaaauuggcuccuuuccccacuucagucucaccuguaccagagcccuuugucccuaccuaaccugugcagcggcuuuaccucuaggcucuucagcugucgagccuugucguccuggaagcguuucuuguucucagccucuugcucuagacccugcagucgcugggccagcagcucuuuguccagccuggcugugucccgcucagccugggaugucugcagggcuugccgcagccuuugcagcuggacccaaagauaacacacaacagcucagccuaauugaaauaugggggaugggugugcccugcccgaggggagaaauacuucacuacugacacucuuuagagccaggcugggaccacagcuuaauggcaaaguauugaaggaagagucacuuuuagguuguuuucuuuauugucuuaaaacuugggggcaggcauaacuaugccuauuuagagaguuuuuaagacuauuaauccuuucaggccuuaacucccagcauuagcagguagagaucaaagagaucucugugaguucaaagccagccauaguuaagacccuaccucaaagcaaacaaacaaaaaaauaucuacuggcucuaggucccaaauuaauaucuauguaauaugagaugauguuuagaauuaagauuuuucaacaucucagcguagcaguggcagugcaugccuuuaaucccagcacuugggagacaggcacacaaucucugauuucuaggacagucagaguuacagagaaauccugucucaaaaaagcaggaaaaaaaaaagcaaaaaagauuuuaaaaaaucauucugggugacuuuaaugugcagcagagguugaaagccacugcucuagagagggaugcugcucuagagagggaugcugcucuagagagggaugcugcucuagagagggaugcugcucuagaaaaggaugccguucuagagauggaugcugcucuagagagggaugcugcucuagagagggaugcugcucuagagagggaugcugaucuagagagggaugcugcucuagagagggaugcugcucuagagagggaugcugcucuagagagggaugcugcucuagagauggaugcuguucuagagagggaugcugcucuagagagggaugcugcucuagagagggaugcugcucuagagagggaugcugcucuagagagggaugcugcucuagagagggaugcugcucuagagagggaugcugcucuagagagggaugcugcucuagagagggaugcugcucuagagagggaugcugcucuagagagggaugcugcucuagagauggaugcuguucuagagagggaugcugcucuagagagggaugcugcucuagagagggaugcugcucuagagagggaugcugcucuagagagggaugcugcucuagagagggaugcugcucuagagagggaugcugcucuagagagggaugcugcucuagagagggaugcugcucuagagagggaugcugcucuagagagggaugcugcucuagagagggaugcugcucuagagauggaugcuguucuagagaaggaugcugcucuagagauggaugcccucuucugugguuccacaugagucuggggccuagcacuccagccauagguucagugagaaggcaaagacuuucaaagccauggacaggcuccuguugucuacguuccuaccucauccugaagccggcucagccccccugaauucuuuucagccucacuggcccaauccuuggccugacgcugggcaucagcuacuuccuuccgggccuuuuccuuguaaucuuccaucugagccuggagcugcugcagggcuagcuuggagucauccccaaucugcuccagcuaaaacgcagagggaaaagguuucugucagcacugcaccucuguaacaaauguucagucccuucucuagacccagcuuccaagagucucccaugagcuuccgcucugccaagcagcugucucuagcuugccuggucuagaucccuggaauggcuaaucguuauauauucaaauucuggacguuggaguuuuagcccuuacuuaucaucucugaucucauuuuccugucuauaaaaugagauaauaacagcaccuacauugcugaguugauacugaauuauguuaaugauuuaaaauaccuauaaaguggcugauacuaaguaaaucuucaaugaccacauuucugcaaacucaaguuauaagacguacuucuaagauagaaaaucugccgacuaaacuaccacaaacccucaguuacugugucucuuuggcucuuccugcaauuuaaaucuuuacuaaugccagaaaccugggauggggagucucugaggagucuauucaagugacuuuagcugagacgccuagcagaaggggauacagagccugaaguagccacauccuauagccaggcaggacucucauuggagggauaagaacaucaacccacccacaaaaccuuccacccaaaauauguccugccuauaagaaauccaaggacaaagauggagcagaaacugagagaaugaucaaucaaugaggggcccaacuugagacccauaccaugggcaagcaccaaucccugacaguauuaaugauagucugucuugcuuguagacaggagccuagcauaacuguccucucagaggcuccacccagcagcugaccaaaacagaugcaaauacccauagacaaacauuagauaaaguccacaaagggacucuuauggaagaguugggggaaggacugaggaacccagaggagauagggacucccaauagaaucaauuaacuuggacccuugggggcacccagagacugaccaaccaaagagcauacauaggcuucuccccaccacaaacauaugcagcagaugugcaacuuggucuuuaugugggucccccaacaacuggagccagggcucacccugacuuuucccccugccuguagauccuuacuagacugccuugucuaguuucagugggagaggaugugucuaguccugcagugauuugaggugccaggguggguugguauccaggggagaccuccccuucuucccucuucucagaagaagggauggcagaaggggcugugugagaggagcacuaggaggagagauggggcugccaucaggauugaagugaauaaaucaauuaaugaaugcaaaaaagaguacauacugcucuuccaggaccugaguucaguuucuagcacucauaucgggcagcucaaaacugccuguaacucuagcuccggggagcuugauguccucuucugaccuccugggguaccguacucacucauaugcacacauauaagcccccacauagacagauauaucauaaggaccaagcaugguggcacacgcccuuccuuaauuucagcacaugggaggcagaggcagguggaucucuguaaauucaaagccaggcuguggucuauauaaugacuucuaggacagucaagguuacacagagaagcccugucucagaaaaaacaaacaaacaaacaaacaaacaaaacaaaacaaaaccaaccaaaaagcaaacaaacaagauaacaguaauaguaaaguuuaaaacuuuuuuaaaaaagaaaaauuugguccaauccuaucugagaaaaaguagugccauacauccugacccaccuccaggguuagcuucuguagggcucgcaccccuuccuaaggggccacacuacccauauucaccucuuuguugagucggucuacaguccuguucagcaaacgcuucugcuccuccaacucugccuugcuccuccggagagccucccgcugcuuccccucuuccucuagggcccgguucagugcuugcuguuccugcccaaggcgugccagcccccgcugggccucaucuagccggaccuccagagcccgcuuggcugcugccagguuccccuccuccucccgggcagcauucaaagccucuuccagcugcuguuucucuaccugggaggcgggagaggaggaaggcugggcugagagaaaggaaaacucaggcugaagcauuggagauaggaagaugaaaaagguaauguuggguguggugacacacaucucuaguccuagaacuugugaggcugacacaggccgaccucacuggucugcauagugaguuccaggccaggagggauuacauagucagaucuugccuaaaaaaaaaaaaaaaaaaaaguggacauccaaaccgacucagaaaucaaagcacugaacaagcaaagggugggagacaacaauaccagcgcagaguuugaaacauucacaccaaaucaguucagaaaacaaaccuaagcuuaauagauacauacggugagggaaaagggcagugcacauuggcaguaaaacugauggccacauaccgagaugggagcacaguacaugggggcguucuaagcugaguaccgagggguggcagugcaugagggcacacaacugagaaaggaggagggcaggagagagagcggggagaccccaagguggacaaaaguguuaccuccagccgaugcacuuugucccgaagccgugccuccaccgcuuccccaccuuccgccagaccucgggccuccuucaacugcugcuccagacccaggaugcgccuucggaauucgucauuuuccucuugugucucccgaagugugguuuccacgguugcccgacgcugccccagcaccauggccucugucucugaugccaccuuagccugcgggcaguugggagaaucggcucagaccgaggggcuccuauggguaagcauuuacacccaggaaaaagggguaccugagaacccacuaaaagcucacaggagcuagggauagagggguagcccuagccaggaaccuuccugacaaucuuaccccuacacagaugcagccacccugccaaauucugcuauuccccacacacaggagccuccagagcuccucaguacauacccaggauagguuaaguuugcaggaccucuggcuucucagcccuccugaccccucagccuccaccuccugagcccugggcccacuccccuugccuuggaagccucuucacaguccugccgcaguugcugcagggucuuuuguagcuggagguucugcugcuccagcucucggccucgaucagccuccucccucagcgcugccagcugcuucucuaacaccugguucuggugucgcccagucaccuccugguucugcugcucugccugaagcucuuuaagcucccccugggugcgucgaagcuccuagaaaggaaaaaaaaaaaaaaacccaguggcgagacucugcuauaaugagguucuggaaaguggagaaaauaagacuucacacaugaugggaagaaauauaaaugauaaggcugcuuucgagagcaauugggagaaucaaaaaagcugaacacaggcuaaucacaugacaaggcaauacuauguucaaguaaugugccuaagaaaaguggcaauucucacaaaaacuugcuuauaaaugucacagcaagaucagucacuguaugucaaacccagaagcaauccacauguccuuaaauuuuaaugaauagaacaucauacauccguaaaacuggaugaagccaggugugaugggacaugucuauaauccaacacacagaaggcagaggcaggaggaucagguugucaaggcaucuucagcuacagagcaaguuccaggcacuccuggacuacauaagacccuaucucaaaaaacuaaacacacauacauaaacaaaaagauaaagauuuuugauaccacacaguugaaucuugacuacaccagaugaaaaaaaaauccauaaauaaaaagccauuauuauagaauuacaauuauuugaaauauucagcuuaugcaagucuggagauacaaaauugucgggacacauagggaaggaccaccaaugggcaugggcgcuuucugggguuauuaaaacaucguguaacuagagaauggugaugguuucacaauacaaugaauauucuaaaauauaccaacugucugcuuucaaaugagaaauuuuaggccaaauaugguggugcacuaaucccagcacucaggaaacagaggcaggcagaucucugugaguucaaagccagccuggccuaucuagugaguccuugucucaaaaaacuaaaaaauaaagaggaauuuuauaguauaaaacuuuauaaaacaugacuggcugccaaauaaauaaaccaaaacacaaaauuauagcacaguaaauaguaauacaucuuaaacuucuuuuuaaagggcaguuaaaauauaaauuaugguucucuuuaguuauaauuuuaacuauaaguagcuauucuacuuaguuauuaacacuuuucaaacuuagcaauagccaauaagaccaaagggucacagaauaugcagugacuauaauguagacacuaacaaaaucccuuacaaagacagagaaacagagccacugccucgucugugucgggcuggguucgucugcgucccuaaccuauauguuguucaaauacuugauaaauuauaccuccuaccugaggcauaaugauaaauaagcuuuucuggaggacugugucaagcugugucaugucagcuaauauauuaauagguauuuuuaacuucacaacaacacguuauaugucauccaaaaauaauuagcugugcucuuuuuugauuugguuugguuugguguuuuuguuuuuguuuuuguuuuuguggagaaguucuuuuuccugggggaggguucuuuuuccugggaguugagaaagguucuuucuauagagcccuggcuauccuggaauucacuauguagaccagacuuaccuugaacucacagagaucuacugcuucuccuucccaaaugcuaauuaaaggcaugcaaccaccacacccgaccuauuagcuguguucuuauccuucauaaacuacaacaccaagaguaugaaacuggguuuauuuuaacuuuuaugacuuccucauaacucuuucaugaacuaucauccaugcaugaugaaaaaagauugacuuuuaggggaaaaaaaaagguggaagugagacucuugggaguguugugucaccaacccgccagcaaaacugugacuugggauacugggaagaugcacaucacccacuacaccccuugagccccauguccaggcugugugcuuuccaaauagccuuuggauuacaacuuggacuccgcaauuaggucagcgagccaagcggauaccagcaucccaguccagggauuauauuucucaauguaaauuaauaaacauccuaaaaaaauuguuuuuuuaucauauaguuaaugaauuucccccucaaagagcagguuuugcagugcugaccaaauuaagguucugaaccugcaaaaaugacccuggaguuuuacaaauccaccuauauucagcuaagaugucuuauaggagguagccagcaguuuuugccuguaccauaaacuggcuguugacagcucuuuuuuauuagagagcucuauaaccaacaaggagagcagccccgcaaagcugugaacccaaaccugagcugcuaggaugaagcuugaaagucacgcucauggaggcagccccacgagcgugggcagaggggucccaagugaggcagcagagcaucccaaccugccacucuacaccccaaguaccaaguaccaaguaccuuuuuaaguuccucaaccuggugaguaucucuuguacuggcucgggccugcucuaagucccucuguaagaccuccaucuucuccccaaguuccucuuccaucuccuccuucuccauccgcaguugcagcagucugaguucagcaagguuuuaaacaaaagauagaagaucaaggucagacuucacacaggggagauucacaggacaauggaaacuagcccuccggaggccacugccauagacacugacucaaggagagcacacagcuuaggaaacacgagugucagugugagagagaaggcaugggugggguccaagagggguacaagaguugguuaaauagcccugcaaaaggcaggagggucuuacuccugcuugguggcucucagcucuuccuuguucuucuggaacaugcucugccaaugcccugucuccucagaggucuccucuagcucucuuugcagcucccgcacgagggaagacaucuucugccucucagccuccagugcagcaugguccugaggaaagauaaaaaugaguaccaggaggcucagggggcaaagcucacuguuguaaaaaauaucuauuuauuuauuuauuuauuuuaugcauaugaguauacuauuguucucuucagacacaccagaagagggcaucagaucccauuacagaugguugugagccaccaugugguggcugggaauugaacucgggaccuuuggaagagcagucagugcucuuaaccgcugaaccgucucuccagccccaaagcucaccuuuaagacagaagacguacaaugcugggaagcugcaguucaccucucugccaucugcaacaagccucccuccauuaucucccuauggaguuuggccacacauccuuaagguucuuaaagccugugaugccucucccugcccugguagguuuccuaaccaaggcuucucacugcaucucacauaucuccuuuagggaaggcuccuaguggcaaccaugaaaaguucaaaaggacacuaauaaggcagccccauucccuggccgugucuuccuccuccagcuccaguuccugucacaugccugggucgcaucuugcaugcuccggcgaagcugcuccgugucucgcugguacugcagccggacauguuccaccuccuggucgugggaggccaccuccucuuucagggcccccuucagggcugucagcucccguucccucagccugagcugcuccucuacucguuguuugcccucuaagaguucuucuagaaguucccgggugucuaacaaguccuggacaucaggaaggugaaaacaauauggucauauuaggacucacucauucuguuaaguaacuuacccauuaagcaauaaauaaauaaauaaauaaauaaauaaauaaauaaauaaauaaauaaaauuauugcaggcuuggcaggguggcauaugcaucuaacccugauaauuagaaggccaagacagaaggaauacagguuacaagccagaauggacaacuuagccaagucccaccuccaaaaggaaaaugcauucauacuuuguauuagucuaguauuaggugcuucuugcccucuaagcugcccauagaauaaaggaaaacugucauucugggcucaagccucacacucccucugagucugcacacggagaagcacuggagaaaaccuaccagcuuuccguacuucaagcaaacagugggcgagugggccuggggaugcugagggaaccgagacuauucaccccacacccuguuuccuaccuuuaggagacuuuccuuuccagaaucgggacucuggcuaugcuugagcuuaagcuguagcuccuucaccugggccuccagcccaugccguaguccuucuuccuggccuagcaggagcuucauguucugaagucuaacaauagagagcaucacuggauacugugucaggcaguuacacaucuaccgcacguugauucauguaaacucccuuuaaaugucuauucgcuucauaauuugcuuugcagugcuggagauagaaggaccuugccaaacuggucagcacuucaccagcuaugccaugucucuauucaaaucuuuuuuuuucuuuauuuguuuucugugaauauauauauguaugggagagaaaucugugugacagucagaggacaaguugcaggagucaguucucucccucccacuugugugucccagggacugaacuuggguccucagguucugugguaagcaccuuuaccaacuaugccagcuccaagcccuaaaugaacuuuuauacccaacuauuucaauuaauacuuggagcuggggcuggagagaugacucagggguuaagagcaccgacugcucuuccaaagguccugaguucaaaucccagcaaccacaugguggcucacaaccauccauaaugagaucugacacccccuucugguacaucuggagauagcuacaguguacuuagauauaauaauaaauaaaucuuuuuuuaaaaaauucuuggagcuguccuuacgugagccagcccuccugcaucuaccucaguccucaccaccuucucacguguuacagucacucacacacuacauuucuucacuggcuguucccuaucuccgggagcuaagauucuggaguggagagcccugucuguaagguggaccucaggaacccucaucagagccucacauaaacaacaucacucacagacagaagacaccugcugcaucacuggguaaauccucacaauaauccugugagguagcugauuacuuuuagggccauuuuacaaacuaagaaccccagaucaugcacuaucaccauuaccacaggaagggaaagagaaaaccaauccuggcuccuuucgcuucugaagauucccccucugccuccuucaacccagggaggacccaccuguaggccaagccuugaagcuaacccacgugaccugcacgucacaugacccaucugcgcacucacuccuugcugcucugcuggaccucccccuuucuccucuccagcaacuccugcagucgguggcacucuucagccuucuccuccagcugccucuccagcccaacccuggaugguucuagcuucugccgcuucuggaagagacauggaaaagcuuguugaaagaucuaguauagcucugcgugguagcacaugccuguaauccugaccuugggaggcagaagcaggaagaucacuaggaauucaaggcuagccuggacggcacacuaauaauuccaggccaauugggcaguuuaggcuacagaguugauaucuugucaaucaaucaaucaaucaauguaccaaaccuccuuaaguccccuaaauguccuaguaauaacaaccaggagucaaaauuacgcaauuaagcugauuaucccugauuaucugcaucagacauugagaagugauucuuuuaagauguuccauuuugaggcaaucuguuuugcaacaaauggauaaagaguauauuauuaucuuuacuuacuguuaagaaaacaggauuugaauacuugaagaacucaacuaagauuaguuagacagccagcaacuacuagaaucaagguuugaacccauuaaguugauuccacuuaaccauuaaccuguacuguuuucuccuuaacuagaggacugcaaaccagcacaagcugaacuccaacuguguacagggcaacaccgagcaguggaagaagcaucuauaaagggcguggggcuggggguguggcuugaugguggggugcuugccuagcguagacaaagcccuggguuccauccccagcacugcauaaacugggcauugucauagacaucuguaauccaaaauuuaggagguaaagaaaggggauuagaaguucaaugucauucuuggccaacagugaguucagggccagcccuucugaagccuucccaacuccaaaacaaaggaaaaauaaaaaggucuagguuuuaggggaagaauggccgcaucuuuucauuccaucucugccacuuacugucacagcaauucucucacgcucuccuccgaccuucagacuucucaucagagaagguccuagugcacucugcacaaccacugacaagauuauguauuacccaggacaguaucugccaaaaaaacuacacucaacaaauucuacuauuauuguugccaucauaauuaugaugagaaaaagacuugagacacauagaauauaaguaauuuuuuuuuugagacaugguuucauguaacucuguuugucuucaagccugauaaaucccuagcggugaccuugaauuccugaucuuccugucucuacuuccugggugcugggcuuacaggcaaggacaaccaugauugguggcauucaguacuagggauugaacccagaacuugacacauguaaggcaagcauucuaucaacugagcuacauacaccaccagacggagaacgaaagcaaguuucucaggcuuuauauaagcaguaaauagcaagccugagauagggacuccuagggaaaaugagaaggaaguaguuagaucuccaaugugcuccacccaucuuggauccagagaaacucaaaguccuugcugggacgaggacacugacuucuucuugucucacauaauacagacaguacuuguccuacuacauagaagagcccagcccaggaaggcaugguggcacgugccuuugauuccagcagagugaggaagauucacucugggcuuugaauuaagcccagccagauauagucagucacucaguaagacacccugucucaaaaaaaaaagagccagccagccucguccauccccaggaaaggcuagcggcaucuucccugucguccucaucccucccguaaccagccucaccuucaccuccucauccagcuucuucugaaguuccuccauuuuucggguaagcucagccuguccugccagggccuugguagaagcaggagaaaccaucugcccgagguauugagaaacaaggggugggaagggagcccgcauccccaucccuggaggccucaaggcccuagccccgacccuugcucggaccccaagaaggccacucacccccagaggcugcauuugcuccagcaccaaacuaacuuuccuccucacagaugccucacucuccgagcuucuggaggacggaaggaaagaagcaagcgugagcagaggaaagggaaaagcaaggaagccagaggggcaggaggaaaguguaugcucccaccggguggaccccacucaccccucccuuaggaugccauagaugguggccuucacaugguccgcacugccugguggcgcugucucucucuggucucugagaaggucuggaguugauuugaacugggagagaaaaaugaagacaaggagaaaggaaagggagaggagagaaagagagggaagauuaggccagaagucuauaugugguucaaauggaacagagguggcaaaacagacaaggccucucagaaugaggaaugcuucaggccugaggaacagcccaggaaaaaaaguccaaaagcaggcuagaucucggcgauauugcugcagaugaggcuuuucucaauaaccagcugugagcuauguccuaaguaauuugucagugacgccaacagauugcuagaguauauacaugcacagagcucuagaauucacauaagucugucucaaaauaaagaugcuccccacuuggucacgacacugaguaaaaucagagaaagcacagucuuuaccaagccccuccaaggaccuuuccauauccuccaagccugcauuaugaaaggugccagaccuagcagacuggcguuugcugaugacugaagaacucuccaugcucacgucuacuuuccuuagaaucuuacccuugaaguauguuguguauguggcuauuuaguagcuaaaauggaggacaaaaggcagagagaccuucucuccuaguuuugugaguuagcaaaggagucugugggcugaugaaaagccagggagguuagaaauggggagggauggcaucugaccugcaccauggcuggaucccgugucuccucaaaacucugaagcacccagucuugagucugacgcgaacggcugaagcugcugaacgggcucugcuucugcgauggguucuuugaacuguccacaugguugucauacuuugugccgcggguccagugguuagcggacuggugcucccguuccucacguguaucccgugggagccugcuguccagacucuggcuccgcuugcgcuguucguggggaaguguccuugugcggcgcccagugcgaccccggaccugcccccccuucugacuaucaaacuuguugaugagcgaguccacugaagacaagggggcagugucaaugguguuaaucgaggaagucgguuuaggggcuaguuccagcaagcuggugcuccuauuacuaggacucauaaaggcaagcccggucagagaggcuugcgacugggaacggaucaguuuuccauucaagugguccuugggcuccucaucagaugugcugcuccgagaaguggcagggcgucccuugacuugagaguagggguuuucggggagcucugaaucggagcucagugcaccuggggacccccgguuguugcccccuuugaucuggaccccaaaggagucagucccuuucucuccacuguuaagaaccacaaacgguugcccggcgaugcccugcacacgcacagcgaccccauagguacuggcucuugcaucccuugcagggcgccgcccacuacgacgaagggugcccauuucaguagcacccucuggcucuguaauaaaucgaauuugaacuccauggucuacggggccccggggaucagccaucaugugugccuuccucacauguaggaggguuccuagaagaugaagaaaacaagcuuuagcuaaagagccugaagaagaaacccagcaucagggaagcuggcugccuaguuaguuccuucuauagaaaauggcucucauaucuuaucugagcaggagaaaugaaggguaugggagucccuucauuucuacucccaguuucugacuuauuaguccugagaaggaccuaagaauuuacauuccucagcaacuucuccugggugaugcugauacucucaguccagauagcacacuuugaaaaggcuaagaaaguaguucauuaguagacagcuugccuaguguguacaaggcccugaguuugaccccaaacauagcaagaagaaaaucaaaaugaaacauauaacauacuuugaggcccacaccccucaaauaauucauuucauuugaugcaauccugagaauuguggcuuauuaagacuuugaagauaaucuucugaucuucacauacaacacaaauugccauggguccaccaaguaaagguggaccccaaaaccugccuaucucauucucccacucccuugaaaaaaagaaaccuccuacugaagaguuuauuaagauaaauagaucauaaaauguggcaccccauuucuggggaagauacuccagcuggccucggugaugucucuaggguaaggguacugaaggcuggacagugaaguuaguuaauuucuacucuccgggaucucugcuguacugcuuucggucccuuuugaacuugguaccauauaaauguacuaccuaucugagaaaggacuucgggcuggguugugauucagugguaaagcauuugugagaucugggauucaauccuuagcaccaagagaggaaggaggcggagaggagggaggacuuaaauaugauuuucauucuuucuuuuuuaaaacaaagucuuauguggucaaagcuggccucacacuccuuacacagauaaccuuggacuucugauccuuguauuuccacuuaaguacuggucuuacaaagguagccauugggccugguuuuaugcaggcuggagcucaggguuucauguauguuaggcaagcacucuaccaaacagagcuucaucccuagcccuuucaauacagauucaagugagccagucaguccaagaagucaguccugaacaggcaggcugcaggauagagccacggccaucuccaggccaacucccagguccacauugcucacacuuagagucagcaaauggaauguguuccaggugugcucugacuccuggaacuugggagggagguuuuguuucaagcaaauuaacaucaacaaauguagcuucccugcuccuccugcuaguuuucacaggagcccugcaccaagcuggaggaggagccucaggugugcacuacagaaaaacaauagcacccaguucaaccucccugagaggcucuggccaaggaaacuuggcaaggucccucucagagauaguagcucuaggaagccaggaaacaggcagcuggaggcaggcggggcaggaggggcagcuggaggcaggaggggcaggagggccggaguccaggggagaaaggguuugggggagggacggguacugagggcauucuuagcaucccuaucccuucccaacuggagaaagggaugggcaaggaaaaccccuuuugugagaaugauucacacuuggggucaugagacugagaaagcaaugcaccuccuccaggacacagcccacacaagcuuuuaacagaauuuuuaaguuugugaaggcagagccuccagagagguugagagcagggguucucaaccacucugaguccucaacccuccagggaucgaaugacccuuucacaggggucaccuaagaccauuagaaagcacagauauuuacauuacaauucauaacagcagcaaacuuacaguuaugaaauagcaaugaaaauaauuuuaugauggggggucaccacaucaugaggaacuguauuaaaggggucacagcauuagaaaggcugagaacugcugcacuagagaaaggcucucacuugggaaaucauguacauaaaaucccagcacuugugaggcugaugcaggaggauugccaugaguucaagaucaguugcagagugagauuuugucucaauaaaaauaaguaauagggacuggagaugcccuuccagaggacccagguccagaggaucugacacucucauacagacaagcaggccaaaaaaaaaaaaaaaaaaaaaaagcacauaaauaaaaauauaaacuauaaacaggguguuaauaaacagacugcuugccuucuucaucuucaugugcaacaauuuuauaacagguaaacuuuuuuuuuuuuuuuuuugcgacaaggucuauguagcccaggcuggucuugaacuuauuaaguagcuagggauuguugcugagaaaauugagguucccucuuuggguucuuaagucucauuaauacaagaauuuauaaaugggccucagaaggaugcuuaaauacaauuuuauuagaguuugagagaggaaacaauagggcagacaaacugucaaucucagcaguugccagcagacgggaaauggaaagaaguugccagaagcaaaaaggagaaagccuugccuuuaagugugcagguucaguaguggaggucagcauccaaccacauggcagaagggaggaggacuucggaggaaaauaaaaugcccaggguauaugggaaagcccacccaagcuucaauagauagccgaaagaaagagagaagaaggcagcguggugcuugucucucugggaaaagcagaccauuuccugcaaagcuuccaucauuugcauauacucccagcagguuuaccucaguuuaccuccacacauuuacuuaauagacuguuuucugucuccuccaccagacaauaaacuccuccaggacaaagaccaagccuccuagcuggccucugccuggagcaugggguauacaaauaaauacuuuuuaaaggcuguaucccaaaccaaggcagacucucccagcagcagaaaguuaugcccgcggacgccucacucacagcauucuuugugccuuaguaacagcuuccuggucuggacucucugcccuauucgguccugaucuuauaaucagguguaccuaaacugccagcucucaagaaucacaugauuuauucaugauaaaguucugcccugucaggauaucugcagaucuuccagaucaggucauggagcuccuguguaggcacagcaaagugcccaacccuuugggccagagggccagacaaugccugggugcuacccaugauuccccuagguuccaaagacccccuucccccagccucaaucacuauccguuccacgaccuuugggucaggggacaggacugagagaucuuuagggugggucagaaaauagagcucuaaaugauucaacauggaaaacccgaaaccuacccgccuucaguuacagaggacagugggguggggccaagagaacagggcagcucugaggccuugcauaagcucuaggcagguaaacaaugaucaagaccaacaaugugaaguccagggcuugggcucucaccagaugccugccugacccucuuuucccucccuggcacaugcccagggcauuucucaccaacuguacucugggaaaagcccaggacagacguuaauucagcgccaucugucugccucugccauuucugccugaacacagggagaaaggacacuacaccuguaccagacagccacuucuuccugaguuacucauuagccugcccugccccaauuccaucaccucuggcccagccauacgcaucuggcuuccaacuaggagugacagggucccuggacuucuagcaggaaguagguggggguuggggguggggcgguuucagguguauggaggaagggcugauagacacagggccaggcgguaugcuggauacugaauagauaugcuggauacugaauaacuggaacauuuagaaaguaaaaaaacugaaaaaaaaaaaaaagcaaaacaaacaacaacaaaacaaaacagcaaucucagugguaacaagaaagcaaauaaaugaucaaaauaaaaacggaacgcucagugacauuaucauuugauaagaaggcuccuuuaggcccaaacagaacuccccaaguggacucuagaccauagucacugaaaaagcagaaaccugagagccaaacuagagcugcuuggccaguggggguaaaaaaacacaaugaagaacugggcccuuacaaacucgcuggacugguuugagaggcaaagagaagggagggccgggaaggcuacguuggaaccuugcaaagcagaccagagagguucccaccaaaggcagaggaacaagaccaagaguggaagcucuguccugccuauaugccaaggccgaggcuccucuggaggagguggcgggagguggggaggaggagacaggaguuacagaugcacaaagaacuuggugacaagccagagugugacaggaacuuugucucccuccaccacucccucucaaguucccaaaguggcauuccuggucuuccacuuaccucugucagcucccagguccuugguucuccccucccugguacaaagagaagcagcucuaccccccucuucucccacaaggguaaaggcaggcaagccagccugagaaccacaggaagccagaauccucuuagaaucaggcaaaucucugaaugggcaggccccagagcaagacccauacucccaaauacccaggaugaaaggaacacguaggcagcuuugucuacaaacauagcgguugcuaauuauuucccaauuacagcaacugucuucagacagagcaucaaaggggccaagcuaagguugacucugcuucaccgcugccuacggcaaggaaauucaccucagaaguugucuggugcccaacguauaccucgucuguggccugggaauguggagguguaaguccccuagucuuuuggucuccuagggaguucugccuauguuucugcaccacuaguaaguacucuagucuaucaaagaucgugaaucaaggaugccaacuaggauuucagggaaucaagaggauucugggaagggucaaggaaauuagcugcacuuccagaucucaccagugucccccaaucuagaacuagagaaaaagaaggaaauauagggcuggagagauggcucagcgguuaagacuguucuuccaaagguccugaguucaaaucccagcaaccacaugguggcucacaaccuucuguacagcuacaguauacucauauacauaaaauaaauaaauaaauaaaucuuuuuaaaaaauauacaaagagacuacuuuguaacagaaaaaaagaaggaaauauguauuugcuggaaggaaaaauuuuuacaucagccucaagaaagaagacuauuucuagguggguguggugauaugaaccuguaauccaggcacugggagcggaaggcagcccaccaguucaaggucagccucagcuguacagcaaguucaaguccagcaugggcuauggcaaauucaaggccagcaugggccauaugaaacccaguaucaauccucguuucacauccccgagaaagcaaacauuuucagcuaguaugugggucgagggauuuaugcuucuccauucccauuccccucucuuguagaauacacacaguucuuucuagaggaagaaggaaaaaauuucccuggcaugaaagcaaagaaagaaacagccuuaaauaaucucacaccuaggaaagagaugggugcccucguauucugaccuuagugucuuacuggcaacugcuuucaccuguaggcaaauggucagggaaugaccccacaccucagcauuuccaaagccagaaggagagugucagagaccaguaaggacugacgggggcggggaggggguaguuacccccaaaaccagcacaugcggauaucaccacuucagucucugaaccucuggcggcacuuccauuugcuccaauaggaugaacccucccccgcccccaugcuggucuccaagagaaauucugccccaagggcuggcgccugaccuccagagauuguagcgcugaaaugcaugcaugcccugggaauaaccuaacccucaggugccucacaccuggcaccuucccagccacucgcuucugacaccguggaguagggguuagcucuuagcucugccaccgcacucugaccgcccuuccugcuaaacucagcaccugugcccaggaggagggcauuugaugccucuacuccggcccucgagcauacuccugaggacccacucgcaucgcagguguccucgcuccagacagauucacucaccccgguccagaucagugcucccggauucacacaccccgcaggggaucgcgcuccgaccagccgagcuacacgcgcugcugcagcccagccccuccgagcucugagcucccuccuuucccccgcccaccaaccuguuacuccccaggagcuccgccccauuggccgucaccucccgccccgccucaccccuucuucuauuggucaguuucccgcaaggggcggagcagacaccgcgggaacccagaaccgggguccccagcccgguggacgggaggggcgguggggucacguggacugguggggcgagggcggggcaccgggggaccuaagaggccauuuugggggcgucggggcucugcggacccgcguagcuuagcgccagagcauccccuggguucugugggaagugccuuccucgugcucuucucaaagcaaaucucgguucacagcccuuucugcccuucaucugccuccgcauaagccagaauacaguucugucgcuuuccgcagaaaauuucuucguagucucccgaugucagcgcguucugcaucucugcucgccugccuuaucggcaauccgaaccaaaaucucagucguggauucucauccucgggcuccuggccuccauaaucauuuugcacccuuuuucuuuggaagauguaaucacccaauuuacaucacccuaaaaaucauuuucauuuuaucucccuaugaaaaucucggccagagccgagaucuucauuuucuuuuguuuuguacgcuucaucucaaacgccuauaacagaggucagcacauaguuggcucuuaauaaaauguguagaaugaaugacuugggaaccgagugcuguaaauuuacacgcaucagaauaagcuuuauaagcagaaaggagcucaacuacagauuguaaauccaucuuuucugaaagccugucaaguagggcuuuuggucccacuacaccgaaaagacucuggggugcuuugcgugcagacugaggcagguaacauuaaagcuggcuccuagugucaaucgcugagguauguuaaaagaagauuggcuuagcuuaccuugcuggccucugaauaguucucuccuuuauuuguucaguaaauauuuauuguaauauauuuagauuugaagaggaaucuucccuacagccagcauuucuguggcguuagcuggagaucauucccuuccccucccccagccuucagaugcugggcguggacccuggaggggaaaguccaccuaccuguucuguagcuggguugcuaggucuccgcauu

SEQ ID NO: 1559 - RNA, 2871 nt, Mus musculus
cuuccguuuccggugacgcuagcgcuuucauuucugucggcugaggugacuaagauggaagcguuuugggagucacgggcuggccacugggccggggguccggcuccagggcaguuuuaccgcaucccggccacccccagcggccucauggacccggcgucggcgcccugcgagggucccaucacucggacccagugagucgcgcucucaccgcgccgggaaugggcggcgggccgggaugcggggaccucugaugcgcgggcgccagcaaucggggcuccggccucgcgcucagggacccuuuucacgauucaggaaccccauggugaccgggacaucgguacucggggugaaguucgacggcggaguggugauugcugcagacaugcugggcuccuacggcucccuggcucguuuccgcaauaucucucguauuaugcgagucaacgacagcacuaugcugggugccucgggagacuacgcugauuuccaguauuugaaacaaguucucggccagaugguguaagucgccuccaaguggagcggacagccuuccguuuauuauuccuguaggcgggauggagggacuugagacuuuggguaauuguugagacauuugugaauguuuggaauacuuuuugguauugggggggguggucuuggauuguagaauuguguguagaacagggagugggauggggagccugaccuguuaucauugcuuucucaauuguauuuaaggauugaugaagagcuguugggagauggacacagcuauagcccuagagcuauucauucaugguugacaagagccauguacagccgccgcuccaagaugaauccccuguggaacaccauggucauuggaggcuaugcugacggagaaagguauuugauaacuuccuugaccgccuaaccuagcaccuauguagugucucuucagucuuuaaacagaaugguucuuuacacuucuuuugguauuugugcuuguguaguacuguguguguguuugugugugcaugcaucuucugcauuguggauucuagagaucaaacuugggucaucgggcaugcuggcaagugcccucaccaccgagcuauccugcuuccccacccucaggcacuuugaccccagagaauuuccaucuuuuaauucagaccuaauggacacagcuaagaaauggaagauuagaucaguucuuugauguguuugucccucuagcuuccucgguuauguggacaugcuugguguagcuuaugaagccccuucacuggccacugguuauggugcauacuuggcucagguaaguagugggccuagcgauggggagaagagaaauagaaaugagaaggcaauguuaaucucuuucccuuggaauuuugauaagagaggcuggaauccuaacguugggcagcugguuuucuuugucuaaggagaauacguuuacauuaacuuccagugacaagaaacagccuuggaauggaaacaguggcagcccuaggcuuccccacuuuuaagagagucuuagcugggcaugguggcacauaucuguaauauuagugcacaggaggcugaggccaggaggaccaugcauagcaagacugcauguauguaggcugcauagcaagacuauuucaaacacaaaacaaagacuccuuggguuaagucacuuuccaaggcugacaggcagccuggggucaccaugguggaggagacaaccagcaccuaagagcuguuuucucacuucugcgugcaugugcacauacccauacaaaagaauucaaugucaaacaaacaaagccagcaccuaauucuuuugaaacaguggguagaaaacucauccacuuuggugccuguuuacauggguuagaguagguugccuucuguuaagccagucuaauuucuccaauguuuugcccgccuguguagccucugcuucgagaaguucuagagaagcagccagugcugagucagacugaggcucgggagcuuguggagcgcugcaugagagugcuguacuacagagaugcccguucguauaaccgggugagaaaugggcuggaagguacaaauucuggagccaggcaugguggcacaugccuuuaaucccaguagggaaacaggggugggugggacucugcauuugaggcgagcuugguuuacauagugagacgcuaucauugcacgcuuugccuucuuucaguuucaaauugccacugugacugaaaagggugucgagauagaaggaccgcuguccgcacagaccaacugggacaucgcucacaugaucaggugagcaagcuacaguagggaucggugacacagggaagcucuugacuuuuacagaauggcucuucuggaggguucaagcagaaacucugugugggugguuuuggagggaaccucuccagguugggggcgggggaacucuccagguggguggucuuggaaauggggagcuccuucagaaguugaugccuuuauccgccuucauuuucccuaaauguuucuucuuucuuuaguggcuuugaaugaaauccaguugaauguccagaguguugaagcuuugcucuucuaaacgugacuguagcuggcucaaaggcagacuuuuguaaaauaaaucagucguuugaaguguucgcugaguuggauuuuguguuuugaaacaggauuuauguagcccaggcuugccuggaacgcagaaaucugccucccaaaagcuagagguaaaagcuucuggcauagcuggcaauucaguguuuauucuaacauggucacauugagaccucagcuaccaaguacugcuuuguaccauguccgugcuguuuccuuuccuggagagaaccauuuaagucuuaaugugugugccca

SEQ ID NO: 1560 - RNA, 3017 nt, Mus musculus
guuccaggacagccaggacuacacagagaaacccugucucgaaaaaccaaaaaaaaaaaaaaaaaaaaagaaaaagaaaaaaaaaaagauacuaacuauauggaacauaaaaucagaccuuuacaaaaguaggaaacaauaugaacgcuuuaugauauugaaauaaucagaggcucaacaaagcucacaguagcagcaucugcagauucauaacuaaacuuuuugguagaguugacucaggaggggaaggaugacagaguaaguaguggaaaugaaaagaaaaagaacacaugagcuucguguuugaaagaacggggugcugauggcacacgccuucagcccagcacucuggaggcagaggccagccugaucuacacagugaguuccagaccaaacagggacaaccagugagauucuaucuuuaaagaaaggaaagagaaaggacaugaaaugcauacuaaccuggaaaaacgacucaggagcccaaauaguauauauaguuauuaaguaacuugaaccaguaguuaauauuaugccuacaaagagcacacaguggugcauaccuuuagucucagcagucggggggcagaggcagccuggucuacauagcgaguuccagggcagcagagcuaccuaacagacccugucuugaaaacaaaacaaaacaaaauuauguccacaaagaaacauaaggcucagauggcuuuauaggugaguuuuuaucaaacauucaagaacaguucauuucuaugugauguaaacucuuccauaaaguaagacaagaggcaacaguccccagcucagaggguacacagaccaaaaggaccaucuuagaaaccucuuuagaaaucuuacuaaaaacaaaggcacucauauacaagaauguucauagcagcauuguguauaauaacagaagccugccgacagcccaaguguuacucaguaggugaguggcuaaguugcuugaugggguauuauacagaugcagaggaacaagucauagcaauuacaacagaggagucggagaaacaauggguaagugcaaaaaagcaaaccucaaggaacacaggacaacauuuuuuaaagcuaaaaauacaagcaauacaaaauuauacauuccuaaagaauauauauacacauggccaauauauauaaacaaaugauuaauaaccaaaaauuaaagacagugauuaccucuaggaagaggccgggcaagggggaaaaaacuacuuucaauguauaaauugaaugaugggucauagguauucauugcauuucauaauuuauaguacauauuucuuuauagauaucaaagauuacuuauaauuuuuaaaaaaucuguucucauggaaauaaauggacaaaugggugguaucucccugaaagaaaaucuauuucuugggaauaaaaccaagauucccugacaagaagcuguccuguggggaggacggaguagguccuugauuaauaugggcugguuuccugcuguucccaaggacacagcuggagcgucugcauccuuccugcaggugcucccugacucgcagcaucuguuaauccagccuaagcccacaguccuggcuagguccugacacaugugacaagugcaugacaucugguggcugcagaaugaagguaauguaaugaaauggcuugggaggggcauucauauccucugagaaggugacacuagguugggagguaggaaacacggcugcggagaaaguuuaagauucagacccuaaaaggagcuuguucugggagacagaggugcgaaagcuguccuguaagaaugaagagacuaacgagaauggcuuccuucucuguccuuccgaggcuacaaugagauaaaaguuagagcugcacugagggagaugcaagguucaggggacaggcagcaguccagcucaucccagccuagcaagcuaaaccgcacccagcggucguuagcugcuccccagcaacaauuccauccuccacccaagccuccaucuggggaaccugggacugugagacggcggacuccacccuuucccaagggugguccacgauguguagagacacauuugcauaaacaucuuccuggccauacuagcuggccaaggguggaacugaccuuggcugguuaaucaugguaaaucuuugggcuuuugcuaggauuccuggcacaaugauagauacccuuucuuucugcuuagauauaacggucaaacagaagccugggaguguugguggcugugaagugguccaaacuaaggaugguuuuacauuaugugaagcagaagaacagagugugcaaucagaucaagccucaccugcagccaggacugccucuugauucugcaacuucagcugauaaacugcuuuuaucuuuaaugaguuuugaguuaaguucccuaugauuagaagccagaauaucccuaaccuacuuacccuaucuccuaggagaacacagggauauaggugggaagucauuacagauuugcuguuuguauuaaagccaugguacugagcuagaaaggccugaagcagccacgaggcacaaagcaagccaggccacuggguucccugugggggaagacuagcuggaugagaaggaggcucagugaagggccucugccaggcagcaggcagagcucacaugaacauagccacucuucccccacagaccuaucugucuaucauggggguguugcuuuggggucuuuaugcucagggguuagggaacuuugaaguacacgacccuuuaacccuuuguugcccuguguugcagcaucagccucucccuuuaccaacugaagagccucuuuuugaauucugcccuugauaacacucacuuuugaagugacaggaggaauuuuaucuucugcuucuuuggcuuccugggaacucaagcuccuuucuccuuuggaaacagcaccaucuugcugaccuugcacaagcacuguuucccgcucagccucacccccuggcccugguccuucuggucucccaaugaaguuguuuucucuuuuuga

SEQ ID NO: 1561 - RNA, 907 nt, Mus musculus
ugucaaacccuguuuuuaaugaugguuccuaaaugcuuuaaccucucuuguaacccaccacccaccagagguaauggaaaagaaaugauacaggagcggggaagggggcgcgggccugucuauaaaggcucuuugcaacaacuccugucuguguugucuggaaaucagcaguugaguucacaggucagcaggcaguggcagcucaauccauucgcaaacaccucacagauacaccagcaguccaguucaguccagucaggauagcaacagcagugacacgaccuagcagagacagccaggcuucagccuugccaugaguuagcaggagagaccaggaggaacaccaggagaggcugugccucucucacggaagugaagaucaagacaaaaguguugcacagcuagcuguaccaacaagccaagcugucacuugucuccuucaccccauggaguccuauuuauacccuccaaacaucccguuuccuccacgugccuugccucuggauggcucuugucucagcacgugcauccaaucagcuugaguccuuggaaacgacaagaagcucggcacaccaccagaaguuucuugguguguuucucugccggaccgugggugggugggaaagaggagggagggagagagccugaguccugccagaguuccagugcucugagccggcagacacgggaggacugcuggacgcuuuccacgcagucccagguagguaucuggcugugugaagccacugaccccacacagcaggugguggacaaggggcaggccccgguaccagguucucagucuccagcaucccaggcuggauacggaggagcugagaacagaauagggccccugguguggcaugggagauaugggaagagagggcacugggaaagaggggcgcug

SEQ ID NO: 1562 - RNA, 9927 nt, Mus musculus
uugaagcaaaaggggaaaacuugccaagcuuuauuccaucauaaaggcagcagagcacaucuaagccucuauccaaccccgucuuuacaguccccgggcagacacagcuaccccucccuccggucucacuucuucucuuccucuuucuugucauucuugccauccuugguggccugggaggccagagcccccaugacacuucgaauggcugcauuguugggauccacaccuggaagguucucuaggacgcucugaaggaacuccggguccugcaugacgucauagucauccuccuccugaaaaaaggcacacggagcagcggagugcggugacagggggcaacaacauguuguaagggacagcaacauguugcugcccacuccugugugcagcuaagggaaugagaggggcaagccaacaagacccaugauguccaugaauggugugcauuccccaaagcacagaagccggagaccucugcuaacggagcucagagaggaaaccagaugccaccacagcagcuuucuugggggggggggggaaccagcacuccuuucccccaggcccucuugggaggagccccacagaacuguuagggauggagaugacaggccacucccacuagaaaauuccaggacaacggaaauaaaaacaccuaaguguuuccuucuguugcuccaagaccuuucuuaugaaaugccagagaggaaaggcccuggucccaaaaggauaaagaucugaaugcaggggaugucagacuuggcugggucagagccucacugcuggcccucaccuugacuggaucagauguguccauggcugagcuggcauccaugucagccgauucuuggcuaaacucugaggaaaggagagcagcagcccgcucagugcuagcuccucaccccagacucuguccaggcccugccacccaagccauggcccaccuguucccugcagggacaucugcauggcguaggcgaucugcucuuccucagucaugcugcuuaggucuggaagcccaggacggccaaacuccugcugguugauggucaucuucaguagggcgucauccgagucugggcaaggacagaaggccaggguagaccuaguagauauuccacagggcuggccacacugcuccccaagcccagcccagcccugcccuccccacugcaucgugaaauggcuagcacccucaggcccaggaguucagaauccaccucuuucaccuucagucccagguguagcaauuccagccucagcugcagaggccgcagcggcccgccgugccucuuccuccugccgcugccgcugcucuuccauagagacucgaagggccugguaaagagcaagacaagggggcuggagagauggcucagcgguuaagagcgccagcugcucuucugaagguccugaguucaaaucccagcaaccacaugguagcucaaaaccaucuguaaugagaucugaugcccucuucuggggugucugaagagagcuacagcauacuuacauauaaugaauauauaaugaauaaauacaucuuuaaaaaaaaaaaaagagagagcaagacaagaucaacuccuggagaccaccacagucgaugcugugguauccuacacaggaugacaccuccucuggcuugccgcaugggaaagaagcuguaacacugacaagcccuaguagaaaauggaagaagcaaggcagagucuguguuuaauugggaaaaaugaagacacuagagucuugcauuggugcccuucaaggaagugaaaagggucuuagagaacggugguacggaaguguucaggacugucucgucccaucagcuggggaucuguacagagaacagaaccccagggucaacauuugcuuaccagggccaauucaggaucagcacugggaucuacuccaaacucaaagucacuggcaccaagacccagcauggcaccgccuucaccagccagaauaggagaacugaugagagcaucagccaagcuagguccaggaggcacugucacuagaugggacccaguuccauccuugccauucaguguguucacaaaggcugucagcuucucuguguucaccuccuguagagcagagagcacaagacagacaccuccuucacuuacugcuucucagucuacggcugcagccaucuccagaguccccgagggagcucaacucuaugaaaggauggccguguucauaacgugggaucggauccuaugcucugcaacccugacuuaccucuuccccaaaauuaaugaugucaacauucacuuuuucuuucuuaaggcguuuagcuaguuucaccagcuaugaagaaagggagaaaaaucaagaaauugauucucuguagugaggacugaauuugccucacagacgcauacagaaauucagcauccuaccaaaggucuggccccaacacugacaucacacauccaccuuuccccagaugacaugccuaacaccucugcccaguucuaaguacugcaagccacuuccaaauggaggccugccuggcaggcugucuguggacucacauccuucucguuguccuccacagggcuaccgacaaaggcgaugaugcgcaucuugugauucuugcccugccggugcuucagagccaacuuggaagggaaaagaaguucccgugaaucccagcagcacaugucccugagucagucugcauuuccugcuccuuacaguaccuaugaaccucaagucuaccauaaugcucacucgguacaugccuccucuuucuguugugccucaaguggaccagaguguaagaccaagucucauccugccccauccuuucuauacugaguaagcacccucuagaucaguggcucccaccuuggagggguuggaugaccguuucacaggguagcauauuagaaauuaaccuuaucauucauaacaauaggcaaaaucguaguuaugaguagcaccaaaacaauuuuacggcuggggucaucacagcacgaggaacuguauugaaggcugagaagcacugguccagguccucucgucuugcucuauucagcacuagaucacagcucuggacagaaaggaucacagacccucauagcagggagccaacaggacucacgugggccacgcggaugccagugcagaaggugaucuugccuuuggguuggacaguguggagcuuggagaggauacggccaguguccggggugaguguggucagcaccucacagucacuaaaugugagcaaagaauuuuagugaguucagaccacacaagugccuccuaaccaugcccauucaucuucuccuuucuuuuuucccucagagacaggguuucucuguguagcccuggcuguccugaaauucacuauguagaccaggcuggccucaaacucagaaauccaauugucucugccucccgagugcugagacuaaaggugugugccaucuuuuguuuagagaccuuaaaagcaacuuuuaucuuuuuuucugaagacaugguucagugguuaagagcacucacccagcacucacaaucagcucuaacuccagucccaggggaugugaaccccuuuucugaccuuugugggcauuaugcaugaccauggugcauaaacauaauacauguaggcaaaacauuuauauacauaaaauacaaaguaagucuuaaaaaacaaggcaaaaaaaaagguacauaucaaguuugaaguuagccaggacuacaugaaaacccgguguggaaaacaagucaaaaucaagacacccucccccagcgcagcaagcuguccuacuccugaaggagguggaacacaggacuggaugagcauagccugugcuaucaaccaaagggcagucaccugcaacccaacaugggagcaccacccaccuucacagccccacugugucccacguacuuggccagugugaucaggcccacguuauucucaggguugcuucgggucuuugagugacauacaauguugacggcauccugcugggccugcagccgggugggaaggaagucuccguuccgcauguacucacuguuguccacacugucagauaaggagaaaaggacacuggaggaugcccugaaacauccucuauaauggaggaccccuucuacaccuccugccagacacacgugguacagcgguggcucucaggcuucuuggaacacagugguggcacaugccuuuaaucccagcacuugggaggcagagacagauggauuucugaguuccaaggccagccuggucuacagaaugaauuccaggacagccagggcuaaacagagaaacugucucgaaaaaaaaaaaaaaaaaaccaaaaaacaaaacaaaaaaagauuuauuuuauauaugugaguacacuauugcucucuucagacacaccagaagagggcaucagaucccauuacagaugguugugagcgaaccaugugguugcugggaauugaacucagaaccucugaaaaagcagucaguguuccuaacugcugagccaucucuccagccaggaauucuuuccaucuuaaacaggugagguagcauacagcuguaauacuggaacuccguguauauagcuaggaggaucuggaauucauggacagccucaaauacauuguaaguuugaggccagccugggcuaugugagacccuaucucaaagaaaacaacaacaacaacaaaaccaaccccaaccaaacucuacauaauaugaaacauaaacuccagcuucucgguuucccaccuuuuuuggucacacaaccuaccaucuaccauugagccacauuccugguucaagaccaacucuuggugacccaugaggucuaggagaguucuugcagccaguggcacuacuugugcuaaggaaagagagcagugcccagaacaagauacuuuauucuacuccaaagaaaaucuagcucagagguaacuucuuuccaccuuauaaaguuuuaucuaguaauaaauagaaucaaaaaaugguaaggaaggguaauguacucaaaaagcagaaacaggauuaucaggaguggggugucaaucagagguccaagcucagguucucauucugcaccuacuuuuuuuuuuuuuuccgagacaggguuuuucucuguguagcccuggcuguccuggaacucacucuguagaccagguuggccucaaacucacgagauccgccugccucugccuccugagucugcaccuacuuuuaaaucuauccauuuguguguauggcuguucugucugcuuguauguauggugccaugugcucaccuacugccuauggaaggcagaagccgguguuggauucgcugggacugaaguuacagacaauuugaaacaacucguagaugcugggaauuagagccgugcccucuguaagagcagccauugaacaucacuuuccagccccugguuaauuuuuuaauucuaagaaaauugcauguuucucuaaggucacuuuuuuauucuauuacacuugggaacucagaacaaauaugggcacaugcugcugccacuugcauauagaagucagaggacagcuuuugggaacugggucucuccucccaggguuccagaaacugaacaggucaucagacuuacaaggcaagcacuuuuagcagcugagcuaucuugccaaauucuguguaguuuuucuuguauucucuacacggaguugcuuugagaauuacaugcauauaaagcacugagcauaguaccuaauacuuagcaaaggugaacacagauuacauguaugauauccuggauuugaucauacaacaaaacaggaagcauuccaggagaguaguuuaguggugacccaaacacacaucuguaaacaaacuaugugaagaugcagcugauccacuggccaugucucuaagcuccgcuuuccugaaacagauccaacuucucuuccaggagagguguggcagccucucaaacuucaaauaaagcugcggguccauauauaaaaccagaggcuucaagcacaguuuggauggaacagcuacuaagugcaaggacuguacacaaggacaacgaauaaauaaagauggggaaagcagucagaauaggaaaggugaagggggugggggguaggagggaaagggaacugacaaugagcacugaggcuguguugcccucgccaucauugggaaggagagugguuacugguagaaaaaccacaggugcauguguuccuuaaaaagccacauugucaauguuaauccuccuauuccagaggcaggaggauuacaggaaauuccuggcagggcuacauagcaagauccuguuucaaacaaaacaccacacuggccagcuuucccuguuuccagcuugguaugaaugggguaauguuaccugcauuucuuagaacugcuuucccucagcaccaugggauucgcucuuucauuccccaaaucauaaacuuuugagcuuaagguauuacccaagcuuuccaugacaucauaauuuuaacacugaauacugcugggaugaaguccugugcuggggugcuucuagcaugaacaaggcccugcgcuugauccucaauauugcaaaaucaauuaauccaucaacacaggacaggcaacagagcauaccuguggcucagcuacuugggaagucaaaagaggauuucuugaauccagaaucugggggcaacaaacugagauccugucacucuguccccucccaaccucucccucaaacucagucucccuuagaaacagcuuucuaagccgggugugguggugcacgccuuuaaucccagcacuugggaggcagaggcaggagaaacccugucgaaagaaagaaagaaagaaagaaagaaagaaagaaagaaagaaagaaagaaagaccaaaaaaccaaaaaagaaaagagacugcuuucuguaacugaagacgacacugagcugaucuuccugaguggaccucuucagugcugugauuacagguguggaccagcacaucagacgcuagcuaacaucucuuuauaacaaucaauacaacggaguucgaguucuagaacucccuaccuacuggccaaauguaaugccaugcauuaaaaacuaacaagagaaucuggcucagcagauuaaagcuaaagucaaaacacuugcauuuuagaauagaccccuacagaaaacucuguugccuggaaauccaagacaccucauagaaaacaagagggucucauucuguggcaauuacacugacggcuaaggucucagguucuauucuuuccuuuuauguauaaaucuaauuuuuuuguuuuuugcuuuuuuguuguuguuguuuuugguuuuuucgaggcaggguuucucuguauagcccuggcuguccuggaacucacucuguagaccaggcuggccucaacucagaaauccaccugccucugccucccgagugcugggauuaaaggugugugccaccaugccuggcuuuuuuuuguuuuuuguuuuuuuuaaacaggaccucaauaugcauuccaaguuggccuugaacucaugauccuucugucucaaccauccaguguucucaacagguguguaccacaucuggccagaucaauauucuuaaaucagugucagucuguacaaaggucugacuccaucacccucagaaucuucucacugggguauagaacagaguucaagcucuucagucauuucuuucuacagugacuccucccaccuuacaacaaucuauguuaagguucacucuggucuauuucccaaacacgggacucuuacuucagcaacuuuguaaugaccucuccucaacaugucuuuuuacagcucuuaaauucugaggauuccccaaacaccaugccgcuacagagcucuauacuuuacagagcaccaucacauauggcuuaccugcuuguacuaugagacacagagaaguuacuacaauucuccaacaauaugcaaaauguaagugagagccagggaacuguuuggauucuaaauccaucuucuauuuuaacauacucuaucccagaagugaaagcaaacuuagaaaacaaaaauagggcuggugagauggcucaguggguaagagcacccgacugcucuuccgaagguccagaguucaaaucccagcaaccacaugguggcucacaaccauccguaacaagaucugacucccucuucuggugugucugaagacagcuacaguguauuuacauauaauaaauaaauaaaucuaaaaaaaaaaaaaaaaauuaaaaaaaaaaaaaacaaaaauauaggacuuaaaaguuaaauuuuaauuucagaugaauaaugaguaacuuucgagauuuauauuuauuguuuuuaggugugugugcgggcaccuacagagaucaaaggcacugaucuucugguccugucaagaaggcagcagcgaggggcgugguggcgcacaccuuuaaucccagcgcucgggaggcagaggcaggcggauuucugaguucgaggccagccuggucuacaaagugagcuccaggacagccagggcuacacagagaaacccugucucgaaaaaccaaaaaaaaaaaaaaaaaaaaagaaggcagcagcaaacaacaugggugcuuggaaccaaacucugugcucuuacccacccaaccaucucaccacccucaacaaguaacuauuuuguuguuguuuuuguuuuauuuuaccaccuuuugagacagggcuucucugcauguccuagaacuugcucuauagaccaggcuggccucaaccccuaagagauccaccugccucugcugcccaagugcugggauuaaaggugugugccacuacugcccggccccaacaaguaacuuguaagagcaauauuuggguuggacuuaaaauucccuuucauacuaaaaaaucacucaugauuugcuugaaauucaaauuuaacugggcauucugguagucuuauuuugagacagaaccuugcuagguaguccugaucaugaaaacucccugucucauccuccaagugcaggaaaccaagcuuaagccauccugcauuuagguggcagugcuagccaaucuccaaaugaaaacaugggccuagugacucaaguuuuuaauccuacauacucauuccaaguucaaggccaaccugugcaucuucucaaauagcgacuucaaagccagucugagcuacagugucaaagcuccaucuaaaacaauaaugaugacaaauaauaaaugcaauccaggugugugaugaggcucauugguagagcacguucccagcguucacaaugcucuggauucaauucccagaaaacacaaaacaaaguccucuuguagcccugaaaaaaaauauguucucagcuuucuauuuauuuucuuguccucaguuucuaaucuaacucuuaauagguacucaucccaaguauaaaccugauaaaaccuaguucauccugcuuaucacggccucuuaauuugcugugugacuacagcggauccccuaaaguccuuccgacucauuaugagacaaggacuauuuuccaagaaugcgguugugagguuuacaugcgauaaaguacagagaaaagaaaaacuuggaggcgaguggagggggcaguuggccucugcuuuaugggagaccugaaauucagggaagggaacaggaguucccgggccugcguuccugggccgggaugacucagggagucgucugccagagucccgcgggccccgaagccacaucucgcccggcgacccaguccccagcccaggcccucggguuucggcgccacgcgcaccaacaacccagacgcgccccccagccacguccgaagcuccucaccaaaccauagugcucuccaacaccaucuugccuccuucccucugcggaccggcuccgggacugacaaacaacagcaccuccgauuggccuggugcucaucaccaauca

SEQ ID NO: 1563 - RNA, 12032 nt, Mus musculus
uagugucgagugccgaucugcgagaaccccgagcugggccaggggcugaaggcggcagcgcagucgcuguaggcgguaugaguuuggcugggggccgggccccacggaaaaccgcugggaaccggcuuucugggcuccuggaagcagaggaggaagaugaguucuaccagacaacuuacggggguuucaccgaggcaagagccgggcccaggaagagggaaagagagaggcgaggagaagggaaaacccuggacaaagaggaagggggcggggauugagaaaggcucggaaaggcgcuccgggcuggacggcggaguggaggggacuuugugugugugugcgcgcgcguguguaugugccucugugugcgugugugugugcgcgcauguguguuugugucugugucuuugucggcuuugcaauuuucuucggaguguguguguguguguguguguguguguguguguguuuaucggcuuuacaauuuucuuguacgcuccuggcuggauggcggagucuggaggagugugugugcguaucagugucugugucuuugucggcuuugaaguuuucucgucccgcugccgaguuauuuaccaaaaggaaccuguccagaaacaaacuuaauuagcacacucuccgccgggcgugguggcgcacgccuuuaaucccagcacucgggaggcagaggcaggcggauuucugaguucgaggccagccuggucuacaaagugaguuccaggacagccagggcuauacagagaaacccugucucgaaaaaccaaaaaaaaaaaaaaccaaaaaaaaaaaaaaaaaaacaaaaaaguuagcacacucucguuuucagcuuucaaaucauagcuuacuguuuucuuaggugacccuuuaucgacuaagagaauccccauuuauuuccaucauagaaacaaaauuucaguuuacaguuagauuugguuuaugucucauuuucugguugguuuuaaggucuguaacagaauucggucuuuuuuuuacaaacaaggcugacauuuggcuaaauuuuuguuaauagaagcuguucagugauugaauauauguuguacaaccagaucagcauacuauauguaauuaaaugguugugguggauuccuuggaaacauuaaaaacuucccugaggauggaaauauaguuuguagcucaguaguauaucacuagccuagaaaaugaguccuagauccuggauuacuggccccuggcaguaaauaaaaacaagcccuaccuugcagggcaacugucugggauccuagucagcuuagauacuguacgauaaagacuuaaguucaagauaacaggugagagguuuguguuuuguuuuuuaaauuguauuauguuugugugucugcauauggagaccagaggcaacuuguaggaguucagucucucuuuucaucauaggagcccaaggaagcaaacucagguggucaggguuauacagcaagcuccuuugcccacagagccacccugaaggucccagaguuguuaaagacaggcagugcuggggaaauaacauuuaaaaugaggacauuuauaaagagcagaccuuggcuggcugaagagucagggaggaaaaggagggcucaguuggaaaggcacugagguccuggugugaaaccuauagauaugguuuuguagauugcuauggaggauauaggccugagcuggauuugguuuuguucuaugagauaggguuucucuacauagcucugacugucuugaaacucacuuggaacuaggucagucuggccucacagaggucaacuugcuuuaggccaccacgcucagcuucuuugccucccaagggacucuacuccuggccuuauauagauuuuguuuguucacuugcuuuuauuuuuaauuuauuuuuuauauuuuagauuuguuuauuuuuuauguauguuguuguuggcugcaugucugucugugugagggugccagagccucugggucuagaguuacaaacacuggugagcugccaugugggugcugggauuuugaaccaguccucuggaagaauagacaguguucuuauccauugagcagucuggccagcccuccuuauacaguuuuuauuuauuuuuuuguuuguuuguuuuguuuuuuuguuuugauuuuuuucgagacaggguuucucuguguagcccuggcuguccuggaacucacucuguagaccaggauggccucgaacucagaaauccgccugccucugccucccaagugcugggauuaaaggugugcgccaccacugcccaguuacauauagucucaaagccuagguagcccuucugccucacacuccugaguccuggaacuguagguauuugucaccacccuuguauucccccuuucaccucccagucagauuuuguaagccauagugaagcaauaguaagcaguuugacuucucauuuaaaggucugaaaugaggcaucaaaguuccaucauuaacuuuuugguuaaaaagauuucucuagugcugguagucuuggggagguagcacaggaagaugaucucugguuccaggccaucuugacuguguuuccaguuccaucuugacucagccuuacagacaaacaaacccuaaugaguaaagccuaaagagggcaagggcagaaaagaaauacggacaagggcuggacuggggaggacacugcuauuccgggguaauuugcuuagcuuagcuggagguuccagcucccagcacuacggaauggagguggguaugggacaguguuaaguaggguugaagggaaguuuuugaaaaagaguggacaggacuuuaugacuaacugggagccacuauguacacagcuuuaauaaacuaguuuaaaauagaucucucucauccuuccuccaagguucauuuccuauuccugucguuuuaugagucgcuauuuaauacaugcaccucaugcuuccagaaaggauauauaaaaaggcuuacaauggaaacaaaaauuaggaauaguaaaaguagaaaaggugccgaacaaaauguauuuuauuaaugugugaaauuuuuaaauaaugaguaaaauuauguacauauuuuuaaaucagaaguaauuuugccgagaauccauguuaaaauggaaauagcauuugauggcugugaguuuccuagcagucaaacuaaauuuguuaugacugaaguauacaguauauucaagaaagacaaauugggcuggagagauggcucaaaguuaaaagaguacugacuguucuuccagagauccugaguucaauucccagaaaccacauggugacuccucauaaucaucuguaaugggaucugaugcccucuuuggguaugucugaagacagcuacaguguacucauauaaauaaaucuuuuuuuuuuuuaaggauuuaaaaaaaaaagucaaauuuauuuagcauuaaauuccagggagaauuucuuauuauaugagguacaacuaaaguaaucaggggcuugauagagaacauucucuugcuguguauuaaaggacccagugcuauaacaguaaauccauagugcccugaaaacacuaagacuaagcaguaacauaguaggaacuugaucuccccucuggugaugugccuuaauacaagaguagagcugagagaguucauguguucugagucucuuucacaaacaguaguuaggaagcguaguggucguuugugcuggcuagcuuagaauuucagccauuuguuauuugcuugcuuugacagcauguguacccaauccauugguugugucccugcuugaagacagagcauaugcuugagauucugcccaagccuguugacuuccccuucguccagugacaccuccucccaggguagcugccauugaaacuuuaacucucagguugcacaucaggccuuucuaacucuuaauucccauagcuuucugcaguauuccauggacauaccccaaauuucaguggaucccauuauccauagaaguauuccaauauuuuucuuucccagugcucaugaaggaggauacauucucucggcagcuguaccuucagagugauggucaacagugagacaaggcagaugagguaacugagccucuuggccuacagauuaggucauaaguuuuuuggcuuugccauuuagauuucuguguagaaagccuggaguagagagguggcucagcugcuaaaagaacacuugcuguucuugucaaggacuugggcuuggcuccuagcacccacaugaugcuaaacaaccauccaucacucuucauucuaaaggaucugauccccucuucuguccuccuugagcacacacccacacaugcacauacauacaugcagucagaacacucauccacauaccaaaaaauguguuucuccauugaaaaaggugugcagcugggcgugguggcacaugccuuuaaucucagaggcagguggauuucugaguucgaggccagccuggucuacagagugaguuccaggacagccagggcuacacagagaaacccugucucggaaaaaaaaaaaaaaaaaagaaagaaaaaggugugcgccuccuuuugacucuuacaggccuagagaagcauccacuguuagaaggaggcugugacggagcuagagcagucagcuagcaggcgucuuuuaaauguuugccaucuuuuuacagcggaggguuuaugugccacaccuacauguaaaagucaagggacaacuugaaggagguguucucucucccaggcgggcccuggaaucaggugucaaguuucuuuacaugcugagcugucucacuggcccuaacauggcuucuuggcaggaacaagcucucugcuugugucuaaauccuuauucuaugaaugugcugugcguaccugucugccuuuucaccuaccuguaauucacucuuccgucuuggcuguuuugaacaauacguguguauuaaaucaaggcuuuucuccuuuuugucccucagagugaugcagcagguucagcaagcugcacuuuguuuagauccggcccacuaccuguguuaauagagcaguauauaguuucccugcuggguaugguagcaggccuauaaucccagcccuugggaaagagacacaugaggaucaagagaucaaggucauccugggcuccauagaguuugaagauagcuuggguaaaaucuguuuuuauuaaaacaaaacaaggggcuagagacauggcucaaugguuaagagcauguacucucuuucagaggaccugaguucaguccccaguccccaugucaguuagcucacaauagccuuuaauuccaguguugggagcugaugcucucuucugaacuccagagggaucuacacuuagcacgugugcacacuugcaugugcccgcgcgcacacacacacacacacacacacauaagcacaugcaugcaugcacguacauauaaguaaaauaaaaauucuaaagaaaagaguuucuguuccuuuggcuuuuuuuuuuuuuuuuuuuuuaagauuuauuuauuauuauaucuaaguacacuagcugucuuuuagauacaccagaagagggcgucagaucucauuacggaugguugcgagccaucaugugguugcugggauuugaacucaggaccuucagaagagcaaucggugcuuuuaaccacugagccaucucuccagccccuccuuuggcuuuuuuauaaagaaguaaugccuuaaagcuuagaccuguuacccaaccagacuauucugauuugcuuucuuuuuucuuucuuuuuuuuuuuuuucuauuguuuuugagacaggucucucugcauacauagcccaggcuggccuggaacuuacuauguggaccaggcugacuuuacagaaaucccccuccucugccucccuagugcugggauuaaagguaccuaccaccauuuccagcuuguaacuuuuuuuuuuuaaacacugauagagauugaacccaaggucuacucuacuguagagcuauagcuccagccaagaguguagccucagacucaugauucuuccuggaaugugccaccccauuuauuugucuuuguuuuuauuuauguggguuuuuaaaaaaggauuuaguuuuccuuuauguauauggauguuuuacuuauggugcaccaagugcaugcguugcuuauggauaucaaagaaggguaugaucccguggaacuggaguuauaacugguugucagcagccauguagaugccuagaacugagcccggggcuucccaaauugcagugccaucucucuagccucaguuuuuguguuuuuguuacaggguuucauguucugcagacuggccucaaacuggcaacaucaccaaagaugacuuugaacuucuuuuuuauuguuguuuuuaguguauuguuuauuuuuauuuuaugugcauugguguaugucugugugaguguguccaaaccuggguccucuggaagaacagcuaguggucuuaaccccagagccaucucuagccccagugacuuugaacuugugacccuccugcucccacugccuuagcacugagauugcaguuuuacaacauugcacccacuuaauucaguguuggagguugaacccagggccucuuucgugcuagauaaacauuguuccaacugagcuauauccucagcccuuauuuagguuuuugggaccagcaucucuuauacccucuguuaaccaaggaauuuuauaucuauuucccugugucacaacuuauuugguugauuuuuuuuucuuucuuuuccauauagagucucauuguagcuuaugcuguccuagaccucacuguguaaccugggcugcccucaaauuuacugcaauccucuugcuaggccuccugagugcuguauuauagucaugaaucaucaugacucaugguccagcuacaacuucuuuucauugcaguguccuauuggucaguaaaugagggcaaaccacauucagagccuuuagaucccuaguaauugacguggaguuuuauagaggucaaucuccaguaacaccaggaaacagugguacuaagcuaagaaccgucaacugggaagacuuugucuguggggugugaagagccaaauaagaaagaauuggaugggccuuaucaggggagugaauugauccacuuccuccucaaggaacauuaacggagccauggccggccagcucucaucucccuguauccucaggaaucuggagaugaugaguaucaaggagaccagucugauacggaggaugagguagacucugacuuugacauugaugaaggggaugaaccauccagugauggagaagcggaagagccaaggaggaagcgcagagucgucaccaaagccuauaagguaagaggacaugguuuccuuggucuuguuuaauuuuuucuuacagggugggcuggagguggggguuguuugucugaaacaaugucuugcuauguagaacaggcugccucaaaggaaaggaguccagccugccucugcccaccaugucuugggguuuaagccccagcucugccuggcuuagguguguucuccuccucaugcugggugcuaauuuucucggauacaauccucaccucuuauuuuccggugucuguuucuaacuuguccccaggagccucuaaagagcuugaggccucgcaaggucagcaccccagcaagcagcucccagaaggccagagaggagaagacgcugcugccacuggagcuccaggacgauggcucugacagugaguuuacgucugcagacccugagguugauaauuguugauucuaacgagaauccucugugugugugugugugugugugugugugugugugugugugugugugugcaugugugugcaugugugacuuuaaccccuuccacccccaaaaaagaaaagaaaaugaagcuagaaaugugccggcuaugguggugcagcucugauuccagcccuccagaggcagaggcccgaggagcucuggguuccaggucagacuggccuacagugaauuccaggacagccagagcugcacagucagaacauacauuuuuuuaaaaaaaaaaaaguagaaaugaauucagagcuuucuucccaucucacuaucugcaggccgcaagucuaugcgucagucuacagcugagcacacacgacaaacguuccuucggguucaagagaggcaaggacagucccggaggcggaaggguccccacugugagcgaccacuaacccaggaagagcugcucagggaggccaagaucacugaagagcucaacuuacguucacucggucagucugguuuggggaaaauaggugcaugagaaaagcugagaccuagaggaccagagaacuggaaacuuguagcagaauaauuagaaaguucauacuuacuauccccagcacuggggagugcaagccagcuuggccugcuucaccaguucucgccucgccaagacucuguagaaggggcuuugucuugaaacacgaaaaacacacaaaaagaagaaaugaggcuguguaauaggagagggaucaggcaguuaagagugucugaaguagccaggcauggugcucauacuuuuaaucccugugcucaggaggcagagacgggcaggucuauggguucaggacagccagagcuacacagagaaaucuuuaucuggagucuuggugggguuguauguauggggaggggugucagcgugacugaguuccaguuaguguaaaauaacaauugcuugguugguuuuuccuguuuugagagaaagcaauaucgccuagucaaaacaggccagacauagugguggagaucugugaucucagucuauggcagacagagacagcagaaucaggcauucaaggccuuucuggauuguaugagccuugacucuaacgggaaaugucuaagucagggagagauuucuaggcgggcucugaccaggcuugagaggaccguguccacguggaggaacagcacagaucugugguucauuuagagauaaaggaucagaguacugugaucuguuuacucacuaacagauacguauugagucccugaaacagacauguugaaucuuucaugguccugauaauguguagcuaaugugaguuacuacugcccuucaugaugcaacagcuauaacugauagugaacugauagugugccacaggaccuagcaagggacacaguggagccagccaugggaacugagggguuacauagaaaugccugaaaagaagagucacuuaguuuagcuuuuugucccuugagaaugcaaacuugggcuggaaacauggcucagaguuccuuccagagguccucugaguucagagccaaccacaugguggcuuacaaccaucuauaaugagaucuggaguccuggccugcaggcaugcaggcaggcagaaugcuguauacauaauaaauaaaucuuaaaaaaaaaaaaaaaaaaaaaaaaaaaaggucagguagugguggcacaugccuuuaaucccagcacuggggaggcagaggcagguggauuucugaguucaaggccagccuggucuacaaagugaguuccaggacagccagggaaacacagagaaacccugucucaaaaaaagagagagagaaagagagagagagagagagagaaauacagacucagcuggcaaugguugcacacacacuuuuuuuuuuuuuuuuaaagauuuauuuauuauuauauguaagaacacuguagcugucuucagacacaccagaagagggagucagaucuuguuacggaugguuguuagccaccaugugguugcugggauuugaacuccggaccuucggaagagcagucgggugcucuuacccacugagccaccucaccagccccgcacacacacuuuuaaucucagcaccugggaggcagagucaggcagaucucugaguuccgggagagccaaagccacacagagaaacccugucucaaaaagccaaaaaagaaacaaagaaacaaaaucacaggacagagcccagagagcugugauagcucagcagguaaagcaguuggugacagccugaguuuaauucuuggaauccacacgauggaagccgagaacugacccuagcacauugucaucugaccucuccacacauguguucauguacauacacucuugaaaauacauauguguaauuuaaguagaugacaggccagagugugggaaaggaaagcugaccauucugucguuucucccuucgauccugcagagaccuaugaaaggcuggaggcugacaaaaagaagcagguucacaagaagcggaagugcccugggccaauaaucaccuaccacucagugacggugccgcuuguuggggagcccggccccaaggaggaaaauguggacguggaagggugagugaaccccgugcccccggcuucucuaggaguuuacuuuucucacugcacacauucagaccucagcucauuccuucccucugcuggcugccagcaccagguaaguagucucugagcggggagugaggaugaucaaagagaagacagcagacacaggacaagagaggggucugucagugaguacuguaguagcccaaguguaaugcguguagccuucugauaccgcagugucucaggauauaaaacuaacaagcuagcagaaacaauugcugccauguauauaggguaucugaucucauccugaggccucccuguuccuuccuccgagguuaacagaauguuuaccucuuccucucaagccuuacguguaucucuuccuaacguuuuaugucagcaggccaggaaaucuggcagcagacccugaccugccuugacucugccuggcgggcagacuuuuacucuacuugagaagcagacaaauggcucugacacuuccuguuguuuuguuuugaguuggucuuacucuguagcucuggcuggccuggaacuccuuauauagcccaggcuaguauucaugaucuacccgccucuuucuccuuaguauuggggucacaaaugugaagcaucaugcccaacuuuuuauuuuauuuuauuauuuguuuguuugcuuauuuauuuauuuuauuuuaauguauaucaguguuuugccugcuuugucuggccugguacccauugaagccagaagagggugacauauuccguguaacugaaguuacagacgguugugagccacuguuugagugcuaggccucaaaccucuauccugggagaguagcccagcucuuaacugcugagccaucuuuccagccccauggccugguaaauacugaggucacagccagcaaaccuagccuaccaccuuccuuugucugucuccgcagcauuuugugacuuuucucuugcccucagccuugauccugcuccuacagccucugcacuggcuccacaugcugggaccgggacuggagcugccgcugccaccccuccugcucacugcucucgcaccuucaucacguucagugaugaugcaacguuugaagagugguucccccaggggcgacccccgaaggucccggugcgggaggucugcccagugacccaccguccagcuuuguaccgggacccuguuacagacauacccuaugccacugcuagagccuucaagaucauccgugaggcguacaagaaguacaucacugcccacggacuuccacccaccgccucggcgcugggccccgggcccccaccccccgagccacuaccuggcucugggccucgagccuugcgucagaagauugucaucaaauagagacaccugaccccuagacagucccucuccugaccuggcucuccacuccgcccucccuucugccaaccuucgcccuuguuucccucaguuccucccuaguucauuucauuuacuugugcucuucauuuuuuuaaucuaauaaaaugguaaaauccuuuuugucugauguguaagguuggggcagaggcagggggauuucugaguucgaggccaaccuggucuacagagugaguuccaggacagccagggcuaaacagacaaauccugucuugga

SEQ ID NO: 1564 - RNA, 7630 nt, Mus musculus
cuuucugacagacuuauuaauagggcaccgggcugaaagcagcugacgcuuggcaagguuuugagagaaaguggaggaggggccagaaguauggggagccauguaccuuguagggaaggaguggccagccugcgaaggagcagacuugaaauccugagacugaacaaggaaccggacuccaggaucagugugcucccaggacccacugcaguuuauuuguaggacaaauggggaaagggguuauuaauguuaguccaaggggagaucggggggcucuuccucaucagagucaaacucaacauuuucauccuuuauccaucgaccucguccaucugggacccauccagagcugcgagcaggagagaaagagaacuggucagggaggagauuuaugaaaggcuuccugugcugcguugcaucccaggaaccuacagcauaggaaggaagaaccaaccccuguaagcugcccucagacuuacagaagugugccccuauaaagauaaauaagcaaauacaauuuuuuaaaagguuacuggugauaagaaaaaagcaguuggauuggucugaaaacaggcaggucccggggaaauagaaggaaacccaaggaccgcaauccagcacucacucaccuucggaggguaagguaaugguucaggacucaucguuugguggggcucaugggugcagaggccaagagagcugcugacucuuuggcaucugaucucucccuaggcucagguuccuuacugaucucugcacucuggaguuggaccucugcaguuggcaaaggaggacuggagacagagggagcaggggcuucuggucugggcagugaagaaccaaaguguguaaaacuaaguacaggaaagcagcaacuuccccauggcccccaagccagaagagcagcgcuugaaacugauuucuuucagacuuugguuuguuugauauuugagacaggguuucucugugaaguccuggcugacgggaacucacuccgguaggucaggcuggccucaaacucagagauccaccugccucugcuuucuaaguguuagaacuaaagguaugcaucaccacugccuggcuccaguuccuuaagaucuuaaauauucuacauaugaaagaccuuggagggcuggugagauggcucaguggguaaaagcacccgacugcucuuccaaagguccggaguucaaaucccagcaaccacaugguggcucacaaccaucugacucccucuucuagagugucugaagacagcuacaguguacuuacauauaauaaauaaauaaauaaauaaauaaaucuuuaaaaaaaaaaaaaaaaaagaaagaccuuggaauuaggaacuugagaaaagcuggggcuggagagauggcucaguguuuaagaccacuggcuguuuuuccagaggaucuggguucaauuuccagcacccacaugccagcucacaaauaucuguaacuccaccucucacacccucacggacauauaugcaggaaaaacaccaaugcacauaaaauaaaaaauaaaggagaaaaaaaggaauuugaggaaaaacuagcuuaauaguuuguaauggcuauuccuaguugucaacuaugucuggaaugaacuaaauuccagaauuggggggcacaccugugauccagaucuugaggcuggaagacucaggcuucugaucuggaucuuggcauggagaucuugaggcacaguggcugugaaaagcuuagguccaggcaagguauaacaugccuuuaaucccaggaggcaaggagaacucugauucaaagucagccugggacaaagcaagucccagauccaggugugguguacacgccuuaauguaggccacaccuucugcuggaggccuacauaagaccacuggaagaaggaagacucacucuucuuccacugcuugcacuuacuugccaagcacaucuuuagaaccuauuuauacaagaccagcugaaacaaccagccuugugggacugagcaacuauuagauucuuagacuucucauucacagcugcccauuguuguaacccaacaacaugacuacaaacuguaagucauuacaauaaauuaccucaauauagacagauauuccauaaguuuuguaacuuuccauauuccuuaugcucuaauacauaguucuaagaguuuuuuguuuguuuguuugguugguugguugguuugguuugguuuuucgagacaggguuucucuguguaguccuggcuguccuggagcucacucuguagaccaggcuggccucaaacucagaagucugcuuaccucugccucccaagugcugggauuaaaggcgucgccaccacugcccggcugguucuaaguuuuugucuuaagauuuuccaaggccaggcauggagugcucaccuuuaaucccaacacuugagggauagaagcaggcagaucuuugugaauaugaggucaccuuggucuaaauagcaggguuucaggacagccagggcuacaaacaaacaaaaaguacaccaccgugcucuacuaauguuacaauucucucuuuuugaauguauuuauuuauugcacuuuuuaaaauauaggagugcucugucugcauguguaccuacaugccagaagagaucccuuuuggaugguugugagccaccaugugguugcuaagaauugaacucaggacuucuggaagagcccccugcguuccuaaccacugaggcaucucaccaagcccuaauguuccuaauaaguaugauuauucuacaauuuuccacuugcuaaaaaauuuauuuuaaaaucauaaaccaccgggcagugguggugcacgccuuuaaucccagcacuugggaggcagagguaagcagauuucugaggcuagccuggucuacagagugaguuccaggacagccagggcuacacagagaaacccugucucaaaaaacaaacaaacaaaaaacccaaaaaacaaaaaaccugaaaaaaugaugguuuacgauuucuuuuauauauaugaguacacuguagcugucuucagacaccccagaagagggcgccagaucucauuauggaugguugugaaccaucaugugguugcugggaauugaacucaggaccucuggaagagcagucagugcucuuaacugcugagccaucuguccagccccuaccaucauuuaaaaaaaauauuuccacaagauuauuauuucucagaauacaaucuggagagcaauaacuuuaaagucaucuauuuccuucuacccuuuuccacuccuggcuuucccauuccacggaccugugcuuccuccggcagcaacuguuauaguggggagcucuguguagagcauucugggugaugauucgagucuggguuagcaaaggagccuggugaugaagagacagaguuagagcuguuaggagcaaacguucccucaagccuguugugugaaguauagcccugucuaaaccacaccugaugcccucucaccucaguuuugcuuucugucuucaauucguucugcugucuuggauuuugcucuguucccuugccuguuugcuuuuugccauagaaaagcuucagaccugagaacaaaagcaaggaggaaugaaaagcacaaugccugguggcuugcucuccaucucccgcccuccccacuucucugauacuuacuggacaaaugcuucuugccugcacggugggcugucaacauggccagcgugucuaguacuggucgaugggggcagauggcacaagcaaagcuagggaaacgagaagugaaugauguguguggugugugguguguauguuguguguucgagagccugcagucgggguguucuugcuauggugaguagguccuacuucugucagaguacuccaccaccaacucccagguuucccgaucuccaccccuuacacuucacuuccagccaaagaguccuauuauacuccugaacuccuuagugacaaaaguuuguugagccuuugauccccgaauccccaggcuugauccacucuucgcucucaccguccaucccgcagcaucagugccucguccucagggauguaacuagccagcagguccccaacucuccguuucugcagggagcaggauaggagaaaugaguaagagggacggauggaaaugaaauaguauggauaaggagucaaauggcacacggggcuaugcagaucauaggguaguaggggucaccacucaguucugguccccuaagcccuccccuagaugucgccagagcaacaaaacaaaacaacagggcggcugaaggugaucagacucucacuaaggcuuacuuugagcacauugaguugacuccagucguccccuucccucuuaaaagacauagcgacugugagacuacgauaaauuccccuacgccuacuucgcugcuccuuuaggccaccguagaaagaguacacuaucgccuucucugcuuccgguuucuuucuuguugaaucuguacuuccggggaugauguuccacgcuugcgucgcgcgaaccggaagacccgccuccagcgcccugagggggccugcauuuccuacaauacuuugagacgcugugccuuuugggaaaugaagucuuuugguuauuuauuuuauuuuuuuauuuuuuugaagagcacacugcucaccuggacacaggaccucacaucucgaaggauccagguguucggagacucaagauccuguauguggagccggaauuucagggugggaccuuccugauguggagcgaggcgucagggaucucaguggacuauauacuacaaacucuugcuguccucaggcucguacuccucagccacaaccuaccuggggugggccuuauuuggaacagagaggaugugggagcacccggcaucccgacuguuggauguggggauacacugagggaagaguguugaugagggugucuaggguucaaaggucagagaucaggcuugcgaggaguuggggagggggcgucgaaagucaaccgggucagcgacugacagcucagggaagauacuuauggguaaggagcucguggaaagagaaauguaaccggccuggcagacuucuuaagagacggacaguaacuccaggcacggcaagaagcagcaagaggaggacgacgaauguagucucucgagagucgggagacuguagagagacgagagaagagaaaacgaauuaucugaauauccauuccuuggguucggccgucacuguuacuuagcugggcuucccucaguugugacccuaggucuugacagugaggagauggcuucucccucuagacagccuccccucggggggucagggcugcugcaugggagccgugcucguucuuauggaagccugguacaaucauccugcuccccagugagggaaagacgccuggagcaucaauuggagccuggagacacccuggcuggauuagcacucaaauacgggguaacggugagucuuccagaauugagauagucccgagaaaguggguggcccgcuaagaugcccccucucacauuauuuaaauucuauuauggucuguuuuuuuucuuccuuauuuugcuuucacaucucagcagagcacuguugggacagaucugcccaacuaucccagugggaggagcaacuccuguagauggugagggaggugggugagugggggcggggcuuacagccauuaacuggacuugugucccuaucaacuuaagacugauaaaccaguuugaucaaggucgaaucacuuaagugucagaguaagguuucugucugacucuaaagccgguacuauuagccaugcgggggugggguagggguggggguggggauguagagacugguaaggaagagcugacuuuuacuagcacucugaaggugcccauuuguaguucuuauuuccaccccaaggcucuguuuucuuugugcagaggcacaaaacaaguccccucuacauacuucaaguguuucaggucaucuuuaggagagguuugaugggcauaaaaaauaucuugcauuaaaguugcagccuuccugucuauauccuguuuuaccacauacaaacaaauguuggguuuagauaaauuccugugccacucuacuuaaagcauaagguaagccuuucuggagacacagcauacguuugucgaugugcucauggaauuuaaauucucaugaggagcagagaagaaacaagaaaugcuguaaggaauauccacaaggggucggagauccagaacuauugagucuugcucggaagugggaguggauaguauuugaugugggguuuugugugugugugugugugggggguggauuuucuagacaguguggccuggaacuuccgguguucuugcaucaugacugcugagauuaggagugugacaaccacacucugaggugcaggcuuaggaguaccgucaccacgggccuugaagaccuagaaacuuuccccucuguucccaccuacaaaucuguucaacccaguuguuuguauccuugucuuccagcagcccacaagcuuuuuaagagcugaaaucaguuccuuucaacauugugccucuaaacccuggcauagucucagucaugugggaguuuaaaagaugauugaaagcugccaggcauggcaguguaccccuuuaauccgagcacuugggaagcagaggcagacggauuucugaguuggaggccagccuggucuauagagugaguuucaggacagccaggucuaaaaaaaagucugaaagccagacuuggugguccaugccaaacuucugauguuagcccucaggagccuaagucaaagggaugcagaguucuaggccagcuccacauauaacaaaaccaggguacuggaguugaaaguguaauucagugguagaaugcagaagagagacaaggcuagacacuuccugugggggcuaaauauacacaguccuugaauccuuuuugaauccucauucaaugaagagccauaggaaguugcuaugccagcaagaggguuaauagcuuuuucuagauaucaagagaaagaugugggcaugaaagaggaagaacagucacguguggccguggugggcgcaaguaugagagaacacaugugagguguuuauuuacuuaauaucugaggucugccagggguccagucuaggacugcacacacuaggcaagcucuuuaccauggagcuacaacucuagacaccaagacuuauuuacuuauuuuauuauuagucaaggucucaauauguaguuuaguuggcuucacacucauagaccugccugccucugcuuuccaagugcugggauuagagaauugcacuauuagcuuggagugguagcacaugccuuuaauccuagcacaggguggguuggugggggaauaggcagguggaucucugaauuugaggugaaccuggucuauagagugaguucaaggacauauagggcuacacaugcauguauggccauuugcuauggggugccuggugccuauagaggucagaagaucaccuggaucugaaguuacagacugcaguugucuucagacacaccagaaggggacauuggaucucauuacagaugguugugagccaccaugugguugcugggaauugaacucaggaucu

SEQ ID NO: 1565 - RNA, 7630 nt, Mus musculus
agauccugaguucaauucccagcaaccacaugguggcucacaaccaucuguaaugagauccaauguccccuucuggugugucugaagacaacugcagucuguaacuucagauccaggugaucuucugaccucuauaggcaccaggcaccccauagcaaauggccauacaugcauguguagcccuauauguccuugaacucacucuauagaccagguucaccucaaauucagagauccaccugccuauucccccaccaacccacccugugcuaggauuaaaggcaugugcuaccacuccaagcuaauagugcaauucucuaaucccagcacuuggaaagcagaggcaggcaggucuaugagugugaagccaacuaaacuacauauugagaccuugacuaauaauaaaauaaguaaauaagucuuggugucuagaguuguagcuccaugguaaagagcuugccuagugugugcaguccuagacuggaccccuggcagaccucagauauuaaguaaauaaacaccucacauguguucucucauacuugcgcccaccacggccacacgugacuguucuuccucuuucaugcccacaucuuucucuugauaucuagaaaaagcuauuaacccucuugcuggcauagcaacuuccuauggcucuucauugaaugaggauucaaaaaggauucaaggacuguguauauuuagcccccacaggaagugucuagccuugucucucuucugcauucuaccacugaauuacacuuucaacuccaguacccugguuuuguuauauguggagcuggccuagaacucugcaucccuuugacuuaggcuccugagggcuaacaucagaaguuuggcauggaccaccaagucuggcuuucagacuuuuuuuuagaccuggcuguccugaaacucacucuauagaccaggcuggccuccaacucagaaauccgucugccucugcuucccaagugcucggauuaaagggguacacugccaugccuggcagcuuucaaucaucuuuuaaacucccacaugacugagacuaugccaggguuuagaggcacaauguugaaaggaacugauuucagcucuuaaaaagcuugugggcugcuggaagacaaggauacaaacaacuggguugaacagauuuguaggugggaacagaggggaaaguuucuaggucuucaaggcccguggugacgguacuccuaagccugcaccucagagugugguugucacacuccuaaucucagcagucaugaugcaagaacaccggaaguuccaggccacacugucuagaaaauccaccccccacacacacacacacacaaaaccccacaucaaauacuauccacucccacuuccgagcaagacucaauaguucuggaucuccgaccccuuguggauauuccuuacagcauuucuuguuucuucucugcuccucaugagaauuuaaauuccaugagcacaucgacaaacguaugcugugucuccagaaaggcuuaccuuaugcuuuaaguagaguggcacaggaauuuaucuaaacccaacauuuguuuguaugugguaaaacaggauauagacaggaaggcugcaacuuuaaugcaagauauuuuuuaugcccaucaaaccucuccuaaagaugaccugaaacacuugaaguauguagaggggacuuguuuugugccucugcacaaagaaaacagagccuugggguggaaauaagaacuacaaaugggcaccuucagagugcuaguaaaagucagcucuuccuuaccagucucuacauccccacccccaccccuaccccacccccgcauggcuaauaguaccggcuuuagagucagacagaaaccuuacucugacacuuaagugauucgaccuugaucaaacugguuuaucagucuuaaguugauagggacacaaguccaguuaauggcuguaagccccgcccccacucacccaccucccucaccaucuacaggaguugcuccucccacugggauaguugggcagaucugucccaacagugcucugcugagaugugaaagcaaaauaaggaagaaaaaaaacagaccauaauagaauuuaaauaaugugagagggggcaucuuagcgggccacccacuuucucgggacuaucucaauucuggaagacucaccguuaccccguauuugagugcuaauccagccagggugucuccaggcuccaauugaugcuccaggcgucuuucccucacuggggagcaggaugauuguaccaggcuuccauaagaacgagcacggcucccaugcagcagcccugaccccccgaggggaggcugucuagagggagaagccaucuccucacugucaagaccuagggucacaacugagggaagcccagcuaaguaacagugacggccgaacccaaggaauggauauucagauaauucguuuucucuucucucgucucucuacagucucccgacucucgagagacuacauucgucguccuccucuugcugcuucuugccgugccuggaguuacuguccgucucuuaagaagucugccaggccgguuacauuucucuuuccacgagcuccuuacccauaaguaucuucccugagcugucagucgcugacccgguugacuuucgacgcccccuccccaacuccucgcaagccugaucucugaccuuugaacccuagacacccucaucaacacucuucccucaguguauccccacauccaacagucgggaugccgggugcucccacauccucucuguuccaaauaaggcccaccccagguagguuguggcugaggaguacgagccugaggacagcaagaguuuguaguauauaguccacugagaucccugacgccucgcuccacaucaggaaggucccacccugaaauuccggcuccacauacaggaucuugagucuccgaacaccuggauccuucgagaugugagguccuguguccaggugagcagugugcucuucaaaaaaauaaaaaaauaaaauaaauaaccaaaagacuucauuucccaaaaggcacagcgucucaaaguauuguaggaaaugcaggcccccucagggcgcuggaggcgggucuuccgguucgcgcgacgcaagcguggaacaucauccccggaaguacagauucaacaagaaagaaaccggaagcagagaaggcgauaguguacucuuucuacgguggccuaaaggagcagcgaaguaggcguaggggaauuuaucguagucucacagucgcuaugucuuuuaagagggaaggggacgacuggagucaacucaaugugcucaaaguaagccuuagugagagucugaucaccuucagccgcccuguuguuuuguuuuguugcucuggcgacaucuaggggagggcuuaggggaccagaacugaguggugaccccuacuacccuaugaucugcauagccccgugugccauuugacuccuuauccauacuauuucauuuccauccgucccucuuacucauuucuccuauccugcucccugcagaaacggagaguuggggaccugcuggcuaguuacaucccugaggacgaggcacugaugcugcgggauggacggugagagcgaagaguggaucaagccuggggauucggggaucaaaggcucaacaaacuuuugucacuaaggaguucaggaguauaauaggacucuuuggcuggaagugaaguguaagggguggagaucgggaaaccugggaguuggugguggaguacucugacagaaguaggaccuacucaccauagcaagaacaccccgacugcaggcucucgaacacacaacauacacaccacacaccacacacaucauucacuucucguuucccuagcuuugcuugugccaucugcccccaucgaccaguacuagacacgcuggccauguugacagcccaccgugcaggcaagaagcauuuguccaguaaguaucagagaaguggggagggcgggagauggagagcaagccaccaggcauugugcuuuucauuccuccuugcuuuuguucucaggucugaagcuuuucuauggcaaaaagcaaacaggcaagggaacagagcaaaauccaagacagcagaacgaauugaagacagaaagcaaaacugaggugagagggcaucaggugugguuuagacagggcuauacuucacacaacaggcuugagggaacguuugcuccuaacagcucuaacucugucucuucaucaccaggcuccuuugcuaacccagacucgaaucaucacccagaaugcucuacacagagcuccccacuauaacaguugcugccggaggaagcacagguccguggaaugggaaagccaggaguggaaaaggguagaaggaaauagaugacuuuaaaguuauugcucuccagauuguauucugagaaauaauaaucuuguggaaauauuuuuuuuaaaugaugguaggggcuggacagauggcucagcaguuaagagcacugacugcucuuccagagguccugaguucaauucccagcaaccacaugaugguucacaaccauccauaaugagaucuggcgcccucuucuggggugucugaagacagcuacaguguacucauauauauaaaagaaaucguaaaccaucauuuuuucagguuuuuuguuuuuuggguuuuuuguuuguuuguuuuuugagacaggguuucucuguguagcccuggcuguccuggaacucacucuguagaccaggcuagccucagaaaucugcuuaccucugccucccaagugcugggauuaaaggcgugcaccaccacugcccggugguuuaugauuuuaaaauaaauuuuuuagcaaguggaaaauuguagaauaaucauacuuauuaggaacauuagggcuuggugagaugccucagugguuaggaacgcagggggcucuuccagaaguccugaguucaauucuuagcaaccacaugguggcucacaaccauccaaaagggaucucuucuggcauguagguacacaugcagacagagcacuccuauauuuuaaaaagugcaauaaauaaauacauucaaaaagagagaauuguaacauuaguagagcacggugguguacuuuuuguuuguuuguagcccuggcuguccugaaacccugcuauuuagaccaaggugaccucauauucacaaagaucugccugcuucuaucccucaaguguugggauuaaaggugagcacuccaugccuggccuuggaaaaucuuaagacaaaaacuuagaaccagccgggcagugguggcgacgccuuuaaucccagcacuugggaggcagagguaagcagacuucugaguuugaggccagccuggucuacagagugagcuccaggacagccaggacuacacagagaaacccugucucgaaaaaccaaaccaaaccaaccaaccaaccaaacaaacaaacaaaaaacucuuagaacuauguauuagagcauaaggaauauggaaaguuacaaaacuuauggaauaucugucuauauugagguaauuuauuguaaugacuuacaguuuguagucauguuguuggguuacaacaaugggcagcugugaaugagaagucuaagaaucuaauaguugcucagucccacaaggcugguuguuucagcuggucuuguauaaauagguucuaaagaugugcuuggcaaguaagugcaagcaguggaagaagagugagucuuccuucuuccaguggucuuauguaggccuccagcagaagguguggccuacauuaaggcguguacaccacaccuggaucugggacuugcuuugucccaggcugacuuugaaucagaguucuccuugccuccugggauuaaaggcauguuauaccuugccuggaccuaagcuuuucacagccacugugccucaagaucuccaugccaagauccagaucagaagccugagucuuccagccucaagaucuggaucacaggugugccccccaauucuggaauuuaguucauuccagacauaguugacaacuaggaauagccauuacaaacuauuaagcuaguuuuuccucaaauuccuuuuuuucuccuuuauuuuuuauuuuaugugcauugguguuuuuccugcauauauguccgugagggugugagagguggaguuacagauauuugugagcuggcaugugggugcuggaaauugaacccagauccucuggaaaaacagccaguggucuuaaacacugagccaucucuccagccccagcuuuucucaaguuccuaauuccaaggucuuucuuuuuuuuuuuuuuuuuuaaagauuuauuuauuuauuuauuuauuuauuauauguaaguacacuguagcugucuucagacacucuagaagagggagucagaugguugugagccaccaugugguugcugggauuugaacuccggaccuuuggaagagcagucgggugcuuuuacccacugagccaucucaccagcccuccaaggucuuucauauguagaauauuuaagaucuuaaggaacuggagccaggcaguggugaugcauaccuuuaguucuaacacuuagaaagcagaggcagguggaucucugaguuugaggccagccugaccuaccggagugaguucccgucagccaggacuucacagagaaacccugucucaaauaucaaacaaaccaaagucugaaagaaaucaguuucaagcgcugcucuucuggcuugggggccauggggaaguugcugcuuuccuguacuuaguuuuacacacuuugguucuucacugcccagaccagaagccccugcucccucugucuccaguccuccuuugccaacugcagagguccaacuccagagugcagagaucaguaaggaaccugagccuagggagagaucagaugccaaagagucagcagcucucuuggccucugcacccaugagccccaccaaacgaugaguccugaaccauuaccuuacccuccgaaggugagugagugcuggauugcgguccuuggguuuccuucuauuuccccgggaccugccuguuuucagaccaauccaacugcuuuuuucuuaucaccaguaaccuuuuaaaaaauuguauuugcuuauuuaucuuuauaggggcacacuucuguaagucugagggcagcuuacagggguugguucuuccuuccuaugcuguagguuccugggaugcaacgcagcacaggaagccuuucauaaaucuccucccugaccaguucucuuucucuccugcucgcagcucuggaugggucccagauggacgaggucgauggauaaaggaugaaaauguugaguuugacucugaugaggaagagccccccgaucuccccuuggacuaacauuaauaaccccuuuccccauuuguccuacaaauaaacugcaguggguccugggagcacacugauccuggaguccgguuccuuguucagucucaggauuucaagucugcuccuucgcaggcuggccacuccuucccuacaagguacauggcuccccauacuucuggccccuccuccacuuucucucaaaaccuugccaagcgucagcugcuuucagcccggugcccuauuaauaagucugucagaaag

SEQ ID NO: 1566 - RNA, 9139 nt, Mus musculus
acuugccaagcacaucuuuagaaccuauuuauacaagaccagcugaaacaaccagccuugugggacugagcaacuauuagauucuuagacuucucauucacagcugcccauuguuguaacccaacaacaugacuacaaacuguaagucauuacaauaaauuaccucaauauagacagauauuccauaaguuuuguaacuuuccauauuccuuaugcucuaauacauaguucuaagaguuuuuuguuuguuuguuugguugguugguugguuugguuugguuuuucgagacaggguuucucuguguaguccuggcuguccuggagcucacucuguagaccaggcuggccucaaacucagaagucugcuuaccucugccucccaagugcugggauuaaaggcgucgccaccacugcccggcugguucuaaguuuuugucuuaagauuuuccaaggccaggcauggagugcucaccuuuaaucccaacacuugagggauagaagcaggcagaucuuugugaauaugaggucaccuuggucuaaauagcaggguuucaggacagccagggcuacaaacaaacaaaaaguacaccaccgugcucuacuaauguuacaauucucucuuuuugaauguauuuauuuauugcacuuuuuaaaauauaggagugcucugucugcauguguaccuacaugccagaagagaucccuuuuggaugguugugagccaccaugugguugcuaagaauugaacucaggacuucuggaagagcccccugcguuccuaaccacugaggcaucucaccaagcccuaauguuccuaauaaguaugauuauucuacaauuuuccacuugcuaaaaaauuuauuuuaaaaucauaaaccaccgggcagugguggugcacgccuuuaaucccagcacuugggaggcagagguaagcagauuucugaggcuagccuggucuacagagugaguuccaggacagccagggcuacacagagaaacccugucucaaaaaacaaacaaacaaaaaacccaaaaaacaaaaaaccugaaaaaaugaugguuuacgauuucuuuuauauauaugaguacacuguagcugucuucagacaccccagaagagggcgccagaucucauuauggaugguugugaaccaucaugugguugcugggaauugaacucaggaccucuggaagagcagucagugcucuuaacugcugagccaucuguccagccccuaccaucauuuaaaaaaaauauuuccacaagauuauuauuucucagaauacaaucuggagagcaauaacuuuaaagucaucuauuuccuucuacccuuuuccacuccuggcuuucccauuccacggaccugugcuuccuccggcagcaacuguuauaguggggagcucuguguagagcauucugggugaugauucgagucuggguuagcaaaggagccuggugaugaagagacagaguuagagcuguuaggagcaaacguucccucaagccuguugugugaaguauagcccugucuaaaccacaccugaugcccucucaccucaguuuugcuuucugucuucaauucguucugcugucuuggauuuugcucuguucccuugccuguuugcuuuuugccauagaaaagcuucagaccugagaacaaaagcaaggaggaaugaaaagcacaaugccugguggcuugcucuccaucucccgcccuccccacuucucugauacuuacuggacaaaugcuucuugccugcacggugggcugucaacauggccagcgugucuaguacuggucgaugggggcagauggcacaagcaaagcuagggaaacgagaagugaaugauguguguggugugugguguguauguuguguguucgagagccugcagucgggguguucuugcuauggugaguagguccuacuucugucagaguacuccaccaccaacucccagguuucccgaucuccaccccuuacacuucacuuccagccaaagaguccuauuauacuccugaacuccuuagugacaaaaguuuguugagccuuugauccccgaauccccaggcuugauccacucuucgcucucaccguccaucccgcagcaucagugccucguccucagggauguaacuagccagcagguccccaacucuccguuucugcagggagcaggauaggagaaaugaguaagagggacggauggaaaugaaauaguauggauaaggagucaaauggcacacggggcuaugcagaucauaggguaguaggggucaccacucaguucugguccccuaagcccuccccuagaugucgccagagcaacaaaacaaaacaacagggcggcugaaggugaucagacucucacuaaggcuuacuuugagcacauugaguugacuccagucguccccuucccucuuaaaagacauagcgacugugagacuacgauaaauuccccuacgccuacuucgcugcuccuuuaggccaccguagaaagaguacacuaucgccuucucugcuuccgguuucuuucuuguugaaucuguacuuccggggaugauguuccacgcuugcgucgcgcgaaccggaagacccgccuccagcgcccugagggggccugcauuuccuacaauacuuugagacgcugugccuuuugggaaaugaagucuuuugguuauuuauuuuauuuuuuuauuuuuuugaagagcacacugcucaccuggacacaggaccucacaucucgaaggauccagguguucggagacucaagauccuguauguggagccggaauuucagggugggaccuuccugauguggagcgaggcgucagggaucucaguggacuauauacuacaaacucuugcuguccucaggcucguacuccucagccacaaccuaccuggggugggccuuauuuggaacagagaggaugugggagcacccggcaucccgacuguuggauguggggauacacugagggaagaguguugaugagggugucuaggguucaaaggucagagaucaggcuugcgaggaguuggggagggggcgucgaaagucaaccgggucagcgacugacagcucagggaagauacuuauggguaaggagcucguggaaagagaaauguaaccggccuggcagacuucuuaagagacggacaguaacuccaggcacggcaagaagcagcaagaggaggacgacgaauguagucucucgagagucgggagacuguagagagacgagagaagagaaaacgaauuaucugaauauccauuccuuggguucggccgucacuguuacuuagcugggcuucccucaguugugacccuaggucuugacagugaggagauggcuucucccucuagacagccuccccucggggggucagggcugcugcaugggagccgugcucguucuuauggaagccugguacaaucauccugcuccccagugagggaaagacgccuggagcaucaauuggagccuggagacacccuggcuggauuagcacucaaauacgggguaacggugagucuuccagaauugagauagucccgagaaaguggguggcccgcuaagaugcccccucucacauuauuuaaauucuauuauggucuguuuuuuuucuuccuuauuuugcuuucacaucucagcagagcacuguugggacagaucugcccaacuaucccagugggaggagcaacuccuguagauggugagggaggugggugagugggggcggggcuuacagccauuaacuggacuugugucccuaucaacuuaagacugauaaaccaguuugaucaaggucgaaucacuuaagugucagaguaagguuucugucugacucuaaagccgguacuauuagccaugcgggggugggguagggguggggguggggauguagagacugguaaggaagagcugacuuuuacuagcacucugaaggugcccauuuguaguucuuauuuccaccccaaggcucuguuuucuuugugcagaggcacaaaacaaguccccucuacauacuucaaguguuucaggucaucuuuaggagagguuugaugggcauaaaaaauaucuugcauuaaaguugcagccuuccugucuauauccuguuuuaccacauacaaacaaauguuggguuuagauaaauuccugugccacucuacuuaaagcauaagguaagccuuucuggagacacagcauacguuugucgaugugcucauggaauuuaaauucucaugaggagcagagaagaaacaagaaaugcuguaaggaauauccacaaggggucggagauccagaacuauugagucuugcucggaagugggaguggauaguauuugaugugggguuuugugugugugugugugugggggguggauuuucuagacaguguggccuggaacuuccgguguucuugcaucaugacugcugagauuaggagugugacaaccacacucugaggugcaggcuuaggaguaccgucaccacgggccuugaagaccuagaaacuuuccccucuguucccaccuacaaaucuguucaacccaguuguuuguauccuugucuuccagcagcccacaagcuuuuuaagagcugaaaucaguuccuuucaacauugugccucuaaacccuggcauagucucagucaugugggaguuuaaaagaugauugaaagcugccaggcauggcaguguaccccuuuaauccgagcacuugggaagcagaggcagacggauuucugaguuggaggccagccuggucuauagagugaguuucaggacagccaggucuaaaaaaaagucugaaagccagacuuggugguccaugccaaacuucugauguuagcccucaggagccuaagucaaagggaugcagaguucuaggccagcuccacauauaacaaaaccaggguacuggaguugaaaguguaauucagugguagaaugcagaagagagacaaggcuagacacuuccugugggggcuaaauauacacaguccuugaauccuuuuugaauccucauucaaugaagagccauaggaaguugcuaugccagcaagaggguuaauagcuuuuucuagauaucaagagaaagaugugggcaugaaagaggaagaacagucacguguggccguggugggcgcaaguaugagagaacacaugugagguguuuauuuacuuaauaucugaggucugccagggguccagucuaggacugcacacacuaggcaagcucuuuaccauggagcuacaacucuagacaccaagacuuauuuacuuauuuuauuauuagucaaggucucaauauguaguuuaguuggcuucacacucauagaccugccugccucugcuuuccaagugcugggauuagagaauugcacuauuagcuuggagugguagcacaugccuuuaauccuagcacaggguggguuggugggggaauaggcagguggaucucugaauuugaggugaaccuggucuauagagugaguucaaggacauauagggcuacacaugcauguauggccauuugcuauggggugccuggugccuauagaggucagaagaucaccuggaucugaaguuacagacugcaguugucuucagacacaccagaaggggacauuggaucucauuacagaugguugugagccaccaugugguugcugggaauugaacucaggaucucugaaagaacagucagugcucuuaaugucugagccaucucuccagccucaccucaauaauuuuuaaaaaugugaagguauccuaagacuaaaaaguaugaaaauuauaaaacaagauuaauaucagcucuuuauauuuuagcuaguuuuuuauggugucaaauaauguuguacgauuacuuaaaaacuuugaauugguggccuaggaagauggcucauuugguaacucaguuaauaaaagugcuugccacacacacauaguaaacccuauagcagccuccaggcucuacccccaaguacacuguuuucaaccacacacaccaauaaguuuggaauacuaagccagaaauguuugagaacaucugcucuacuuagugaaaaggaagaaaaagagcuugcuauguuuuaugagguugguggauuuuacugucagacauuaauuucguugcuuuuguuugaagauggaacagauuaagcguacaaaccgccuuuauacuaacgacuccaucuuccugaagaaaacgcucuacauccccauccuaucagagcccagagacuuguuuaaugguuuggauucugaggaggaaaaugauggagaggaagaggugcgcccgaguaaggaugagaucggaucaucuucggggaggaggaagaaucgagggucagggucgggucggcccaauggcacaggccucccgccucaccaggaaaccuccacccccagccaugaccuuucugccucugauuuccuuaagaagcuugacucacagaucagccugucaaagaaggcugcugcccagaagcugaggaaaggggagagugggugagucucuggccgcuccuucuagcucccugcagagacccucuucuuuuagcuggucacaaacuaagaaguaaccaaaguacccgaggacaggcaaguggaugccuuucuccccaugugguccccaaaucaugaaagagccaguggcaucuggaaugggguagugggugggaagcagggucuguggggucuuacgccagugguagcgcgugggaggcagggucuguggggucuuacgccagugugcugggaugaagccuuaggagcaaguucuucagagggucgcaagacuccauccaacuugugaaacaaagggaggcagccuccccucccccaccuccccacucaccgcuccauucucagguccuugccuugauuuguugcucuuucucccuucccucaucggcaggguaccugaggaggacacgggucucuacccuagcuccccucggaugcagcagcgagcaguccuaggcccugugccacucacccggacgucucggacccagacacugcgggaccaggaagaugaaaucuucaaacucugauguccccagaacugaugagcaaggcaggauguugaaggaccagcccgagggggagaggagucugaggugaggcugaagaacagagcuucccagccugccucacuccucuccagccaucuuugccaagauuucuucagcuggggacacuuaguggcaagcguagcgagugggagcagaccucuucccaguucuugggcugaaucuagaguuagccuuuagauucaaaggcucuucuaugcccucgcugucccguugagcauucccuggccuuagagcagggaagcagagaccccuccccaucuccaaugaucuuaccuaauuuauuuggugcuauauugaaguaauauuuauuugcuauaucuaacuccuuucuccucuuaacugggaaaagaggggggaauuuccauaucacugaagauagggaaacccagaacuguaaguggaggcggcuggcugcucgccugucccacuuuccuagcgaagcuuguugcugaggccugggaguuggugaugcucaccauagaauggcagacugcgcugaguuuuccccacucccaagguaaagggugggacucaguuguaacuaagaacucccuacaaccuuucccacgccuuggcucugagagaaggcagcgugguggauacugacuaagcauccuucuuccagcuccucuccucuccccagcgcgugguggggcuaaggaauggaagaugcuuugggguucaaggagaacaguuacagaagugucuuuguuacgcacccuagccuaccuuugccuugcccccacuucauauguaucuguaaucuguaucugaucugcaguacaauuugucuuuuguuccuuaagugaugaaauaggcauggcggcacaguaguccugggagucugucuccgguucaggagugggaauaaguguuguuucuagaccucuccucuauguuuagccugaguauggagcucgagagauuaaaccgugagcccugugcaugcuuuagugguuuuauuuccccugugccucccuucccccagcuccuucuagaagcucuggaacacagcgucuguauguguccuagugcugccuccaacucuagauccaggaggucucuaaugaccaccuuccugcguguggccuuuaguguccccuuccucggguuuguggaggaggaggauccccugguucugggcagcccucccgggagaagcggaccugaguuucacuucuucuucagucagcuguuuccuuuacuggaacuggaugggagcgagagccgccucacucaguucagccuugcuuugccccagcaguaguuuggggguggggguggccucagugucuauagcacucuugggagagagugaagccaggggaucgagaagcauuggugcaggguuagagagcccgaugugucauuucccagucagucauuuugccaaaguccagugugcugagcuccggagcuucagagcuugcccucguccagcagcuuccggagcccaucacagaucuugccaaggugcugagugaagucaggcccauagagggcagccagcaggucggggucagaguagugaucaaacacgugccugaugcggucaugugacuugggugugagguggugcuccaccagcuccagcagaaugucccggcacucgacgagcagaccugcuagcacggcagccucaaaggugaaguccaccucaccgaagcuaagugcggucauggcgcccugccguagcuucugacgaaaucguguagccagagccagcuccccagggccaaagcagccacugcggugcagcacagccacuuuaaccgcuaccuugaugaggucuuugaucacccgcugugccuugggccggcugugcguguauucuuuggacacgcgguaaagcucgucuagcaccucgcugcuggucucgucgauaaagagaugcgccacggaccgaccagccauuuuacucagcagcuucuucuccgcuuguagugccagacucuuugagcugaaggacuccauggugcuugcggucggugugugaucagucacuggaagaggcaaccggcua

SEQ ID NO: 1567 - RNA, 8795 nt, Mus musculus
ggaucucaccguagggagcaucgggaucugugcaggguuuucuccgcgugcacccuuccucugaugcccagugaagccggacgaugggauuguagcauucaacccggggguaaaucaugggcugaggucgccgaccacaccagggccgcgggguugggcagaggcagccagcucugaacugcucugggcucaagcaccagggggucccugaccaauguccgggugggccgcaaccgcgccacucagagacccaggcgcccugcggggcacgugccacccgccccgucggggcuccuccgcuccauaggcgcagcgcaggguuccgggcaccgggccccgcccggccgcggcccacacccaacucagcuccgcuacugggcucggccugggcucgccggggcucggcgggcaaaggaggaaggagggagggagccgcgggcagcggaagggggaggagaggacccggcccagucagugcgcaccggccgggcgcuagaagugggaaacggaguagcggcgcccgggccggagcagcucugcaccggacgccgaguaagucugugcgcggguccgcgaggguggcggggcagugacgggcgcgggggcucagggugcagcucggagggagcggggccuccaccggcucauggcggccggccugccggagggcgggccgagcgcugcuggagcgggcgauccgggcccggcuggggccucggaccagagaaggccugcggggcaacagguagggggacuggggccgggcgcucgcucaggauccaugguacagacgccccuuuguuaggaguggagcaguagcggaccuucggugcuagaagccccugcgggcccgcgugcguccuggggccugaguguggaggccgaggaggaacgguggcggccccugcuguugcugcuguugcugcuacugcuaccgccgccgcugccgccucuguuucugacccccuugugcccaucccaagagggaggucagaguguccaugugccuaacgggaaacaggaaggaguacacucuuuagugucugucccggccccaaagggcucacauuccuauaccguuauggggcguguuuggccagcucuggguuguaacuugcuaauuacaggcccagaggcccucaaguuaguuggcuaccugcagguggguggcauuucuuuuuagccugagcuugggaauuccugugccuaagcugcacuccuggcauccaaaccagaucucacuuauccgaguuuccagccucagcugucaggguguucuaagcgcugugaggucuggagugagccggucuuccccagaacugaguuagggaaggccucccccagaaauuacuucuguuugugugagagcugggguagggggucacuucccaucccagagcuaaggugacugucuugcauuugugauggggccccuaaggucaaauauuccguuccuuaggucuuguuucuggccacauagugccuaauuucuaaggggugugguguggugugcugugugugugaacuaguucuggugccucuauucucacuggagccucugacuagguuucucucugucgcuggccacagggagacugacauuguacaguuccuuucaacacuaccccauuugccgcugcuacuucaaccuacuggccucucccugucucuggaaggcauauucuuauauaguguuugggguuggagcagggaaguuugugaaacaucccagagaagccugaggccacgguugucacagccucaccccuuagcuuuaccagaaucugcccuguauuuuugggcucauacuuuagcccgaagcaguugacuucuauugcucuucaauaucuagaaagaaguucuuuuuuuuuuuuuuuuuuaaaugguuguugauuuuguuuuuuuuuuuuuuuagauuuauuuauuucauuauauguaaauaccauagcugucuucagacacuccagaagaaggcaucagaucucauuacggaugguugugagccaccaugugguugcugggaauugaacucaggaccuucagaagagcagucagugcucuuaaccacugagccaucucuccagcccuagaaagaaguuuuuuguuuuuuguuuuuguuuuuuugguuuuucgagacaggguuucucuguauaguccuggcuguccuggaacuuauuuuguagaucuggcuggccuugaacucagaaauccgccugccucugccucuggagugcugggauuaaaggugugcaccaccacgcccggcucuaugucgccuucuuaaugguugcucagacuugagagcccugugaaaccgucucuaucccacuaucuacugucucacuggcccugagguuuucuuacaggucacacuucuauccucccagcuuucuggcucugcaggugcccaucucucacccuauuacacuugcauuggagggugggguggggaggaaucaaucagaguuggagccaggcaaaaaccuugcuuagguuucaaguaauauaauccuugugaaguccgugcuguauuggcuccucuucagccugugauucugaaaguggugccugucucugaggcaggugugugugaggaagacagauggacacuacacuggaucuccucacgugugcaggcgguauaauuuuugugaguggaagaguugcagguguaauuaaguugcagguguaaucaagguguaaucagcccuuaggggcuggaugucgccuucucucuaguucugauuucauguugauggaaugcucugucugaugugcugugccaaguagccgccaggggcgcagcaaggagccaacuggcucugaggagguguguaaggcugacuagaaacccuagucccuucuccuccuguugagucaaacguccugacccugcuugccucuggugcugcuucucuacuguggaaguucagaacaacaaagaaggacacaucaagcuugaagcccagugugcaggcccccagcagucuucacuucccagggacacagcgcaagaauccccagguugagauaggugugcuguucugugacuacccaacccccacccucuagcuccuuaccuuuuugguagggauaagcaaggcacuagacauuccuacgcugcuggagcccgggagagaggcuccacccacucggggcccuuagcuagcucucugaaucuuuaacucucgaaaggcucuaugaagaaaaacauccuaguuaugggacggcuuggagauggcccaaggcuaggguugccugugugcuugauuuuaggucucacuggaggaaaaguuaggcacugaggaacacaguagccaggcgacaaggucaggaauuagucccuauuuccuauccaguuaacccaaaagguaggaaggaagaggugggguguccaaaauuguuccuucaguuggccuucugccuucuucccuuuucuucucuauucaguuuucuccuuuucucuaggaagaaagugugcuugugugggcagucacacuuaauucuguccuuuggagaggcuuccacucuuuuuauuuuuuugguuuuuuuuuuuuuuuucgagacaggguuucucuguauagcccuggcuguccuggaacucacuuuguagaccaggcugaccucgaacucagaaauucaccugccucugccucccaaguucugggauuaaaggcaugcgccaccaccgcucggugaggcuuccacucuuaacaaauuaauuuuucagguugagguggaggggaaagagguagugcucuccaucauggggccuggaauguauaauugggaugugugugccgggugugcagcugaaaauccuuuaucgucuaucuaucugaccucugaguucauccacaagagcagugaccaggaguggggacaagaggguaaaguccuugagcuggaauacugacuggccugugacaugccgagagggauuucgcaagugcuucugugaaagguggaggcggggcuguugaaagagccaaccagacccaggaccagccuagcucagcuguggacugagggcucuguccuccuucagcaacuccauagucagugccuagugccucugcucacgcuggcccacaggcugcugcuucaguucucuccaccugggaggccaccuuucuccugucacagcucauagucucuaggucagucugcaugcaguuaccucuccuuauucacagggggagagcuggggagccuggagucucagaauuuccaggcaugcuccugguugaaccuugcuguuuuggauucccuguccccaguccugacuguaucuguacuuguacccugauuuccuuccuuuuucccucuuuaucucccuccauuucuuuucuuguuuuuuucaaggcaggguuucucuguagccugggcuggucugggacuugcuuuuccuuuguagaccuugcuggcucaaauucuuuucucacuuccuuucugaacagaggcuuauagaucauuuucugcugcccacguagauguguggagcauggugugugugcaggugucugaugcucauugugcuuuggggaugugcuugucucauucauucaaaacugagcagcccuccucuccucccccucuagacaguguaugcaguucagcuuggucucagacuuaugaucccagugccucagcagcucaagugucgaaauuacagcaccaagacucaucaccacaccugacauaaucuauuuuacaaacuaagggucuuacuuuguagcccuggcuguucuggaacuuuuuguguggcucuuccugccuuugccucugccuccugagugcugggcuuaaaggcaugcaccuucugcucacucucccuguuuaacuuuucuuuuuuuuuuaaauuuuuaauuuuuuuuauuuucaagacagggucugauuaacuuuucugauuguugacuacagcuucucggacuggguuuugcuuguccucuagguugaaauccaaaagauaagauugauaagaaaggagugcuuuuuuuuuuuaauuguagggaaucaggcccaaguggugucagcaucaccuaagguugcaucaaacuguaaauaaaugcugaacuugaaagccacugauuuccuauuacagaugaggaaaacagcuaacuuaagccaaccgauucauuccaaggcuauguagccagaguccaaggcuugugugacuaucccauucccuuugacuagcaggaacguucacucccucucugcagagugcuugcacguggccuucugaccuuuucuuuccucacucaggaugcuccagaccuuguaugacuacuucuggugggaacgacuauggcugccugugaacuuaaccugggcugaucuagaagacaaagauggacgugucuaugccaaagccucagaucucuacaucacacucccccuggcccugcucuuucucgucauucgauacuucuuugagcugugagcaugcccucaaaccuucucugguugucagccaaccuauagggcuucguguuggucuucugauacuuaguucuggacauugguguucuggccacucaggagcccaugcucccccucccccagcgcaccauugucuuccugaggcugaggacucagcauccccagccuuguccuucaaugguuuuuuguuuucauccugcacccgccuccucgccuggucaauagugaacauaggcagcuuugucagcugugggcagcccaggaggccagaagaaagguggaugccagggaauuugggaaacugaggcccagaauuaagucuugcaguacuuucucugucccauuuagggguuaggagugcuccaagggagccagacaccucuuucucaugucccuuacucaguuauguggcaacaccccuggcugcccuccugaauguuaaggagaaaacccgacugcgggcaccucccaaugccaccuuggaacauuucuaccagaccagcggcaagcagcccaagcagguaugagaggcagaugauucuggcaguugcugaguuugggugggucagaguuugaaugcuugcuuuggaaggugaggacuugguagagggugggcaugauucagguuauuauggggagagguuaaguagaaugggggcacugcugaucugaaggcugaauauacuggucuuacuaugccuagguggagguagaccuuuugucacggcagagugggcucucuggacgccagguagaacgcugguuccgccgccgccgcaaccaggacaggcccagucuucucaaaaaguuccgagaagccaggugggaggaguuggggcaagugaaacuggguggcaguuguguuuucuugcugggaggugaagguaccuugagagggugucugggggcagugggaaacuguugauccucccaccugguuuccucuugcagcuggagauucacguauuaccuaauugccuuuguugcuggcauggcugucacuguggaugugaguacugggaagugggagcacauccuuuaagauggaauaagccauaggauaugaguccuucuuccuuuaaucucucucuuugcagaaacccugguucuaugacuuaaggaaaguuugggagggauaucccauacagguaugagaagaccccuuauguaauaguguucuauagcacacaauaccuuaugaaggaaggguuucaugaauacauggcagaagacaaucaugaaagacuuaucuugaggggcuagaaguaaugaguuuggaggugugccccuuaggucugaguguccugggaucccucaccccuaauuucucucccagagcaucaucccuucucaguauugguacuacaugauugaacuuuccuucuacuggucccugcucuucagcauugccucugaugucaagcgaaagguggguaaagagaccagaugagguccuggggugaagagccuccccuuugacuucaugggaaucugggcagagcugcugggauguggggaacaaaaguugagggguuggaaggaggaacaauggaauagggaagaguccuuuggagccucuaucuuuucugcaggauuuuaaggaacagaucauccaccauguggccacuaucauucuccucugcuucuccugguuugccaauuacguccgggcagggacccucaucauggcucugcaugacgcuucugacuaccugcuggagguuaggcuuccucacaguagaggccccagugcagguuccccuugucccucaccuuccaggggaugggagagagggaauugucagugcagcuagccacaugcaaauacuacugucuaugggagucaagagccagugauaauagaugguguuuuuauuuauuuuuauagucugccaagauguuuaacuacgcgggauggaagaacaccugcaacaaccucuucauuguguucgccaucguuuucaucaucacucggcugguuaucaugccuuucuggugaguaggugcucaggcuccugccuuuucauuugucgcaggcuuucacccauggccauguuuacaacuugcccuugaaucugcaggauccuacacugcacgaugauauacccacuggagcucuacccugccuucuuuggcuauuauuucuucaauuuuaugauggcagugcuacagaugcuccauaucuucugggccuacuucauucugcguauggcccacaaguucauaacuggaaaggugaggaaggcccaccccccuuuuguaggucucacuucucucacacuguaacucuccaaauuccuugucaugcugcaacucucuuuaaaaaguaugaggguuuggggguuaacaggaaacuuagaggcagcccuuggauacugaaggauauauaacccuuuuguccuuuucacagcugauagaagaugaacgcagugacagagaagaaacagagaguucagagggggaggagacugcagcuggggcaggagcaaagagccggcuccuagcuaauggccaccccauccucaauaacaaucauccuaagaaugacugaaccauuguccuagcugccucccacaucaaugcaugaggccaagaaacuagccaagcuucccuuuaggggcauuugagcucuggggagaaaggauaugaggagucuacacugaccuuccacuucuuuuuucacccaguugccuuuaaaccagacucuaaacagccuaucuccagguagaaaggaggcuuggccacauccacauccuguugagagacauagucucauuucccucucuaccuucuaagcuacccuucuugcuaauccuucuucagcucugaggguuggaaucauaacucacauuccucauuccuaagaauuuggagcuagcuguuugccuuugacucccugacuucaagccaggguugugccuuacugucccuuuucugggccucauucugccaaagcuggaccaagguuccaucuuucuaagcucccuagcucaggccaagaaagaaagcugagcuacuuuuaacuuucucuuccuuaaauacaagucaaugaagugaaggaggguaugcauacaugccccucacccuaccccagggaccaugguuccuaggaucucacugccucccucucuggccuuccuguccccucccuucagcuaugacagcugguguggaguagaagggcaacuaguucuguuauuuauugaacauuugggguuucaguuguaaagccacaacuacagguaggaccugauauuucggcgagggaccauuucagaccaaaauguacuguuaauuuuuuuuaauuaaaguauauuaaagguuaaauaaaacaugacugugucagacua

SEQ ID NO: 1568 - RNA, 8795 nt, Mus musculus
uagucugacacagucauguuuuauuuaaccuuuaauauacuuuaauuaaaaaaaauuaacaguacauuuuggucugaaauggucccucgccgaaauaucagguccuaccuguaguuguggcuuuacaacugaaaccccaaauguucaauaaauaacagaacuaguugcccuucuacuccacaccagcugucauagcugaagggaggggacaggaaggccagagagggaggcagugagauccuaggaaccauggucccugggguagggugaggggcauguaugcauacccuccuucacuucauugacuuguauuuaaggaagagaaaguuaaaaguagcucagcuuucuuucuuggccugagcuagggagcuuagaaagauggaaccuugguccagcuuuggcagaaugaggcccagaaaagggacaguaaggcacaacccuggcuugaagucagggagucaaaggcaaacagcuagcuccaaauucuuaggaaugaggaaugugaguuaugauuccaacccucagagcugaagaaggauuagcaagaaggguagcuuagaagguagagagggaaaugagacuaugucucucaacaggauguggauguggccaagccuccuuucuaccuggagauaggcuguuuagagucugguuuaaaggcaacugggugaaaaaagaaguggaaggucaguguagacuccucauauccuuucuccccagagcucaaaugccccuaaagggaagcuuggcuaguuucuuggccucaugcauugaugugggaggcagcuaggacaaugguucagucauucuuaggaugauuguuauugaggaugggguggccauuagcuaggagccggcucuuugcuccugccccagcugcagucuccucccccucugaacucucuguuucuucucugucacugcguucaucuucuaucagcugugaaaaggacaaaaggguuauauauccuucaguauccaagggcugccucuaaguuuccuguuaacccccaaacccucauacuuuuuaaagagaguugcagcaugacaaggaauuuggagaguuacagugugagagaagugagaccuacaaaaggggggugggccuuccucaccuuuccaguuaugaacuugugggccauacgcagaaugaaguaggcccagaagauauggagcaucuguagcacugccaucauaaaauugaagaaauaauagccaaagaaggcaggguagagcuccaguggguauaucaucgugcaguguaggauccugcagauucaagggcaaguuguaaacauggccaugggugaaagccugcgacaaaugaaaaggcaggagccugagcaccuacucaccagaaaggcaugauaaccagccgagugaugaugaaaacgauggcgaacacaaugaagagguuguugcagguguucuuccaucccgcguaguuaaacaucuuggcagacuauaaaaauaaauaaaaacaccaucuauuaucacuggcucuugacucccauagacaguaguauuugcauguggcuagcugcacugacaauucccucucucccauccccuggaaggugagggacaaggggaaccugcacuggggccucuacugugaggaagccuaaccuccagcagguagucagaagcgucaugcagagccaugaugagggucccugcccggacguaauuggcaaaccaggagaagcagaggagaaugauaguggccacaugguggaugaucuguuccuuaaaauccugcagaaaagauagaggcuccaaaggacucuucccuauuccauuguuccuccuuccaaccccucaacuuuuguuccccacaucccagcagcucugcccagauucccaugaagucaaaggggaggcucuucaccccaggaccucaucuggucucuuuacccaccuuucgcuugacaucagaggcaaugcugaagagcagggaccaguagaaggaaaguucaaucauguaguaccaauacugagaagggaugaugcucugggagagaaauuaggggugagggaucccaggacacucagaccuaaggggcacaccuccaaacucauuacuucuagccccucaagauaagucuuucaugauugucuucugccauguauucaugaaacccuuccuucauaagguauugugugcuauagaacacuauuacauaaggggucuucucauaccuguaugggauaucccucccaaacuuuccuuaagucauagaaccaggguuucugcaaagagagagauuaaaggaagaaggacucauauccuauggcuuauuccaucuuaaaggaugugcucccacuucccaguacucacauccacagugacagccaugccagcaacaaaggcaauuagguaauacgugaaucuccagcugcaagaggaaaccaggugggaggaucaacaguuucccacugcccccagacacccucucaagguaccuucaccucccagcaagaaaacacaacugccacccaguuucacuugccccaacuccucccaccuggcuucucggaacuuuuugagaagacugggccuguccugguugcggcggcggcggaaccagcguucuaccuggcguccagagagcccacucugccgugacaaaaggucuaccuccaccuaggcauaguaagaccaguauauucagccuucagaucagcagugcccccauucuacuuaaccucuccccauaauaaccugaaucaugcccacccucuaccaaguccucaccuuccaaagcaagcauucaaacucugacccacccaaacucagcaacugccagaaucaucugccucucauaccugcuugggcugcuugccgcuggucugguagaaauguuccaagguggcauugggaggugcccgcagucggguuuucuccuuaacauucaggagggcagccagggguguugccacauaacugaguaagggacaugagaaagaggugucuggcucccuuggagcacuccuaaccccuaaaugggacagagaaaguacugcaagacuuaauucugggccucaguuucccaaauucccuggcauccaccuuucuucuggccuccugggcugcccacagcugacaaagcugccuauguucacuauugaccaggcgaggaggcgggugcaggaugaaaacaaaaaaccauugaaggacaaggcuggggaugcugaguccucagccucaggaagacaauggugcgcugggggagggggagcaugggcuccugaguggccagaacaccaauguccagaacuaaguaucagaagaccaacacgaagcccuauagguuggcugacaaccagagaagguuugagggcaugcucacagcucaaagaaguaucgaaugacgagaaagagcagggccagggggagugugauguagagaucugaggcuuuggcauagacacguccaucuuugucuucuagaucagcccagguuaaguucacaggcagccauagucguucccaccagaaguagucauacaaggucuggagcauccugagugaggaaagaaaaggucagaaggccacgugcaagcacucugcagagagggagugaacguuccugcuagucaaagggaaugggauagucacacaagccuuggacucuggcuacauagccuuggaaugaaucgguuggcuuaaguuagcuguuuuccucaucuguaauaggaaaucaguggcuuucaaguucagcauuuauuuacaguuugaugcaaccuuaggugaugcugacaccacuugggccugauucccuacaauuaaaaaaaaaaagcacuccuuucuuaucaaucuuaucuuuuggauuucaaccuagaggacaagcaaaacccaguccgagaagcuguagucaacaaucagaaaaguuaaucagacccugucuugaaaauaaaaaaaauuaaaaauuuaaaaaaaaaagaaaaguuaaacagggagagugagcagaaggugcaugccuuuaagcccagcacucaggaggcagaggcaaaggcaggaagagccacacaaaaaguuccagaacagccagggcuacaaaguaagacccuuaguuuguaaaauagauuaugucagguguggugaugagucuuggugcuguaauuucgacacuugagcugcugaggcacugggaucauaagucugagaccaagcugaacugcauacacugucuagagggggaggagaggagggcugcucaguuuugaaugaaugagacaagcacauccccaaagcacaaugagcaucagacaccugcacacacaccaugcuccacacaucuacgugggcagcagaaaaugaucuauaagccucuguucagaaaggaagugagaaaagaauuugagccagcaaggucuacaaaggaaaagcaagucccagaccagcccaggcuacagagaaacccugccuugaaaaaaacaagaaaagaaauggagggagauaaagagggaaaaaggaaggaaaucaggguacaaguacagauacagucaggacuggggacagggaauccaaaacagcaagguucaaccaggagcaugccuggaaauucugagacuccaggcuccccagcucucccccugugaauaaggagagguaacugcaugcagacugaccuagagacuaugagcugugacaggagaaagguggccucccagguggagagaacugaagcagcagccugugggccagcgugagcagaggcacuaggcacugacuauggaguugcugaaggaggacagagcccucaguccacagcugagcuaggcugguccugggucugguuggcucuuucaacagccccgccuccaccuuucacagaagcacuugcgaaaucccucucggcaugucacaggccagucaguauuccagcucaaggacuuuacccucuuguccccacuccuggucacugcucuuguggaugaacucagaggucagauagauagacgauaaaggauuuucagcugcacacccggcacacacaucccaauuauacauuccaggccccaugauggagagcacuaccucuuuccccuccaccucaaccugaaaaauuaauuuguuaagaguggaagccucaccgagcggugguggcgcaugccuuuaaucccagaacuugggaggcagaggcaggugaauuucugaguucgaggucagccuggucuacaaagugaguuccaggacagccagggcuauacagagaaacccugucucgaaaaaaaaaaaaaaaaccaaaaaaauaaaaagaguggaagccucuccaaaggacagaauuaagugugacugcccacacaagcacacuuucuuccuagagaaaaggagaaaacugaauagagaagaaaagggaagaaggcagaaggccaacugaaggaacaauuuuggacaccccaccucuuccuuccuaccuuuuggguuaacuggauaggaaauagggacuaauuccugaccuugucgccuggcuacuguguuccucagugccuaacuuuuccuccagugagaccuaaaaucaagcacacaggcaacccuagccuugggccaucuccaagccgucccauaacuaggauguuuuucuucauagagccuuucgagaguuaaagauucagagagcuagcuaagggccccgaguggguggagccucucucccgggcuccagcagcguaggaaugucuagugccuugcuuaucccuaccaaaaagguaaggagcuagaggguggggguuggguagucacagaacagcacaccuaucucaaccuggggauucuugcgcugugucccugggaagugaagacugcugggggccugcacacugggcuucaagcuugauguguccuucuuuguuguucugaacuuccacaguagagaagcagcaccagaggcaagcagggucaggacguuugacucaacaggaggagaagggacuaggguuucuagucagccuuacacaccuccucagagccaguuggcuccuugcugcgccccuggcggcuacuuggcacagcacaucagacagagcauuccaucaacaugaaaucagaacuagagagaaggcgacauccagccccuaagggcugauuacaccuugauuacaccugcaacuuaauuacaccugcaacucuuccacucacaaaaauuauaccgccugcacacgugaggagauccaguguaguguccaucugucuuccucacacacaccugccucagagacaggcaccacuuucagaaucacaggcugaagaggagccaauacagcacggacuucacaaggauuauauuacuugaaaccuaagcaagguuuuugccuggcuccaacucugauugauuccuccccaccccacccuccaaugcaaguguaauagggugagagaugggcaccugcagagccagaaagcugggaggauagaagugugaccuguaagaaaaccucagggccagugagacaguagauagugggauagagacgguuucacagggcucucaagucugagcaaccauuaagaaggcgacauagagccgggcgugguggugcacaccuuuaaucccagcacuccagaggcagaggcaggcggauuucugaguucaaggccagccagaucuacaaaauaaguuccaggacagccaggacuauacagagaaacccugucucgaaaaaccaaaaaaacaaaaacaaaaaacaaaaaacuucuuucuagggcuggagagauggcucagugguuaagagcacugacugcucuucugaagguccugaguucaauucccagcaaccacaugguggcucacaaccauccguaaugagaucugaugccuucuucuggagugucugaagacagcuaugguauuuacauauaaugaaauaaauaaaucuaaaaaaaaaaaaaaacaaaaucaacaaccauuuaaaaaaaaaaaaaaaaaagaacuucuuucuagauauugaagagcaauagaagucaacugcuucgggcuaaaguaugagcccaaaaauacagggcagauucugguaaagcuaaggggugaggcugugacaaccguggccucaggcuucucugggauguuucacaaacuucccugcuccaaccccaaacacuauauaagaauaugccuuccagagacagggagaggccaguagguugaaguagcagcggcaaaugggguaguguugaaaggaacuguacaaugucagucucccuguggccagcgacagagagaaaccuagucagaggcuccagugagaauagaggcaccagaacuaguucacacacacagcacaccacaccacaccccuuagaaauuaggcacuauguggccagaaacaagaccuaaggaacggaauauuugaccuuaggggccccaucacaaaugcaagacagucaccuuagcucugggaugggaagugacccccuaccccagcucucacacaaacagaaguaauuucugggggaggccuucccuaacucaguucuggggaagaccggcucacuccagaccucacagcgcuuagaacacccugacagcugaggcuggaaacucggauaagugagaucugguuuggaugccaggagugcagcuuaggcacaggaauucccaagcucaggcuaaaaagaaaugccacccaccugcagguagccaacuaacuugagggccucugggccuguaauuagcaaguuacaacccagagcuggccaaacacgccccauaacgguauaggaaugugagcccuuuggggccgggacagacacuaaagaguguacuccuuccuguuucccguuaggcacauggacacucugaccucccucuugggaugggcacaagggggucagaaacagaggcggcagcggcggcgguagcaguagcagcaacagcagcaacagcaggggccgccaccguuccuccucggccuccacacucaggccccaggacgcacgcgggcccgcaggggcuucuagcaccgaagguccgcuacugcuccacuccuaacaaaggggcgucuguaccauggauccugagcgagcgcccggccccagucccccuaccuguugccccgcaggccuucucugguccgaggccccagccgggcccggaucgcccgcuccagcagcgcucggcccgcccuccggcaggccggccgccaugagccgguggaggccccgcucccuccgagcugcacccugagcccccgcgcccgucacugccccgccacccucgcggacccgcgcacagacuuacucggcguccggugcagagcugcuccggcccgggcgccgcuacuccguuucccacuucuagcgcccggccggugcgcacugacugggccggguccucuccucccccuuccgcugcccgcggcucccucccuccuuccuccuuugcccgccgagccccggcgagcccaggccgagcccaguagcggagcugaguugggugugggccgcggccgggcggggcccggugcccggaacccugcgcugcgccuauggagcggaggagccccgacggggcggguggcacgugccccgcagggcgccugggucucugaguggcgcgguugcggcccacccggacauuggucagggacccccuggugcuugagcccagagcaguucagagcuggcugccucugcccaaccccgcggcccugguguggucggcgaccucagcccaugauuuacccccggguugaaugcuacaaucccaucguccggcuucacugggcaucagaggaagggugcacgcggagaaaacccugcacagaucccgaugcucccuacggugagaucc

SEQ ID NO: 1569 - RNA, 34558 nt, Mus musculus
cuguuuccccucccccgccgucucuccuucaguuugccuggguuuggcaaggcggagcccuggaguaaaaccuggggucgggguugugagacgcggcccuugcggucgggcgccagaguuguggggaggacggacugaggugcgcugaggccgagguggaccugggaggcuuggcuggugcgaggcuggggcugugugugggaacuuggcgggagaggagcgagccgggggcgggcgggccugaggcggcggcugcgggugggcgcgaggcggugcgugggugaggcggugcgucgaugaggcgcgggaaagcaggagggcggcaggcuggaggcugcugcgguucugcguggcccgggcggccaagcgccugugcgcguuauuccgaguguggcugcuggguggucgccauggcuucaagcuuuugcucugaucacguagggauguccgacuuuuccucucuucgucccuuuucuucuuugcuggucgcagacucccagggccuggugcagccgggaagcccaucccuugugcagcugcccucuugcauggcccuaggagguuuuaaaagccaccuugccacgggaaagcaaagagccgcgaggaaaaggaggacuaaacaacccggguggaauuaguucauugcggcucaccugucuccagccgccggugccucgguuagacucgguguagugacagagccaauuaaggaacaaguagcucccagaaguaucuuccuuggucgauaagcacucuucgguuuccugaaaccuuguuuuagcuagcucccuggugcguguuggaguucuccagggucuccccgcucuuaguuguuacccagagcuugggucugugugagaagaugaggcuccccgggaaaucuccagaucgccuuguggaggaggaggggagagaacagaguuugcaggcuuuugauuaugagacagaaauggugugagccucgguuagaguuguuuucgcuucuuguucauccugcacagggccaaagcauguccucccucccugggugcaugaguuuggcugcagcgccagcugcagcugacucugcagagauugcugagcugcagcaggcggugguugaagagcuggguaucucuauggaggaacuucgucaguacauugaugaggaacuggaaaagauggacugcauacagcagcgcaagaagcagcucgcagagcuggagacguggguacuacagaaagagucugaaguggcuuauguugaucggcuguuugaugaugcauccagguagggauuccaggaagcagaaguaaauguccaucuguguccuccuuggagugacuguuguugucauuguccuaagcacuuuauacuuuggcgacuucagucagguggggccuuacucuuccucugaguuuguaaugcagaguugcaacagaacacuuuuucccuguggguagcugcuaugugaucagcaguaguuagguuaaaggcuugaauucccuucucuuccuccuggacugaacuuccuuccuaagauccccagaaagugaagauuguagaguugcugucuuuucuguuuuucugagacagaaucccaauaccuaaaucuugcuggccugcaacuugcagagaucugccgacuuuugccuccuaagagcugcaaugaaaugauccuagcuuaugcuuguugaguugauugggguuucauucguucauccauuuuugauacaaagucucuuuacguagaauuggcugcccuagaacucaccauauaaaccauauugagcuggacucauagagacccaucugccuuuguuucuccaguggugagauuaaagggauguuucacagcacccagcaaaaugaaguugauauuuaaagcugucuucuuaguucccaaagccacauagauaauaaauaucagauauuaggacuuuuguaacagcagguggaaaauugaagucuagaaaauuguuucauagaagaauuacauggaaacaaacauucuguggaaaagcauucuaaauagguacuuuggaacauguagagcaaacagucuauauuuaaauauacauaauuuccuguuacuguguuguguuuuguaugugggggggguuguuuuuuguuuuuguuucuguuuuuguuuuguuuuauuuuugagaccguuucuuuguaacucuggcuguccuggaacuaccucuguacaccaaauuggccuggaauucagagaucugcuugccucugccuccugagugcuggguucuguuuuuguucugucuaaagguuucuuacucuguaggccaugcuggccaugaacuguauugaccaugaacucuauugaccaugaacucuauugaccaaagugaccucaaaccuagcuagucuugguuccucaggcuaaggacuaggauuacaugugugagcucagaggcuagguauuguauaaauguauauacauuguaaugcucuuguacugcacugucuccacuggcuuugaucuuuucugcauguguuccaauaucagggaagugacuaacugugagucuuuggugaaggauuucuacucuaagcugggacuacaguaucaugacaguagcucugaggaugaagcuucccggcccacagagaucauugagauuccugaugaagaugaugauguccucaguauugauucagguaaaugaugaagcuuuggucagaaaagucuuagaauggaagcugaaauacuggaagacaaguauguugcacauaaagaaucacauugucauuacuuaauaugccaaaaaccugacugacuuauuaugacaacaaguaaguauucuuagcaucguaaguguuuucuguauucugauugcuuccuuuccccauuucagauaagguauacuuauuuucugucuuuucccccauguguuuguguguaguuugccuaugucugaguuucuuuuucaguuacugugaucaaauaaucugacaaaaucauuugaagguuaagggggcugauccugguuccaaguuccagaucauauccaugauggucggggaaaucacaguggcaaaagccuaaagcaucuggucacauuguucugcaaucuggaaacagagggagugucucauccugcugcuccuccaaucgcucucuuuauuuguguauuuaugaagucuauggaaugguaccacucacggugggcugguccauccaccucuacauagucaaaauaauuccucauuggcuugcacagauuuccauuucacaagucauuuuaaauucuguuaaguugauaucaauggucacaguguuccuacccauguuugggaguagagguauauggguggguguacauauauguagaauucaaagacuuauaucagguuuauugcuugaucacuccucucuuuauuauggaagcagggucuugcugaaccaaggguuugccaauucuagcauguguagauagccagcucagaguggguuucugccuuaugaguacuaggauuacagguuuggggccugaggauccagacuccaggacuugggacuuguuugggaaacacgauaugcuggcuaucucucuaaugcuuuuauuuugcaauaggauuucacaguuucuggcuaacuucuaacucucaguauagcccaugcuagcuuuggacuucgagcaguacuucugcuuuuuuuguuuguugguuuguuugucuuguuauuuugagacaugcuuucucugugcagcccuggcuguccuggaacucacucuguagaccaggcuggccucaaagucacaucaaccugccugccucugggaaagguguguaccaucaccaccuggcaaaaguugccucaccccaccucccauuuauugauugauugauuguugauuuguguguguguguguguguguguguguguguguguguuuuguuuuuucaagacagaguuucucuguguuaagagagcccugacugucuuggaacuugcuuuauagaccaggcuggccucuaacuuaagagauccuccucccucugccuccccaguacuggaauuaaaggugugugccaccaucacucagcucuauauugaguuugcguucagaauccuaaucagaacaguuugauacugugaggaauugucaagccuccauccacagcucccuucugggcucuaagaacuuuauugccaauuguagauuggguauguccuacauccagauagcaagggaugucaccaggcugacuuucaucucuagccuccauagaucuuuuucaugccaaaccuacugagaagucugcuggcaagcagcaggccaguacaacaggcuauagcauaauuuguuaggccaacuuugacgaugucauuugguauaguucaugugcauauacugucccgacuguuauauuuccuauauagggauauggauucugacagaugcuaucucuguuacaugaaauuucauccuguauuuggguuuguuguacuuauuguguuugaucaucaaucccuccauuuucugggaaauguugugguuucauuuuucuuuagaauugcauacugcuccucuuacuuauauguacuagcuggucauccauuaacuucuugaugagugauuuuugagacaaagucucgugaaguccagauuuaccucagacucacuguguagccauagcaugccuucguucuucuuucccaaagucauuauuuuagacauaugucucgcucuuuuauuguuuagaggguuuuuuauguuuguguauuuuuagacacuguuauaggccaggcuggccucaaacucaacacaugacggagaauuauauucagccccugguccuucuaccuuuaccuccaacucccaagugccaagaucauaggugucaauaugacaguuuuuuacuuauccuugauaguuacaugcauauauaaaaauguauuuugaucauguacacaaucuuucauguucccaacuaacuuaccuuuccucuuccuucuuucauguauuguuuuguuuuuuaauuuuuuccuaauccgcugaguuuaauuuggaugugggauucuuggguaacuuaccaguggcuacaucccugaugaaaaauuguucccucccuccuccagcaaccuuuaacugccaaaaguuccucagggaggggugggucuuggugccccucccccauucuugcuggaauguugacugacuuguucucuuuuuuuuuuuuuuuuuuuaagauuuauuuauuuauuauauauaaguacacuguaacuguccucagauacuccagaagaggacaucagauuucauuacggaugguugugaaccaccaugugguugcugggauuugaacucgggaccuuuggaagagcagucggcgcucuuagccacugagccaucuugccagcccgacugacuuguucuuguacaagucuuaagggcugauaaccaguguggcugggaguugaagaguccaagggcccuaucaagucuagaagacaaucuuucccaacauugcuucccuaagugggggaaauggaauauuggguaaugaucauggaguuucguuuuggacuaaugaaaauguucugaaaguagguguaccgugauaguuucacagucuaaucaguggauuacauuucacugaacuacaugcaccuuaauaagaacuuuuaagaauaagugaauuuuugaaugauuuccuaagauaaaauaacuauagccugggcagugguggcacacaccuuuaaucccagcacuugggaggcagaggcaggaggauuucugagcuugaggccagccuggucuacagagugaguuccaggacagccagggcuauacagagaaacccugucucaaaaaaccaaaaagaaaaaaaauauauauauacacacacacacauacacacauauauauacauauauauaaucuccauguuucuguaguuauugauaguuuuguugcaccaugcuucuggaaaauaagcauuugcucaaguuuaguagccuuguuucauuuuguuuuuguuuuuguuuuuguuuuguuuuguuuuguuuuucaagacaggguuucucuguauagcucuggcuguccuggaacucacucuguagaccaguagaccaggcuggccucgaacucagagauccgccugccuuugccucccaaaugcugggauuaaaggcaugcgccaccacugcccagcaccuuguuucauuuuaaguugaauaauuaaauuauuuuuacaaauuucaaaucgaugacaauugccuuaagugugauaaacuaccaccugucucaguacuuauccagagguaaacacuggcaggcauuuacugauuuucaucuccagaccccuuuuaguaaccguuucaguaccuuccuuuuccaguacugggaauugaaccuagggacucauacauguuaccaguaaaugugcccccaccaacuuuauacuuauuuguuugguuuugggguuuaaaaguuguuuuccucuuuuaagauuuauuuuuauuauuuuuuaauguauaaaaaaacauuaucuggggcuggugagauggcuuagugaguaaaagcacugacuacucuuccaaaggucuugaguucaaaucccagcaaccacaugguggcucacaaccacccauaaugagaucugaugcccucuucuggugcgucuacagacagcuacagugugcuuauuuauaauaaauaaguaaaucuuugagccagagcaagcagggacugaaugagcagagugcaccugaccgaguggaccugaguggaguugaccagcacgagcggaacggaccugagugagcagagguccuaaauucaauucccaacaaccacaugaaggcuuacagccaucuguacagcuacaguguacucauauacauaaaauaaauaaguaaaucuuuaaaaaaaaaaacaaaaucugucugugggggaguguuugugugaguauaacuggucucagagcuuagaagagugcaccagauccacugagguguagugaaugugcuugugagcugccaguguguguacuagaaaccaaacccagauccucugcaauagagcuacuccgucugaacucugauccuugacuugagucccugguuucuguauuuugacucuuaugcauucuugcuuagcuaucagcuuaacuuuaaaccgggcuaaccuuaacauauggugcuccucuugcccuacuuugcuuuuuauuuugagacagggucuaaauugcucaggcaggccuagcucuuguucucuagauacagcaugucuugaaggugccauguuccugccucagucucucagguagcuagguucauaugcccagcuuuuuuuucacugaaguucuuuucuuucauaggugaugcugggagcagaacuccaaaagaccagaaggugaguuggguuggguauaggaaguuaaucaugaaauugggcuggagggauagguagaguuaaggagagcaugcugcucuucuagaagacuugaguucuguuccagcacccauguugagagucuuucagcugccuguaucuccaagguaucuagugcccucuucuggauucuagaggcaccuacauacaauuggcauucacuuacauggguaagcagaaaucagacauaguuaaagccaggucugguagcacacaccuugaauccuaguaccagggaaggaaaggcagguggaucucugugaguucaaggucagccuguuguauaugguaaauuccaggacagccagguccauguagagagaccuugucucaaaaaaccaaauaauaauaacaacuagaaauaauauagccgagcaugcuaguacacaccuuuaaccucagcacugagaagucaggggcaaguggaucuuaaugaacuugaggccagcguggguuacacggaguuuuaggcuaguuagagcuacaagugaaacugucuccaaaaccuucauaauaauaauauguggcuagaaugguaguucuguguuuaggagcacucacugcucuuaaaaagaaccuggguucaguucucaacacccaaauggugacugauaaccuuccauaaguucacuuucagaggaucuaauguccugacuucaucaggcacauaugaauuucaguuguuucauacacacacauacauauacauauaugugaauacacauauacauacacauaugugaaugaauuugauggacuaucaauguuggucauuugggguguuuaccuagcauucagcaaucuuugggcuuaguucaccacuauaccagagguuuucuggugaugcaugccuguuaucccagcacucagaagagauggaggcagaaagaucagaaguucaggcucauccucggcuucauaccuuugaaggcuuggaauauagauaacccugucuuuaaaacaaaaaacaacagugcuggagagauggcuccaugguuaagauaagcacuggcugaucuuccagagacuaagguucaauucccagcacccacauggcagcucacaacugugugacuccaguuucagcguauccagcacucucauauagacuauaugcagaugaacaucaaugugcauauaaugaaaaagcuuuugaaaguaguaaugagggccuggagagauggcucagcgguuaagagcacugacugcucuuccgaagguccugaguucaauucccggcaaccacaugauggcucacaaccauccauaaugagaucuggcgcccucuucuggagugucugaagacagcuacaguguacuuacauauaauaaauaaauaaaucuuuaaaaaaaaaaagaaaguaguaaugaauuuuagccuaagcauacauucaguuuaguuucaauguauucaccauauaauaagucccauucauuacagucaucuuguagauauugcaagaaugcagaaaaauugagaaguugccucugucuggccuuuuaauacaguugaaucuauuuuaauuauugaagacaaguucuucacaggcaguguucuuuaucguguuuuguuguuauuguugauuuguuuuggcuuuacuuauuugcagcauugggaucuaaaccaugggucccuaugcauguuagacaagagcugucuaacucauaauacucaggguuuuuuucccuucuauuuuccuacagcuucgugaagcuauggcugccuuaagaaaaucagcucaagauguccagaaguucauggaugcugucaacaagaaaagcaguucucaagaucuacauaaagguuagugugagaagugccugcauaggugagaggugaguucuuucuggaauguuacugacagucagcuuuccaucucagaaugcuguuugacuugucagucucuuuuuuuguuggugguggguuuuuguuuguuuguuuuucgaggcaggauuucucuguauaguccuggcuguccuggaacucacucuguagaccaggcuggccuugaacucagaaaucugccugccucuaccucccaaguguugggauuaaaggccugugccaccaccgcccggcucugacuugucagucucuuuuuaacauuaauuuuauguccacagucagucugagaguuauugauugaugcgguggcucaggcuguuaacuguugauacuguugcugucaauaaggaguugucgauagucguucguggcauaggcugguagacuaugccaaaggaguuagaaaugugcuaaaguucuguauucauuucuccuguuagcauaaacaguggauugucuugugcuucugccucuauccaagaguuuagcaagaguugcuaauggucacagaauuucaguuuccucuguuucuacaccaccuucuguuuuugagauaguaucuucuauauccuaggcuggccuugaauuuucuguguuacugaggaugacuguaaacuuuugauccucuugucuucucugagaacuugagauuacaggcaugagcuauuaugccagguguaugcagugcugagguucaaauccagggcauugugcuugcuaggcaggcaguccagcagcugagcuacagcccauccuaccuuacuguccucuugaccuuaccuuucuccauccaaccacucaaaucacucuuuauaacaacucuuguuuauaggaaccuugggucaggugucuggagaacugagcaaagauggggaccugauagucagcaugcggauucugggcaagaagaggacuaagacauggcacaaaggcacccuuauugccauccagacuguugguauguguguucaggcuggaggaaggacugagcaaagguaaccuguagggcauccauugcugacuguuuuuccaaagccuuuucuuuugucuucuauguugcacccaagacuuaacauuggaaauaacaguuuuuugauuuucuuuuuuaaaauuuugguucucuuuucuuuuauacagggcuaggaaaaaaauacaaagugaaauuugacaacaaaggaaagagucugcuaucugggaaccauauugccuaugauuaccacccucccgcugacaagcuguuugugggcagucgagugguggccaaguacaaagauggaaaucaggucuggcuuuaugcuggcauuguagcugagaccccuaacgucaagaacaagcucagguaucuggacagggauuguagauuguaggagaauggggccuggugccaucuauucguauuggggucagaauuucacuguuagcuuuuauguccucaauuccuuccguaugaucugaaaccguuucucucucgcucucucuuuuuuucaugguguguguguguguguguguguauauacuuuuuuuuauuuuagauaucucuguaccuugcucagacugccaucacacaucuuuuguuuuucuuuuuaacaaguuaaaguaccaaacugauuuauuuaucuuacuuuguguguauguauauacaucacaugaagccugcaggaacuaaaggaggauguugcauuccccuugaacuggaguuacagaugguuguaagccaguauguggguucugggaacugaacuuauuagguccuggaagcaauuagaguacucuuaacugcccagccaucucuccaacccaacuaugacacuuauguagccuagauugcucucaaacucacaaaccaccugccucugucucuugagugccaagauuauagaaaugucucauaugcaaccuugacuggccuggaauucacuauguugacagguuggugugaaacaaaaauccuccugccucuaccuccugagugcugagauuaaaggugugugccuccacgccuggaagacagaauaguuuucagaaaagaguuugguuuuuuuggguuuuuuuuuuugguuuuuuuuuuuuuuuuuggguuuuuuucgagacaggguuucucuguauagcccuggcuguccuagaacucacucuguagaccaggcuggcuuugaacucagaaauccaccugccuccaccucccaagugcugggauuaaaggcgugcgccaccacgcccggcccgagguuuuuuaguauaagggaaaaauaaagggagacuggacugaucuguguuucagagaaugaaaagaauaauaauguacccagugauaaaacauuccguauaaccuccaugucuguuuccuuuuccugcagauuuuuaauuuuuuuugaugauggcuaugcuuccuaugucacucagucagagcuuuaucccauuugccgaccacguaagugucccuacacaauuccucaucucuaauuucuuacucuguuuuguaugucuucuuaaggugguaaauuaaaaggcuugacuucuguuuugguguuccaguuuguuuggagacauagcauuguucccuaacuuuguagccugaaugaacccuaaaagauucugacugucuuuaucaacuuacagauuugcuuugauuucauuucuaaggaauuuagguuuaaagaaggcugcucucauguuuuacauuucuguuuguauugucuacauaauaacuuccuauagaagcuguguguguguguaugucugugugucugugaguauauacauauauacacauacaugcaggcccaucuuccuccggugcugucuaccuucuuugguuuucuuauuaauauuuuaauuuacuuaauuuguaugaauauucugcauacaaauaugucugugcauuugaauuuccugggacuggaguugccauguaggugcuaggauuucaauuggcacugccauuucaauugcacacccccaucgcuaacuuucguauguauagucuaagaauuaaacucaaaucuaucuuagaacugucuauaugaccagacuagcuuugaaccuacagugaugcacaugcuucuacucccacacuuacuuauuuuuaaucucuguguguguuguaccugugcacuuagccauugagaccagguaugaaggcgucccaucucuucuaucacucucuuucuuauuacauugaaauaggaucucucacugaaacagaaauauacaauuuuggcuaggcuagcuggccagaguauuuacauguagcuacccuaaauguggaauuauaagcauacauggccauuuguuuuuaacauggguguugaggaugcauacucaaguccacaagcacacuugccauugaacuaucucccuagauccacaauuauuugugauugcagaagaaucaauuacuuauuguuaacauggaaauaaacacauggcaaagucuuugaguuuuuaaauuuuauguuugcauguuugccacgcgcucugaucgagucagcuugacaagccgagaggcuuggaagcuacucacucacgaggcaaaagaguuucacggaaacucgcuccuggacucuggcguucucucuaacccauacauuaacuuuccauucccgaguuagucuaauguauggauccacgugcucuccuuuaguauuauccuauuauaaaugccuuuuaagauugaauucugacauagcuaaagccaguguuccaacaguccuagaacguccuugagcaagaccuugggcuuggaauucaguacugccccugguauuacacuaucacuuugaguaaaaguuaggucacugcccuucacaggaaucuaccaucaccaaggaagaaagaaguuucugaccguaggagaaaccagaauagauacuuagaacuauagcugaguuacacccauauacaggaauuuacaaugguuuaggaaguagaucgugcugugguuuuagaguauugcauuauucaugagaugguuagcuagaacggaacucccuaguuagaaccaugacuugggugugaaagcccuugcccuaggagaguaaagaccucacaccuggcuucuaagacuauagcugaguuacacccauacacacgcauuuacaauggccuaaggggaagguggacuauucaauagaccaaaauaggaacuauggcaggaucuaucccagguagaucccguuagaccuucuguguuugcauucaucuguuuuauguaagaauccaguaaccucuuuguaccuugcuggugugucacccaacuuccuuauugucuucugcauaaaaagucugaugcucgauuugacauuauauucagauccuacacaaccucuccugugugcaucugucugucaguucaucugacacuuugcccacccacgacuagagacccguuccacgcagacaaaggggcccagagggucugcggcacauguucacauauguuugggauuguauguaggccaaagcugauauuagaugccuugucuacuuaauguuaauugaggcaaaguuauuggcuaaaccuggaacuugcgaacuccagcuagccaacugcagcuagccagguugccuuggggauauucuauuucugcuuucugaauguuagaauuauagacagucuucauagugucuuagcuuuuacacagguucugugaacuugaucaucaugcuugcauggcaagugcuuuaucugcuuaaccaugucuccuguaguucaagcuggccuugaauucuguguauaguuaagguugcucuuuaacuuuuuuuguuuuguuuuguugguuuuucaagacaggguuucucuguguagcccuggauguccuggaacucacucuacucuguagaccaggcuggccucgaacucagaaaucccccugccucugccuccuacgugcugagauuauugguacaugacaccauucaugacuauauuuugugcgugugugugcacacacaugcuuacaugcauguguguaagccagaaguuaauguuaggugucuuccuauuuuucaccuggucuuuagacagggucuuccauugaagcucugaucaguuggcuuggcuaggcuagcuugcuggcuggugggugggucaucauuguuuuugaaucuaccuuccccucacaaugcucaaguugcagaugugugccaugacacccagccuaugucagcacugggugucuaaguuaggcuggaggaugguucagcaguuaagaguacuugaugcucuugcagaaagacccaagcucaguucccaacacucauauuuggcagcucacagcuuucgguaacuccgguuccaggguacccagugugcucuucugacuucuuuuggaggacugcacauucaugauguacagaaauaugcaggcaaaacaccucaaauuaaaaaaaaaaaaaaacuuuaaaagaaaaauuuggggggaaugaaaaaaagaaacaauagacugugguauagcucagugguggacagcucuuacuuugcauguggaucaccaacauuaauuagaaaaagaagcaaaacugaccagugguggagcacgccuuuaaucccagcacuugggaggcagaggcaagcggaucucuggguuugaggucagccuggucuacagagugaguuccaguacagccagggcuauacagagaaacccugucuugaaaaaccaaaaagaaagagagagagagacagacagacaggcaggcaguggugguacacaccuuugaucccaacacucaguagacgggcaagaggaucucuggaggcuagcuuggucuccagaggaaaagaaaaaaaaaggaaggaggaacgaagaggaaaggagacuuacuguuucauaauaguuuacuacuuccacugguucguaagauucuccauaaacugaaaugccuguuucuuuuacaugaauugcuuagguuuguauguggcuuaguuuauuuaguauuuauaugugcauuugcacauuagucucuguacuuaagauggucuugguuuugcuucccuugagguuaugaauuuauuuauuuuuucucuuuaaauuuugaaagugccaaccguucuucccuuucaagauauguccuuccuguccucagcucugcuucuuuccuuuggacaguaaaaaagacuugggaggacauagaagauagcuccugccgagacuucauagaggaauauaucacugccuauccaaaccgcccaaugguacuucucaagagugggcagcuuaucaagacugagugggaaggcacaugguggaagucucgaguugaagagguggauggcagccuagucaggauccucuuucugguaauguucuuccaaagaagaauuugugguaauauuagggggcagguaccaguaaaaugguuaacuguggaaagacacuugcugccaagccugaugauaagaggugacacaugguauauagucuucacaagagacaggauugauucuaauccugaaccugcuuuucucccucccuuugcuccugccucccaggaugacaaaagaugugaguggauauaucgaggcucuacacgccuggaaccuauguuuaguaugaagacauccucagccucugcaauggagaagaagcaaggggggcaacucagaacccguccuaauauggguauguauguccuaaaagauagcuagggaagggaagagacagaguagacuagcacagaaaauuauguauugcagcuguccuuuuauuuaccagagcaauaccacuaacucucuggaucaagauagaugucuaaaauauuuucauuaguguugauggcuuuguggagcugccuccacauugcuguguuuuuuaaauuucuucuaaauauccacacauagccggacauuuugaugcacacauguaaucaguuccagcacuuggaaggcagaaguaggaauaucugggauucaagaccauccuuggcuacuuagugaguuugaggccagucaugauuacaugugacgaugccccaaaacaacaaagucuuuccaaaaccaguguuuacuaguauauccccuuauugguauaaauaauaaaaacaaaaaagguuaacacuuagaaaaugugucauuugccacuucuguauaugaauacaggcauacucauacuaaugugcuuguguagucagaggaccaucucagcuuuagaauuaaccuuccuuguucauuguguauguguuaggcuagguucccugcacuggagaagcucuguucucccuccuauuucccuacagaagcacugcgguuacagacacacgcugcggcgccuggcuuuacauagguucuauagauuugaauuuggguucuuauacuugugucacuaagccaucuucauauuacauuugcugcauucuucuuguucucauuuggauuggguuuucuuuuuguuguuuuuuuuugagacgggguuucucugcguagcacuggcuggccugguauucacucuguaguuuaggcuggccuugcacucacagaaauccaccuacuucuacauuucaagugcugggacuaauggcaugcacaaucaccgccuggccauuuccugcauuuuauauuacauuaguugauaguguauaugcauaagaauaucuggcacaucugucauccucucagcagucaguuuucguuuguuuuuccuguaggugcugugaggagcaaagguccuguuguucaguauacacaggaucuaacugguacuggaauccaguuuaagcccauggagccccuacagccuauagcuccaccggccccacuuccuauaccuccucuuuccccccaagcagcugacacugaguaagugcucaucauuauuuuuacuuccaguuauucuauuuuuuuuaccaccaguaccuucugaagccuuacuauauggucuccuaaucucccuagaagcuuagaaagccaacuugcacaaucacggaaacaaguagccaagaagagcacaucauuccgaccaggaucugugggcuccggccauuccuccccuacuucauccacacucagugaaaaugugucugcugggaaacuugggauaaaccagacauaucgguaagacaaccucagacacugggcagcuuaacaacauggacuccaaggaccuuuauuuuaaaguuauguuagugagaaacuuggacuugaaaaggcagcuucugagaagcugguaauaagauaguuaaauuagaaauuccauaucuaagaaacauacuguuacaagaaaguuauuugccaaaacuucuugaucauaguaaaaucaucauugcuucaacagaaaggagacaccacugggccuuuuccuugacucuuaggagauggcaaggaugcuucgaaccuuugguagaacacuagauucuacuuccauaacaaagaauacauuagggagcaguacccuguugagcuagagaggcaaccugucugaagagucaacagggaguaaguagcauuguauugcuuguuguccaggcuuguuugguaaggcaaagaaucugacauuauucuucaacauccagagcacagcuggcuguaaucucaguuguugggaggacagagcagaggauuggaagccgcaggauagccuaggcuacaugaggcuuugucucaaacaacaaagcagaaaaacuauaugaggucuggagagauggcucagcaguuaagagcacugacugcucuucuagaggucaugaguucaguucccagcaaccacaugguggcucacaaccaucuguaaugagaucugaugcccucuucugguaugucugaagacaggaagguauacucacuauauaagaaauaaauuaauaaaucuuuaaaaaagaaaaaagaacuguaugaaagaugagggaaauggcuuagcuggggggaggggaaacuguacagcagauaggcuugugaccuucugaucucauaucuugcuuuucauuugcaggucaccuuuggccucaguaacaucuaccccagcaucugcagccccuccagucccuccagucccaccagggccuccaaccccuccagggccuccagcuccuccagggccucuagcuccuccagccuuccauggcauguuagagcgggcaccagcugagcccuccuaccgagcccccauggagaagcuuuucuauuuaccucaugucugcaguuacacuuguuugucccggaucagacccaugagaaacgaacaguaucggggcaagaacccucuauuaguuccacuucuguaugacuuccggaggaugacagcacggcgcagaguuaaccgcaaaaugggcuuucauguaaucuauaagacacccuguggucucugccuucggacgaugcaggagauagagcgcuaccuuuuugagacuggcugugacuuucuguuccuggagauguucuguuuggauccauauguucuuguugacagaaaguuucaacccuuuaagccuuuuuacuauauuuuggacaucaccuauggcaaggaagauguuccccuguccuguguuaaugagauugacacaacucccccaccccagguggccuacagcaaggaacgcauuccuggcaaggguguuuucauuaacacaggcccugaauuucugguuggcugugacugcaaggaugggugucgggauaagugaguuggugggguguacaggcauugcugucucugccuucagguuuauuacaguugcuuuucuuuucuuuuuuauuuguauugcuuucccuguuuuccuuuaccuccucuuucagcuagaguucugcuaaggucauuaugaaauacagauacagaaacuggguacaguggcacauaccuguaacuucagaauuugaaauucagcauuguggcaguuucaucuugaguucugggccagccuaggcuucauaauaacuuugaagcuaggcugagcuagcuacgcagugagaucuuauugaaagagagagagagagagggagaaugaaugaacaugagauagggagaccagggucugaucgucuuaaauguccccaggaguaacccuggaaauguagggguuauguucuguuccugucuccucuugcuguuucugucuccccuuaaccuuucauccuuguguucaccauuuagauucuacuuuauucucacuguaucuuacucaugcuuuuucucacuaccuuuaccuuauccccauccucuguuauugguugauuuuugcccuaagguaagguuuguugagggagucccuggugacuaaggaugaggccucgaaaguuccucgcaagggaaagaguuuccauaaccaagaucugcuuaaaaauauggcuuuagcuccaccuuuccuacagcucggccugcuucauauucagcauggcccuggagguuagagccuuugguauuucucacauuuuaggaaguccuugccaacaaagucacucagccagugcaccuccugugcacucagccagugguaccacacaugggcaccuugggccuggcagagccugaccugagaugaaugacugcagcuagcaaguccuaaguuguggacucaacucaguuuugauuuaagaccgcucaagcuggcccagaacuuacuagcugaggauagcaguuaacuccugauccucccaccucuaugucucagauauuggauuacagauguagaucacuguguccaguucccauccucaugaaccucagaaaaccacaacucuagucacccuuuucucucugcagauccaaaugugccugccaccagcuaacuauccaggccacagccuguaccccagggggccaagucaacccuaacucuggcuaccaguauaaaagacuagaagagugucugcccacaggguaaguauucaguuuggagauguccucagagaaguacauuguuguuuuuuuuguuugcaagagccuuuggaaaccuaacuguugccuuugggaagcugaagcaggaagauaguuucagacccaucugagcuaugauaccaaaauugugucucaaaaaauaucugagagugauuagagaggguuuuuuugguuuuguuuauuuguuuuguuuuggagacaggguuucucuguauagcccuggcuguccuggaacucacuuuguagaccaggcuggccucgaacucagaaauccgccugccucugccucccaccacaccuggccgauuagagaguuuuuaauaauuuucuuaugcagaaaccuuagaaggaugugauagcauaugcagaaggauugcuugauuucuaggucagcuuggacuaugcagcaagaccuuguguagaaacaaacaaaaauggaacagcgaugcucaguaguuaagagcacuuguuauugcaaaggacuuggguuugauucuaggaccuauaugguggcucacagccaccugucacuccaguuccagaggaucugguacaaacacgugcacagacaugcaugcaagcaaagcacucauacaccuaagguuaauuucuuagacgugugaauguucugauuaugacuuacccuagcaagugagauguauucagagacaguuggaagaaugaaugacagggcuuuguuaaccuaaaaugagaaguuagaaucagggccagugguaguagugcugucuuuuuuuuuuuuuuuuuuuuuagauuuuuuuauuauuauauguaaguucacuguagcucucuucagacacaccagaagagggcgucagaucucauuacaugguuuugagccaccaugugguugcugggauuugaaccuucggaagagcagucagugcucuuaauggcugagcucucuccagcccauggugcugucuuuuaaucuuagcacucaggagacagagacaggaaguucaaggauacccuagucugcaaauugaguuccaggacagccagggccacacagugaaacuaucuugaagaaacaaaaacaaaaaaaaguuaacaucaaaaucaugauaaauaggaaguagauuuuauguagucuuuuaaauuuuuucuuuuuugggggggauguuauaugucuuagaucaggaaaaaacagaauuucaaagauuucaaagaccaauuagguaauuuuaagagaauacaugagaaguaaugggagguaggccuugcacuagaauggaaaugacaguagaaauuaaggaggauagggauggguguguagcccaacagagggcaugguuaauaugcaccaagaaugaaguaauaaaugagagcuauugggugcauuagaaaguacagcuauauagagaaauuuuguugguugauugguugguuuuucaagauaguguuucucuguguagcucuggcuuccuggaauucacuuuguaggccugaaugaccucaaacucagaggucuaccugcuuugcccccugagugcugggauuaaaggugugugccaucaugcacaguaacauauagaacuugauaaacgacuagagaguggaaugaaagaaguagaauggaggacaguucccagauguuuggcuugaggaaacaacuggucauugaugcugaguuggaaaaccaaaaggugcacagcugagugugguuucaccuuguuuucagccauauuaaauuaggcaguccaaauacaaaugugaagaagaugguaacauuucuggagcaggauguacaugguggugcauaaaucauuaaaucaguauucccagaggcagaggcagaccucugugaguccaagacuagccuguuuaacauuugagaacauuaaaaacaaauagauaaaaaagauuucuggagcaaaguuaagggcuagacaaaaagaccugggaguccuaaguagagaaacaauaaauuugaaugaaugccguauuugggguuugcaucaauaucugagacucaggacaaguuugaaagaagaaauagagugagaauggaaaauaguccggcaaacuauacauggaauaagaacccaguccuugaguguacagggaaagggaaaaacauacauaagauuacuucauuuuucauaaucaaagggucuaccuuuaaauugaaagguaugcuuacucuggagguguagcuuggugauagagcacuugcccauccuguaugaggcccuggguucaguucucagcauaauaaaccaaaauagauucccacuaagacauaauuagagccagguggugauuguaaacaccuuuacuugaagcauucuagaugcagaggcacauggaacucugucuacuaagcaaguuccaggacagccaagaauacacagaaaagccuuguuuugaaaaaagagaaucgccgggcaguggugguguacaccuuuaaucccagcacucgggaggcagaggcaggcagauuucugaguucgaggccagccuggucuacacagugaguuccaggacagccaggacuauacagagaaacccugucucgaaaaacaaacaaaaaggagaaucaaagguuaugguauauagcuuaauagaaugauugccuaguguccacagagucuuggguuccaacaccagcacaaaauaaacugguuguagacauggagacuggaggaucugaagugugaguucauccucagccucauaguaauaucaagucaaccuggguacaugagacucugucccuccaguuccagggcuuccuucuagagcacuguacucagcuguguuuguguugaugcgugugggugcagugggugagaaucuauaaucucagaauucaggaagcauacacugaaguaucuuuggaagcugaaagccaaccuggucuaccuagugaguuuuaggacagucagagcuacauaugcaaucuguuucugucaaagagaaacaaacaugacuaggggcuggagagauagcucagugguuaagagcacuaccuucucuuccagaggacugagguuaaauucucaacaaccacauagaggaaaguuaaucaggaaagcaugugauccagaaaacaguagacccaaccaaaaggacaaaugaaggaaaugucaaauaugcugcugaggggacggucucacagggucacauggcacuucauguggagacccagcagugcucaaguaggacagauaacugcugggguggcuuccugggaagaugaguucauggcaaacuugagaggagauuuagacuguuggggaauuaguuaauuugcguugaacauagagaaaacaaagcagagaacagcugacugguaguauguaccuaucauccuaucuuguuuugguuuugguguuuugagguagagaucugccuuccuagugcugggaguaaaggcauuucuacugccuaacuuccuuacauaauugaaaaauauucccaagccagguaugacagcacacacuuauacuauaauccuaaugcuuagaaggcuaaagcaaaauaauggcaaauucaaggccagcccaagcuacaacaaacaacaacacaggucagggaugguugugcaugccuguuaauccaaaacucaagaguauugucaggaucaagaccaagcugugcuggugagauggcucagugguuaagagcacugacuguucuuccagaggucccaaguucaauucccagaaaccacauggugguucacaaccaucuguaaugggaucuggugugucugaagacagugacaguguacucauauacauaaaguagauaaaucuuuuuaaaagaaaaaauacaaagccaccuuugccugugcagcugauccaaagacagggcagccuguguuacaugaaaugagauccuguccagaagagcuuaaaaaaaauagagaaagaaaagaaaaauguugagaguauagcuuaaugcagugcuugccuaguguucauguagcaguagguuugauccacaguacugaauauguguaguacauaccuauaaggccuccugaaaucacaccauucuagaggaggaaacauauaaaaaacauagacauuuuuaaaucaaaauacaaauuggacugcugcucauggccuuucauccuagcacugaggaggcagaggcaggcagaucucugugaguuccaggacagccugguuuauaggaaaucuuugguuauuaguuaguuuugcuuuuguugucucugguuuugaguuagggauagaacccaaagccuuguucaguguuuugaaugugaauguuuaccacagguuccaaucuuugguggaacuguuuguuaaggauuagauguggccuuguuggagaagauaugucacuagggguggugagguguuaaaaacccaugcuauucuaguuaguguuuucucucugccugauguaagcucucagcuacugcuccagugccaugccccacaacauaauggugguggacucagcugcaaaaaaaaaaaaaaagauuuauauauuuuauuuauaugaguacauuuugcucaggaccucuggaagagcaaucagugcucuuaaccacugacucaucucuccagccccagaugcuuucuuuuauauguugagguguauguuuguagcaagagaaaaguaacuuaagauuaccacuuagggggcuggagagauggcucagcaguuaagagcaucuucuugagguccugaguucaauucccagcaaccaccuggugacucacaaccaucuguauuggggauccgaugaccucuucuggugugugaagauagcgacagaaugcccacauacaugaaauaaauaaaauaauuuuugcuaaacuuuaaaaaaaaugacuaccauuuaacuacauauccaguccuacacuacaagaaacagacuuuaccuucucucuuuaaaaaauaaaaggggggcuggagagauggcucagagguuaagagcacugacaacucuuccaaagguccugaguucaauucccagcaaucacauuguggcucacaaccaucuguaguagaauccgaugcacucuucuggugugucugaagacaacuacaguguacucauauaaaaaaaaauaauuaauuaaaaaaaaaaaacagaaaaagacuucaguucuuuuuuuagacaaguucuccaucuuuagucuagggcugucguugaaacuugcuaucuaccuagcuuggucucccaagugcuagaauuacaagccugcagaaauauauaucuagcaaaaauauuucugaauaaguauaaauauaugucacucauauuuaaaacuauuaguuccccaauacacauugauuucauucuaaccuuugacuuggaaaacacuguacucucuagccuacuucucucccucuaaaguuguuugaaguguguuuauauccauuacuuccuagauccauuucacgcuguguuuuuuuuuuuuuuuuuuuuuuuuuuuagccuaccucuggugguuuugugcaggagauguguucuuggcacccuccacugcuuuuguuuggcuggcuuuaaccuugaucucucaguuucagucuccagucuucaaccugucccuggguacuugaaaaguaggccuuuuccccugggaguuuguuuuguuuguuggacauggccuccauugcuaaaccagcuuccaucucacuguauagccagugguaacuuugaauucuucauucuucugugucuaccucaaguguuggaauucuaggcauuuaacacacacauaguauauacucuguuuucacucucucguucucuuuuacagcaccacaauuguacuuuuuauaaguauuucuaacaacuuccuugacucaauugugggaucuuuuuuucacauuaauauaagcuuacauuuuauccaauccccaccccacccccaucccacuaccuagugcaguguuacagaguagccacugaaagacauuuuaaggaaugaauaaaugauacuuaguauaguuacucugauggcuuccugugcugauaacaaauaugaauagcccccuaauucccaauaggcuuucccuagguauggccuagaauucacuauguagugcugagauuaaaggcaugcaccacuauacccaauuggcuuuuuuuuuuuuuuuuuuuuuuaauuugacauggccagggauaguggccacaucuuuagauuuauuuauuuuauguauaugaguacacuguugcucucuuuagacacaccagaagagggcaucagaucucauuacagaugguugugagccaccaugugguugcugggaauugaacucaggaccucuggaacaguaguccaugcucuuaaccacugagccaucucuccagccagccagcccccccacaccccgaauaggcuuuuaaggaugcacacaguaaagcaguacccaggagaggugcugaugugugauacucaguuucugcaaauugcucaaacuuuaguccuguuaaugcauuuuugucuguguaucucacaguaaucccacuccauguuuuguguuguuuuauuuuucuuuuuacuuauuuuuguggugcuggcagucaaacccaggaaccucaacaguccuuucuaaaguugggguagaaaauuaaucuuuauuuuuauuuuauuguugaauuguuuuagauuuacucuuacuuugcauguaugucuuacauacacgcauguauaugcacuauguguaugccuuuuggauccccuggaauuggguuuacaaaugguucuaagcuacuaucugaaugcugugaacugaacccagguccucuguaagagcaacaagugauccuaacugcugagccaucucuccagccccuuguauuuugagacagguucucagauagcccugguugacuuugaauucucaguguugccaaggauggccuugaguuucugaaacuccugcauucaccaccuaaauucugggcuuucaggaauuuaccaccaucaccaguguaugcagugcuaggaucuaauucagggucuugcacacacauuacauaacuaagcuacauccccugcccucguggaucuguguagucugaugguagugcauauguaaaucagagaucaauauacuacgucuuuucucuuuaccucccuuccuucccccucaggguuucucuguguagucuuggcuguuuagaguguuagccucugccucugccuccagaaugcugggauuaaagguauacaccagcaacaacuggcaaguauuuguacuuuuuaucaggaaguuuuguuuuauauuauauuuucacaguuuugagacaggaucucucuuuguagccuucacugugcuauagaacucaaguguguugaccaggcuggcauugaacucagaucaccugcaucugucucacauauuuucucuuuucuucaguuguugaauugguaauaugaggucaaaauuacuaugauccuuuucuuugugcauucccaauguuugaacacaacuuuuuaguuguuuguuuuuuuuuuguuuuuuuuuuuuuucuucucgagauaggguuucgcuguauaacccuggcuguccuggacucuguaaaccaggccucaaacucaggaucugccugccucuucuucccaagugcugggauuaaaggcgugcgccaccacugccgguuaacacaacucuuguuaaauaaauguuuauugaaaacaacguauuggcacaugccuuuaauccuagcauuuggaagguagagauaaguuacugucuggguucuaggcaagccuagucuauguagugaguuccagauggcccugucucaaaaaaaaaaaguaagccaacccccacccuaaaaaaauguuuucugaaagaguaucagcuuuaugcuaacaaaagaauuguaccaauauuauuauaauuuucuuaucuauuuccuuuugguauauauaaucuggcuucugcuuuucuucuguaucuguuucuagaugucaguuuuuuauuacauucauggggugggggcaggugugcauagaucagaagacagcuuggaggaauugguucucuccuucuaccuuguggccuccagagguugaacuuaggucaucagucuuggugaaaagugcuuuuacccaauaagcuggcucaccagcuucccuacuuguaucaacugagacaaccuauaaacuuacaucugcagucugaaucaccucauuguuugcuaauccuuucuccagggguuaggcacucugucacuuauuaucuacaguauuacugugaauauugugaaacacuuugccuucugaauuauguucuuggucuuuauuuucacaugaguccaagaggauagaggaaucacuccaaaaauccacuaucucgggucacuaccuacuugaugaucuuugcuugugacauguguuagagauuuaagucuaucaguaacugugucauugacuguauucuaaccucccaggguuuaugaguguaacaaacgcugcaauugugacccaaacaugugcacaaaucgguuggugcagcauggucugcagguucgacuacagcuguuuaagacacagaacaagggcugggguauccgcugcuuggaugauauugccaaaggcucuuuugucugcauuuaugcagguuagugauuaaaaaagggguuuuacccuaugagguuugggacauggaaggucaaggaaaaguugaacauagcaaaguguuaguggguaugguagcacaugucuauaauccaagcacucagaagaugaaaacagaaaacuuuaagaguaggagauaaccugggcuacagaguuagauuuuaccucacaaaaaaaaaacaaaacaaaacaguguuugaggaguggaaauguagcucaggagaacaaugcaugcuuaguuuucaggaggugcuggaucacucccuaacauuaaaaaaaagaaaggauggauggaugcauaaaguguuugacaguugaacugggaauaagaggaggugggaaucucuucuauaaaggacaugauaagugauauauaccugaauagguaggaccagagaggggcaaagguacuucuuaaacaguagaagggaaucagauuuuggcuauugauguuucuuucagugagagacaucauuuaauuguauuauuuucuccgagagauauuuuaacccaggaaguaccaaggagguaaacaaaagaaaaaagaaaaaaaaaaauugggaagggcaaagcaacaagcugcagugacauugacuuaaugucagaggcaaagguggcaaaguaagcauauaauagauuuacccugcugguggguguaguacugaugaagaccaucaauucucuugauucucaggcaaaauccugacagaugacuuugcagacaaagaaggccuggagaugggugaugaguacuuugcaaaucuggaccacauugaaaguguggagaacuucaaggaaggauaugagagugauguccccacuuccucugacagcagugggguagauaugaaggaccaggaagauggcaacagcgguucagaggacccugaagaauccaaugaugacagcucugaugauaacuucuguaaggaugaggacuucagcaccaguucaguguggcguagcuaugcuacccggaggcagacucggggucaaaaggagaaugaauugucugagaugacuuccaaggacucccgccccccagaccucgggccuccacauguuccuaucccuuccucaguaucuguagggggcugcaauccaccuuccucugaagagacacccaagaacaagguggccucgugguugaguugcaauagugucagugaagguggauuugcugacucugacagccguucuuccuucaagacuagugaagguggagauggccgugcugggggaggccggggagaggcugaaagggccucuaccucaggauugagcuucaaggaugaaggagacaauaagcagccuaaaaaagagguaagaacuuugagagcagcccuacuccccuccagaaauuacuuacuuuaacucacaacccuggagguacaaagcugcaucuggugauggccauccuagcuggcagacucccaaggugguguaaggcauuacauggcuagaaucagggaauaucuauuuguguuaaaagcaguuccuuuuagcauugguacaaaugaagauugaaacacagggccuuaccccuuucaagacuccaucucaaaggcaaagaaauaaagaauugauucuaaauauauaggguuuacugcuguugggauuuuguuuuguuguuuuucgagacaguguuucucuguguagcccugccucacucuguagaccaggcuggccucaaacucagaaaucugccugccucugcuucccaagugcugggauuaaaggagugcuccaccacugccuggaugcuuuuguuuuuuuuuuuuaauugcuguuuuuaguuagacacggucacaguacacuccagguuggccugaaauuugcuauuacaaauuuaauguugaaauacuccccauuacagauaguaaaacuguuggguccgugaagcacagagcucacgagacccauuauugagaaagauuaaaggcccuugccaggagaguauacuguugauugugaauguuaacaaguuauaacaugauuucccuacaucaccaccuucagugugucucuugcugacuuaugguaaugcugucuuuggagaucuucuguuaccuuggaccaugaaaugaucuuuaaccuuucccuuguuccuuuccaggacccugagaaccgaaacaagaugccaguguaagugcuugcuuuuucauccuuuaagccuuccucuccgcuuaagcacacaaaagaagccuaagaaacaaccaguagcaacuugacccucucaaucuuugaccuucccauagaguuacugaaggcucucagaaucauggacauaauccucccaugaagucugaagggcuucgccgaucagcuaguaaaaugucugugcuccagagccagcgaguugugacuucuacucagucaaacccugaugugagugacugucuuaugcuuaugcugccuucuguuuuauucaguccaaguaaaggagcacacaauaguccaccucaaguccuuggcuagagugacuguuaagucucuucuugggcuuugacuuuguguuuuguucuccagcaucuaaucauuaucuuauuauaaccaaagccccucuugccaaaucauggguaaaagcauuaacuugagcagccuuuccaugagcugcucauccuucuucacacccuucuguccccaggacauccugacacuguccagcagcacagagagugagggggaaaguggaaccagccgaaagcccacugcuggucacacuucagccacagcuguugauagugaugacauccagaccaucucuucuggcucugacggugaugacuuugaggacaagaagaacuugucagguagucugaaaauguuuggaugugguaggaaggaacaggaaaaguaggaaaaacacuuuuaaaagaaggaaauaagcugagugugguggugcaugccuuuaaucccagcacucgggaggcagaggcagguggauuucugaguuccaggccggccuggucuacagagugaguuccaggacagccagggcuacacagagaaacccugucccgaaaaaaaaacaaagacaaaaaaaaaagaaggaaguaauucagauccuaagaguugggcagguuucccaccucagcugaacuguugaacugccaugugcccuucccuucuuccccauaccccuccguuucuucagcuccuuaguucaacauaacuauucaugcuuuuaauaaagugugacaaucucagccuggugcccaaaccuguacuucagcaucugggaugcugagacagaaggcuuguggguuuaagacaccugaguuaagaggaagccucaucugaaacaauguaacuuauggucuucaccaccccaagacaguuucuuuguagcccugauuguucuggaacucccuauauagccaagguuggccuugaacuccagauaucugccuaccaaguacuggggcuaaaggugugcaccaaccauacuuggcuaugauuuagggucuuagccugaauuuagcuagcuuauugcagugauuggaauaaaagugaggagaaguggggcaugguaguaacauguaauuccagcacuugguagaaagggggcacaggaggaucacaaguuugagaccacccuggcugaaaaugaaaguaguagaagguauagucaggaguugggaugagaugauuccugaacaccaccaccccuuuuuuuuucucuccaggaccaacaaagcgccagguggcaguaaaaucaacccgaggcuuugcucuuaaaucaacccaugguauugccauuaaaucaaccaacauggcuuccguggacaagggggagagugcaccaguucguaagaacacacgccaguucuaugauggugaagagucuugcuacaucauugaugccaaacuugaaggcaaccuaggccgcuaccucaaugugagaugcugaaccaccucuagguguaggcuaggccauugccucagauuccugacuuuuaaagacacuguaucaacccaccuuugcugauaaguugaucucagagagugaaauagcuuccuuucaaaacaucacugcuguaguauauaauggaguagagaucagauguguguguguguguucucacaaagccagauguuucccugguugaaugacugucaucuuuaaacuuacagcacaguugcagccccaaccuguuuguccagaauguguuuguggauacccaugaucuucgcuucccuuggguggccuucuuugccagcaaguaagggggagaaugaggaaggggcaaguuguguggaaaucggggugaggcguaccuuccuuuguggucaggcuucacuuuuacccucuacacuuauucuuuuucgcacuucaggagaauccgggcuggaacagaacucacuugggacuacaacuacgaagugggcaguguggaaggcaaggagcugcugugcugcuguggggccauugaaugcagagggagacuucuuuagaggaagacuuccucacuuugagaacgcuugaacuauccuuuuccccaggaacugggucuuccugacuguugaacucugaccccaagucucugaucuagcuucuucccagcuccuaguagauagagauggggauucucaaucaggacuuucccagcguggugcuagcaggcacuaggguggguagacaugaccacucuagcaucagccugagguccuucucaucuuguaugcauucaugauucacaugggcuguguaucugccaucccugauuuguaugguuucuugaaagucuucuaacaagaugguaaaguagagauugugguuugucuuaucuccugccuugaucuuccaugucauuucccagugggcaacuaucauuaguuuauaccucgauuuuauuugcccuguguaauuuuuaacuaaaaauguuacauaaccacaagggaggccuaagaaaaaaacuaacccuuucucaagucuuaauagucugacacagucauguuuuauuuaaccuuuaauauacuuuaauuaaaaaaaauuaacaguacauuuuggucugaaauggucccucgccgaaauaucagguccuaccuguaguuguggcuuuacaacugaaaccccaaauguucaauaaauaacagaacuaguugcccuucuacuccacaccagcugucauagcugaagggaggggacaggaaggccagagagggaggcagugagauccuaggaaccauggucccugggguagggugaggggcauguaugcauacccuccuucacuucauugacuuguauuuaaggaagagaaaguuaaaaguagcucagcuuucuuucuuggccugagcuagggagcuuagaaagauggaaccuugguccagcuuuggcagaaugaggcccagaaaagggacaguaaggcacaacccuggcuugaagucagggagucaaaggcaaacagcuagcuccaaauucuuaggaaugaggaaugugaguuaugauuccaacccucagagcugaagaaggauuagcaagaaggguagcuuagaagguagagagggaaaugagacuaugucucucaacaggauguggauguggccaagccuccuuucuaccuggagauaggcuguuuagagucugguuuaaaggcaacugggugaaaaaagaaguggaaggucaguguagacuccucauauccuuucuccccagagcucaaaugccccuaaagggaagcuuggcuaguuucuuggccucaugcauugaugugggaggcagcuaggacaaugguucagucauucuuaggaugauuguuauugaggaugggguggccauuagcuaggagccggcucuuugcuccugccccagcugcagucuccucccccucugaacucucuguuucuucucugucacugcguucaucuucuaucagcug

SEQ ID NO: 1570 - RNA, 10180 nt, Mus musculus
uuuuccagccacugcuggaguugacuuccgcaauccuuaccgaauaaaucuagcacccuuagucuuccgcucacaguagccacgcuuccuauccgaaaagagccuagcgaacagauucucaacagcagguaacauuuuuaacuucuggaucuuuuagcgucuuguuccuaccaauuaaccuuauuuuaagaagagaaaggauauaaugaauuggggaucaaauaauuuaaguucccugaauaacaacauaauccuuaguuuauuuucuagcuaaauguguauggaaaucuuuaggauuuucuaugugaaugaauauguggcuguugguauaaucagaggaagaggauucuguaagccugucucaagcgugggcucuuucugaguucuguuuaacuuaagaguuaaccaacuccuggggaagaagaagaauucacagccacccgcaagccugucacaccccgguuacuggugcucugcuggguagucuguugcuuugcaaagaguagaugaaaugucgucaguguugcacaagucauaugaugugcugcuggugggaaaugguuuuuaaacuuaagaacuugcaauuaagccaacacaagaaauuaauggggccagagcagaugcugaaaagcugugagcugugaacuuaggucauuacggaauacuguccuuccaucuuccaccuccauucgugucugaggcuuucacccuguaaagcagccacgucgcuguuuggaaaaaagaaaagagaaaagaacagcuacuuacccgugacaucugguuaugaucagagcuguuuccugccuaaaggagaggagguggaaagaaaaaaguggacaaggcaaaugaagauacagugaacguaaauaccaucaaaaugguccuguccucuccuggcaagaucuggguguaggcaaggaagaauacuaugcacaaagccugaaguguacuguagcuagaacucuggcucuguaaccacgcucacugugcuuauucuguuuaugugcacccuuaccugggauacgggggugggguggggguggcauaagagcugccgagccuuucccaguuacuucuacgcacugcgguugccuaaagugugugcaguguugguggaacauacgggaguuacaaugauuaagucagaugauccggcaccuccugaacuucugucuguuuuaugugagaaucaccugcaauuccuuguuuuccauauacagccaagugugccugucucacagucaaaugaagggauucuugggcauggcucacaccuuuaguccuggcacaggggagaggggguagaucuuuaaauucaaggcccucuugauuaacauagugagcucaaggccagcaaagacuuacauaaaaagaccaugucucugaaauggcagaaagucuguguguguaugugguguucuuuugaguuuaugaaucccuuaggauuaguguguguguguguguguguguguguguguguguuauuuuucugguagaaaauuuauuuuuaaagcucuuaaaagguuaaaacuuuccugauaaccugucugcugccauuugaacauccaaagccaaccugugaauuucugcuaguggaaaucuccccuaauuauuccuuccgccaggauguggguguucaaguuucugcugcuacccauggugagcuuugcucugucuccggaggaaaugcuggacacccagugggagcuauggaagaagacucaccagaagcaguauaacagcaaggugcccaaggaagcaguccccauucucuaacucugcagcuagcuuuuccuucugugcaucaguccuucugucugcuucccacauguauuagcuggagagguagcucaggaacggauggcuggucuagcauguacaaggcacugaguccaauacccaguaccauagauggggcuguaugggguguauguggggaaggcucuuuuaaggaacacuucucauaguaaugccauuauucuauggucucucuaaaccuuugcauaagauuuguguauguacucuuaagagucuaugguuucccaguuagauuguguuuucuguuuauguuguaugucuucuucuaaaacuaccuauauaaccacucagucuacaaauuuacugacuauccuguuuagguggaugaaaucucucggcguuuaauuugggagaaaaaccugaagcaaaucucugcccauaaccuggaggccucucuugguguccauacauaugaacuggccaugaaccacuugggagacauggugaguugccucucagauccaggccugcccacugucuuuacccuggucccugcuaaugcuuggcauccuuucuugucucagaccagugaagaagugguucagaagaugacgggacucagaauaccucccucucgauccuacaguaaugacacucucuauaccccagagugggaaggcagggucccagacuccaucgacuaucgaaagaaaggauacguuacuccagucaagaaccaggugccuucuguagugugugcuuguguguguaugugugugugugugugugugugcgugcucacgugcgugcgcgcacgcaucugugguaaucugacugugguauaguucaugcuacaagaauauagcauauuguuacuuaauucauuaccuauuuuguauauuuaggauuuuuuucuacuuuaaaauuuuuacgcuaagcugugggcugaagauucaagaucuaaggugcugccuugauccucaagaaauucucauucuuaaaaauuagaaaaaucucagaaagagaaaauucugcaaucaggaaaguaaauccuaauaguagcugacacuuucugagagauugcugugcaucaauagugucucugauucucgcgugagugagaucucucgguguucacagaaaucucaucaacuuuaguaucacucacuuucuuguucuuuugagacgaggucucuugcccaggcuggccuccaacucagucuauagcugagauugaccuuuuagccucuggaccuguugccuccaccacucaagugauggaguuacauguauguuccagcaagcccaacuuauucucacuuuaaaggaaacugaggcacagaguucaguaacugcucaagauuguguuucuaguaugcaaagucaggguuagaauucaggaaaacugucgccagagcuauaaaguccccacuguacuugacuucaguuaaaggagacaguggucacaguugucaucaauggggacaauagcagggcuucacaacaaagacagucuuuaugguugaguguuuguggguggaguuuucucaggcuggcagagagacccacccucugugaagagugauggcugacagguccucuguauguuucucagggccagugugguuccuguugggcuuucagcucugccggggcccuggagggccaacucaagaagaaaacugguaaacucuuagcucugaguccccagaaucuuguggacugugugacugagaauuauggcuguggaggcggcuauaugaccacugccuuccaauacgugcagcagaacggaggcauugacucugaagaugcuuacccauaugugggccaggugagaccaccguaguauguagccgugggcugcuccuuccccgggcaugguuuuguuuucuguuagcauauccugcuccuuuccauuuuuuuuuuccuuuuaauuuugagacaauaucuuacucuguaucccaaacugaucaacuagguauccuaggcuggccacccuuuuuuugagacaagaucucauauagcccauguuguccuuaaaaguacuauguagcugaagacaacccugaauucuuccuaccucaagcuuccaacaggccuggguuccagacauggcuauccuguuuuccuaauagaauuauuugccauagaaggccaagauucucauaaucauggaaaacauugagccaucucuucagccccgugacauuuuuaaugcaguugggacugacggguaguagaguuccuuggaauauggaccuuuaaaagaggaacugcacguuucagugauagaaauauaggcaacuaugaguuaaaauauguucaguuuguuuucuuaaaaggucagcuguuccuugauauuuauggaaaugucacagcauacucaaauucauacugcuguauguagcaaaaccaagauuuuauaaaauguauuauuguguauaucuguauaugugguaucugugugcauguccuggugggcuugugccauagcaugcaaaguacagagauaauuuuguggauucucuccuucuguagguccugaggaucacauuuuaauuauuaggcauauuuagcugaaguuuuaccaacuaagccaucucgccagucccccuaccaggaucugcuuaucuccugcagccuuuccucucaugcacccguguaacauggaagcuagggaauguuacuuuggaacauagucaccuggguguggaagcuuaucuucacuuuacuauauaauaccaaaccguugccagaaaucaugcuccuacugcaguauauaagaaagccccugacccacagucacaucuucaccacgauguuucccuggucauuuguacuucuucuaaacugauaaugaguggcccaguguguaugccuguauuuccagcacaugggagguggaggcagggggauuaggaguucaagaucauucuaaauaccugguauaucugaacguacccagccuggccuauaugagucccucucggaguagaggaugggacaaaacacgaagauccaaaauaaaaaguaaagaaggagagauccucuauauagagucuaaucuguugccuguugauuuacugacauuauuaaauauauuucccacucagcaauuuaaggauauauuugagaaaagaauauaccaaagaaccaauaauuagucaguuaacaaaugacagcuuaugucuuauuagaaguuuuuuuuauguauaugagguuuuugcaucuauauauguacauauaucauguguguuccuggugccccuagaggugagaaggacauuggauucccuggaacuguugauacagauaccaugugggugcugggaaccaaaccuggguccucagcaagagcagauccuuaugaugucagaggggcccuucuacccagcuccugugauuuauccagcauuacaccaaccuguuuauugaaaauaguuuuuauguguguguguguguguguguguguguguguguguguguuugugugguguguguugauauuauaguccagacugcccuggacacacagagauccaauagacuacugcucacacugucugggaguggggguugucucaucucacagaaguugcuggggaguguucuuggauuugaagccacuauggggcauccugaugucuuuccccaguguguucucccaguuaaaaggagaugaagggauugugagcuuuaaacaguucaaauguggaucugggcucucucuacucaggugguacauugagauccuggggucuagaaauccuggggucugugccaggaauccagcuaggaacugaaucuauauuugugguaauauccuuugugcuucacagucccucauuuccuaauuccucacauguguuuauggaaguaaauggaguuuagggugugguuggccaagucagacucuuaugaucugucacaugccuggauuuuggggaagcgcuuggagacucuuguaauugggccuaguuugggauuuuaaugauugagaugcagcacuuaucagacauucuaccacccgagagucuagcaguagagucccacguguauccauuaauguagauucaaguguuguaaauaauuaggugcugcauugggucaguugucuuucuuuccuuacugucauguuggguguugauccuugggccucguaauguuaggaaagcccaccaccgcugagucauguuccucaacccucuuuuagcuuuuuguaaauuacuuuuaucucccauuuaagcaacuagaaucuuuuuguaaaguuuauuuuauggaugugaguacacuaucgcuuucuucagacacaccagaagagggcauuggacccauugcaggugguugugagccaccaugugguugcugggagcugaacucaggaccucuggaagaauaggcagugcuuucccuucuaagugauggggucaaugucugcaccaugccaggcccugauuuucuuuucaguccauucacaagauacuuuauuucauuuguagauuguauauuucauucaugccucccuuuucuuuuccuuccuuccuucuuuccuuccuucucuucuuccuuucuuccuuccuuucuuucuuucucucucucucucuuucuuucuuucuuucuuucuuucaaccauacagcaccaagguuuauagacugaaauccucuuauaucaugcugacauugcagagaugugucacugcaucugguugauuugagcaguuuaauaccagaaucauguggcagagaacagauuuugagaaauuaaggcacuuuaaccuuaaaccgucccaucaauugcugacaguacuguugguauuuagauauguguucuuuuagauacaaccuuaagguguuuaaggucuaguauguaggaggaugcauuuccaccaagaauauaacaguaucucauacugugaggcuugcaaacuaugaguucagagccaacuuagacuacaucauauacugucucaaaaagaaaggaaagaagaugaugacaauaacaaggaguuggagagcugccucauugguuaagaguccuugcuuucucuuacagacaaccuuaaucuauucccgguacccacaauaggcaguucacaacuaccuggaacucuggcucccaggauccagugcuuuuuuucuagccuucaagaaaaugugugcacaccuaugugcauauacacacauaggugcacaccccauacacagacagacaagauacacaaauaaauacgcgcauauaaaggaaagaaaguaucuuuuccuucuggaguugguuuuuguaaauucuagaaagcaggaaaugacuugagguuuuuauuuuuauuuuuauuuuacacauuuuugggucuuuuuguuuuuaagacaggauuguacuguguaacucaggcuggucuugaccucauggcaauccuccugccucagccucuugauugcugggauuacaaguguacauucccguaccuggcuucauaauguucuaaaacgguaagacccaaagacuaguugguugccuguaacaugguuggauuucucaccaacucauugccauuugauugacucugcucugauccaccuuugauuauuauuucccaggaugaaaguuguauguauaacgccacggcaaaggcagcuaaaugcagaggguacagagagauuccuguggggaacgagaaagcccugaagagagcaguggcgcggguaggacccaucucuguguccaucgaugcaagcuuggcaucuuuccaguuuuacagcagaggugaguuucucuuccuguagagcccccucuucuaggguguggguguggcccuaagaggauugagugcuuaguuuucacagucuugcagcugcugcagugcuucgugucucagcuguaaaucccgaggcaagggaucgcacgggcugccuauguucagagaaccucauccagaguuuguguuguagguguguacuaugaugaaaauugugaccgugauaaugugaaccaugcaguguugguggugggcuauggcacccagaagggaagcaagcacuggauaauuaaaaacagguaacacugaccuugucaauuaugaaacuaacauaugauggguggacaauagugcuaaaaguauaugcuggacagcugcccguugggcaagaugcuuaguagcacacaagcagaugggcagauguuuguguuggucucucgcagcccaaucagacuuaaccgaccaguucauucccagguaucucauuugacccgauguuuuuguuuguuuguuugauugguuuugaauuuuugagacaggcucuccuguagcucaggcuagccuugagcucaauauggcccagaacucuuccuuugucuuauuccaccccuccagaucugucuccugcuccagucuguccauacgcuggauuugagucacauugucauaucauauggcacuuucccaucuaucuuaccugucacaccuuuccaccaucccaccacucccauagacccaaagucaacucauccuucagguucagccucauacaucuccuuucucccccaccccccaagacaggguuucucuguguagcccuggcuguccuggaacucacucuguagacuaggcuggccuugaacucagaaaucugccugccucugccucugccucugccucugccucugccucugccucugccucugccucugccucugccucugccucugccucugccucugccucugccucugccucugccucugccucugccucugccucugccucugccucugccucugccucugccucugccucugccucugccucccaagugccagaauuaaaggugugcaccaccauugccuggccucacacaacucuuacaucacgcuuuccuuuucuuucaccucuccugccuccucuauucuucuucucccucugcuuuuugagacagggccucauuccauagccccugcuggccaagcuaggauggaacucacagagaucugccugcuucugccuccugaguagugcugggguuacaagcaugugcuaccaacccuggccucucucccuccccugacacagggucucccuguguagcuguggcuguccuggaacucucuauguaggcccagcuggccuuaaacccagagagaucgccugccucugccuugucaucuuugucagaagcagucucuagcaucuuuaagaccugucucaguuucuucuguugcugugauacaauauucugacaaaacaacugaggaagagagggcuuauucuccaguuccaggggacgguaccacggcagggagagccgggcagccagagcuuguagccgcugucacauccugucugugaucagaguagaguagugaacgcaaugaaugcaggcuaguguuccgcucaguuucucuccauuuacguaguaccggaucuguucagggauuaauucucccacaucaauuaacaauugagauauuucccagaggcccaucucuaaccgauucuaaauucuguuaaguuggcaauuaacacuaacuguuacaaaaccaaccuggauagcaugccuucuuuccacauccugacuuuauuauuguuuuugcuguuuuuuucagacaggguuucucuguguaguucugacuguccuggaacucaauguggagaccagguuggccucaaacucacagagguccaccugccucugccucuaccuucaaagugcugccauuaaagaagacaugugcugccacugcauucgugcacgcacacacauacacacacauauacacacaucaguacuugacaaaauacaguacguguuuuaaggacugcauacaguaugcuccuauguauuuuucuugauugguccuacagcuggggagagagcuggggaaacaaaggauaugcucucuuggcucggaauaagaacaacgccugcggcauuaccaacauggccagcuuccccaagaugugauuccagccagccagcccaucucuucucagauuccuuccuucauggugcaagauauugguggcuuuggaagggagugggcauggcgcuccugagagggacgcagcgaugcuaacuaagauuguuucauuucuccucucguuggugcuuccagugacaacucuacuucccuucucucugcccagggcccuuuucuuuguggacacaacagggcauuuuucugagaguuguggacucugugcugguagacauuggaguccuccagcaggcuggaggacuaaggugaccuucccgagccccugucuucuguauacaccagugaacauuucagucuuccacugagaugcacaaaucuauucgugauucuuugacaaauuuacaugauauuaaaaaaaguguuuuuccuucuuuguauuugaaauaaaguaucucauuuacaauuuaauaaagaacacugcguccauacuau

SEQ ID NO: 1571 - RNA, 29621 nt, Mus musculus
cuuccucauuguggaugcuucaugugacaagcuccgauuucuuuuuagagucauuucaagcagccuccugcugccagggacaucuuuggagugagcaccacacuucaggaugaccaugagggcuccuggccacgcugccauguauguacugucugcuucuuuuguuuucuucauauauggccuuaaacaugcucuaucuuuucaucagucaggccgcugggauuuuaaaucuuugcuuucaggaaguaagcugaaaacaaaaaucaugccgcccauucgccucuuguuuuucugauuagggagagucuguuugagagauucuuguuggcuuaacugugugauaacuguguuguauguggaugcggugagauuuaaaccugggcuccugugaagcaugagcugaaggcucacaccauuuaaaaaauucaguuucagccgaggaguggcgcuucaccccuuuaaucccagcacuccgaaggcagaggcaggcagaucucugaguuugaggccagcuacagccagggauacacagagaaacacuaucucaaaaaacuaaaauaauaauaacaacaacaaaaacaauaauaauaaauccaguuucaggcaacuacugaauuucuguuaaauauaggaacggagcgggcaucagcuguguuuuuuagaggcugggccucaccucuuaaauuuggcggccuuagaacucgauaugaagaccaggcuggccucaaacuuacagugcuccuccugccucaccucugccuccugagugcugggaucacaagcgugggccaccacaccuggugagaagccuguuugggguaucuccucugaaacagauauuugauuuguuggggagaaaugugaaaaaggaaaauaacccaaggguguacaaaucuaagagcuggguuguccuuuagcuucucugaaggcgagcacgguuauuugagagagaagguugagcugcuugguuguuuguauuacuuugguguucacgcucaggccaagggucucacccauacuagacgagugucagacguggcgcugcauccccagccuucucuguguugccuggacaggccuggaacucccuguugacaguccuccugcguuggcuucugaagaugggacuauagguauccaccauuguaccuggcuuaguuuugaaauuaaauuuuaaccaauuuaagagaggagaguaacuauacauauuaaugaggugcuauguaguguugccauacaccccccaccccacccacccacacacuauguuguggugauuuaauuuuuuuauuauuuuugguuuuucgagacaggguuucucugugcaguccuggcuguccuggcgcucacucuguagaccaggcuggccucaaacucagaaauccaccugccucugccucccaagugaugggauuucagggaugugccaccacugcccggccagugauuuaaauauugaaauggccacuuaagauagacacauguccucauuagaaggguuucuuuaagaaaggaggaaggggggcuggaaagaugucucaacaguuaauagcacuguuugcucuuccagaaguccugaauucaauccccaaugacuacguaguggcucacaaccaucuauaaugugaucugaugcucucuucugucaugcaggugugcauacagauagagcacucauauacauaaaauaaaaauaaguaaguaaauaaauaaauaagaaagaaggaaaagggaaggagaagucuccuuaaguagauucgugagaaaauccuggagaguccugauuuuaacuuuguaacuauguuuguuuggaaauuuucuuuuauuuuuuuaaguuuuaugugcauggguguuuugccagugugugugugugugugugugugugugugugugugugugcaccaaauacaugcagugcccauggaaacuaggagagagaguaacaacuuucucuggaaccaaagccacagaaaguugguggcugcaguaugaggucugagacuccaacccagguccucuggaagagcagccucuuaaccacugagccaucucuccagccccacuuggaaauuuucuggaaauuauuauuauuauuauuauuauuauuauuauuauuauuauuauuauuauuauuauuauuucagauagcaucugucuacauagcccuagcuguuguccuggaacucacuauguagaccaggcuagcccgugaacucucagagauccaccugccuccugaguucugggauuaaaagcauaugcuauugcccagcugaagagcccuucuuaaaguauuaaaaguacuacuauaguauuuuagacaugauucccucuucauccuggacauuccaggaaguuaccuguaucacuaacuuacagggcucuguuccuuucuuuugagaagacuuuugaggacccauggcaacauccaugguaguagugcacaccuguaccuguaaucucagcauuugggauuuggagucaggcagauugcuacaaguucaaggguagccugggcuguguggugagguccagaacagccugggcuacagagcgacauaucuuuauaaauacaaacaaacaaaagagaacuauggaucaaaauacacacagauaaugguuaugcuucuucuguguccuuccuuuaagcagaagauggcuguuuuggaugccccuggugugcucuguggcaauggagcaacugcagagagacccuacccuggacuaccauugggaucucuggaagaaaacccaugagaaagaauacaaggauaagguagaugauugccacccgagcagugugcuuuugcucagcgcccuguuuuccccauccccagaugacauuugaaaaagugguauuuucuagauguauuguguacuuauuucuggccagauauugcuuugaguagaaacaaggcacauucuuguugcuauggagcucauguuaccgugacaguguuacagugcugauggugauggacaaugagaacagauaaagcaagacaugggugauguggugaccuggaagacaguggugaugcauccuaccaaggaugcggugggagggcgaaggaaaggccagcaaauaaggcaacauuagagccgaggacugauagaaagggcaauaaacaaaauggguggaagggagggaccguccugggccaagaaacacauucaggacugaggaaagaccacauuaggcacauuugaggaacagaaacccuuggcuguggaagaggcauaguggguaaaguacuggccauagauacgaggaacugagcucaggccucugacgcccauguggguacaguagcaugucuuccuaacuuaagguggagaaaccaugugagccauccagccuggcacaugcagggccagagauugcauuucaaaguguggaagggaguuccaccuaaacacugcucacaucaguauucacacuaauucacauacacacacgagcacacacaugcacaccagagagagaaauaaaaauagacauuuaaaaaauguuauguggacacagccauugcaguacauugagcuccauagagacagcgccggggcaagugcgagccggacgggcacugggugacucugugccucgcggaggaaaaucaaguaaacaugggcaaaggagauccuaagaagccgagaagcaaaauguccucauaugcauucuuugugcaaacuugccgggaggagcacaagaaaaagcacccggaugcuucugucaacuucucagaguucuccaagaagugcucagagagguggaagaccaugucugcuaaagaaaaggggaaauuugaagacauggcaaaggcugacaaggcucguuaugaaagagaaaugaaaaccuacauccccccaaaggggagaccaaaaagaaguucaaggaccccaaugcacccaagaggccuccuucagccuucuucuuguucuguucugaguaccaccccaaaaucaaaggcgagcauccuggcuuauccauuggugauguugcaaagaaacuaggagagauguggaacaacacugcagcagaugacaagcagcccuaugagaagaaagcugccaagcugaaggagaaguaugagaaggauauugcugccuacagagcuaaaggaaaaccugaugcaucgaaaaaggggguggucaaggcugagagagcaagaaaaagaaggaagaggaagaugaggaggaggaggaagaggaggaagaagaggaggaagaugaagaagaagaagaagaugaugaugaauaaguugguucuagggcaguuuuuuuuuucuugucuauaaagcauuuaaccccccuguacacaacucacuccuuuuaaagaaaaaauuugaaaaaaaaaauguuauguggaugaguguuuuaccuucauguaugucugugugccaugugugcaguaccuucuaaugacagaagagggugucagauccccuggaacuggacugacagcugagcugucaagugggugcugggagucaaaccugaauccucuguaagagcaaccagggcucuuaccuucugagcuauuccuccagcccagucccuucuccccauuuauucauuuuguuauguguauuagugauuugccugcauguacguaggugcacuacaugccuucaggccuccaaccccacaccuggaggucagaagaggccauuagaucccguagacugaaguuaugagugguuguaaacuaccauguggaugcugugaaccaaaccuggguccucugcaagagcaacaagugcucugaaccacugagucaaacucuccagcucccauaaaaaauaaacuuuuauuuuauuuuuaagcaugugucuguacacgcaugugagugugggaccuggaggcuaggcccucaacaguggugcugagcugacugaucugggagcugggaccacacuuguguccucuggcagaagagcaagugcuguaagcaugacccuucucucacuugcauaaguaauauuuauaaaacgcacugcaggcucuggcccacagaagugcuucaagauaggauuuuggcuguuugguuaguugguuggauuuuuuuuccagacagaguuucuuuauaugacagccuuggcuguccuggaacuaucccuguagaccaggcuggccuuaaacucacagagcuccccaccucugccuccugagugcugugacuagaggugugagcaccaugccuggguagguggcuuucuuaguucucuuuucgacuucguucugaggcuuuauuucaaaguaugcuuguugcuugaucuugaaacguuaaccauaacuucaaaccaguagguccuauaacuauacaauauuuuuuuccaaauuaacaaaugaaauugaaauacacaguagcuuaucauuaguccuaaguaccacgguguacagcagacuggccacugcagcucacuccugccugagacucaggcccuucgaucuccaccuuccaaucacucuuccuccagccucugccuaugucuacaaguauggcuuuuguauuuuauuauuuaaucuauuaauuaauuauuaauuaauuggcucuguggauggaaucuuugugcuauacccugggugaauuagauauugguaaaaauaucaaugaaauccuguagcuaaguguccuucuaugccuggguuauucaguguacuacggucagguucaccugucuuguucuguaugacagaaccucucuuuuuaaaaggcucaauggcauuagauuguguauacauaccauacuuucuuugucucuuugucuuauaagacucaucaguugauucuguaucuucaucauugggcauggggcugcaguaaacacaggacagcaggaaucucucccgugucuugauuucguuucauuuagauguauauccagaauggggugggccgcuagaccacaugggagguuugguuuuaggagauuagguuaucuguguuacauuuauuugcuuguuuaugauugugaauucugugugcauguguuugcaugcgugcccauguggagugugugugugucugacuaccacuaaaccaauucuucuuauuuauuuauuuauuuauuuauuuauuuguguauguuguguauaauuuugucuauaucuuguuguguucccaguuggauguagacacacacccuccaaggagcuauuuuggaucccuggaugaaacacacacacacacacacuagcuuauuuuaaaugugcuuuuuagcucaacacugggccuucuaagccuccugcggcuaucgugcccuuaucuucaaucccagcucaacaccuguaaaucugcccucagcuuaguugcucaguuaccuucugugaagcccauugggcacuguuuucccuuucugccgacauauucuccuguagcugugcgucuguccggcuucccucccaccccccaccaauaucuccauucuccucuuccucucuccuccugcauguccugucucuuucuuucugccuagucuuuggcacuggcaucuuuaucgauagagcaaaaaacaauuggggucgaggaccuccagugucgguaacacauaugcccgaucaaagcuucagaaaaacuccccuacgaguauuuauggcauaugucaguguaugugcgugugaguaugcacaggcauauguggguaccagcagaggccagaagagagcauugcauucugugcaucuauaagcaguagccagcacccagugucagcugggaacugaacuggguccauugaaagagcaguaagugcucuuaauuccugagccaucucucaaacccagguucuuuuuuuuuuuuuuccuaaaaaaaaaaaaaaaaaaaaaaaaaacuuugcccgcugagccaugucaccuccuguuuuuaauucuucaaucaauagugagugauucuuuuauaccguuuaaggauccaguuauacuucugcauaugaaucaagacucccacacuguuagagcagggagauuauucuuuccguuucuguguuuuuggcaucuuugcuaaaaaucaacuggccauaaacgccuguuuguuucuggguucuccguuguacacucuugggccuguggugccuuuugagaugaggugcgugauaccuucgcuuuuguuuauauugcucaagauuuguuggaaguuggagguuacguaccuccacauaaaguuucuagauuguucuggguucaugaaaaacucuauuggaauuuugacaggaauuacacuaagucucuaaauuguuuuugaguaguuggucuguuucacugaucuaauucuuccaaucucuggauauaagcaguauaucacucugaauuucuuuugccacaguuuuacaguuuuuagcauauggcugccucugcagacuugcacguucugugucuauggauucaacaagcgauggauugaaaauauucuuuguagcagggcacgguagcacaaaccuguaaucccaaauacucaggagguggggacagaagaaucaggaguucuagauuaugcuuugcuauguagugaguuagugaguuugaggcaaacguagggagcaucagacccugucucaaaaagggggccuggcaauaugggucagcuggugaagacacuugccaccaggccugauggugugagcuagaucaccagaucucaugguggaaagagagaaacaacuccacaggguuguccucugaccuccacccaugugcuauaggcauacacacguguacguacacauacacgcacacgcgcacacacacauguauacaagcacacaccacuaaaugcuaaagauuaaacaaaacaaacacagcuuaccuaaacacaguagauguuaaaaaauugcaucugaguguaucuguguguaucuauggguguacaugaaugcaggcaucugagaaggggaggagagggcauggaauccccuggagccaguguuagagguguguagaguuacaucagccccaucagugcuggcacagaacaugcgucaucugcgagagcagugugugcugcuuuuaaccucugagcucucucucucucuccagccacauagacuggacugguuuuuuucccuuaacaucuacacaacacaauauagcaagcauauuauauuauauaaauagucuaaaaauaaauugaaguauauguguauuuaugcauguagguagguaaauuauauaaaaauacuugaauuuuuguugauuuuuggagacagggcauuacuguauaucuuuugugaauuauuuuauuuuuauuuuaugcauaugaguguuuuuagcauguauggcucuguacaaugugcauguggugcccagagagaccagaagagggcacuggauccccuagaauuggaguuacaaaugguuguggguacugggaauagaaccugguuccucuggaagaucagucagcgcucuuaaccacugagccaucucuccagcccccucaauguguaucuuaagcugguguaauauucacugugaaguccaggaugacugugaacucucagacauccuccugcuucaccuccugagugugagccauuacauucagcuuacagcacuuaaggauuuugagcacucaaggauguuugcauucuugggaaaccuggggucuaauccuucacaguuuccucuugggaagccugggguccaaucccucacaguuuccucacagacaguugcccuuagucuucaguuccuccacagaauuucuuuuuuaaagauuuauuuauuuuauguauaugaguacacugucacugucuucagacacauaccagaagagggcaucagaucccauuaccgaagguugugagccaccaugugguugcuggaaauugaacuuuggaccucuggaagagcagucagugcucuuaaccucugagccaucucuccagcccaaaauuuauuuuuucaaguauuuuuuaugcaugugaguggguccugugaauauaaagcuagguucuccugcuucagcaacaagcauuuagugacugagccaucuccccagcucaugaacacaacuuuuaacaaguauccuaccucuaaauuaacuuauuuuuccuuuccuucaguuuauuuagauuucuuuuuucuuuuacuuuuuuuuuuuuuuuuuuuuugguuuuccgagacaggguuucucuguguagcccuggcuguccuggaacucacucuguagaucaggcuggccucgaacucagaaaucugcuugccucuuccucccaaguacugagauuaaaggugugcacaaccacugcccagcuuagauuuacuuuuucuuaucccacuuucuuccucuagaguuugagauguguucaucgugggcccacucuguccaucacuaggaaaauuacaaaacuugugcacagggagcagggcucuguccagacugaagagggcacauguugcugacuacucacuaggccuuugauccagucugguuuuguugagcuugaaagguuucagcuacuaauggaggcgcugaguauauuguguguauuauauucuguguaaguggaucucugagaggacaagaaaaucaauagucagcaucauaauuaauucuacauaauauuaagauagcagagcccaaaugauugucuucagccaggcaugguagcacacagcuguaauacuagcacuuggcagguagaggcagaggcacaagagagagccauucacaguaaauauaaggccagccucagcuacauggaaccuuucauuaacuaaaaaucaaaaacuaaaacaagagagaaagaaaaagcaaccauaccaguguaaacuaaaauauauuggaauugcucaacaaagucauugaaucaacagugguuuuuuaaaacaaaguuuguaaguauguuugugugccugaauguguugcaucauucgcaugcaggagccugugaaggucagaagagacauuggauccccagggacuagagucacaaacaguuguggugagcuaccguguggggguacugggagcccccuguaagaguagaggucauucuuaaccacugagccacccuccagcccuaaaucaaaucaucuugaaaauagcacugagacauccgcucagaagucaccguacagaaacaaaauggagaagacuguacgcaagcaaaagcuggagacuggggaguccaaguggcccagagcaugugaagaagaagguuagacggaauggugaagaaauaacacaccaaaagaugcugcugggaauuuucaguuguagaacucuucccucaucaucaaaucaaaacgaaggaaaaacauguaaaaaaaaaacccauauccagacacacaugaggaagccgcaagacuuuuaagaaaaaaaaagaaaaagaaaaaucuacaaaagcucgugagcacaguuaagaacagagguaccagauccuggugcaguaaaauagccauauaauccuagcacacaguaggaggcauaggaggguacagacaguugccagcuugagcuacacagcaagucugaggcaaccuggacaaccugggcaagacaagggaucagcagcgggcagcggcggcggcgggggcgguggcggcggcagcagcagcagcaguggcagcggcggcggaggagguuuucgaggugcagucugucauaucagcacucaggugggggaaguggaaggaacgugacuucaagggcagcccgaacuaugugagaaucugucucaaaaucaaaauaaaagucugaaguguuauaguuaaaauucugauuugccguaauggugugcugguuagucuucugucaaauugacacaaacuacagucauuggagagaugggagccucaacugagaaaaugccuccauaagauuagacugcaggcaagcacauagugcauuuucuuaauuagugauugauuggggggaaaggggcuagugcacuguggguggugccaucccuggacuguaguucugggcucuauaagaacaagccacgaggagcaagcaaguaagcaccaccccuccacggccucugcaccagcuccugccuccagguuccugcccuguuugaguuccuguccugacuuucccuucagugauggacagugcucugaaagcucaaaucaauaaacccuuuccuucccagguuguuuggucaugguguuucaucauagaaauagaugcccuaaaagaggacaaaugaguaucagagaaaaauuuaaaacaacaacaacaaccucaaauagccagagaagcagaaauguauagacagaugaguugauuuucaggaaugggaaagaaucuuauggauaucuauacaguuaggugugaggaguaugcaggagccgaguaagggggauugcuaggaguuugaagccagccugagcuacagugugaguuauuaggauagcuaaggcuacauaacaagacuaugucuuugaaagaaagaaggaaagagagaagggaagagagagagagagagagagaaagauaaaagucuagaaagaguagagcuuauugccuauaagggcaugcaucaaacacaagcuucuaacauuuggagaucuaagaaucaaauuuacaacaaagaaaaaagaaaaaaaaagaaggaaauucacuguagauaucauauauuuaauaaguaucuaaaauuaaaaacaauaauuugaauuaaaaugugauuuuagcaguuguuuugcauguauucauuugccuauauguuuuuagacagauccacagucaguaggaugcuauuugggguacuagagaugcucagcaguuaauagcaccuuccgcucuuccagaagacucaggcucaguucccaacacccacuuuggguggcucacaaaccacucucccuagcuccaugugaucugaugccuucuucuagccucugugcucacaugcucacacauacacauaugaggggggcggguauuaagaacaauaaguucacuugcauuccuuuuccuucuguuucagaaugaagaagaaguacggcgucucaucugggaaaagaaucugaaguuuauaaugauucacaaucucgaauauucuaugggaaugcauaccuaccaagugggcaugaacgauaugggagacaugguagguaaaccacaagcaauccuuauuucacguguggguaagugccaggcugcauacguagggcacuauccucugggcucugugaagcuuuggcccagccagagcggccaaagagaugccgcucuccaaggggaauccagagcaaggcagauugcuggaccucguccacagucacuacuguccuggaguuggugucguaagguggauaccagccaagguuggagcaauggagcaggaaguggcugugguaggcucaagcacccaacugguugggccaggucgagguccagagggaagccucaggagaauacgcuucccuggaguguuaccgccugaucccacaggcgcucucaggccaucucuggugaaaugguucaugcgcuuuacuccuuauagauaggaccuuauaaacauuuugaggugggucgaaaggcaaaugcuuucuauuggcuucaucugagaugucagggaugccucauuugcauguagaaugacuuaugguguugucccuacaugacugauugucacaguacucacaauggggugucauggucaggaguagauuuaaacgccuaccauucucaauuaugagaguuuccaggguuccugaaucagcucggccuuaccagguuuucugucugguggcacaguccacugccccacaggcaaguauaauuuuuguuucaucaaaaguaauuugaagguacacugggaugucaaccacaaaaccaaaggaaacugcagcuagggcuggaacauggggcaggggcagaguacacaucucccaugaugcagagccguaggcuugauccuuagcaccaccuccaccuuaacuaagacagguaagugugcucacgugcccacaaagcuagaaagcaauggaugucagggccuaaggaucaguaggcaaauuccuugguuagagaaagaaaggagccggggagauggcucagagcucuggcugcucuuacagagguccugaguucuguucccagcagccacauaguagcucacaacugucuguaacuguaaucccauggaguccuuuggugguaugcagauauaaauacagauaaaacaccgauacacaaaaauaaauauuuuuuuaaaaggaaaggaaaagaaagggaagaugugggucagucugcggccugaaucugcccccuuagccucaugugaugcaagaagggauuuccucaagguauccuuugaccaccaugugugcagugguguaagcgugcccacauguuaaauaaguaaagauagugagaaaauauauuuuuaagauuuaucuauuuauuauauguaaguacaccguagcugucuucagacacaccagaagagggaaucagaucucauuauggaugguuaugagccaccauauaguugcugggauuugaacucaggaccuucggaagaauagucagugcucuuaaccacugagccaucucucuagcccaagaaauucuuauuuaguccuacuuuggccaauuucuuaaaaaaaaacaaaaaaccaaaaccaaaaccauccccucuucccucccccuuucucccccuccccuucccuccccccucucccccuucuccccuccccuccccucucccuggccccccuccccucuccuccuuccucucccccuuucuccuccuuccucucccccuccuccccuccccccuccccuccaccccuccccccucuuuccugucucacauggucucauauacccuggcuggaacaguccauauaacugagaaugaccuuuuucuccuaccuccaccuccagaaugcuggggaucacaggucugcccaucauaucccaccuaccaaauccccucuuuucuggagauuaaauuuauaaaauaguauuguucucaauaaauuuuagaaagcacuuuuuaagucuuuaugguaaguagcuauauuugccuaaguguguauugggaugaggauacggccugccuccuuucuuacuaggagcaagugggaacuuggugccguggacucuucuuuuguguguguucccagaaaggccucugcauacugaauggucucugccaguugcaucuccgcccuccucauugguuuuuggguucuggucuacacaaccaaaaauguauaauacagccaauuaagaaucacaugacugguuaguucauauuguuguuccuccuagggggcuacaaaccccuucagcuccuugaguacuuucucuagcuacuucauuggggacccugugcuucacccaauggauagcugugaacauccacuucgguauuugucaggcacuggcagagccucucagaagagagcuuuaucaggcuccugucagcaagcucuuguuggcauccacaauagugucugguuuuggugguuguuuaugggauggauccccagguugggcagucucuggauggacauuccuucaaccaguaccccugggacuaaaccaccaaucaaagaaaacacaugguaggacucauggcucuagcugcauauguaguagaggauggccuagucagucaucgaugggaggagaggcccuugguccugugaagguuucaugccccaguauaggggaauaccagggcuaggcagcaggaaguggguggguuggugagcagggggagggggaggggauaggggauuuucagaggggaaacuagaaaagcggauaacauuugaaauguaaauaaagaaaauaucuaauaauaaaaaaagaaagaaagaaucacauuacuuuagaaauaaagacaaaauccaggcauggggggaacuggcuaaggcuugcugaguagggguguagaaacagggauauccuggcagcuugcuggcagcccaguguaguucaaacugacacaggagggucuauauacccagguuuacacugcaaacacacacacacacacacacacacacacacacacacacacacacacauauacauacaugcacauacacagaggcaaaaaauaaaaauuauaaggagaaaucaauucuaguggguuuggaaagggaacauccuuggaaaccaacuucuauuuaaaugucaccgugcccuguguaguucugagggaaagcagcuccucuugcuuuacacauugcucuguacagagaaacccugucucaaaaaacaaaaagcagccgggcggugguggcgcacgccuuuaaucccagcacucgggagccagaggcaggcgauuuucugaguucgaggccagucuggucuacagagugaguuccaggacagccagggcuacacagagaaacccugucuccaaaaaccaaaaaacaaagcaaaacaaaacauugcuuuguaagauuaugccuuucuuucaaucaacucuguaacuucuaguuuuuaccauguuucuauuucuucuuccuucuguuuaaacuauguugccaaugaaaaguucaagauuaaagagacauacugagcucaccuaagucagcacccacagucaccucagacagcacccagucaccucagacagcucccacagucaccucagacagcucccacagucaccucagucagcacccagucaccucagucaacacccaggcaccucagacagcucccacagucaccucagucaacacccaggcaccucagacagcucccacagucaccucagucaacacccagucaccucagacagcucccacagacaggucacuucccagucaaguggguacaacuaccacucauuuuucucaguuuuaaaauauauucacauuuauaauucuuagggaggagagagagagagagagagagagagagagagagagagagagagagagagaaaucgauggggcuaaccagcaauauagcucaccggguaaaggugcuugcugccaagccugacaaccugaguucaaucccugugacccagaugauagaaggagcgaacugauuccugcaagauguuccccgacuuccacaugggagccaugguacaccggcugucacaaacacaugcacaagaaagggaggaagggagggaaggagaaagagaggaaggaaggaaugaaggaaggaggggagggagggagggagggagggagggagggagggagggagggagggaggggaggaaagagggagggagggauggauggaaaaugaaaggcucuaagugagaugugcuguuuacuugcuuuuuagaccaaugaagaaaucuugugucggaugggugcucugagaauuccccgacagucuccgaagacugucacuuucaggucauacucuaaucggacauugccugacacuguggacuggagagagaagggcugcgucacugaggugaaauaccaggugagugucaccggcccagccucugcaugcuggcugagugcucucucccugucucguugcacacucuggaagugagucucacugucuuguugucacuuccugccuguuuuguuauucucaucugcccaacuacauccuaagggguuuguuguuauuuguuuuuguuuaguuuuacuuaugauucauuuaggcuuauauacauagcccaggcuggccucaaauucacaauguaaccaaacuaaguucccuccauauuuuggaucuuagcuauauuuuggaucuuagcuucucgucaaauaugaugugauuuguacacuuagccugcaaaauucucucucucucucucucucucucucucucucucucucucucucucucucucucucucucucuccccuccccuguucucucucuuucaagacaggguuucucuguguagccuggaauucacucuguagaccagacuggccagaucuaugaucugucuaccucugacucccaggugcugggauuaaaggcaugagcugcagccaugcuggcugagagcacucgcuguucuuccuccagaaaaccuaaguuugguucccagcacccagaacaaagaacccacaacugccuguaaugccagcuucagagaauccaacgcccucuuuuggccugcacaugcaugcacacauacagauacauaaauacacaauaauaaaacaaagcuuucuuuuuaaagauucuaugauaauaaugucugaaaaauguuuacccuacgguuaaagcuuuuugcaucuggcaucauuuugagacaauaacacuggaguuugugggugcuugucacgagugucagugagcagagacaggaauuaaaucuuuuuaaaacuuuuagauuuauuuuaugcauccauguguuuuggcugugugaauguauguacaugaguacucgcgcgcacgcgagagagagagagagagagaguguguguguguguguguguguguguguguguguguguguguguuugcuagcuuguaccacaugcauggaaugccugcagaggucagaagagggcaucagaaucuuagaacugaaguuacagaagguugugagccaccgaguggauauugggcaucaaaacuugguccucugcaagaacagcaaguacucugagccaucucuccagccacaggaacggaaucuuaauuuaagcuguauuuuauucugagaggugauggcuggagaagacaguggaugaacauucuagaaaucugccuuacaucucaucucuaggcagcaggcuuccuaaggaguggaaaugaaagacaucaaacacugacgagccucugggcaugugaugagucugugauacuugggggauaagccuccuaagcauagcuccucauuaccucucagguagcugguuugccucuuuuccaggccacugagccuugcaguccucauguggugucaccugguacacauagcauugacucugaacagcaaaccauucgcaguguguccuggcugugcuguuugcaaucuguuugcacaggugccuuucuuuaacaugaggugcaaugugcccuuagaacacagccuaggaaagugccucgcucugucccuccugucuggcucaauuggcccugaguuauucugucucucaaaaaucacuuuccggggcuggcaagauggcucagggggucccaugugaggacaggggagaggagagagaaaaggagagugaaggacagguaaccaaaaugaauggauuauauagggaggaagggcaacuggggaagggcagcccagugccugggcugggggaaguuuaggguaggggcaggguaugugagccauacccuguaaugguuagggacugagggaugcugggagaaccuuguggccaggcccgcuuugguauguuaaguagacaccucauggcuguuugagcccuaagcugcuucuggcaucuucccuuuaggggaaggugguugggacuuuguauauguucaaugugcaccauccccaccagggcacauccucgccuggagaaaugucugccuuccaauggucugagagagaaggagcccucaguggggcaggcagcucuuccuggcagagcuggaguugucuucugcccugcggaagccauacugaucccggacggauucuucucuguuuuaggguucuuguggugccugcugggcuuucagugcugugggggcccuugaagggcagcugaagcugaaaacggggaagcugauaucccucagugcucagaaccugguggacugcucaaaugaagaaaaguaugggaauaaaggcuguggaggcggcuacaugaccgaagcuuuccaguacaucauugauaaugggggcauagaggcagacgcuuccuaucccuacaaagccacggugcgucacguucguccccugacuucguuccuccccacugcuacacugccaccaccaaagcacugaccccuucuagagcccuaucagcugcuccuccaugucaagaauucucuuugaaauacagugacccucuuaaucuucccgugggguuuaggguugcuguuguuaguuacagagucucgggcuggucucgaacucacuacguagcuggggagguucugaaguccuguucuuccugccuuaccuuccaaauguugaauuauagaggcuuuugucgccacucccuacacagaaaauauuuucaaacaagcacgugccauucauguuuaaauacaggcuuaaagaaaccuuuucagacccuaaaccucaaugcccagugauauuuccaggugaucuacuaguucauucucccacuuaaaaggcucaauaauguuauccccuuuaccaccagauuucuuauuuucuuuuuaaacaaauuuuguuaaguaacauaagcaaaaaaaaaaaagucacacaagggcugacaagauggcucaguauguaagggcccuuguggucaagcuugacgaccugaguuuaaucaccuaucccagagagacuaccacgucucauaagucauccucugaccuccacacucaugugaguaaaugcaauaaacucacacuuuaaguaauuaucacuggacaacaaccuaccuuaagcaguuuugcuuugguuuauuucuuucagcuucuuuuucuguuaugauuuguaggaggaaacacuguuacauauucaacaaacauccaccuguaacuucuggguuuguuuguuucaucuuuugcuuuugagacacagucacacuauauaacuguagguggccuggaaucacuauguagaucagacugaccuugaacucucagagauucaccugccucugccuucccagugcugucucuugggugcugucucacagcugcagauggcccagggcuuggcuuauaaacccaggccaccuuguccagcuugagucaguguuuacaaacaguaaaacccagaacaaaagaagaaagacagguugggacagagggacagagaaagggacagagggucagaggacagggggcgggggacgucauagucaguugaaaagggugaaguagugggggcugggggugaagggacagggguggggauaucauauuugaaauccgggaaguugaaguagacuuuaugguuggauuuuuuuguaggaugaaaagugucacuauaacucaaaaaaucgagcugccacguguucaagguacauucagcucccguuuggugacgaggaugcccugaaagaagcaguggccacuaaagggccugucucugugggcaucgacgccagccauuccuccuucuucuucuacaaaagcgguaaagaugaggcaucagccucuuauuugcuacccuuaauauaggcugagcaucuggaaccuuguucuaacuggugaauccuacuggucaagacugauuagcaugacugcauuaagcuccuuguauacccagcucuuuucauccacacaguaacuaauuuacacacaaauccuccaugcaaaaguuaaucugccuugagucuggagagcugacucaguggcuaagaacauuugugguuacaaaggauccagguuugauuuccagcucccacauggaggcucaccaccuccucaggcaccaggcaggcuugugauguacauccaggcaaaacacuaccucacauaaaauaauaaagauaaaucuaaaaacaaaauuaaaggggggaaaaaguuaaccugccuaagucacucagccaaagugguggaacaaggguuaaauccaugagauugaaaaccauguuaccagcuacaaaauccacauaggauuauguccugucuauaauccuagcauucuggaggcagagguagaggugggggaggagaugagaaaguugaugccugccuaggcuacucuaucaaaaagccaaaacaaaacaaacaagaaaaaagagucagauauguuuguuuguuuuuuaauccaugaagagugcauuauacaaacuaaaaaucaagaaagcaaucccacuuccaacuauggagagagcuaauaauaaauuuauccagagagcagaaaagugcuuagagagacauaaagugaugcgugcacagaggugaaagcuuuagcuuuauccucuguuuagagagaagagucaaaugucaguaagauucuucacaaaacucggcagacuaauccuaaagagugcacgaaaccauggagacccuccacagccaaagcccuuugaacaaaaugaggaaaagaggcaucacaauaucuaaccugagagugcauuccugagcuacagcagccaaacagcauggcgucagcauuaaaacggaucagcaacacagaauggugacucccuguauaaagaacacagccaggguguguucagaguguggcucagcaguuaagagcacugacugcucuucuagaaguccugaguucaauucccagcaaccacaugauggcucacaaccaucugaacugaacugaacugaacugaacucauagcccucucuggugugucugaagacagugacaguuuacucauauacauaaaauaaauaaauaaauaaaucuugaagagaagaugacagugcaaccaggcguauuggcacauguuuguaauucuagaacuugggagucagaggcaggaggauuauaccucaaguuugaagccagccuggcuguccuuauuagguuaaaacacagaccaaaaacaacuugggaaggaaugugucuuagucaggguuucuauuccugcacaaacaucaugaccaagaagcaaguuggggaggaagggguuuauucggcuuacauuuccauacugcuguucaucacuaaggaagucaggacuggaacucaagcaggucaggaagcaggagcugaugcagaggccauggagggauguucuuuacuggcuugcuugcccuggcuugcucagccugcucucuuauaaaacccaagacuaccagcccagagauggucccacccacaaggggccuuucccccuugaucacuaauugagaaaaugccuuacaguuggaucucauggaggcauuuccucaacugaagcuccuuucucugugauaacuccagcugugucaaguugacacaaaacuagccaguacagaauguuuauuuguugggcaguuuacaguccaucaucaagggaagccaaucaggaacugaggcugagaccauggaacaauguuguuuaccagcuugcuccauuugcuuucuuauuccccacccuaccccaccaccaccaucuacaccacuccuacaucaaucauuaaucaagaaaaugccccgcaggccagucugauggagguaucuucucaauaaucuagcugugucaagucaaccugaagcucaccaggacauugacuguauagugagugaauuccggaccagccagggcuacauagcaagaccaggucucaaacgaucauaaagauagacgauaacucaaugcuggugacacaggaaccauuucacacugauuguaagacuaucaacuaguacagcuuuuaagggaaaugguauagaaauucccccccaaaaaaguaaaagauagaacuaccauuugacccagaaacuccacuaccaggaauauaucccaaagaaauuaaaucaauguacugaaaagacaucucucaaguucacugcagaauaauuuuccacaaccuaagugaccaucaacuucugaguggauaaagaaaagauggcacauauauaacaaggaguacuauuuggauauauauauuuuuuuuaaaauuacaggaauggagguguggcuuggcuaguaaaauguuugccccccagacaggaagccuggguucaguucccagcacacagauauugagcaugguaguauuaaacaugucaucucaacucuugggacguggaggcaggaggaucagaagcucagggucaucuuuggcaacauaucaaguuugggggacauccuaaguggguuaugugagacccuggccugugaggacauaagggagggcaccuaauaguucuuuaagauuaacacuuaaaaccgcacaugcacaccaucauacgaagcucaguaacacagucccccaguacacacuaaaugcagaacucugucuuauauacagcagaaagcuacaauaugcacugagaagcauuuaauuuagaaaaagcucagaguggacaauuuaugaauuuauacaaagaaaugcaaccaguuguacauaaguuaagagaaguggaagacaugguaaagagauaauaauaaauguccgagagaucuaugggucagucccaaacuugucagggaaacugacagaguaucaaugucaaagaauuacaaugucuaagucaccuugucauaucuccaagcauguuuuauuauccugaaacacuugccucuuucccaucuguguuuuauucccaggugucuaugacgaccccuccuguacgggcaaugugaaucaugguguucuugugguuggcuaugggacucuugauggcaaagauuacuggcuugugaaaaacagguaauacauuagcacaugaguguuggcuuuauugucaggacugggaggguaccucagcaaauauacucuugcuguuaggaugcuggucaccauagcagcaaggaugugcauuuguagcuucuuacaaagccccaugggaaauuacucacugccccacuauggcggucuggaugagaauggcccucauagacucauaaauuugaaugcuuagucaccagggagugguacuaauugaggaggauuaaaaugauuaggagauguggcuuuaagguuuucaaaaagccaggccaagaccaggccccuuccccagaccuucccccagccacuugcagaucaggauguagcucucagcuauugcuccagcccuaugcuuacugcugggcuuccugucaugcugaaaauggacugaugggcugaagcuauaagccaguccuuuauaagaguuucugugaccauggugucucuucacagcaauagaacagugacuaagauacccaucuucaucuuuguuuucacgauuugucuucuauaauaacuuucuuauuauuuuauuuuauuucauaucauugauguuuugagauagggucuugcuauuacuccuagcuggcccagaacucacuauguguuccaggcuggccuugaacuuacagccauccuuugucucugccucccaaggguuggaauuacagauguacacugccauuucccucugggcuuuucucaccauuccuugccugcucuguagaacagucaugaugaugaguuucauuugacaguguuagggcugaagcggggggcaugcacauacuccuuaagcucuuccucugacgcacauccgcagcccuuucagccccucguaggaacauuguuccuauagccagacucagaauguugguauucccuacugccccagggacccaaaugguuacuucugacuucaucuacaucauucuagucauaauuuuaccauaaccuguaagauggaagccuucaaaucucuuccacuaccuguagcauuggcccacaacuucaugcuuaccuggucuuagucacuuugacaauuuacuuucuccaaacucaguauggccaaggaauucaguucucucuccaccauacuguucccuccagaauuuuccauaucaguaaaucauaucacauaacaucguuacccaacagauaguauguuauugagggcucaauacacuuacacuauaccaaccuccugaccuucccagggauaauuaaguuacaagucaagcagaauuuccaucaaaagcugucuuggagucugccucauuucuaggucuucuggcucuauuucagacagcucuugccucgaccauuccuugagagccugagaacugaugcucuuuguauuuuauaucuguguaugugaaagugcauggugugugggagguguguaugggguggguguggguauagguauggauucgguaugagcguauauaucuggauuuuggagauugaacccaggccaccaggcuucccggcaagugcuuucacccacugucuuaguuacuucuucucaguugcugugauaaaucaccauaacuaagacaacuuguagaagagaggguucauuuggagcuuaugguccugagggauaagagucuaucaccauugcagcaggaagcugugcacagccuacagcaggcacagcagcaggaacagcugagagcucacaucuugaacugcaugcaaguagcagugggagccaacucaaaauggugcacaucuuuaagcucucaaaaccaguccucaaugacacagcuccuccagcaaggccacgccucccaagccugcccaaacagggcuaucaacuggggaccacacuuauucagaugucagagaauaugggggauaggaauggcuccuucaaaccacuacacuggcuggcccgucuugccagguccauucuuuuuacucuugaaucuuuccuguugcugccuaacaggugugacuaaguagaacaagucuuggcguguaaccauucuagcauacaauagccccucaauaacccacugaacugaccucugcaugauucauaagcaaaaugaguacagcuuuuagagagaaagggggaugaagaggcuagagagugaagagcccuuugugcucuagcaagaccucugcaagcacccucaugugcauaaacuuacacaggcacacacagacaaacaucauuugaaaaauauuuuaaagguuuauuuuauuuuuaauuaugucuauguguguaaauaugugcauaagagugcaggggaccaagguagccagaggugucagauccucuagagcugcauuauaggugguggugagccuccuaacaugggugcuagaacucaaacuuggguccuccggaaggacaguauguaaucuuaaugacugaggugucaaaaugaugaaaguuuuugucuucugguucuugaggcuagaagacagaaaugaacauguugugacuuuagcuacuuuugggggaucaugagaaaaaaacucuuuauagacauggaucugagaaagugacacucacaggaguagaaugguaugguagcggcuagcagguaggacaggaacagaggagaugcuacacaguguucggacugucagcucuaagccaguucucucgcaugacagccacgucuuucuuacugcuucuauuccuuugccuccgaauguguggcacacacauguacuguaugcacuuguauauauaugauacuuucuuguuguuguuguuuguuuugcuuuguuuuaagacaggguuucuccauguagcccuggcuguccuggaacgaacucuguagaccaggcuggccucaaacucagagacccaccugccccugccucccaggauuaaauauaugugccaccacugcuggagugauaauuucuaauuaaacauauuuuaguuuaagaaaagaaaauaaaauaacuacugguuggccaacagccaguuucagagggaucccacaccgucuucgggcugccauaggcacugcacaugcaugaugcacagacacacaugcaggcaaaacauccauacauauaaaauaaaaacaaaucuuuuaaaaaaauguuuuugcaagguggugguguugaacauccguaauuccaauacuauggaggcagagacaaauagaucucuguaagauugaggccagccuaggcuacagagcaagcucuaggacagccaggguuauacagaaaaacugucucaaaaauauaauaauaagggcuggagugauagcucagcaguuaagagcacugacugcucuuccagaaguccugaauucaauucccagcaaccacaugguggcucacaaucaucuguaaugggauccgaugcccucuucugaugugucugaagacagcuacaguguacucacacacuuaaaaauaaauaaauaaaucuuuaaaaaauaauaauaauagauugauggugauaaaaaagagaccaguguggugcaauaauccuggcauuggacaguggaggcaggagggucaggaguucaagaccagccuuugguacauagcaauuucaaggucacauugaaccugggacacaucucacacacacacacaaacacacacacacaaugaaaagaaagagagagagagagaguggggagggaaggggggaggaaggaaggaaggaaggaaggaaggaaggaaggaaggaaggaaggaaggaaggaguugagcaccuccccagauuuugaggcuugcagccgugugauuuccauucuuugacuuguagaaacaggccucucucuugcccucaaaccucgcaaggccucgugugugcagacuucaguccuacuggauuaaggcugaccuaaugacuucaucuuaaucuaauuaaugacaucuacuaauuaauggcaucuacagugccccuacuuccaaauaaagucacauuuucgagguccugugauuagaauuccagugcaaacuuugagcaggucacaguccaacccugaauacucagggcuuccuggaaacacaggcucuguaagucaaggucgauggcugccuucagauucccugugaggagcuaacagauggcagugauguauggucugcugggaaagcagcugaggaaaugucaaauguugauuuacucuuaagccaauguugauuuacucaucacggcagugaucuccuuguuguggacaugugugacauguugccucuuguuguucacugggcuucuuuuuuuauuuguuuaggguuuuuuuuucccccauacacccauuuuuuuggcucccuccuuccuuccuuuuuuuuuuuuuuuuuucucuuuuuuuggccaggcucuuauguagcccaggcuggccucaaguucauuaagccacagaggaacaaaagcuccuguccuccugcuuccggcuggcuccuccugcugccguuaggauuuuaagcgugugaugcugugugcccaguuauauggcuucuugaguacagagacgccagcuaacaugacaagcuggaaaauguuuagucccaggcagcucauuucuacacuaaguagaauauucuacuuuuccauagcuuuaaauaggagaauuaucucaucuggauaauucacaacuguauuauuugucauuugauucagagcuaauugcuguguaacacuuucauaguaguuacucaaaaguacuucuugacagauguuucugcaagccagaugaugguggugcaugccuuuaauacccuggagacauaggaaggcagaucucugaguuugaggccagccuggucugcagaccaagucccuggacagccagagcuacacagagaaacccugaaaucuugucuugaaaaaccaaagaaaaaaaagaaaaaagguguuucucaagaaauauguaugcuggaaagacauaacccuuaagccagacuuuguggcacacaacaccuguacaggguggaaucagaaggauuaagaauuuaaggucagucucagcuauaacuuuaggacagcuuggccuggugguacacgccuuuaaucccagcacucaggaggcagaggcagguggaauucugaguucgaggccauccuggucuacaaagugaguuccaggacagccagggcuacacagagaaaaaccaaaaaaaaaaaaaaaaaagaaaagaaaagaaaaagaaaaaaaguuuaggacuaaccuggguuucacgugacucuugucuaauaaaaaaaauucauuaccuaugacccuauugugcaaaaccauuuagagauggaguguuacaaauaauauacucuuuccuugcagaagacaugccuagaaagcagaaauggaucuuauauuauugaccuuaaauauaaguauguccaacaauauggaacuagugugugugcugggccacaccuguaaucgcaggcuuggaaagucaaagcuggagaacugcugaacuugcagccagacugcgugacauaaagagagcuugucuaaacaaaaugaaaaacaagcaaaaccaaaacaaaaagcuaaaaagaagccuuuaauuccagcacuuagaaaauagaggcagauggaucucugugacccagccugguccacauacaaaguuccaggccagccagggauacauagucagacccuguauaauauauuuauguaaagcuagagacaugguucaguggauaaaagcacuggcuguucuuccagagugccuggguucaauucccagcaccuacaugggaacucacaacuguuuguaacuccaguuucaggggauagacacagacauacauguaggcaaaucaccaaugcagguaaaauaaaauaaauaaauaaauugauugauugauuaaacauauguaaauguaaauguuuuaggggaagcaaagagguaaaauauaguuuuauuauauuauuuuguaauuuugcuguuuuuuucucuuuuuauaguuggggccuuaacuuuggugaucaaggauacauucggauggcaagaaauaauaaaaaucacugcggaauugcuaguuauugcucuuacccagaaaucuaaaccauuucuucuuuuucuaacaagucacaaagauggaauauacucuaacuuaauuugccugcaauauccagaggaaccaagugugucgugaucaauguguaguuacuguacuaacuagguuauagcuauuuuuacacccuguugucuaguguuuucuaauaaccauuuguaacaugauagccccaaagugcuuaauaaaaucugucauuucaaauaucua

SEQ ID NO: 1572 - RNA, 621 nt, Mus musculus
accuguucugauuguugugagcuuuuuuuuuuuuuuucuuuaaaguuuauucaauacaacauaaacuccaacuucacugagguggcugaccacguccacgaccaaagccgccucuaaacuggaacucaguggccgagccagccccagccucaguuuucuugucagcuccagggggcacagcgcuccuucuguaggugucucugucagccuccccucuugugaaucuugcaggucgcucacccucuggaccuuugggccgaggccugccggucucgggacggcugcggcgcaggguggcgggcacgaucuccggggguaggugcagguagucucggggacacuggaugcccucguucguaagguaccaguagaaaugucuccaagcaaacuguuccuucacguagccucgagacuugagagacugcauggccuucauuacaugaagguugggcacauuuuugucugccagcucggggugcuuaggcauguggacauccuuuuuggcgaccaucacgcccuccuuaaaaaggaguucguagauggcaauccgauucuucuuaggcaucaacaucgcggcggcugcaggguccgaggcggaggcuggaaaaagugucgugagcu

SEQ ID NO: 1573 - RNA, 7143 nt, Mus musculus
cuaguuuugguuuuuuccguggguauuuuuuguuguuuuauuuuaaauacugaaaaaaauuccccagggcucuguggggcuccccauucacugcccuucuccacacagcaaaccuauuucaaggacagcauuuuuuuaaaaggaacaguuuauccuaaauccucaacuuguucugcagaaccagagagaccucgucugcuuuaaagaacacaauuccuuuucucugacacuagaucacuagccauauucaaagagugcuucucucuucagagcugaaccugaaccccuuaccaucccucaccuuacagucaaccacagcaacccagagguucaggagaacgguaggaaacuucuuuuuuaucagucauaaacccucacucacucccccacaucuucacuccauccuuucaaccccacccuugggaucucaaugaguuuucuuccaacaguuauuuggaaaaaaagguaaaacaaaacaaaaaaaaguucaaggucuuggugcucagcccaaggggcuccauguguugggacaccagugggcagguucucugccucucuagccugcacccgggccaccuccugaccccuggcuacaaaagcagggaggggcaggagccagcacaggacccgagugggcagcgucucacgaucugguggagccccaggaagcaucacucaacuuggccacuguggacgaacaaggaagaaacaaaaaacaaacaaacaaaaaaaaaaccagucaaguaaaaggggaaagcucguaaauuccaucccagucuugaccccaugguuucuccaaauacuucacuaaacuaccuuguauaugccugaauauuaaguaaaaggaggagggaaaauaaaaagaaaguuuuagucuuucccuauccauaaucagaacguuuucucccuuuucaauauacucaugguaaacaggaagacaauucuugagacaucaaauaaccggagguuuccuagugaaggcucacaggagccacacagugcacagccacuggcagcggugaagaggaaccucagcacugaggugcugacuggcagaggccagggucaaaccacauacuuguuuggaguggacuaaguagccuggauuuaaucaaaugcacuuagauuuuuaaaugaugcuuccaugcuaagaagcaagccugagaagugcagcuuguuccuuggcauccaagagugacacuauuugauucugauuuccuuuccccuuucucaucccuaucuccagcucauuguguguauguguacacacuaacuacuauguguauuacuggagguugaaacuagggucuucugaauguuaggaaaguauucuacauacgaacuacauuccuagcccuaucuuugcuuuuuauuuugagacagggucucacuaaauucccaaggccagcugugaacucacucuguagcccaggcuaccagccugccucaguuuguugaacagcugggaugacaagccagcuugauuucccuauuucuccuguccuuuucuaaaaaccagacucauugugaacauaucagcucuggagacacaaaucuaaccaauagauaaggcagcucagacaggggagaaaaagguacagaauucgagaagaucggagaugaagaaaacguacaaaauuauauauauauuuauauauauaauaacaugacauaucuauguaaacaugguugggacauugaagaaacuauacagugauguucaguuuguccccuucccacauggacuucucauuaaggaugacagcaugagaaaauggagcaaaaaacacaaaauuauauacauuacaaaugagagucaaagaguuugggggccagggagaccagggguccugcucucuccauuccuuccucaccaaucuauuucuacccaaucugaaugauggccagagaccugggcaguggccaaucaggagaagggcauauuuacauguccuuccccuaacacacacauccacaaacucgccagacauccuaagggcacagugcaaucuggaaaggggagagagacugcaccaucuugcucuuuugagcaguucucacucuggcccucucugucgaugacgagcagguggcauuuaguaagauccaggccaaacuagugaugacacagcaagacaggcugcugccucccucccugcacccucuuuccauccuccaccagugaaucaucugcuaaggagcagcugcuccagcuggcaguagcucuaagcucuggggaccagcucccuucaucccuucuuccuccaugccuaacauacaucugaagcaagaugccacgucaaugagccugucuccucaggccuauccagucugcugccagagcagcuuuguagcagcuagggucaacagcagacccaggaaaaugggcagagucaagacacauccagggacagccuuuucagguuuguucucuuucucucucaaaaaggcuaugauaccuaugagacuguuguuggaagcuauggcccuuaaaucucaaacucucucucgucccauguagcacuucuggcucuacagagcugagguucagccaugggccugccucaauuuugguuuuaugaugaccagaaggguauggcagguguaggacuuuagagucagaguuagccuacacacgcguuuccgucuguuuacagacgaggaacaggaucaauucagagaggcuacagaccuggccaagcucacacaucagugcuguugagcuugacaaaaacuacagcccaaguauuucaacuccuaaacucuuuccauuaucccauaauacuuucaaaaagcaacaugcuggaagagaaaagauaccauuuucuuuuucauaaguagcuaacgucuguuaaacuuuacacuccuugagaagcagggcagcuguuggaggaacacagcagagggguuaggugggcccuguaauuuuaagcaagcagaaaucuccucucuuuugaagguccccuaaacacccacgaugggaacacagagcacagaggccuaagggacagcacacuuagaagcacagagagcaucuccuucacucuaccuuucucagcaugucaauucagccuugggacacugaaccugucacacugcuccacgauagcccgucuaaggacuugcuccuccaacaggagaacuugcaucuuccacauucucaccacaggaaaagcugcagcacucugcacuccuagucuuuccuacucuugggucucuacugggcuaucaugaggguguacaaguuucaauuuacccaaagaaaugaacucagagcccaucuucaaccuaagcccccagcagaaugucuccccuggauggcaagcugagcucugacuaggugcccauucccugccuacaauauauaacaguccagugggugaggaaggggaagagaggggcccagguuaccccgcaagcuugcuggugacgagcgaggacuuucucuggggcagguccugugggguggggauguggucaccggucaccagguucuugucugcuccugcacuuggcagcugcuuguucuucaucuuggcuuuggccauguuguagucuccugagucaaaguacuuuugcuaagagacaggagcgagguuuagaugaaugugcaaccuugguguucuccaaaagcagagacucacugucuaccgucagcauaagcucccaccuaccucagcugucuaaguauuccccaugcacacaguccacauuacucacuuguaaguucauuucccagcaugcucugaccuugucagaauauaagcagauuacuagcagaaacauguaccuuuguugcauaaggggcagcugugucccugaaccuaggugacaacuccuguaucuuuuguaccuuacugaguacuagaagguucaauuacaaucacuuacuucauucguaacagcuaggugccaaagcaauaccuuggugcuggggaaaagcaugaauaagacucaagaagaaucaaucugggucuaccagcagcuagagaccaaccagaaaccgacuaucagaguuagaaaauauucucagagcaggauuaggcacugggcuugcucgugaggcagugagcuuuccagacucccaccacucccacacauguuccauggugagacugucugccuacgccuggcucgccucaagaggagcugcaauucaacaucacacugucaucugugacuaagacugagcaccugggauucuccacaggaggcugcuucucucuccaucucaucuuuacacugcagcuuuguccuuauaaucugcugucagcucaugguagggagaaaccugaccacgaaggagauggcugugaaggcagcccuccacugcuaaggaaggccauuccagcugcuguuucuucacuuuuguggccuuauagguuaaacccaggcuagacaagugcuuucccaugagcuacauccucuaucauucuguacaggaaaaagaauugucucuguguuacuuuuuuuuuuuggagacagguuucaaaaaacccuggaacucacuaugcagaccaggcuggccuuaaucucaagagauauaccugcuucugccuccugaguacugggauuaaaggcaugcgccaccacugcccggcggcaugcacuuuuuuaauuuuuaaagauaauuacaaaaucuuuuaaaagaauuauguuuguauauguguccauggaagccagacaaccuccuggagcuggagucccagcugccugauauggguacugggaaccaaauauugccuuucuggacacagcagcccagcucucucaacuucugauccgucucucaagccuagccuuggcuauucuaaaacuuacuauguagccuaagcuguucuugcaugugugguuauccuccugcuucagcucaggcgcugagaucacagaugcuagccagcacacucagcuacaauagucucuugaggagcaugguuaguguguaaugccagcuuuuaacagacuaaagaaccuuauugcaaguugaacuauuuggguguucuguaucuaauauccuuccuucaguccccaucugccaccuacccaaaugcccaccauuaauccuucauuuccuauaguuagaagggaaguaacaucauugcagagauucacauaauuugcuuuucucuuuccaaguuucuaauuuaucuuuacuacugcuaaauaaccaaagcuacagaaaaacaugcaguagaaugucuacggacuucauccaaggugccacaguauaagggugucccauaccccuuucuggagucucuucaugaggaagucggagccuccaggcuuuuguccuaggcuuggauauuuggccuuuagcuuugccuccucagcuuucucagggagaaucccuucuuucuccuguguauccugaagaaaacacgccaagugaaauuaauggcugaaaaacaaugacuucuaauaucugauaaccuuuguauuaucaaauuuucuuagaggucuaccuguuuguaauuaugcuaucuacacucuguucuguugaguguguguauuauuuaaggauuuauuuauuuuaugugcauguauucugcagacucguauggcuauggcuguguaccacauggaugcccagugcccugaguucagucugggcccgguuuccuagacugaacuguacaugguugugagcuaccaugggcugggaacuaaacccaggugcucugcaaugaguguuccuaaccaaucuuuccugcuccucuacucuuaaaagcuagaccuuuguucaaaugccuaagcucaagauaacuguaucaagcaaagaaaaacaaguuaguucuuauauuacacucaaggaaucacccgugaccugugaacacuagguuaaagguaguaucucaacaugauacuugaaccauagagcaagccagagcucacucaggaaagauaaaaaaggaacuacuagaguuccuggcuguccuacaggucaggggagcuuuugucugcugagaggcucccuccucauucacacucuaagaagcaauauggucucacuguggaggacgcuaggcauguggcuuauucuaaagauauuuaccagaguaauauacuugaaaacagaaaucaacaugccauuaguuuuucuuguuguuuuuauuuuuauauuuucugagagagggguucuugguguauauuagguuggucuugaacucagaacucaagagaucugccugccucugccuuccaagugcugggauuaaaggcgugcgccaccaucuccuggcuaguguauuuucacuugacaaacagggucagagauaacacuaaguguauuuaaugagucccugagcucaguguuaaguaacucaaauauggugucgaagaagggguuuggcacuaguguuuucauaaugcgaugguggguggaccacaucccacugcggagaaauucgagcggaucuauaagucacugacggugaacaacaaaccaucccuaccaaacaggucuaaggaaguugccaccugaacuuaccccaugguaauaauuacucuuuuccccucccccaaugcugguucauuuuaaaugucuucacuuugaccucuaucuugcuguggaugaaggaugagcuccagucugguauuuaucuuuacuaaucaaacaucucauuuacagcucuggaccaccauccagcccccuuucauucgccucaucuuuccaaacacccgcccacgccagagcucgcccaauuauagaacggcuuccaugaacugaauagaggccuacuggccaauaagaaaggggagcccacagauugacaaucggcuugacuaaucgacaucagggcacuaggccgcgccgaaaugcagccugcgcgacauuaguaguggccaaccccuguacagccugaggcagaggcggccaaucagcggcagcgggggcguauuccgcccgcgcggccacccccgguccccccuucuccucaccugcuucuccucgccggucuccuccgcaggguuuucuucuucuuguuucugggacauggcagaaccgggacuguguaaugcagggcccgggaagucagccggaaaagggaagggggaggggaaacggggacaaccugagcugcugcuccggcuccugucacuaugguugcucagucaaaauggcggcucaagcccgugacg

SEQ ID NO: 1574 - RNA, 2341 nt, Mus musculus
agcucacuagugaacacucgccuaauacaccagcccccuaggucugaccccucaaguguauauacacagauuucuauuuuuauaugauacuccucaaaacucuagaaaaaugccaaaauagugauaguuucuuugaaaggucuacauacaggcuaguauggugacauacauucguaaucccagccugaucuacaguugaguuucagccagccaggacuacacagagaaauccugucucaaaaaccagaaggaaagaauuguuuuaagauacagaauuugggaaaagauggaaacgaaaaauaaaaauaaaaaacuuauauuucuguucugaauugcuggguaacugauaauaccauaacccaaagaaaauaaaacugggagaggagagggugugguagaagaggguguggcaggguaggaggcacugcuuuuguggauuuaaggcauacugguaagggcuggagagauggcucagcgguuaagagcacucacugacugcucuuccaagagguccugaguucaauucccagcaaccacauggugggucacagccaucuguagugggaucugaugcccucuucuggugggucuggagacagcuacuuauauaaauaaauaaauccuuuaaaaaaaaaagacauacugguaaaacuauacaguggaaaugggaagaggggacuggagcccauaucaaaucaagaaaagaacucaacaaauugggagagucugggcuaggaagaaggcucagcagcaguaaagcucagccccuggagucaccaggcugugguggcugugacaccuuuaaucccacacccaaccuuuacuccugcacucaggaggcagaggcagaggcaggcggaucucugaguuugaggccagcuggugaguuccaaguuccaggauagucaaugcuacacagacaaccccugucuccaaaaacaacaagagcccaaauuugaugaccgggaucugugaucccagguagagguagcagcauucauuggaaacuuucauaucuagaaauagagaaauccugccacagaaacaagauggaaggcaagaaccuccaacagagguuguccucugaccuauacaugcacaccauggcaugcaagggcgcgcgcgcacacacacacacacacacacacacacacacacacacacacacacacacagaggagagucugagcuaguguaccacaggaaguguagcccaguggguagaauguuugccugccguacaugaaacccugcauucaaucacuagcacugaauaaaaccagcgguggugcagaagugcaugccuguagaucagaaaugcaaggccaucugcugcgggcucacagaguaaguuugaggucaggcugagacaugggagauucugucuaaaagaagaggagccgggcggugguggugcaugccuuuaauuccagcacucgggaggcagaggcgagcggauuucugaguucgaggccagccuggucuacagagugaguuccagggauacacagagaaacccugucucgaaaaacuaaaaaaaaaaaaaaaagaggaggagaggaagagacuggaggagagaaagaagagcuggagccacuguggugacacacaccuuuaauucuggcacucagggaguucugggccaccaaagaccugcaucaaaacuaaaggguuagagagagauggcucaguccuuaaaggcuaggcucacaaucaaaaggagagagagagagagagagagagagagagagagagagagagagagagagagagaaccgagagggaggaaugugcaaaaaagcaggaugccuccguuguaaaggagcuuugcugcugucccugaugacccuugaguuugauccccaaaaacccucaaaguagaagacagaagggaaaaucauuuaggugagaguccauguaaguguccucugacuuuccauacaugugccauggcuugggcacacauaacaugacuaaaugaaguguuuucguguauauggauuggucuuugggugugucuguucacuauguguacaccuggcacccuuggaggccagaaaaggauguuggauaccuuggaacugaaguugcaaaugacugugagcccaucauguggaggcaagaaucaaaccuggauucucugaagaacaaccgcugcuuuuaaccagagucaccucucuaguugauuuuuuuaaauuuaaaacuacagggcacaaaaauguucucacaucuuggacaacugcuaucaugguuauaacuuguauaauuuucaagacuuugacaauggguauguacuaauaggugauuuuaauucugaaaauaaaauaaagugucuuuaaga

SEQ ID NO: 1575 - RNA, 11919 nt, Mus musculus
uggccaguaagccaucugcagaucuguagugggacagaaucuuaggcccuugauccagacugccccagguuugaagcucacuccacagcccaugaggaccacaucuuccucccaucccuaaaugccgcuccucuucccacaccacaucuggccucacauugcucggauggugggguccccaugaacauaacgaagagcauguuuaugucaaaaccaacuuuaauaaaaaauaaauuacuucuggggugggcaucauuuucagugugaaguggcgacuggggcuaggaugucuuaugcugacguuucucuuuuucacccucgacacaaguggucccugcccuggagaggugugguccuuccccaguaagguaggguagcaguggcugaucccugccccugcuaaugagggagguaggaauacagagacuagauaaggcagggaugggaacaacaggguaauuuagaagauguggagacgaggauuggggcacagaccuggaacuucugggggacacacacuauguagcucagauuaguguggaaauauaaccuugcucucucccccuuucuccccagcccagaaaagcaugagggauacaggcaccgcccacuuccuauucuuucucaagcugcuuuuguggaagugauaaacauacacaggacagacccccaggcaggucagguacacuucuugagcuaucacacuguaggucucucacccuggaggaucccucuggcaaggcugagaccaggugaaaagccagaggguacagagcgggcuagucaguggguggcacaagaaaaccacgaaggcagggucucugggacccguuucaagccgguuccagcugggacugcuccaggacaugggcacaagagcggcagcagguaguuguguaguagggguagacgcagagccgggccuguaccaccagggggcaguguggagagcuguccuugcauuggucaucugaggacagaggucaauggcacaagacuggacugacaucauccccucugggagcgugguacccaaucccaccagcucuucucauaucugcccauaguccaacuccauccccucuacuggggugggugggacgcucuuuaccuggucgcugguugcaggguuggcuguugcagggccgcuuccuggaaggucucaggugaggagggcaucgggagcugagagucugguugccacucaggcacuggacuucccucgucugcaugccucccuggcaggaucgagaacacuggggagaccacagccaucugaucagaugucuaacguucucagggcugcuccccaggccacccacuuccucucugagagacugugguagaacauucuccaggaacauuauaagaccccaaauggagagggucccccaguccugcaagucuuugggaagugggacaacacaaaaggucgacuggguuguccugggccgagagaggcuuggcugagugcaggccucuuuguuagaggcccaaggagagcaaggcacgggugccaggcacucaccggacuccagagaguggagaaccauuuguccucacaggccugccccugacagggcugcagggcaggcggccuggguaggugggaacaguugcugggagaagucacauugaacucggcccccagcuuggacacacagauaaugucucuguguugugugccagacccacacuccgaggaacacuguaagggaggggaagagagaucacucuuaaguuuaaaauguggggcuucgccaggacugguuucccuucggucccgcaucucagggcccccagcugaccucacuccaggggccugugaaccagcgccauguccucucacagggcccuaaacugcaggcacgcauaucgggagggcggcuucugagagggcagcccugcucagugcuuccugcuuccgggucucccugaagggucuccccacuccuaaggcagaccacagcgcgucucuggauuccugucccgcacucggcugagcacuguugggagggagagugaccuauguguugggaggugaggaagcccuggggauaccagccugggagaggagauagacagcuggguucuagucuguucuugaacuugguguaaagcugagauacuuaaauuucugacccucuugcuucuaccucuugggugcugggguuaagagugugugucauacaccugguuuaugugacacuggggagcaaaagucgggccucaugcaugccagcuuugcaaacaccgccaacugagcuacaccauaucuuaccuauuuauuuauuuauuugugugaaaccuauuguuucuguauguacaauucuuuuaaagacagggucucucuauguagcucuagucauccuggagcuggcuguguggaccagucuggccucagacucagagagauucuccuguuucugccuccguaguagugaaauuaaaggugugugcuugcgaguccagcuugugugugagugcaggggcccaagggcugguucucuuuuuccaccaugggauccagagccucacucagauugccgggccuaccacacaaggaguuucaccuacugagccaucuggccaguccccugcugcguuuuacuuugcuguuuuguguguaugugucuguguauaccacauaugcucacagaggccagaagaggauaccagaucuccuggaacuggaguuagcagugauuguaagccacuugauguggguacugagaacugaaugcagguccucuaggaaaacagaaaugcccauaacuacugagcuaucucuccagcacauuuuuucuuuauucuuuuuugucugguugguugguugguugguugguuggauuuuuguugcccaugguuuuuugaggcaggguagcccuggcuagccuagaauucaaacucacagagaguucuccugccuuaucugggaugaaaaguacugccguauccagcuugcaucuguuuguuuguuuguuuguuuguuuguuuguuuuaaaaagacagauugagccgggcggugguggcacaugccuuuaaucccagcacuuggaaggcagaggcaggcggauuucugaguucgaggccggccuggucuacaaagugacuuccaggacagccagggcuauagagagaaacccugucucgaaaaacaaacaaacaaacaaacaaacaaacaaaaagacagauugagggggggaaggggugguagcacacaccuuuagucccagcacuugcuagccagagggagguauaucucugugaguuugaggcuagccuggucuacagagcuagucuaggacagccagguuacacaaagaaauccugucucgaaaaaaacaaaacagaacaaaaaaguucuauugcugccauaugaccuggaacucacuauguagcccaggcuggcccagccucccaaguacuaaaaugaugggugugaauguaaguuuuucccacuuaacucugaauuccuaggcuaagucaaaaacaaaguuuaucaaggcuguguugaacagggugugacaacauggccugggguacagucaccagggaaggcagauuugccagaaguauaggacccaccuuggaacuccagucacuguagaaccaggcuguggugcaggggcccaugucacaggccucucugcuggggggcggcgggggcccugaagcacacuccugcuuguccaccucaucaccauuacugccaacacaccgaacuugccggcuccucugaccacgaccacagcgcacagagcacugaaggaugagagacccgaggcugggcgucagccaucuuccagccuugcuucuacagaacuaggguuucacagacugggggagcugagcaagggccuccaggcugccaauccuguugugucugucugauacuagguuccauagaggucuuguuuggaaaguuucugaugacaaagaagaaaagguggaaauucuuuggagccuacuucucaaggguccuccucaccuggcuccagggggagcuaaucucccaguggccacagaggugcagcugacaaggcugggugauguugggccgggggagauguccacagcgcucuggagguaccgaggagccaccaccuccgaauuccugucugcagaguagcuggcggugcugggugccagggccacaggaucggcugcaggauguccacucgccagccucccagcugugggugagggagagggaacgauggguggaaaugugggggggggggugacagacugggacccgaauaggagaggagucauuucacacuuggcaucugcauuucuagccuggaaggaggcugccaggguuuccuuacugucuacggggugugaaccuuucuaaucuaaucuuccugcauccaggugcuguaagaacccgagggcagggagcaaggacagggccagcccucccugugggccguacucacuauggaggacacggggguccauggcaggguucaggggaagcugggggucuggcccccacagcacagcucuguucauccaacuccucuccugacucacgggaaaugcagaggaaaauggggugccaaacaccugaagggaauaagagggcagccaggggaggcaggaaggcucagagccccguuucaaugaaaucccagacauaggguccaauguagacccgugguccaggauacagaaucuguauagauauauauagagaacagggauuugggcugagguguccuccuucaccuuugccacaggaugcugaacacucagagugccccacuuguuuccaguauccagcagaagaccccauggcuguccugacacgagucggaggaggcacuuggggaauccgcaccugacguuggagggugccuggugcccggacugggcggggggcugaggggaguaggggcuccccccucagcaucucugcagggaaauccagggaccagauuagaugccucccugcuacccuggagcucagucccugccucacccuccucuccugggucuggggauccuaguuuuaccaggcugaggcugaagggcuggaggcuuuguggaaggacucucuaggacugcaggaggggaagagaugacauacugauaaaaaacaccuggguuguccucuugaaagaucaucugaggagggaagaucacaauggcuuggaguaacaagaggggcauacgcuaggcuagauccacacugcucugcccuaagggcccucccucccucccuaacgaucuagcaccugccccagcucacauagacguccacaggcugagugguagggccuucugcugacagacucucccccuugccuucuucccguggaggacgguuauacuggaagacagucccaauggcuguauaggacccuggaggauccacagcccaguucccauugauaauggagcggcccccaggcccucggagugcugaaagacagaugucugagcugagugauagugguacucucuucugaagccuuugugcccagagaccucgaccauccacccuccucacccuccauccgguuuaugagaaggcuccagccucuuccuguuuugccuuucguucggcugaagaggguguguaguaggcagaucaaagaaaaaggauagacuggggcauaggaccgagguccucuuucuuaccgagguaauuggaacugggucgcaacugggaaaugugaaggugggaggccccggcagggauccacaggaucuucugauagcccaaggggcccccucggucagugagauuucccgaaaccaggcggcagguagaaccaucacccccgcagacuccgcagccauccggacgccugccagagccaaggaccccaucacagccagggcucuggggagagugaggugaggcaggggccacacagacgccaggcaucccucacaccuggccccgcuccacccagggcccucagcucaccccugccugccacacucuuugugcuucaagucagaguauucucugaccuccuuccuccccacuaugucuggaggagcuuuagccaagucuggugggauccugucuacaacccauccuuacuggacagcagaaacuuucccuuuggccaccucagucugguguuuucacucuuguggcaauuaaaggaguguguguguguguguguguguguguguguguguguguguaggugcacauguacaaaccaacacccugcccucccucaccaggcagcguccagccacacagaugucuagggauccaggcugacacaggguuccauccugcaccuuuucagugugucggacauagaaucggaagccacgggggcggcaguucaguucacagcgcugggagcccugaacuaaaggaggagacacaggcuaguuaacuggguucccucgagaaagacgcacccccccccaagagccuugacagccuuuacauaugggggcaucgggaagcugcuguggaagggggggaggggcaacuucccacgcuuacgauuuugugucuuauguuuuuuguuaugcuauguggucucgaguuuaagaauuugacugaugccaggcgugguggugcacaccuuuaaucccagcauuugggaggcagaggcaagcagauuuuugaguuugaggccagccugguuuacagagugaguuccaggacagccaggacugcacagagaaaccccguuucagaaaaaaaaaaaaaaaaaaaaaaaaaaaaaagaauuugacuguuucuuccauuucguccuccuaaaaaagggaaaguuuggcagcuggccaucaaagauuuuuguuguuuuguuuuccuuguguauaagauuggggugcucaggugggagaaagaggucaucuugcaggagcggguucugggauucuggagaucaaacucaggucacuaggcuugagacaagcuuccuuacccacugagccaagccuaccauuccucaaaaggguuucugacacgugugaucaugaguucauagcucaugaagguuugucuugguguggaguugacauagccacaagucccaguggacaguaacuugggagcaacaguguccugcuggaacagguuacagucacgcccccugucggaaagagccucucuagacagcucccucucccagccugccuccagucuugaccauccacccaucacuucccaaaaucccucccuuccuuagaucugggcuaagugucuggugugaccugaaaaguaagacaacagaagggagagaggggccacccaaaccugagucgguccuucggggguggggguggggguggggguggggggcaggcuagaaaccgcaccuucggugaagggcucccacugguacagcuggcccaugaauuccugggagucaaaggcggcacacuguagggcccuggggucuggcugcucaggggggcaaggcugagaagacagauacacaggagucagagcugcaggagaaaucugggaugugggccacagccagucuaggguuugggaaccggucggucagcuccacagaagaacaucaaggcucccgcccugaagucagaaccuccauccuccaguccuagucuggcaagaugaggacccaggucagggaacagugaaagccuaggccacaaaaccgggagaagaacucaccuccuggcugcaggcucgcaucuguucacuuuccccagaacaguuuggagcagggauacugggagcaaagaugcuccagagugggcuggagucucuugucaggggcagccagccaucuggggaccugugaggaccuggaggucuccagugccuccugcucugcuggcuccgggggacaggagagaaaggaggugggugucgucgcucugcucccuggggacugcuccaacuucccggggaagguggcauucguggcccaagggaucccuggaaagaccuacugucuccaaaagaggagguaggugcaggggucccuguguaggaaggagcagaacuaguucuggggagcacuucugucugagcaguuccagaccuuggaguuucagcugagugagaacgggguucagggggcugcaugugagggccgugcuuuucagaggccagcucugugcuuggaggcugagauggaaccaucccuuccccuguagaagaguucuuggguugcccgggucugugaggaugccugcggcuccggugcagaggcaaggcaaaaggcacucucccauaaccgaacaucccuggcuugauggggucucgaacccggaaccuaggaggauguguagacuuagucaucucuuagccugucuccguagucugcuuccugaaagauuggccugcugaagcgccuuuccauuacccccuguucugcucugcccucagagccucaccucugggccccuugaggcuccuggguuuccucucuccccacuugagaagcaggagcucgaagagggccaccccuuccccgaggcuguggccuauacagagacuggggaucccguggagucuggggucuggagcccuggccccggggccggugggcuucuggaugucuugggggucggggagggagggguagggcugggugcaguucacauguucggcuccugcgcugcacccccaccccacagggcugggagcaggaagcccaucgaccccaagguccccagaggccuucagggaccuggcccuccucugauggcagcugaugagaagguccaaacagcuacagaggggagaaggucagaauuagugucucaagguucaaggguuauucguuguccaaggucacauuuacagguagggccaaacuccagccuuuucuagguuauuagacuaagagagggagucagucugggugggccaaaccugauacaaggggccgaagucucccagugggaaugugaagccacccuacaggggaggccagggcacaguggagggacccugggcaggguagcaguggcucacuugucccgggcucaccuccugauccuggcagggcugagggagaggcaggagcagcaucauacacagccagagccugcacaccgaggggugggggacaucagagggagccagagguguuacgacauugccugcccccacccagcuucucaggaagcagacgucccuugucacuugccagaccccuuccaacaguucacagucccuuccugugugcgugugugucccccccccccccucucucucucucgugugucguguguguguguguguguguguguguguguguguguguguuuguguguguguguguguguguugagacaggguuucucuguguaacaguucugaguucugaauguccuggaacucacucuguaggccagguugcccucaaacucacaggcauccaccugccucugcuugaguuacaggugugcaccgcuacccucugccccuucccugcccuaauggagacagagcugguccuuuccacugcuaccccucuuucuuaccugcccagccaagauuccauugcucuuccugugacugccccugggcuggggagcaggggacaggguggcuacucuggcaucggggcuuggagggugcucugaggagggaggagcauggcguuaccccuccagcuaucuggggggacugaagggcugucucagcacaacaccaacagccuggaggggugggggaggaaugguccaccccuuuaggaccuaagggugggagcaagaagggacguugucuuugucaucugcuagaggguggggggucugaccucagccucuuaguucaguuuagucuccucccuauggcccaagauggacuuagcuccuuuggaggcugauguggguggggguagggguugugcauaggcagcuugggccagagcuucuuucuccuagagcucuagggccuagaggaggcaggcuaugccagucacccaugaggggccagccagaggccuccgggcaccagggguggggucacaagccuuaauuccacaguugggauggaguucaagggguucagcuugggugauaugggaccucuaucacaaaacaaacaaacaaacaacaaaaaaaggaaaaccaaccuccucccgcucacagaacccaagagcauuuguuucuuuuccuuuuaacuaagcuccuuacggaggacaaggcucauacaggcugccccgggcauuuuuuuuuguccaagggauaaacuaaguggguuaauggcuucaucuccugagaagaggcagugacuuauccuccccaugagugccagcauccacaaggcacuggcucagggugacuuagcucauguacaacuaguuuucugcuuuuuuuuuuuuccuuacaaugcucagccaaacugggacaccuaagaaggagagauguagccauagcagcccaugcuugccagguucucccucccguaucccuggaaaguccacccuuaagucuagcuguaaacacuggguagcaggggucuucauaccuguccucaaaucuugucucucccuacccccauccuccauucccugccuucucuuugaggccccgccuacccacauccucaucccaucuaaguucugcuuuccaggaaaaacacuguuucugcugccuuugaauggcaccaugagaagaauccaaggaucgcuggccaaaguaggccagaucagggcaugcaaaggacagagaggggggcaaagcuagguccugcucccccucccugggaccccagggcuugggaauuugaggaggagaccaaaugggcugagcugaguucuuggagcuagggaggagguaaaaggcaccacguccuucuucaguugagccagccacugaaucuacgacuucccugauggacgaguggcccuguucaacccacucaucagcccucugccugcccagugaggcuggaaggauggggggugugugugauggacacaaccugucugaugcugguccccucuccaccucccucugcgccucucugcuccuccagucugucccugaugccucuccguggucuacccaguacacauaauccuguccugagcugguuuuggcagcucucuggagaagugagggguggggggugacgagaacuccuggggcuagggccaggccuggcucccucucuggaaaaguccaccccacccuccccugcauaggggagcaggagccgacacccccccccccccccgcacaaauguauguuuguccuuucuccacgcccagggugaggaaaaugagguuggaagugggcauccugaagucacgguggacccuggcugagcacaaaccuaugcugcuccuggucacacccccuugugggccagugacaccaaggaaagugacuugcagggugcuaaccccuucaccccaggcucacuucaggcaaaugagccaaugcagaguggacggguggagggaggguuaguaagggcugggcuagcagaggagagaugcuguccugucagaaugccaggguuuucacggcauccccccccccccaaacaucccaacaggugucuuuucccucaaccucucacaacagauugaguugugcaaagagcacucacccgcaucccucccggacacccuaucccugcguucccagaguacaggcgucuggucgcaucuucccgaagccccucagggaagagccggcugugccggcgugcagggagguccuggguauguuuuccaacuucacuaugugacuuaauaggaaucuuggcacaagcccucgcccgggugaugggacucggagucccagggaccagacccccuccccaggaauucgccuuaggguccgcuguucugagacagucagagcccaggcggggggucggggagguucuaccuucucugcgcccgcucucuccagcugccucugguaguggccaccgcggcccggagccccaggacagcgccgcccgcggcaggcuccgccccacgcca

SEQ ID NO: 1576 - RNA, 11919 nt, Mus musculus
uggcguggggcggagccugccgcgggcggcgcuguccuggggcuccgggccgcgguggccacuaccagaggcagcuggagagagcgggcgcagagaagguagaaccuccccgaccccccgccugggcucugacugucucagaacagcggacccuaaggcgaauuccuggggagggggucuggucccugggacuccgagucccaucacccgggcgagggcuugugccaagauuccuauuaagucacauagugaaguuggaaaacauacccaggaccucccugcacgccggcacagccggcucuucccugaggggcuucgggaagaugcgaccagacgccuguacucugggaacgcagggauaggguguccgggagggaugcgggugagugcucuuugcacaacucaaucuguugugagagguugagggaaaagacaccuguugggauguuuggggggggggggaugccgugaaaacccuggcauucugacaggacagcaucucuccucugcuagcccagcccuuacuaacccucccuccacccguccacucugcauuggcucauuugccugaagugagccuggggugaagggguuagcacccugcaagucacuuuccuuggugucacuggcccacaagggggugugaccaggagcagcauagguuugugcucagccaggguccaccgugacuucaggaugcccacuuccaaccucauuuuccucacccugggcguggagaaaggacaaacauacauuugugcgggggggggggggggugucggcuccugcuccccuaugcaggggagggugggguggacuuuuccagagagggagccaggccuggcccuagccccaggaguucucgucaccccccaccccucacuucuccagagagcugccaaaaccagcucaggacaggauuauguguacuggguagaccacggagaggcaucagggacagacuggaggagcagagaggcgcagagggagguggagaggggaccagcaucagacagguuguguccaucacacacaccccccauccuuccagccucacugggcaggcagagggcugaugaguggguugaacagggccacucguccaucagggaagucguagauucaguggcuggcucaacugaagaaggacguggugccuuuuaccuccucccuagcuccaagaacucagcucagcccauuuggucuccuccucaaauucccaagcccuggggucccagggagggggagcaggaccuagcuuugccccccucucuguccuuugcaugcccugaucuggccuacuuuggccagcgauccuuggauucuucucauggugccauucaaaggcagcagaaacaguguuuuuccuggaaagcagaacuuagaugggaugaggauguggguaggcggggccucaaagagaaggcagggaauggaggauggggguagggagagacaagauuugaggacagguaugaagaccccugcuacccaguguuuacagcuagacuuaaggguggacuuuccagggauacgggagggagaaccuggcaagcaugggcugcuauggcuacaucucuccuucuuaggugucccaguuuggcugagcauuguaaggaaaaaaaaaaaagcagaaaacuaguuguacaugagcuaagucacccugagccagugccuuguggaugcuggcacucauggggaggauaagucacugccucuucucaggagaugaagccauuaacccacuuaguuuaucccuuggacaaaaaaaaaugcccggggcagccuguaugagccuuguccuccguaaggagcuuaguuaaaaggaaaagaaacaaaugcucuuggguucugugagcgggaggagguugguuuuccuuuuuuuguuguuuguuuguuuguuuugugauagaggucccauaucacccaagcugaaccccuugaacuccaucccaacuguggaauuaaggcuugugaccccaccccuggugcccggaggccucuggcuggccccucaugggugacuggcauagccugccuccucuaggcccuagagcucuaggagaaagaagcucuggcccaagcugccuaugcacaaccccuacccccacccacaucagccuccaaaggagcuaaguccaucuugggccauagggaggagacuaaacugaacuaagaggcugaggucagaccccccacccucuagcagaugacaaagacaacgucccuucuugcucccacccuuagguccuaaagggguggaccauuccucccccaccccuccaggcuguugguguugugcugagacagcccuucaguccccccagauagcuggagggguaacgccaugcuccucccuccucagagcacccuccaagccccgaugccagaguagccacccuguccccugcuccccagcccaggggcagucacaggaagagcaauggaaucuuggcugggcagguaagaaagagggguagcaguggaaaggaccagcucugucuccauuagggcagggaaggggcagaggguagcggugcacaccuguaacucaagcagaggcagguggaugccugugaguuugagggcaaccuggccuacagagugaguuccaggacauucagaacucagaacuguuacacagagaaacccugucucaacacacacacacacacacacaaacacacacacacacacacacacacacacacacacacacacgacacacgagagagagagagggggggggggggacacacacgcacacaggaagggacugugaacuguuggaaggggucuggcaagugacaagggacgucugcuuccugagaagcugggugggggcaggcaaugucguaacaccucuggcucccucugaugucccccaccccucggugugcaggcucuggcuguguaugaugcugcuccugccucucccucagcccugccaggaucaggaggugagcccgggacaagugagccacugcuacccugcccagggucccuccacugugcccuggccuccccuguaggguggcuucacauucccacugggagacuucggccccuuguaucagguuuggcccacccagacugacucccucucuuagucuaauaaccuagaaaaggcuggaguuuggcccuaccuguaaaugugaccuuggacaacgaauaacccuugaaccuugagacacuaauucugaccuucuccccucuguagcuguuuggaccuucucaucagcugccaucagaggagggccaggucccugaaggccucuggggaccuuggggucgaugggcuuccugcucccagcccuguggggugggggugcagcgcaggagccgaacaugugaacugcacccagcccuaccccucccuccccgacccccaagacauccagaagcccaccggccccggggccagggcuccagaccccagacuccacgggauccccagucucuguauaggccacagccucggggaagggguggcccucuucgagcuccugcuucucaaguggggagagaggaaacccaggagccucaaggggcccagaggugaggcucugagggcagagcagaacaggggguaauggaaaggcgcuucagcaggccaaucuuucaggaagcagacuacggagacaggcuaagagaugacuaagucuacacauccuccuagguuccggguucgagaccccaucaagccagggauguucgguuaugggagagugccuuuugccuugccucugcaccggagccgcaggcauccucacagacccgggcaacccaagaacucuucuacaggggaagggaugguuccaucucagccuccaagcacagagcuggccucugaaaagcacggcccucacaugcagcccccugaaccccguucucacucagcugaaacuccaaggucuggaacugcucagacagaagugcuccccagaacuaguucugcuccuuccuacacagggaccccugcaccuaccuccucuuuuggagacaguaggucuuuccagggaucccuugggccacgaaugccaccuuccccgggaaguuggagcaguccccagggagcagagcgacgacacccaccuccuuucucuccugucccccggagccagcagagcaggaggcacuggagaccuccagguccucacagguccccagauggcuggcugccccugacaagagacuccagcccacucuggagcaucuuugcucccaguaucccugcuccaaacuguucuggggaaagugaacagaugcgagccugcagccaggaggugaguucuucucccgguuuuguggccuaggcuuucacuguucccugaccuggguccucaucuugccagacuaggacuggaggauggagguucugacuucagggcgggagccuugauguucuucuguggagcugaccgaccgguucccaaacccuagacuggcuguggcccacaucccagauuucuccugcagcucugacuccuguguaucugucuucucagccuugccccccugagcagccagaccccagggcccuacagugugccgccuuugacucccaggaauucaugggccagcuguaccagugggagcccuucaccgaaggugcgguuucuagccugccccccacccccacccccacccccacccccgaaggaccgacucagguuuggguggccccucucucccuucuguugucuuacuuuucaggucacaccagacacuuagcccagaucuaaggaagggagggauuuugggaagugauggguggauggucaagacuggaggcaggcugggagagggagcugucuagagaggcucuuuccgacagggggcgugacuguaaccuguuccagcaggacacuguugcucccaaguuacuguccacugggacuuguggcuaugucaacuccacaccaagacaaaccuucaugagcuaugaacucaugaucacacgugucagaaacccuuuugaggaaugguaggcuuggcucaguggguaaggaagcuugucucaagccuagugaccugaguuugaucuccagaaucccagaacccgcuccugcaagaugaccucuuucucccaccugagcaccccaaucuuauacacaaggaaaacaaaacaacaaaaaucuuugauggccagcugccaaacuuucccuuuuuuaggaggacgaaauggaagaaacagucaaauucuuuuuuuuuuuuuuuuuuuuuuuuuuuuuucugaaacgggguuucucugugcaguccuggcuguccuggaacucacucuguaaaccaggcuggccucaaacucaaaaaucugcuugccucugccucccaaaugcugggauuaaaggugugcaccaccacgccuggcaucagucaaauucuuaaacucgagaccacauagcauaacaaaaaacauaagacacaaaaucguaagcgugggaaguugccccucccccccuuccacagcagcuucccgaugcccccauauguaaaggcugucaaggcucuugggggggggugcgucuuucucgagggaacccaguuaacuagccugugucuccuccuuuaguucagggcucccagcgcugugaacugaacugccgcccccguggcuuccgauucuauguccgacacacugaaaaggugcaggauggaacccugugucagccuggaucccuagacaucuguguggcuggacgcugccuggugagggagggcaggguguugguuuguacaugugcaccuacacacacacacacacacacacacacacacacacacacacuccuuuaauugccacaagagugaaaacaccagacugagguggccaaagggaaaguuucugcuguccaguaaggauggguuguagacaggaucccaccagacuuggcuaaagcuccuccagacauaguggggaggaaggaggucagagaauacucugacuugaagcacaaagaguguggcaggcaggggugagcugagggcccuggguggagcggggccaggugugagggaugccuggcgucuguguggccccugccucaccucacucuccccagagcccuggcugugaugggguccuuggcucuggcaggcguccggauggcugcggagucugcgggggugaugguucuaccugccgccugguuucgggaaaucucacugaccgagggggccccuugggcuaucagaagauccuguggaucccugccggggccucccaccuucacauuucccaguugcgacccaguuccaauuaccucgguaagaaagaggaccucgguccuaugccccagucuauccuuuuucuuugaucugccuacuacacacccucuucagccgaacgaaaggcaaaacaggaagaggcuggagccuucucauaaaccggauggagggugaggaggguggauggucgaggucucugggcacaaaggcuucagaagagaguaccacuaucacucagcucagacaucugucuuucagcacuccgagggccugggggccgcuccauuaucaaugggaacugggcuguggauccuccaggguccuauacagccauugggacugucuuccaguauaaccguccuccacgggaagaaggcaagggggagagucugucagcagaaggcccuaccacucagccuguggacgucuaugugagcuggggcaggugcuagaucguuagggagggagggagggcccuuagggcagagcaguguggaucuagccuagcguaugccccucuuguuacuccaagccauugugaucuucccuccucagaugaucuuucaagaggacaacccagguguuuuuuaucaguaugucaucucuuccccuccugcaguccuagagaguccuuccacaaagccuccagcccuucagccucagccugguaaaacuaggauccccagacccaggagaggagggugaggcagggacugagcuccaggguagcagggaggcaucuaaucuggucccuggauuucccugcagagaugcugaggggggagccccuacuccccucagccccccgcccaguccgggcaccaggcacccuccaacgucaggugcggauuccccaagugccuccuccgacucgugucaggacagccauggggucuucugcuggauacuggaaacaaguggggcacucugaguguucagcauccuguggcaaaggugaaggaggacaccucagcccaaaucccuguucucuauauauaucuauacagauucuguauccuggaccacgggucuacauuggacccuaugucugggauuucauugaaacggggcucugagccuuccugccuccccuggcugcccucuuauucccuucagguguuuggcaccccauuuuccucugcauuucccgugagucaggagaggaguuggaugaacagagcugugcugugggggccagacccccagcuuccccugaacccugccauggacccccguguccuccauagugaguacggcccacagggagggcuggcccuguccuugcucccugcccucggguucuuacagcaccuggaugcaggaagauuagauuagaaagguucacaccccguagacaguaaggaaacccuggcagccuccuuccaggcuagaaaugcagaugccaagugugaaaugacuccucuccuauucgggucccagucugucacccccccccccacauuuccacccaucguucccucucccucacccacagcugggaggcuggcgaguggacauccugcagccgauccuguggcccuggcacccagcaccgccagcuacucugcagacaggaauucggaggugguggcuccucgguaccuccagagcgcuguggacaucucccccggcccaacaucacccagccuugucagcugcaccucuguggccacugggagauuagcucccccuggagccaggugaggaggacccuugagaaguaggcuccaaagaauuuccaccuuuucuucuuugucaucagaaacuuuccaaacaagaccucuauggaaccuaguaucagacagacacaacaggauuggcagccuggaggcccuugcucagcucccccagucugugaaacccuaguucuguagaagcaaggcuggaagauggcugacgcccagccucgggucucucauccuucagugcucugugcgcuguggucguggucagaggagccggcaaguucgguguguuggcaguaauggugaugagguggacaagcaggagugugcuucagggcccccgccgccccccagcagagaggccugugacaugggccccugcaccacagccugguucuacagugacuggaguuccaagguggguccuauacuucuggcaaaucugccuucccuggugacuguaccccaggccauguugucacacccuguucaacacagccuugauaaacuuuguuuuugacuuagccuaggaauucagaguuaagugggaaaaacuuacauucacacccaucauuuuaguacuugggaggcugggccagccugggcuacauagugaguuccaggucauauggcagcaauagaacuuuuuuguucuguuuuguuuuuuucgagacaggauuucuuuguguaaccuggcuguccuagacuagcucuguagaccaggcuagccucaaacucacagagauauaccucccucuggcuagcaagugcugggacuaaaggugugugcuaccaccccuucccccccucaaucugucuuuuuguuuguuuguuuguuuguuuguuuguuuuucgagacaggguuucucucuauagcccuggcuguccuggaagucacuuuguagaccaggccggccucgaacucagaaauccgccugccucugccuuccaagugcugggauuaaaggcaugugccaccaccgcccggcucaaucugucuuuuuaaaacaaacaaacaaacaaacaaacaaacaaacagaugcaagcuggauacggcaguacuuuucaucccagauaaggcaggagaacucucugugaguuugaauucuaggcuagccagggcuacccugccucaaaaaaccaugggcaacaaaaauccaaccaaccaaccaaccaaccaaccagacaaaaaagaauaaagaaaaaaugugcuggagagauagcucaguaguuaugggcauuucuguuuuccuagaggaccugcauucaguucucaguacccacaucaaguggcuuacaaucacugcuaacuccaguuccaggagaucugguauccucuucuggccucugugagcauaugugguauacacagacacauacacacaaaacagcaaaguaaaacgcagcaggggacuggccagauggcucaguaggugaaacuccuugugugguaggcccggcaaucugagugaggcucuggaucccaugguggaaaaagagaaccagcccuugggccccugcacucacacacaagcuggacucgcaagcacacaccuuuaauuucacuacuacggaggcagaaacaggagaaucucucugagucugaggccagacugguccacacagccagcuccaggaugacuagagcuacauagagagacccugucuuuaaaagaauuguacauacagaaacaauagguuucacacaaauaaauaaauaaauagguaagauaugguguagcucaguuggcgguguuugcaaagcuggcaugcaugaggcccgacuuuugcuccccagugucacauaaaccagguguaugacacacacucuuaaccccagcacccaagagguagaagcaagagggucagaaauuuaaguaucucagcuuuacaccaaguucaagaacagacuagaacccagcugucuaucuccucucccaggcugguauccccagggcuuccucaccucccaacacauaggucacucucccucccaacagugcucagccgagugcgggacaggaauccagagacgcgcuguggucugccuuaggaguggggagacccuucagggagacccggaagcaggaagcacugagcagggcugcccucucagaagccgcccucccgauaugcgugccugcaguuuagggcccugugagaggacauggcgcugguucacaggccccuggagugaggucagcugggggcccugagaugcgggaccgaagggaaaccaguccuggcgaagccccacauuuuaaacuuaagagugaucucucuuccccucccuuacaguguuccucggagugugggucuggcacacaacacagagacauuaucuguguguccaagcugggggccgaguucaaugugacuucucccagcaacuguucccaccuacccaggccgccugcccugcagcccugucaggggcaggccugugaggacaaaugguucuccacucucuggaguccggugagugccuggcacccgugccuugcucuccuugggccucuaacaaagaggccugcacucagccaagccucucucggcccaggacaacccagucgaccuuuuguguugucccacuucccaaagacuugcaggacugggggacccucuccauuuggggucuuauaauguuccuggagaauguucuaccacagucucucagagaggaaguggguggccuggggagcagcccugagaacguuagacaucugaucagauggcuguggucuccccaguguucucgauccugccagggaggcaugcagacgagggaaguccagugccugaguggcaaccagacucucagcucccgaugcccuccucaccugagaccuuccaggaagcggcccugcaacagccaacccugcaaccagcgaccagguaaagagcgucccacccaccccaguagaggggauggaguuggacuaugggcagauaugagaagagcuggugggauuggguaccacgcucccagaggggaugaugucaguccagucuugugccauugaccucuguccucagaugaccaaugcaaggacagcucuccacacugcccccuggugguacaggcccggcucugcgucuaccccuacuacacaacuaccugcugccgcucuugugcccauguccuggagcagucccagcuggaaccggcuugaaacgggucccagagacccugccuucgugguuuucuugugccacccacugacuagcccgcucuguacccucuggcuuuucaccuggucucagccuugccagagggauccuccagggugagagaccuacagugugauagcucaagaaguguaccugaccugccugggggucuguccuguguauguuuaucacuuccacaaaagcagcuugagaaagaauaggaagugggcggugccuguaucccucaugcuuuucugggcuggggagaaagggggagagagcaagguuauauuuccacacuaaucugagcuacauagugugugucccccagaaguuccaggucugugccccaauccucgucuccacaucuucuaaauuacccuguuguucccaucccugccuuaucuagucucuguauuccuaccucccucauuagcaggggcagggaucagccacugcuacccuaccuuacuggggaaggaccacaccucuccagggcagggaccacuugugucgagggugaaaaagagaaacgucagcauaagacauccuagccccagucgccacuucacacugaaaaugaugcccaccccagaaguaauuuauuuuuuauuaaaguugguuuugacauaaacaugcucuucguuauguucauggggaccccaccauccgagcaaugugaggccagauguggugugggaagaggagcggcauuuagggaugggaggaagaugugguccucaugggcuguggagugagcuucaaaccuggggcagucuggaucaagggccuaagauucugucccacuacagaucugcagauggcuuacuggcca

SEQ ID NO: 1577 - RNA, 25761 nt, Mus musculus
cuuccguagucacgugccguagggaccgcagcguggcgguguguggcgguagcgacggcgggccguagggcaaccggaagguuuccgguuccgguguaacguucgggcuccgucucaggggcugaaguuugugaggugaguaguggccccgcgcccgaaaggcuguagccuucggugcgagcggcuggacagggcgggagugcucggcgggaagcaggcugggaggacucccugguucuguccggggaagaagucagaaugggcuggcugaaggcaaagggcgggggcgggaagcagcagggugggcaaaccugcccugaggugaggaguuagcgcggacucgguggggccggggccaggugggaagauagcaaagaccggagcaugggguuccaggggcuuguagcguagaaaaguaaggaaucccuucggaagaugagauucugcuaccugcucauucagaagacagcguucugccucccuccccuuccccuuccccuuccccuccaccccccagccccccaccgacgcugacgcccccucgcuauuagaguugaacaucugguuagugacaacucuacugacugaaacuuucuuauccauugacuguuucguuugcacauucgggucgaauuugaagacauccauuuguuaguauauuucuugagcuuacauccaauaugcuuaauaugcuucaccuauuacucuggauuuugaaaauugcuuaaacuuucuagccuauuauucaauuguaguggguuguaagucccauuaacaugaggauucuuggcuguuuuguucacugcuguguguguccuuacaugcaguaaguauucugcuugacaagaaauaguaacuuaaguauuuauugaauggaguguuauaccagaugucucauuuucuaagauaaguauacugaggcucucgggaauuaacuugcuuuccuaagggcuuaugaaugguggugcuuacuauauucuaucuuaaaugggcuuucuucuccacuuuuagugccugugguugcuuucuuuuugauaggcaguauacugcuaucucaugauggcccaaaaaagcuaucccaggauuauucauaaaaguugucacugagaaacagccuuccagauucauucagauguauuaaauacuguguauugacagaucuuaugagagagaaaucugucaagaauguaggagcuaauuagacugcaucuuuuuuuuuuuuuuuuuuuuuuuaugacaaggucucauguagccaccggugauguugaacucuguagccaaggcuggacuugaacuccugauuccccuugugcugggaucacaggcuuguaugaucauucugagguugcauuuuuuagaugucuuuaaacaucuugaaagaguaauucccagaucauacuaagaugcauggcagugcuaagaggaggucuuaugggaaguugaggucggugcagucaauagauugacaugcagccauuaggaagaaaaucagaaauuaaguuaucuuuaugcuggugaagauguugagauuuaagauuacccaaauguaagcaugaauaguguugaaauuuuucuccaacuguguuaaguaauaaaaaaaucauguugguguauagaauacuuaccagcaugaauaaaacuacagagaaaggugacagcauucuuaaggauuaugagauuuaacacaggaggacugacuugaauaaacccucuucuuugaauccguuagacaaguuuuaggucaaaguuagguuagagaauggcuuccagagcagaaguugacuucuagauugacucuucagauguucuguuugccagucuuuugugugacagggucagaguuagaacccauuccucagauuacguuauuccuaguuuguucauucuuuagauagcaaugaugacugaugcugaguuagaauuaaaauaucaaaugaguggggcaugguuguaugcuccuagaauuucucacugggcaaguggagacaggagaguugccaaguguugaguucuguaugagcuacauuguaagaccguaucucaaaaaaaaaaaaaaacaaaaacaaaaacuaauggaccccuuccuucuguuuugaagcuugguuuuagggaauguauuucccuucauaugaaguggagagaugugcuugggguugaaaauaggaauggggaaaagcacucuuauuaugcuauuaucuugauuguuuuguuuuccuuuucucugacucuugcuugguuucuuuuagguguaguuuuuuugucccauuggagcucucauucuccauuuucuccgaaauggcgcugucuaagcgggagcuggaugagcugaagccauggauagagaagacggugaagagagugcugggcuucucagagcccacaguggucacugcagccuugaacuguguggggaagggcauggacaaaaagaaggcggcugguguguaccucucucacucuucugacguauagugauuccaaacacugauuugaacuuccccagguugucccuguuaggagcauuaaaggaaagguggugcuagcccccuucuccuuuuguuauuugcuuguuuugagacaaggucuccuguguaguugugucugacuuggaacuccuuagagauccaccauccucugccuccugagugcagggguuaacagugugcaccacucccuccucccccuuuuuuauuuaaaagacagggucucauggagcccagucuggcuuccagcucacuagcugaggauggccuaagacuuaugagucuauuuccucuacaucagcagcucuccagcuguggguagugacgccacaggagucaaauaucagauaucauguauaucggguauuuauaguacgauucauauugguagcaaaauuacaguuaggaaauaacaucaaaauaauuuuaugguugggguggccacaacacgagaacuguguuaaaggguggagucaucaggaagguugagaaccgcugcccuacauccugaauucugugaucacaagcaugcaccacaccugauguaugcaguguuggagacugaggaaaccaggacguaggcaagcacucuaccaacugagccacaccucucucccauuuucuccuguuacaaugggaagaacuuaaaaaaaaccaauuuuucucuuauuauuugugguacauuguaaauuacaaucuuugguuaccauaccaaaucaccuaagucaaauuugcuuaggaaauauacuacaaucaaagauugcuucugauugacaucucaaauaugaaaguauaagauaagugaaagguacagggagguagguuuuguuaugggaggucuuccauaauuuguuguuguuaugaauuaaggugauauuuuaucuuaaacugguuuuagggugcuggggguugcacccaggcccuucuaccugccuagcaaaguauuuucgacagcgcuacuuacccaacccucauuuuaaacugugauguucaacuuaagcaucaaaaauggcuguacuacuuucugcuccaaaaaaagaaaaagaaaagaaucuuuaccucauacagcagggucauuaaguauaccagaaacugggaauuaaguauaucagaaacugggaauucugcaaagaaaauuguuuuaguuacuaugaagacaggguaccacacuuggguccauugcaagagcaguaugugcucuuaaccaucucuaguccccuacaaagaaguucuuaaaacuuugcugggcagugguggcacacaccuuuaauuccagcauucaggaggcagagacagguggaucucugaguuugaggccagccuggucuacagacugaguuccacgauagccagggcuacacagagaaacccuggcucaaacaaaauaaaacaauaacaaaaaaaguaaaaacuugggcuggugagauggcucaguggguaagaguacccgacuguucuuccaaagguccaguguucaagucccagcaaccacaugauggcucacaaccauccauaacaagaucugacgcccucuucuggugugucugaagacagcuacaguguacuuacauauaauaaauaaauaaaucuuaaaaaaaaaaaaaguaaaaacuuuuccccucuuuuuuuuauugucuauuuauuacaucugguacuggacuguaugcuuugaccuuuuuaaucuauggccucuuuuuuuccugccagaucaccugaaaccuuuucuugaugauuccacucuccgauuuguggauaagcuguuugaggcuguggaggaaggccgaagcucaaggcauuccaagucuagcagugacagaagcagaaagcgagaguuaaagguagguuaugguuuguuaucuaagaagcucagcaguguuuggaacgauaagaaacgugcugagcuuaccucgcucacacuuggcaucuacuauuagaacaccuaauauuggguauggggauauagcucauuaauagagugauugcccggcaugcaugaggcccugggcucaguccauuacugcaacaaauaaauagauaaaaacaacaacaaaauagaauacguagagggaaucuuagaauuaaaguagaggaguaggguuuucauuaucauggucuaugagugaaguucauuugaaguaguucaaagaaguaauugauagucugguccuuuuuucacaugugguuuuguuuucacuguucccuccuuacuacuaccuauagauugagcaauccaagaaucuuggauugcuugaagccuagacaugcuucagauuauuuccacugcugccugacuguagaccucauucuuccucauuaauagacauuucuauguaauguacauggagauaagauuccuaaaaacaacuuccauauagcccacauugcucugcacccuacugagggucacugucuucaugagugggccaaguaaaagaguuagaaauacucccuuuucuacuagaugcauauucugugguugcuguguagucguggccuuuuaacaugagcagugucaguggcuggucucucuuaccucaguucccuaacauagccaguuucucuaucucgcuucccuuuggcucucuuggauuuuugguuggucgguucugagauaaggucuuacuauauauagcuagcucaggcuuuccuagaacugaugugcccaaaugcuaggauuauauguguguaccaacaugaucagguugucuguuuucaguaaguuuucuuuugcuuaugaaucguucuuaaagacucauuuuaaaauuuuuauuuauguauauuauauguaugcacacaggugcccacaaaggucagaagagggugucagauccccugggguuugaguuacaaggaguugugagccacuacauaguugcugggaacaaacucuuguuccuggaagacagcgcucacucuuaaccuccaaaucaucucuccagcccuuguuuuggauuuuugagaccagaucuugcuaccaagcccagguugucuucaagcucagagguucuccuggcccggccuccugagugcugagauucuaagcauguaccaucaucauacccagcucuaaagugcuuuugauaccuugcauaucaguugcuuuuccugagauacacacaaaaaaagaagcagugucugcuuggggucuguagccaugcuauaugaccaagaaaaauagaaauuccuaucccuuuuguuuuuugaacauuauagagugaucagagaaagcagacuuaguucuugacuuaaguaguuugauauuuaggagugaggaguugcaagaaaucagucacagguuacaaaaugugaguagcaguuuuguauacauuugcaacugguuacagaauuucagacuuguguuaaacuuaagaggagaggauuagacacguacuguacagaucaacacagugaggguuguguuacaauaguacaugcugcugugaaggccaagcucaggcugugaauggacuaacuacauggggugggauaguaggaaugguuucuugagggagauaucuagauagcaugggauaugggucccauuuuugguccauucaaguccccacuccacacaauauauuaugggagaguccuuuuucuugaacuguaggaguuccaggaagcgcucgccccuggcugaggauauguccuugcaaaacacgagcccuccuagugaagaggggaugucacccaaagccuaccaccgguguguacauuugcuuuuucccauugucccuuccaguuggccacucuugguccuauuaaauucauuuugcaaauuagucaacauauuugaguucccauuguaugauaagaagaaaauguuauuggggaauacuaaacaagaacaagccucuuuucuggaagaacuuagauuuuaauugggagaaagucuaccuaacacguggcaaacagugucagcaguauaauguggucuaauaugagccgagcucuaagugcugagaggaugugaaagaacaguuggaucagagugggaugagaugaugaggagaacuuccuggaggaggugaguuuuagacaggauuugugggaaggaggaagagcauuacaaauguaggcaguagcacuggcaaagaucuugagaugggaaaacuuaucagaacaugggaaugaaauuugcuugagugggguaagagaaugaugaaguugggugagaugguccacuuggaggaguaucuagagacccugcuucuugcaaguaguuauuugaaagguugucauauccccugggaaaccacaggaugcugguaggguugggaugguuguuccuuuccccuagggaggggugcaauucuucuuucaucuuggguuccuuuaggagguguuuggugaugacucugagaucucaaaggaaucaucggggguaaagaagcggcggauaccccguuuugaggagguagaagaggagccagaggugaucccuggaccuccaucagaaagcccuggcaugcuaacaaagcuccagguuaguuaaaagaagcaaagggauuuugugaguuguggcaccaggcucacagugaucaugauuugaguuuguguuaaccauuugaggaaguuuuacuuuuuccuuuauauuuuagcagucuuugguuugaucagaaguagcccagcuaaggauuauugacacuguauuuauugagcaccuaguguguuacuucaucguuugcccaguugucugccucaucaauguuggaaaaugaaaugaaaugauagcacuuagcuugacuauaucuuuagagcuucuuucugcucuucguuagaacauaacaagcaucgaaagaggccuugcaccauugcccaugcauaccuacaguaggaauucaggggcugauaacaugaucauuaacauuuuuaaagacaaagucuugcuguuacccuagcuggccucagacucagaucugccugcuagugcuucccaagugcugagauuaaagguguaugcuaccaugccuggcugauaaccaugauuuuuaaacauaguaugaauuuuuaugugcaugcaggaaccugugggaguuagaaguaucagauacccuagaacugguuagagaugguugugagccaccauauggaugcugggaccugaacucagguccuaaacaagagugauuggugcuuuagcugugaaccaucucuacagccucccuguccacuugaauguaggaaugaauguuaggaagugugcauguacugcuuccccucuuuuagauugaugagagguuaagguauuaaugccuuauccaaagaaauacaggcagaaagugugguacaguucuaaccucauauugucugagucucagucacauauacuaccuaauauaucaauccuaacauggggggaaaagauugaaaaauucuagugcuuaaggguauaggcuuaucuuuagcaaauuuucuugucuaugguauagauaauauauuuauuguggagacauucacaaucuuuuaggucucuagaacugaaugcuuuuuaauuuaggaacauuuaugggaggaaauaaucuuuuccaccuuuucccucuggagaacagaucaaacagaugauggaagcagcaacacgacaaaucgaggaacggaaaaaacagcugagcuucaucagccccccugcaccucagguauggugccugauugcucggaaaagaagaguuagcacaagguuguugucauucauccacaugagaggccggaaagggcuccaguuguccaccauaaucugccaugcuguguauguaucuguaugccuaucacacacucucugauuucuuuuaaucucuugucuuauagccaaagacaccuucuucuucccaaccagagcgacuucccaucggcaacacuauucagcccucccaggccgcuaccuuuaugaacgaugccauugagaaggcgaggaaagcugccgagcugcaagcccgaauccaggcccagcuggcguugaagccagggcuuauuggcaaugccaacauggugggccuagcuaaucuccaugccaugggcauagcuccaccgugaguaucuuucacacagucccauaucacuucuaaaaguucugggguaguuauuuaaagguaauuuacuugaauauuacuaacuuuuuuuuaaaagacguauuuauuuuauuuauuuuauguacgaguacacuguccugucuucagaaacaccagaagagggcaguggaucccauuacagaugguuguaagccaccaugugguugcugggaauugaacucagaaccucuggaagagcagucagugcucuuaacuacugagccaucucucuagcccguuacugacuuuuuuaaacucaaagaacauuaaauaauuucuuaaaaguuucccuuucuuuuuuugguuuuucgagacaggguuucucuguauagucuuggcuguccuggaacucacuuuguagaccaggcuggccucgaacucagaaauccaccugucucugccucccaagugcugggauuaaaggcgugcgccaccaccgccuggcaaguuuccuauuuuuaauaaaugauuuuaauucaguuacauuuuuuggcuuuauuguaguuuguugucugcuuauaacugauagaacuaaaauaauacuuuucacuuaauaauggagguaagaauagaaucagauuucuuggcuuauuacuuaagagcuucagccauuaaccaguauuggucgagaccauauguuagauggguggcacauggugguacaugucugcaacucuguuacucaggagggagaagcaagaguagugagguaaauaugaaucuagacuagucuaccuaacaaguucuuagcaagucagaacuacauagcaagacccugucucguuugugauuguucuggcaucccaagacuaauucaagaacuuaggaacagaugauagaguugcuucccaugcaucccagugguagaacaucugccuaguaugcaggaggccuugggcucucagacucuugaaccaccacaaaagggguggggguggagggaaaugaccuggaagaugguucaaugguuaaacuacuggcugcucuuccaaaggauucagguucaauuccuaguauccacaugguagcucacaauuguuuguaacuccaguucugcaggauucaacacacuuacauagacauacauguaggcaaaacaccagugcacgugaaauaacaacaaaagaagcaggggugaggguagggguggaaagguggcuaaguaguuaagaacacuugcugcuauuccagaggaccaagguuugguucccagcacccacagguuggcuaacagccaucuguaaguccgguucuagaggacuugaaaauaaauuuugaaaaaaagagaagaauuugggaauaaaauaagauuagauaauggccaagugguagugguggcacauauaauuucaguacuuaugaagcagaggcagaggcagggaaucucugaguuugaggcuggucugcuuggucuacauaaucuggucuauauccuguaaguuccaggauagccaggaggaaaaaaaaaguaugauuuuagaauuaauuucguuagauuaugcccuguaucuaaguacuuaauuugauguauuuuuuaugguaacccaugaacuugaauauucuguacaaaugcucuaauacugagugaguuauauccuuagccaauacugagauauaucuucagccugguuugauguuuuauauuaacucuuagcuaaaaagcagaacuaauuuacauugguuuugguuuuuguuuuuuuuuuuuacuguuuuguuguuguuguuucaagauuuauuuauuuuauguguaugaauauuuuccugcagguauaucuguguaggucauggguaaauagugucaucagaggucggaaagaggcauaggauucccuagaacucaaguuacagacagcugcaagccccaagugggagcugaaacucaaacccagguccucugcuagaguauccagcacuccuaacuguccccuuacucugauuuuuuuuuuuaauggagauuuuauaaagcacugacaagauugccuucccuaagguuaauuuacaguugucuuugauaauuuugacuccuuuuguuuucuguuggguuuuccuugcuucaagguucuauguaggauuuauuucucugagggauguuuuguuuuuucaggaaaguagaguuaaaagaccaaacuaagccuaccccauugauccuggacgagcaaggccgcacuguggaugcgacaggcaaggagguggagcucacacaucgcaugcccacccugaaggcaaacauucgggcugugaagagggaacaguucaagcagcagcuaaaagaaaagccaucagaagacauggagucuaauaccuuuuuugacccccgagucucaauugccccuucccagcgccaaagacgcacuuuuaaauuccaugacaagggcaaauuugagaaaauugcucaacgauuacggacaaagguaauuuagaagcucagaagcugacacaaagacacuuuuagguccauauuuuugggaaauagaaacauaauuuaaaacaguguaauugguuuaagugcuauauucuuagacuauuuauuguuuacucgguuucucuuccugacugcuuucugcuuguauagagcacuccccauugaccaacaguugaggaaaacaguucaaagccaguuuccugacuucuuuugaugaaugauaaccugauguuagaauuuacuacagaaaaucuacgugcuugggagaguuggauugaauguaguuaauuaaauagucccuuuugucuucucagaaugagguuuucguagaaucccacuaauguauaucuacaguaugagugaaaggagagacaagagucagaggacuaaguaaacugcguaaaaaauaaggcaguuuaucuuucaaauccuuuagaaguugugaauucauuacauuagguauuagaauuuaauaaggguuaaauuuguuauuaaauuuguaacucgacaacuuuccuuugcuccaacuuaccuuccuaucuuguuugaucuugcucuuaggcucaauuggagaagcugcaagcagagauuucacaagcugcuagaaaaacaggcauucauacuucgacuagacuugcccucauugcucccaaaaaggagcuaaaggaaggcgauaucccugagauugaguggugggacucguacaucauacccaacggcuuugaccugugaguguuaaaugccaagagaaaggugcuacagacaccucaaauaccacuuuaaaugcaaagggaauagauaacuacacaacagauuuucaagcugucuugaguuauauuuagcuuuugggguuaguuuaccaaaaucagagacaaauaaugcaaagugagucugaaaaacauauuuacuucuuuauuuuugcagugcuggcaaugaacccagggcuuauuuuaucuugccauauuuucaaguuuuauauuuuuucuuacuauguauucuauauauuuuacauguuuauaaugauccauuuauaggucuagggaccuaguucagugguugaacaugugccuaguauauggaaggcacuuaggucugaucuccagaacugcaaaaaaaagaaaagaaaaauguuuauuguuguuuuuuuucccccuuuaaauuuguuuaguugugugugucugucugugugcucauacacaugcagguguacaugcccguguauagagcucaguggacaguuuugucagucuuuccuucugcauuauugagauggguguguggggauggggguggggggucacucuuguuggcuccaguguguuacacauaggauuuggccagcccauucacuuuuuccaguucccauuuaguuguaagaauacuggaauuucagaugugugccauuacagccagcuuuuuuuuuccuauuguaugugugugaauggguuuuuuguuuguuuuguuuuuuuaagauuuauuuauuuuauguaugugaguacacuguagcugucuucagacacaccacaagagggcauugagucccauuacagaugguugugagccaccaugugguugcugggacuugaacucaggaccucuggaagaguagucagugcucuuaaccacugagccgucucuccagcccaugugugaauguuuugccugaauagccugcauguguauguaugugcaccacauguuuccuuagugcuugaggaggucagaaaagagggucagauccccuggaccuggaguuagaccuuuugacaagucauugugugagugcuaggaacugaacccagggccucuggaaaagcagaaguggguuauuuuggucgguugguuaguuaauugguuuugcuuuuuuguuguuguuguuuuuuuuauuuuuugauggcuuuauuguuguuggguguuuuggguuuuuuuuuuuugacauguuuuuucuagauaucccugaaaacuuuguagugguguucaacaccaccucccagccuaguagaauagaaguguuuuuagccauugagcuaucucucugguccucuugcuuuauuuaguaauugauuacuuuucauucuuuuuuuuuuuuuuuuuagguuuguagugggauucucuguuuuuguuuuuguuuuuuuauaagauuuauuuauuuuauauauaaguacacuguagcugucuucagacgcaccagaagagggcaccacuggauccuauuacagaugguugugagccaccaugugguugcugggaauugaacucaggaccucugcaagagcagucagugcucuuaaccacugagccaucuuucagcucucauucuuuuucuuuucguagguuuguuuuuuguuuugcagggagagauuuugauauagagucucacuauguagccauggcugacuugaaacuuacuauguagaguguccuuaaacucaaagacauccaccugucucugucucugucuccuggguacuaagauuaaagguguguacugucacuccuggcauuuuuuugaaguaucaguaauacacuauaguagcacucagaaccucaugcaauuuaaguaagugcuuuacuacagaauuauaucccuaccuauuggacaaagguucgaaauuuauugguccaauaauaauaauaauaaacuuuuauuagcuuaguguaacuaaguuugcucaguugguaaacuauuacuuucuguuuagucuaggauaugauuucacuaguuaaaaagccugguaugggaacucagaaauuaagagcauuuaauuaggggcuggugagauggcucaguggguaagagcacccaacugcucuuccgaagguccggaguucaaaucccagcaaccacaugguggcuuacaaccaucuguaacaagaucugacccccucuucuggagugucugaagacagcuacaguguacuuacauauaauaaauaaauaaaucuuaaaaaaaaaaaaagagcauuuaauuaaauuaacucagcauccaaaugauggcuuacaaccaaccaccuguaacuccaguuccaggggaauccaacucccuccucugaucuuugcaaguaccgggcacauauauaguacacauacauaauugcaugcagaacacaaaauaaccuguguguguguguguguguguguguguggaggagguggggagagggaaagggaacaggugugagcauaccaggaauuauauaaugguuuggaccuguaaucccaguacuagggaggacagggauaggaggaucccuccaguuuacuggcaagccagucuauaagguggagaacgauugagcaagucacucagugucagcucuuuuggccuccauucaaaugugcacacacaugcgcaauauacacaugacaaaagcuuuauuggagaacuaugcaucuguuucuuuauucugauaauggcuuuagcagccugugucauaaccuuuuuuacuuuucaaaccauuuauuugucagcuuguuucuuggugacucauuguugcuaaucagaaaauauauuuggagcuggagagauggcucagugguuaagagcacugacugcucuuccagaggaccuaaauucaauucccagcacacacauggcagcuaucaauuguuuuuaacuccaguucuggggaucugugugaggcgggaucuggcgccuguacacagacauacaugcaggcaaagcaccagugcacauaaaaugaaaauuuaucaaaaaaagaaaauaggcugccugucagggauaucgaagcugagauuaagauugagaaugacugguauaaagaugugcaacauuggugguuuguauguaugucugaaugaggauggugggucuccuagaacuggaguuagagacagcugugagcugccaugugauugcuggaaauugaaccugaauccucuggaagaacagccagugcucuuaacuaccaugucaucucaccagccccaacaugugcaaguuucaugagacuucuuguuuggaaaguuauguguaaccuaaguaaaugauauagguaguacauaauauaguagaacagauagaaaauggauauuuuuucauuauguuucuaaacuauucuguuugguuguuuguugucuaggcuauuuuuuauaucaucucuacccacauaucuuguuuucucuucuuccuccaauuuuaguacagaggaaaaucccaagagagaagauuauuuuggaaucacaaaucuuguugaacauccagcccagcuuaauccuccagguaauguacagauuauccaacuaagguucuagaucacgcagcauuagccacagaaugcaugagcuuucugucugugcuuuccaaccuauagccacaggugauuuuuuuguuuguuuguuuuuguuuuuuuguuuuuucgagacaggguuucucuguguagcccuggcuguccuggaacucacuuuguagaccaggcuggccucgaacucagaaauccgccugccucugccucccgagugcugggacuaaaggcgugcgccaccacacccggcgugauuuuuuuuaaaugauuuauuuuuuauuugcauugguguuuugccugcauguauuaucuauguguuggauucccuagaacugcaguuguaaacaguuaugagcugccauaugggugcugggaauugaaccuugguccucuggaagagcagccaauguucucuggccaccuuugcaguccccuuguauuuuaaauuuuaguuaaguaaaauggcagagcuggcuaguggcuacugagagacauugauauuaauuuguggguauuacaagcugaacuuuuuauuuauuuugguauauuauuuguuuauuuugagaaugggucucacuauguagaccaugauugucaggaauuuuuagagauccuccugccucugccuccugaguacugggauuagagaugugcccaccuugucccccuccucccaucuguuuugguuguuuucauguccuggcuuccuuuagcauucuuagcauuaaagcaacaaaaucuagcuaacucuuugggugcccaacauaggcacuacuauauuauuuagguuacuuguuauggaauauaagccuauuuguuccugugucuggguaggguaaggguuguggagugaggagucuguuagaaaugcaaaggucucuagccugagacacugauaaaugggagaugugcgcauucuuucacuuccccaaaucacuugggauuucuuaguaaaauucuagcaauggucaccccauguguauguaugugagucacauguugcuggccccauuugugaucuuugacuuuauucagucuucuuucccccuuuuuuauuuuauugauuuuuuuuuuauaguuaagucuguuaguuugguuaaaagagauaggugguuuagcugauugggucugugaccccagcauuguggggaauugugauucgauguaagcaugggauacaaaugaagacucuuaucuaucucaaaaggagaacauuuuugcuuacuugauuaccauauguacuuuaagauaaagacagcaaagguuguaguugugggucugguuuccguaggugagugccuucaguuagucacuuagaacuugaagaauuuuuccauagaacagcugaaugccuucuuuacaggguacaugcuuacuggcagggcauaaugaugaugcucuuauaauccuaguaucaggaaguugauguagauaaaucacuucuaaguuugaagccaacuuggggugcauaaaaccuguuuuaaacaaacaaacagaagagagauaaauagaucuuaaaggauuuuaauacuuucccucaggaugaacugagauaguaccauagugacauucacuuggccauaguuccaguaaguacagaagaauauaucgagaccuugaaauaacggucggacauccuuugucuuaaaugcuugggacaaaaguuuuucagaugcugcuuuuucagucuuuuagacauuuucauagcauuugagcauuucucaugugggaauuugaaaauguaaucaucaaaaaguuuuaauuucaagagauagggguggcucauuggguaaagcacuugcuacacagaugugagagacagacaaucccuagaacaagcauccugccucaguguacaaaguggacaacagucaaggaagacuccaauuagccucuggucuacauacacacagguacauacauguggauaugcaugcgugucugcacaccacacauacaaaacaagucaaguuuaaaaggcuuccaggguuucugaaacugggaauauaacucaguugguagaaugcuugucuagcaugcauuaacuccuagguuggaucucagcccuacauaauccaaguauggugccauacacuuuuaaugucagcucucgaaaagagauggggggauuggggauggcuaaguggcucaauugguaagagcacugacuccucuccugaaggccugaguucaaaucccagcauggugacucacaaccacucguaaugagaucugaugcccucuucuggugugucugaagucagcuacaguguacuuauguauaauaauaaauaaaucuugagagggggagagggagguguguggggggguugaagggagacugggauauuagaagugcaaggucauccucaucuacugaauucaaauacugaauuccagccagccugagauacaugagguccuauucaaagaaucauuuuggauuuuguaguauuggcgaucuuagguuuuuagauuagggacauucagccucuaauacaaauuaaaaauaggaacuagacuuaaucagauuuuauguagcugccauaaguauuugucagaggaauaugaggauuuuuuuuuuuaaacaaacaugcuuuaaaaguauagggauuucuuuuuuuuaaguuuuauuuuacuaucaagcccauugguggaauuagagugagguuccagcaaagguuuauuacuaagaaucuguaugugucuggggugugugugugugugugugugugugugugugugugugugugugucuacagaugcccuuggugaucagaagcuggagcuacaggggcuugcuugucagccacccaagguggguacuauaaaguuggauccucagcaagagcaguguguacuuuuuuaaauaauaaaguuauuuuuuauuuauuuuuaaauuauuuauuuauuauauguaaguacacuguagcugucuucagacacuccagaagagggagucagaucuuaugguugugagccaccaugugguugcugggauuugaacucgggaagagcagucgguacucuuaaccacugagccaucucuccagccccaauaaauuuauuuuuauguagguguuuauggggaguuggacaaugugcguguauguggguauaugccagaaacauacauauauaggugcuuuugaaagccagaucuccuggaacuagaguuuagagacuuuuuuuuuuguuuuuuguuucuguuuuuuguuuuuugagacaggguuucucuguauagcccuggcuguccuggaacucacucuguagaccaggcuggccucgaacucagaaaucugccugccucugccucccgagugcugggauuaaaggcgugcgccaccacgcccggcuagcaguaaguauucuuaaccacugcaccaucuccagccagcuucuuccagaggguuuccuccauuuccuaguacugaaauugagcgcagagguuguacaguaguuagcauagcugcauugccgacgcaaaauuuauuguuauguagguuagggaauuucaaauuguauuccauagaagcagcaaauuauagaaaguaggacccaaguggaguucuggauucuuuuacuuccucagauucuuagccagugcuacuguuugcauuugcugaaagugaacaacuucuuaaagaaaaaacauuuaugagccauaauacuuucacuuaguaaaaaaaauuauacuaucagucucaccacuuaaaaauaacaaauagccaggcgugauggugcacgccuuuaaucccagcacucgggaggcagaggcagguggauuucugaguuugaggccagccuggucuacagagugaguuccaggacagccaggacuacacagagaaacccugucuugaaaaaacaaaacaaaacaaaacaaaaccaaauaggucaagcacaguuaguggaugcaggugauuucagcaguuuugagguggaagcaauaggccagucugagcuacaaagcacgacugucucucgaccuccucccucagauuuuaguugaugguuuuucuaagugaugcauacucaccuaaaucccucuauaauuuaugcuuugguaacucauuuuucuuuuuaacaguugacaaugauacaccaguuacccuugggguauaucuuacgaagaaggagcagaagaaacuacggaggcaaacaagaagggaagcacagaaagagcuacaagagaaagucaggcuaggccugacaccuccuccagagcccaaagguaugugccugcuggccugcuaccauagagugagugagucagucagucugucuuauaaaggcacuuuaaugucuuugaugguuuuucugaaucauuuacaggauuuuuuuuaaccugugauguuuucuucuggcagaacaacacauucauuauagaagucauuuagagcuuguuuuuaauuauuuuuuguuguugaugguuguuguuuuuuguuccugcucucaagcacugcuuauuucaagucugcucaaaauucacauuuuacaauaauuccuacauugaaaaaucuuaccugcuuaacucagauuuuauaguaguucaaacuaucuaaaaaauucaguauacuuauaucauaaaaaacauaaaacuuaauuucuuauuucucauuucucauucauuggcauuaaaaauaaauaaacuccacaaauaugcaacuauuguuuucuugaguauauaaaugugugugugugcauauauauguacacacacacacauuuauacauauaaacauacacacacacauauauguguguguuuguauauauguauguguauauacauauauagaggaggcaauauaccuagaaauaguauauauaaauacuuuauccuagcuagagaaguaauuuaagagauuaggagauugauugcugcuuucuuuccauuguagugagaaucucaaauuuaaugcgaguauuaggaacagaagcaguucaagacccuacaaagguagaagcccaugucagagcucagauggcaaagagacagaaguaaguggggugcgguagggugggauagggcagagcccaggacacuaccuuuccagacccuccugggguugguauuggagggaggagagaguccucuguugcucucucuuucccuuagcccugccucugaucggcaaugccuuucucacuuguggauguccuuccugucacgacagagcgcaugaagaggccaacgcggcccgaaaacuuacagcagaacagagaaaggucaagaaaauuaaaaagcuuaaagaagacauuucacagggggugcacauaucuguguauagguagguguccacauugacagcugucucuguuucuuuuuugagacaguguuucucuaccuagucucagcuauccuggaacucacuaaguagaccaggcuggccucaaaccuagagauccacugccucugccucccugguucucggauuaaaggugcggcccauuaugcccuccuugcaccuacauucucauuaucuucccaguccuuaggacaaaaucacuguggccuucaaguauaccuuauucuuuugugguaacuacuucauuucucuagaaagcaguaauuuuuuucuuuauuaccuugucuuuauccugaggaucuguaguaauaggccuuucauccacacuucagaauauauuuguacccaggaaauacauuuuuacuuuuuuauuaaugucuucauuuuagucuagguuaaguuuauauaugcauuccacuuuuuagauacacuuauuucuacuaaauaguucuuuaucagaaguggcacauuauaauaaaacuucuguuuauucagauuaaaauuuuuggaccagauaggaugaugcaugccuguaauuccagcacacaggaggaacaggacaguucugaguuuauggcuaaccugaaccacguagcaaguuuuuggcuaucccaaacuggaaaacaagacaaauucuaauaauaauagaggagcacuuccugaaagaguccccuuccuauucucugaucuauuaagauacuaucuauagguaacuacuauuuacaguuuuugaugucuccagaaauuuuuuugaauacauggcaucuauacuauaggcaucuagagguggcaggauuuaaagcuuuuucuaccuucuggaacacugggcuugcaagcuuuuuuggaugauaguaccucuccuucauucauagauucuaacuacuuacugugaagaaguauaagaccagcaaagggaggcagaggcagucaaaucucucgaguucaaggccagauuggucuaugcagugaguuccaggccagccagacuacaugaugagacccuguauuuacaagagaauaaaaauauaacugcauuccagaggucuugauuuuagauccucuguauuugccauuccauucaggcagcuucuagugauaaaacugaagacaugacuaaaguuucccuccuccagaguucgaaauuugagcaacccagccaagaaguucaagauugaggccaaugcugggcagcuguaccugacaggggugguggugcugcacaaagaugucaacguggugguaguggaagggggugagugcagagaguugagggaaacucucuagacaacccuagcccuaaagcgauuggcaguggggagaagggaggaagauuucugugagaccgcuguuguguuuccgauucugugugucugcagaagaagucuguccugguccuggggcucguuccccuucccauugcuaucugaguaguagaugggcucagcucagagguucuuccuacucugucaucuuuccaacucgcaaaauucucuuuucaggccccaaagcccagaagaaauuuaagcgucucaugcuacaucggauaaagugggaugagcagacaucuaacacgaagggagauggugaauugggguuagaagggauuacaugggagagcugggggagguggagugauaguucugucuauucuucauccauucuuccuggaauagucuuguguucaagaaguuuagacagaauguuuuguuuugugugagacagggucucacuguaugguacuggcuggccuugaauucauaagauccaccuaccuauacuuuuuaagggcugagauuaaagaugugugcccccugcccagcuagguugacuuaaacaguacugcugcauacacccagcaggcuuuucucuuugacuuaguuucaaguucugguugcaagaguguauuuaaagucagcaaacuaugcauucguguguacaauaucuaaccuguauuauucuuuacuuaaauuucuuauuagcuacgucacgguaguucacaccuguaaucuccuaagaguuugaggucaucuugagcuauggagcaauuuuaaagcagccuaggccacaugagucucaaaaaaaguugguauuucuuucuaaucacuccagacuaguaguauccacccaugaccccagcacucagaaaguggaaguaaaaagaucauggguuugaaaccaacacaugccaauguaaagcagauauggacuacauacagucucugacuuccccaccccaacccaauucaaaagaccauugaauguauaaaaaauagauuuucacaucaacaacaacuuucuacuuuaaacaggaaagaauacuuuggguuuuguuuugagacaaggguagcccuggcuggucugaaacuauauagaccuagcuggcuucacacucaacaggaaagauaacuuuggagcuagcauuaaaguuuaguaguuuagcacuugucuaccauguucaagauccugcacacugagagccagacaagguguggggcacagguaaagaaagaaaagauauauuuaguggggcaugguugcugaagcuuguaaucccagcucucaguaggcugagucaggaggauggucucaguaaauaaauuuaauccagcacuugggaggcagacccugcuaaguuggaggccagccuggucuauguagcgagaaucugacucaaaaaacaaaccaaauauugagcuuuuuuugucuuuuccagaugaugaggaaucugaugaagaagcugugaagaaaacuaacaaauguguacuaguaugggagguuagugucucuguaaaacgcugcaguucaguuggccggauguuuagcgugguuuuuagaaguuggucuuuagcgugugccgguggggaagcauauggagaacaguggcaguaggaguacacguucucagcaggaagguagugcccaggccucagacgcacaguaacgcacgcacuagacggaagaguccgggcuugccggggagccagugaugagugcuuaucuaaugcuuuagaguccgaguuccauccuuggcuuuacagcagaacaggaccugagccagacggugucagguuucauugccuuaucuauaaaauauggcuguuauuugaucuaccuggcguguugguuguagugagaguaaauuagagcaggcccaaauucaacucccuuacucaguuggcagggcuuuccuccuguaacuccagguccaggggacaugaccucguggcuuugacaggugccugcacucacaugaacacauucuuuauuuaaauuuuaaaagauuuauuuuuguguaugagugcuuugcuugcauauauauguauaucuacaucacauacaugccucauggaagccagaagagggugucagaucucucagaacugguacagauaguugugagucacuaugugggugcuuagaaccaaaccgggguccucucuaagagcaguaguuaugcuuuuuuuuuuuuuuuaagauuuauucauuuauuuuauguauauaaguacauuguagcuguacagaugguugugagccuucaugugauuguugggaauugaauuuuaggaucucuguucacucuggucaaucccacuccggcccaaagauuuauuuauuauuauauauaaguacacuguagcugucuucagaugcaccagaagagaggaucagaucucauuaugggugguugugagccaccaugugguugcugggauucgaacuugaggaccuucgggagagcagucggugcucuuacccgcugagccaucucuguagcucauaaauaauuuuuuuuaaucuuuaaaaaaaaaaaaaaaaaaaaaaguucuuaagguugguacuguuacuuaguguagaguguuuuucuuacaugccucaccccauagguucgauccccaguacuugggagaaaaaaaguuguuuacgucugugguuccuuuaaaacaguaacagaaaaacaaacaaacaaaaaacauccucacccccccccccaaaaaaaaccccaaaaggcuaaaaaccuuuauguauaaucauacaaauaucuaagacaugggguuauaauuacuuuaucauauaaucacauuucagcuagggauguugcuacacaaauguuauuaggucuuuuaaaagacuguuaagucuuguuuaaguaaguagacauguuagagugcuugcccaacaugaauaaggcucuaaguugaguucccagcacuggauaggguagaaagcuuauuacaauucuggucucucuggggcauggugguacauuaggaaguuguaguaggauuucuaauccaaagggaguuguaggcucaacagcaaguuacucuuuucaaauaaguaaauaaauacaauuuucacuucuuaccuaggguacagccaaagaccggagcuuuggagagaugaaguuuaaacagugcccuacagagaacauggcucgugagcauuucaaaaagcauggggcugaacacuacugggaccuugcacugagugaaucuguguuggaguccaccgacugagacuacuguuagcccuuguaucuucuuugccuuuguuucuucugucuucucacucuacuucccaaccuuaccccaccgugcgugugaucucagaacugugccaggccgauaccagggcaaaaagacuaccaaguucacccagucagccuggugcuacccuccauccuguaugugcauaugauuaaagaguuauuuuuaaaauuaguaugauauuuuucauauggucauagauauuagaauuugguuuugugggugauuuuuccauauuccuaggauccuaguaguuuaaguguguaaaugucugacuucuaagcaaaugguaaguacaguuuucuggagauaguaagucagaaaguaguguuaagugguugugggaugaguggccaaaugcaguauguauuucuuaaccuuuauagcuagaauaauaaggucauauguuguugguuucuuuaggucaaguccuaggaaauuaguucuucaaauggguauggcuauuuugauugaaauagacuacauacuauccaagggcaucaguuuguaaacuaagacaggaaucaguaauguaguucaauuuccacuguuaaugaugccaugugacuccucucagcgauaugcugaauaaccuuuuaagaagauuuaagauaggcugucauggccgggcgugguggcgcacgccuuuaaucccagcacucagga

SEQ ID NO: 1578 - RNA, 3754 nt, Mus musculus
auuuaaguaaaaaaugucuuuaaucagaaaggauuucuauuuccucaccacaaauacauuaaaguaaaaaaaaaaauacacauaaaacauacauuuauacaaauugggaaucaggggaaagaagcagagccuggguuagggcugaggauccggagcaacugggggauggcuagucaucuguggcucuggguguccuuuagucaucucucugucugugguaggcaggacaggcggacauaggaugcaacuccagucugauggcaguguuacuggcaaacuguggcaacgaggcuccucgccaggcaguuucuucagaucaccagggacgacaggagacaguggaguuggugggaccggagugcccggggcagaaugggugaagggcuguccuccuuucuggaggacaaggaugacaccaaugcuggcuccagugccuauggggcuguggccagaggcggagccuugggagcugaggggaggguuacaaauuggagugcuaugaauccaggugagguucauagcuggccauccagugagaugccaaggcugcuuugguuucaaaacuaaaugucccagcuguguuuggcccaucuucucuaggagaggugcaggagaagcagccccggggucaccgugguggcugggaaagugcuagagaaugggaaaugcaaaaccaggaguuaacaaagcuuacacaugaguuucacuuaagcacagaccuuugcuucccuugaggacucauuguacagugcaaacaaacguuugugcaacagguguguucugccaggugaugaugaaguaaaaauuucagcaaucaaguaaugcucccaucuaccuaacacaaaguuggaggcuacucuguaacagacaguaugaggcuacuagaaacagacaagauaaaaagagccccauggcucucauuauuuauacagugauuccuguucgacuucuuuaaaucaaacccaggaccuacuaaguggcagaaaagcagucucauaaaccacaccaccagccagagaaauugaaaugacuuuaauuuaauuuucuuuucuuuaauuucugugugaaaggucucauuucccguguuuaguucuuuaugaggcaugauccuguuaaucuuucagucagucauuuucauaucacuagaagcuuuaguggauuuagcugggcaugaugaugcacaccuuucaucugaacacucgggaagcugaggcacaugcaucucugaguuuaaggcuagccaggucugcagaacaaguugcaggucagccacuacacagagaaacccuguuuucaaacaaacaggaaaggaaagaaaagaaaaggaaaggaaaggaaaggaaaggaaaggaaaggaagaaagaaagagagggagaaagaaagagaaacucacuauguaagguuuaaaguuauguugauagaagucaaaagauggagagggggaggguuuuggggggaggucaagaagagaaaaauggaggcaucuucuugugagucauuuggccagauuaaaagccuucuguaagccagguaugguggugcaugccuuugaucccagcacucgggaggcagaggcaggcggacuucugaguuagaggccagccuggucuacagagugaguuccaggacagccagggcuacacagagaaacccugucucgaaaaaaacagaaaaaaaaaagccuucaggaagcagacagcuuugacaggagggcagggguaaauuucgugagaucucaacagaauagagccaacaucgagacgaaaucuaaaacucacaguaaugugccaagucagacagacagcccuucccugggagggaaaagggaaggcaccuggaagggagacguucuccagacagucggggccugggucuucucccagucucucccuuggucuuuaggggcauaccuugcuuaucuggugccggcuaccuccugaggaugacuucugggcagcuaugugaggaaaccaagucuuuaacaucccuuccaccugcagcaagguuccuagauaacguucucugugaaaaaaaggauauuuuaaaagucaacuaugaaaaaagaaacagggagaacuguacaggccucccucaauaagauacugaggagggaaugaaggaaagagggagacucaccccaucugaggcuucuguaaaacacccacuaugcgcuggauccgguccauggccacacucuguuggaagcuacuuaauccuagggugaaagagggagggugauuagagggcgugggauguacacagcucagcuguagguucacucccagcauugagggaaacagcagagguggggacugagguaaauguaaaggaaauacagagacagaugggguucaaaugaauucacaugaagaaauuaaguuacagaugcaaacagaauagcccaugccccaaagagaaauguaagauuucacucagagaaggggggcuacccccagaaauauaauuaauuaaucagauuauuaccucugucaaagcgacccaucuugaguccguucaguaggucugugaggggccguaugaacccuuggaguucuuuacacuguagaaaaacagcacaagacuuugagaccagcagugguuuuucugcugugauguaacuggcagguccuugucaaccaauuagguguuugccacugcacuaucuuuucugcuuucuguuaccuuuugagcaaagagcagaucucccucuguaguacauccuuggguguucagacucgucuccuguucaccgucucuugaucucuugacuucagauccuugcuguuccagaugaggugcuguauguugguuacuagaaacccugggucgaugucugcagcggauagggccuggacugggccuggaaccuccucucugacccacagugucuggccugagcucaugggugcccuugcccucccucucguuaucagaagggaagcuaaagucacuguucacagaggacguggaaaaugauggggagagggaggaggaggaauaagaagaaacacuagauggagaauccauagguccaggagcaggagaggggcugaagagcagcucccguaguaccaaagaucagaaccugcaacugaaaagcaaagcgagggagucugaaaucagagucaaagaauuaggaaagggacugggagacuggggcauucuaaacagaguaacaugguuuucgcuuuguuuuauuguuuuuccguucucaauagaaacaagaaagaaaggaaaaaaaaaaaaaacuugcucuuccagccgcauucaaaaucuagaccgccagcccacacagagcucuugacccuacacagccuuucuucccuugggugaauaaccgacuuuacaccuuccccucagccugcaguucugggcuguucccggccagaccucauagggagccuaucgaccuaaaaacgacacccgcuagaggcugcucugcgcaccagaacccaccucaggucccuagaguuccggccccauagacacccggcuccaccgcuuucgcauccuucaccaucaggugcacugcgcuggucagucuacggucgcgccugccaggugaugcaauaccucccaacaccccgaucugcggucuuccaugcccaccccauccgggucgucuuccggagagcgcuuggcucucguccgcuuaccugggucugucgguucagccccggucgguaugcagcuucuucacugucugugcuggucuagccgacccaccuccgccucacucugugggucccgcccc

SEQ ID NO: 1579 - RNA, 3754 nt, Mus musculus
ggggcgggacccacagagugaggcggaggugggucggcuagaccagcacagacagugaagaagcugcauaccgaccggggcugaaccgacagacccagguaagcggacgagagccaagcgcucuccggaagacgacccggauggggugggcauggaagaccgcagaucgggguguugggagguauugcaucaccuggcaggcgcgaccguagacugaccagcgcagugcaccugauggugaaggaugcgaaagcgguggagccgggugucuauggggccggaacucuagggaccugagguggguucuggugcgcagagcagccucuagcgggugucguuuuuaggucgauaggcucccuaugaggucuggccgggaacagcccagaacugcaggcugaggggaagguguaaagucgguuauucacccaagggaagaaaggcuguguagggucaagagcucugugugggcuggcggucuagauuuugaaugcggcuggaagagcaaguuuuuuuuuuuuuuccuuucuuucuuguuucuauugagaacggaaaaacaauaaaacaaagcgaaaaccauguuacucuguuuagaaugccccagucucccagucccuuuccuaauucuuugacucugauuucagacucccucgcuuugcuuuucaguugcagguucugaucuuugguacuacgggagcugcucuucagccccucuccugcuccuggaccuauggauucuccaucuaguguuucuucuuauuccuccuccucccucuccccaucauuuuccacguccucugugaacagugacuuuagcuucccuucugauaacgagagggagggcaagggcacccaugagcucaggccagacacugugggucagagaggagguuccaggcccaguccaggcccuauccgcugcagacaucgacccaggguuucuaguaaccaacauacagcaccucaucuggaacagcaaggaucugaagucaagagaucaagagacggugaacaggagacgagucugaacacccaaggauguacuacagagggagaucugcucuuugcucaaaagguaacagaaagcagaaaagauagugcaguggcaaacaccuaauugguugacaaggaccugccaguuacaucacagcagaaaaaccacugcuggucucaaagucuugugcuguuuuucuacaguguaaagaacuccaaggguucauacggccccucacagaccuacugaacggacucaagaugggucgcuuugacagagguaauaaucugauuaauuaauuauauuucuggggguagccccccuucucugagugaaaucuuacauuucucuuuggggcaugggcuauucuguuugcaucuguaacuuaauuucuucaugugaauucauuugaaccccaucugucucuguauuuccuuuacauuuaccucaguccccaccucugcuguuucccucaaugcugggagugaaccuacagcugagcuguguacaucccacgcccucuaaucacccucccucuuucacccuaggauuaaguagcuuccaacagaguguggccauggaccggauccagcgcauaguggguguuuuacagaagccucagauggggugagucucccucuuuccuucauucccuccucaguaucuuauugagggaggccuguacaguucucccuguuucuuuuuucauaguugacuuuuaaaauauccuuuuuuucacagagaacguuaucuaggaaccuugcugcagguggaagggauguuaaagacuugguuuccucacauagcugcccagaagucauccucaggagguagccggcaccagauaagcaagguaugccccuaaagaccaagggagagacugggagaagacccaggccccgacugucuggagaacgucucccuuccaggugccuucccuuuucccucccagggaagggcugucugucugacuuggcacauuacugugaguuuuagauuucgucucgauguuggcucuauucuguugagaucucacgaaauuuaccccugcccuccugucaaagcugucugcuuccugaaggcuuuuuuuuuucuguuuuuuucgagacaggguuucucuguguagcccuggcuguccuggaacucacucuguagaccaggcuggccucuaacucagaaguccgccugccucugccucccgagugcugggaucaaaggcaugcaccaccauaccuggcuuacagaaggcuuuuaaucuggccaaaugacucacaagaagaugccuccauuuuucucuucuugaccuccccccaaaacccucccccucuccaucuuuugacuucuaucaacauaacuuuaaaccuuacauagugaguuucucuuucuuucucccucucuuucuuucuuccuuuccuuuccuuuccuuuccuuuccuuuccuuuucuuuucuuuccuuuccuguuuguuugaaaacaggguuucucuguguaguggcugaccugcaacuuguucugcagaccuggcuagccuuaaacucagagaugcaugugccucagcuucccgaguguucagaugaaaggugugcaucaucaugcccagcuaaauccacuaaagcuucuagugauaugaaaaugacugacugaaagauuaacaggaucaugccucauaaagaacuaaacacgggaaaugagaccuuucacacagaaauuaaagaaaagaaaauuaaauuaaagucauuucaauuucucuggcugguggugugguuuaugagacugcuuuucugccacuuaguagguccuggguuugauuuaaagaagucgaacaggaaucacuguauaaauaaugagagccauggggcucuuuuuaucuugucuguuucuaguagccucauacugucuguuacagaguagccuccaacuuuguguuagguagaugggagcauuacuugauugcugaaauuuuuacuucaucaucaccuggcagaacacaccuguugcacaaacguuuguuugcacuguacaaugaguccucaagggaagcaaaggucugugcuuaagugaaacucauguguaagcuuuguuaacuccugguuuugcauuucccauucucuagcacuuucccagccaccacggugaccccggggcugcuucuccugcaccucuccuagagaagaugggccaaacacagcugggacauuuaguuuugaaaccaaagcagccuuggcaucucacuggauggccagcuaugaaccucaccuggauucauagcacuccaauuuguaacccuccccucagcucccaaggcuccgccucuggccacagccccauaggcacuggagccagcauuggugucauccuuguccuccagaaaggaggacagcccuucacccauucugccccgggcacuccggucccaccaacuccacugucuccugucgucccuggugaucugaagaaacugccuggcgaggagccucguugccacaguuugccaguaacacugccaucagacuggaguugcauccuauguccgccuguccugccuaccacagacagagagaugacuaaaggacacccagagccacagaugacuagccaucccccaguugcuccggauccucagcccuaacccaggcucugcuucuuuccccugauucccaauuuguauaaauguauguuuuauguguauuuuuuuuuuuacuuuaauguauuuguggugaggaaauagaaauccuuucugauuaaagacauuuuuuacuuaaau

SEQ ID NO: 1580 - RNA, 4674 nt, Mus musculus
ggaauuagaugggagguggccauggggcagcgaccggggguuguucccucuucggcuuccguagacgaggucgggcggaccuucguccgggguuucggcacccccccuuccccuuccccgggguccgggggugacauugcaccgcgccccuccugggguugcguccucgccccacgcggacucccccucggcgcgcagcucccuuucgccuuccuuggccgggguucccucccuuccccagcugcccagucaugggggcugcuguguuuuucggaugcaccuucgucgcguucggcccagccuucucccuuuuccugaucacuguagcuggagacccacuucggguuaucauccugguggcggggugagugucgagugguggagacggggccgaacguagagaaaaaggugcagaaagggcuggaggaacuggagcaggcuugggagccugaguuggggggcagaagucggaaaagguuggacacagggucaaaucgugaucuaggagaauuucccgcagucggcuuccgccuuccagggauuucacagauucuuccuguaguccucccggcaacgucagagaaggcccaaggccaagauuaaugagggggcugugcugaccucggccagccaaggaucuuggaauggauaccuagucuguccguucaugcccacacacuuugacucuaaugaagacucuaaccagaucucuacccuuucugcugcuuucagauucuuacaaaugagucuguugguggagacacuuaucuggucccugucucccuuaccauccggaagucuaacuuccacuuuucauacauuccauccuuggcuggcucccuccuugauuuuuccaucugcuccugucuuugccucucucauugcccuuguguuuucucagagccuuuuucuggcuggucucccugcucuuggcuucuguggucugguucaucuugguccaugugacagaccgaucagaugcacggcuccaguauggccuccugauuuuuggugcugcugucucuguccuucuacaggaaguguuccguuuugcuuacuacaagcuccuuaaguaaggacaaggggggcucuggaagggaggggggacaguggugugcauggcgggaagugggccagcccugcgauggugguuggaguaagggucguuaaagggaggguauuggaggggaaggaacaucccugcccuuccuucuguuucccaggaaggcagaugagggcuuagcaucacugagugaggacggaagaucacccaucuccauccgacagauggccuauggugagccaagggagagggaccagaggagggaguuggacaccccauccucucuuucuggguaaucuaaacagccacguaugcuaaaguguuuuucuucauacuugacuuccaaggagaggcggucuggagggagaguagguaugguagacuuuucccugggcuuggggaguagguacugcuaaugaagcuguggugguccuggucguugacaagacccuccccuccccccaguuucuggucuguccuucgguaucaucaguggugucuucucuguuaucaauauuuuggcugaugcacuugggccaggugugguugggauccauggagacucacccuauuacuuccugacuucagguaaggcccacuucuaaccuugccuuugugcccuguccuucccuggcccugacuuacugcccuucccugggaggcuccucuggcucaccgucucaggaggcuggcaggcgaucagggauggacaucuucccgucucccuccccgcagccuuucugacagcagccauuauccugcuccacaccuuuuggggaguuguguucuuugaugccugugagaggagacgguacugggcuuugggccugguaguugggagucaccuucugacaucgggacuggugaguuggagacaggggcccgagucagggagaaagcauuuaauagugagcuggaugggguauguguucccaccuaguaagucaccuucccuuaccuggggcggaggcagaaucuugacuucugcuaccuuagcuucaguuaggucauccgcucuggggcagaguuugaauugcuuagucguguuaccacagaaggcuggaggugacuagaaagagcugaaaccuuggagggaaucugaacucaaaaguugccuuagcuauaagauguuagugcuugaagggaaacagguuucugaaugagaugucugagcaagguugggucagaggcccagagugaauguugcaguuaggugcagggagaaucuaaccgcucuucuguccucauucucagacauuccugaaccccugguaugaggcuagccugcugcccaucuaugcagucaccguuuccauggggcucugggcguucaucacagccggaggcucccuccgaaguauccagcgcagccuuucguguaaggacugacuaccuggacugaucgcccgacagaucccaucugccuauccacugcccaugacugaacccagccccagcccggguccauugcccucauccuccgucuccucgcugaugugccccgcuuccuuccggguuuggcguuguccauuugugaccuguagucucuaagcuuucucaggagcagccugggugcagccagucagggacugguggguuugaaucugcaucucuccccaccaccuggggacccccuuguuguccaggucuccccaugugucagugcuccacccucacccugcccaugacucaccccgcuuccccucugcaggccgccggcaggaggacagucgggugaugguguacucugcccugcgcaucccacccgaggacugagggaacaugggggggccccugggccuggggugcccucccgaucuccucgucccguauuucuccaucuccaguucuggacagugcagguugccaagaaaagggaccuagcuuagccauggcccuggagaugaaguuacugaggcugaggguagauggguucaguucagugucuccugcccagacuggacaucuuggucuuuuucucaggucugaaaggaaccauuuuuugguaugauaaagaccccaaaaugccuuuuuuuuaaaguggggagagggaggagguacgccgggagccucuuuaaccuccauaggcuguguuugcucccaaaucugcugaugguggcucauuucuauccuguuuucccuuuggucccaggcccugggggaaaggaaggaagugcaugcuuggggacuggucccacuggaucucuauccuaacguccauggccgucagcaccccuccuuuccccaaggugaaauggagggugcugugggggccugcccacuccauggcagugcccugaaggagucagacuaccauggcaucgcaggcccagagggcagacauuuuuucuaguuuuuaauuggggugugggaggguuuggggagguuuucuaucacuguguuguuuuucugcugaggguggaauauucuguccuuuuaaucaaggugauugugauuuugacuaauaaaaaggacuuuauaauuguggggggacuuggcuuuaagagggguaauggauugagauuucuagcuccggguggcuccgguccauccucccuagccaagugccugugauguucaccauuggugugaugagagaagcaucauuagugguguaacuuguggaaguuaacuuccuagaaguaggucucccuuguccaggaacaggauacaaggaguuaauuaaucauaccccugccccuucucuuucucuaugucuaucucugccacucaacagacagaggaacucucccacucuugaaagccacaaaaaaacauucaagaauuaagaucaaaaacuuuuaauuuccaaacauauauugagcaaaaaauaauuaaaaucccagcagcagcccuuuuuuccuagaggaaaaaaaaaaacuacaacguauaucuaagggagagaacauggcggugugaggugaaagauggcaguuuauccucagcuucuuccaaccaagcaugaggacagggaaucuccucauccacagcuuugaaggccaaaggcucagcccuuccugaagagcuggggucccugguguauagagaggguuaccuagcaggacacgugccugccuacaacuggucguccagugccugcagcccucagagaggcucccuggcaggaggagagggaggcaucugcagcaucuugagacagaguucacgccucugugguagcccgagcagaggugaaaaccacacuuuuccuguuucccagccgcuucuuccuggaaaggggagcaaugguucaugggagugacuagccuccuaagugagaguagacauagaauaggaaauacauuuaaaaaaaaaaaaaaaacucaauaaguauauagucaugaccuuaaauguucucuuucccccaccuccugaguacaaguaugugccagcaggccagguuuaauguggugcuagggaucaaacccagggcuugggcacaccuggcaagcacuccgccaacugagcuacagccucagagaauuucguuggaguugggggugggggagacuggguuaucucacuauggagaccaggcuggccuugaacacacagagaucauccugcuuccagcucccaagcguugggauuaaaguuaugcacuaccaugc

SEQ ID NO: 1581 - RNA, 6926 nt, Mus musculus
auuaagaucaaaaacuuuuaauuuccaaacauauauugagcaaaaaauaauuaaaaucccagcagcagcccuuuuuuccuagaggaaaaaaaaaaacuacaacguauaucuaagggagagaacauggcggugugaggugaaagauggcaguuuauccucagcuucuuccaaccaagcaugaggacagggaaucuccucauccacagcuuugaaggccaaaggcucagcccuuccugaagagcuggggucccugguguauagagaggguuaccuagcaggacacgugccugccuacaacuggucguccagugccugcagcccucagagaggcucccuggcaggaggagagggaggcaucugcagcaucuugagacagaguucacgccucugugguagcccgagcagaggugaaaaccacacuuuuccuguuucccagccgcuucuuccuggaaaggggagcaaugguucaugggagugacuagccuccuaagugagaguagacauagaauaggaaauacauuuaaaaaaaaaaaaaaaacucaauaaguauauagucaugaccuuaaauguucucuuucccccaccuccugaguacaaguaugugccagcaggccagguuuaauguggugcuagggaucaaacccagggcuugggcacaccuggcaagcacuccgccaacugagcuacagccucagagaauuucguuggaguugggggugggggagacuggguuaucucacuauggagaccaggcuggccuugaacacacagagaucauccugcuuccagcucccaagcguugggauuaaaguuaugcacuaccaugcuuggcugagaaugcuuuauuuuuuuuggagacggugcuuuucuguguacccuggcuguccuggaacucacucuauagaccaggcuggccuugaacucagagaucugccaaugagugcugggauuaaaagugugccgcugccacccaaccucugagaaugcuuuuuaguagaaaauaaauacugcaggaauagaaaguaggaucucaccuaauuuuuugagcgaugaaauaaacagccagcagaaggcaaagacauccagccaagauucccacaccuagacccagcaucucuccugggggaaauaaggaugucagcucagccuaacagguccugauccaucuuugcuggggcccgccucgugcugccacauaggacccucuuaccugugguauacagugguccugcugcagaggaagggaacuuggguuagaggaguuucagaacauuucccccacuugggagcacugcuuccacaccugagaauugaccugggcguccuuuccuggggaugauucccgguccagagguguacugggagcccuuccccucagccuuuuccuucccagggguucacuauuucacgccuuugagccccccaguuccccaucucuucugagcccugcaagucaccuuggaugaaagaagcaaagaugguccucugguugagaggcugggggacucuguaguucuguacaaggggcucagagggguccucuucuguagaggacaaugucuccuggagcuucucuaacuggggagcagacauggagaaaucaccccaagacguuggaaagggucugagguucaagcaguauucccucuccacuacucacacaccugucccauugaaaucugggcccuucuguugaagacuguccagagcacacucugguagcaggggggaguugugagugagccguuguagcggaagaauugcuccagcuguugggggaacagcucucucacgcugaagggaggcacagaggucuucugaucuggggaggacggagcgagggucaggcuuccuggacaggauuccucugagcagaauucacugcuuucuccccgcccucucccaagccucucaggucagggcuugaacguuuccuugcaguugaauucuuacuguagguuuuuagggcucaccuuuguaucuuauuucauguagacgacucagaaugugaucauaagcuggauucucagucucgcccaccugcaaaggcaaugugccaauagacacacacguuuggagugagugcugggguacacuuccgagaggccugaggauuagaauaaaggaucagagagagaccugagaggggcugggggaugcugaccucaaugaggaugccuaggacagccaggcccuguggcuucugagcugccucacucaagcugcuguaggacugggagucauagugaaccacguggagcugcagggggacagaaggaaacaaaguuaccugauguuucuuaaucccucuaaggcuuugauuucagucacccccgcaauuacccaaccugagugucuacccccaaagcuuugucuuagcucuucaauaggguuuuucaagggcccagguccauccucugagcuccacuggaccgaacccugcaucaucuguguccuagcccgaguuccccgguaccuccgcagccguggcuucacuguugaucuggugcucugaucccucgagggauccucucugaccccagugcagguggagcugggcugcuguguauuuucggggcaguccacccaggugcaggguugggggcagggaaagcugcacuguggggaaagagcaggcuaggauggacaguucccgccccagcuugccaccacuugggacauaggguucuccucuuccuucuuccccccagaauugccugguucucucuagcaaaggaaccucucugcuaaugauuaagucagugcuaugacacugcuuguacacugagcuugaucauggacgucugaucccaccuuagcugcaggagccugaaccucaauguuuuaugguuuuuguuuuuuugguuuuuuuugagacagggauccucuguacacagacuguagcccuggcuguccuggaauucacucuguagaccagguagccucaaacucagaaauccaccugccucugccuuuugagugugccaccuuggcccagcucugaaccucauucuaacguccacauucauuaauguguuauauauuauaaauuguucagacguuauaaguuagaacucuguuuccccuggcuuuuuuguuuuuuggguuuuuuguuguuguuuguuuguuuguuuuucaauauaggguuuuucuuucuuuccuuggcuuuccuggaagucacuuuguagaucaggcuggccuugaacucagauaucugccugcuucugccucucaaguguugggacuaaggcauguaccaccaggcuucuccuggcucuugaagaucuaaacugaaaacugcaguuauuugaagcuggcucuuuuaccuguauggccauuauuguguagauccaaaggcucagucccaagcuggucauauccauggggcuguacagcaggcagaucggggucaaauaucacacugucugucuggauauugaugggggacugggcaucgccuccacacucaggauaagagguuggccaaugguccugaccgugugggccugguggagggguaaguuacuauagacauuuguccaguccuacagccccaaccacccuuuaguagcccuggaccccauguuauaguggaaguaccacgcaguuggguggggcugggugaggugggaguccacacggggugacuguccacuacucuaguaagugggagagugguggcuuucacucaccuguaguuucagaacaaugaagcugaaugaggggaagaggaaauagauagaaagccugaauucuugcagaaguagaaucagagaggacaaacagccuaaacagauggaauaucuuugggguacccuaucaaguagacuugagguucagcuauccuuucugucauucacguucuccucucacacuggaccuugcuuugacuccagauaggucauuaauuagaaguucagagggauugaguuccacugucccuagagucacaguauccugccagccuuuuccuccugaccucaggcucuguccaguuucagaggcagguuggggguaggacuauuuaggagaaagagagccagaaggauggcagccagcucgcucauugugccucuccccgcccaguuuucuucauuuccacagggauuuacagaggacgcauuggcuuuuuugcugaaucaggagaugugggauuuaaugauuacagcagggucuagcagccacuuguguaagccccagggucuguguguguagggagaaaaagaggagcuagugggugaagcucaggaaaagcucuuucccucccccaggacaagucuucaugccaggugcggagguccuggggugaaaggagugccaauccaugugcaguuccaaucucaccuucauauguccaguggugaccuguaagagagggauuugggcuguggccagugcagccuggagcaauguccuggccucugcucucccuccggccgccagcgccuccuccuuuucugcucucucuuacccaccuccacuccagagcuucccaagugaaguauugaaacuggauaccuuugugaaaaggucggggguccuauuuaaaauaacuagccaggcugcaguugugauuaaagaguaaagagggaggagcaaggaaaagagauaaagccaggagacuaaaauuaaccuggauccaaaugugcaggcagcccagcccuuacuuuuucccaucuggagccaagucaguguaacacuuagaagguuggggugggguaaggcaagggugugagcagagggcuuggaagcauagaauagaaggaggaggaagaggaggaggaggaggaggaggaggaggaggagggaaagucucagugaauccugcugaagccaggagggcuuaguccuuagccuugguguacugccgcuaggacgagggcccagcaccuucagcaggaguuuuaguucuuucugcucucacuagcuguggucacucgaaucaugaacaucugcucuuucaggcucaaauggcucaagaaaagcaggagucgggguagggccuagucuauguugaggguggugggugggcacaggcagccaggcuggcaaagacaggaugaaaguguagcauuguguguagagaggagaguugccagccgggucacaugccaggaucucaugcaguucuaucucuggccaaaacgcuaggggucugagagucaccccccccccccccccacggcuaaccugcuucaaggagaaaaggaagucuucuuggagauuggcuuguucuauuuaacucuagaaacuggggggaaauacccuguuccuuuuccucuucauuagucuuuuaauuauuuuguuugagacaugauuuuacucuguaguccauacuggcccuguauucacagugugcuucaggcugaccucaaacuuguggcaguccugucucagccuccugagagcugggauugcaagcgugugguccaaugcccaucuugcuuguuauuccuuuaacugcucacaccgcuccauuccucagcgggggcaacucugcgaguagcucccccccaccccuccuucacuaucucuuuaggauacuccaacaacuagaguucucuggcuguugugaaggugcccugcccuuccugugaaaugcucugagcugauucuaaugccucuuuuuuccucuuuccaaauuguuucuucucagaagagauuugugacuccucauuuucuuuuggaucccuuggucccaucuuccucucgcuuucuagauaauccccccccccaccucguccuuccaauaaacuuuaaucccucaccuacuaugugcuggauacagaauggggccugagaagcacaaaaacaggguguagaaaccaggcauggggaggcagagccaagcaggucuaaccucagcuacagagugaguuugagauaggucuggccacgugaaaccuugucucaaaaaaaaaaguaaauaaaaauaagcaauaacaacaaaaaaaguugugggaauccuucaggcguuccagaaacaacuuagcuuguuuucuccaacgucuccccaccucucuccuaauccugaaagcccuuuguacacuauaaagagcugagcaaacguuuagucguguuccuuucagggaaauggaccagcugccccugccccuuggcagguaauggaguuauccuuugaucagcagagggucggggucugagucgggcaggacugcagcacgugucccuucucaccccugcucucccuaaccagcagagugcguaaacaaagacgggcaggagggcugcccgggacuagggcaguggggaaagaguggacuggagaacuguagcuggccgaguguccuacacuccugagcauucacacacuggccucuggcuagcucucccugucgcagagauagcaguaaucgcuggguuagagaggaaaaggaaaagaauggaaggaucuccuccauagucuuucucccaccccaugccuccccccccuaccccccagccccuaggcuucccuuucugaaaccucuccucccccacauaaguacacauggcuacggguggacauuagcacagacccaguuguaccuacccccaucugcagccaggauccaagucaccuuuaacaggagagcgaagaacaacauauuauccccacaaugggguacaagggaccaggaauuugggguuuagaagagagagguggagagggagggagagagaggaguuucuggcguucuaucucuuuucuucuugucucugucucugcagacuuccagggacuugauuuuccacagguuaacacgaacuucuggaucccaggauaaauuucuuccucucucacuuucucucucuuccucucucugcccucuccguaugucccuucguaaucuccacaccacuuacuggccagcaacuucacaguugccucccgcuuuuaagguggcucgaaaccgguguacgug

SEQ ID NO: 1582 - RNA, 1498 nt, Mus musculus
gcuucucuaacuggggagcagacauggagaaaucaccccaagacguuggaaagggucugagguucaagcaguauucccucuccacuacucacacaccugucccauugaaaucugggcccuucuguugaagacuguccagagcacacucugguagcaggggggaguugugagugagccguuguagcggaagaauugcuccagcuguugggggaacagcucucucacgcugaagggaggcacagaggucuucugaucuggggaggacggagcgagggucaggcuuccuggacaggauuccucugagcagaauucacugcuuucuccccgcccucucccaagccucucaggucagggcuugaacguuuccuugcaguugaauucuuacuguagguuuuuagggcucaccuuuguaucuuauuucauguagacgacucagaaugugaucauaagcuggauucucagucucgcccaccugcaaaggcaaugugccaauagacacacacguuuggagugagugcugggguacacuuccgagaggccugaggauuagaauaaaggaucagagagagaccugagaggggcugggggaugcugaccucaaugaggaugccuaggacagccaggcccuguggcuucugagcugccucacucaagcugcuguaggacugggagucauagugaaccacguggagcugcagggggacagaaggaaacaaaguuaccugauguuucuuaaucccucuaaggcuuugauuucagucacccccgcaauuacccaaccugagugucuacccccaaagcuuugucuuagcucuucaauaggguuuuucaagggcccagguccauccucugagcuccacuggaccgaacccugcaucaucuguguccuagcccgaguuccccgguaccuccgcagccguggcuucacuguugaucuggugcucugaucccucgagggauccucucugaccccagugcagguggagcugggcugcuguguauuuucggggcaguccacccaggugcaggguugggggcagggaaagcugcacuguggggaaagagcaggcuaggauggacaguucccgccccagcuugccaccacuugggacauaggguucuccucuuccuucuuccccccagaauugccugguucucucuagcaaaggaaccucucugcuaaugauuaagucagugcuaugacacugcuuguacacugagcuugaucauggacgucugaucccaccuuagcugcaggagccugaaccucaauguuuuaugguuuuuguuuuuuugguuuuuuuugagacagggauccucuguacacagacuguagcccuggcuguccuggaauucacucuguagaccagguagccucaaacucagaaauccaccugccucugccuuuugagugugccaccuuggcccagcucugaaccucauucuaacguccacauucauuaauguguuauauauuauaaauuguucagacguuaua

SEQ ID NO: 1583 - RNA, 18152 nt, Mus musculus
ggaguguaggcuaggggggguuggcggugccgugucauggaggcucagucucgcagcagccauugaaggggaaggaacugcgggcgcgcgcgugucucucucccucacucucucugugugaaagugugugcgugcccgagugugcgcgcgcggguguguggacucggaggugggggcagccgaguuagucccaagucgucggacuccauuugcuauucuuuucuuucucucccacacccgugugguagugggcguucgucuuugcgucucuuuucauucaucuccagaccuuuagagguuuuuuuaggguuggggauaguggggagggcaggcgaggggaaaggaggaggacauggagaugaagaagaagauuaacauggaguugaagaacagagccccggaggaggugagaugacucagcccccauaguccccucccgcccuggaucgugaggggugggcuucggggguccgggugggugcgcagggcgggcugggaagcgcgcccccacuugggguggaggcgggguguuuauuuuaaguuuuaaaucaccaggcucuugugcuuaaaauggcgaagggcuuaaguuucuaggggcauuuucgugagcgcgcgggggcucagccccauggcguccucgcagacugguggcccggcaucgcgggcgcgggcggcgugggcgcgacccccggguccucgccaccugcgaaguugguguaacuuucccgcggcgccgccacucggccggccgcggccccgggugugggacucgcgccgaucugugccccacgcucccuccgaccgugcccgcucgcgggcagcacgcgccgcggccggggccgcagcggaaucccgggacccgacggcgcgggccgcgauccgcguggcgcgcggacuuuuacgcaagcuggaggcuugugcgagccucgcugcgcucagugcggucguagggaagagucccgagucuugaagggggcccgggaggcgucgccccgacuccccgccgucggauucccuagcgguuuacgccagguccgcgggucuggagauuggccgcggcgggcggggaccaggcucgcugauucgcggccgcggcgugaaaucgagggacaagggguccgcgccgccguggucccuugacgcccgcucaaaggcgggcaucugccgggccuccacaguuaucaugcagagccaacggucccugagcccugcugauuuucgugguuccuuugcggguuuuggugacuggaggcgagagagaggugguggaaacauuguugcugugaggguuaucucugggagcaauggaaguuuucuagagcuucuuagaagauucuagaaaaacucaaaaguugaaagcugucagcaggacguggugagugauaucuguaauucuguauaucuguaaaucuguacuucucauaucaagaaauucccagcccuugggagggaggccgagguaggacgcugguugcaagugggacucugucaaacaaggcaaagcaaaucaaaacaagcaguuucucagaagucuuguggagcaaaaaugggucguccccuccgccccauccuuucaccuucaauuuggaggauugcuugacaugccuuuuugcagucucuuuccuuugguguggugugguaacaguuaaguuuauauagauaguuuauaaggcacucccauuuauuuacuuucuccuugggaaaauguaagcuggguuguauuguucuagaauccaaauuagcaaauaggaguaaaguugaagagcugggauucugacacuaggucuacaaaacucuugcugagcucuaagaagucucugguuaagaccagaauccaaaggcuuaagaauugcuuggcgugguaggcauuuaauucaaggcagaggcaggcagaucuuuuugaguuugaggccaguuuugaguuugacuacagcugucucaaaaacgaacagccagacggugguggcgcaugccuuuaaucccagcacucgagaggcagaggcagguggauuucuggguucaaggccagccuggucuacagagugaguuccaggacagccagggcuacacagagaaacccugucucgaaaaaccaaaaaaaaaaaaaaaaacaaaaaacaaaaaacaaaacaaaacaaaaaccaaaugaacaagucggagauagugucccacgagcuguuaaucccaacagccaggaggcagaggcaggcagauggauuucugugauucagagaccaugcuagucuacagagcaaguuauaggacagacagggcuacacaaagaccaugucuuaaaacaaaacaaaacaaaaccaaaacccaaacagacuuaucaaaaugucccuaccugacacuaauggugugacguaaugcaagucauuuugcauaccuaggcuucccugaggcuauaacagggauaucuuuguaccauuucugcucauuuaaauaaugccaaaguuacacucaaguagggaagaugacaguccuuguugccuuuaaauagacauuuuuuuugcucugggaauagagaaccaggguuugcuuuugugauuacaucuauucaggugcauaggguaaguuuuguuacuauaucucagaucuguggcucagugguuaugagccaccacucacaagguggcuuacaaacucccaggaguccaacuccuuuucuggccucugaaggcacugggcacauaugagguucauaugaggaaaaauggauacacauuaaaaaauaaauaaauaaauuuacugcccagagauauuaagaaauccccuucugggccgggcgugguggugcacgccuuuaaucccagcacuugggagacagaggcaggcaaauuucugaguuugaggccagccuggucuacagagugaguuccaggacagccagggcuacacagagaaauccugucucaaaaaaucuaaaaaaaaaaaaaaaaaaaagaaaaaaagaaauccccuucugagccagagagauggcucagggguuaccaacacuggcuguccuuccaggucuucccagaaccagaacccacauggcagcucacuacugucuguaacuccagucccaguuauccaacacccaucuucuggcuuccauggguacugcaugccuagggugcacagacacacaugcauucaaccauaugcauuaagaaaagaaaagacguucaguccccccucccuccaagcaugggacagacaguccauguggccuccaagcuugggacaguccauguggcagcuugagcagcagaaggagaaacaauguuuugaauauuguuuugugugauauuguuuaucuucagcugacaccccaaaggugggcugucuuagaagcuuucuaauacugauuucugaagguuagcaagguugggauucuacuggcauucaucagccuagcacacagaggcuuaaacagaaagugaugagcuucaagcuccccccguagcuuugagucuuuccccggcagcccaggugucuccucccggguguaggucaggauagugcggcuccugcucagaguccaaaccggucucgguaggaccuuuuccacaguugcuuuuuuucugccucagugauuugaaguaggcauuggacuuguuaguccaaggucagauggaaaggaccgcuuacagugacagcuaaaucacaucagguuggguuuuuaaaauacaugcuuuuaauuuuguuuuuauauauguuuauauauguguuacgcauauaaauauguuuaugugugguuucauuguauguuauuguuguuugccugcaaguaugucugugccagggugucaggagcccuguggaacugggcuuacaaggugugagcuugugggugcugggaauuuaacccaagucuuggaagaguagccagugcucuuaacuucugagccaucucuccagcccaccaucugucaguuuccuuaguacauguuaauuauauauaguguuucacuuuucauacauguguauaguauguugugauuacugucauuccucuuuccccucccuuacucucuccacacugcugauccucuuucccagcuaauccccagaaagccuucaagucucucucucucucucucucucucucucucucucucucucucauaacuccgugaguuacguuagguucucacgggagugugggugaagauguacaagaaggaccugugcaaggacuuacuguuuggcgauugaucuugcucucauuucaggcaguuuuagacugcaugguucugcauggcucaagugacucuucacucccaaguaccugggauuacagcuuccuuacuccaugcccagucugccacagacuccauggcacaagugaccccucccccaucauacccaaguagcugagaugacaaccucauacgcuggccgcacccaguguaggggauuggcauuuuuguuuugcuuucguuuguuuugagacaaggggcucuguuuuguggcuuuggcuguccugcagcuuacuauauagaccagguuguccuggaacuccccgagauccuccugccucugccuccggaguguugguauuaaaggccaccaccccuggcugggauuucuauuuugauauucaugcguuuagaaugcuuagacaccgaagggucuguuauuaugcaaacuaauuauuucguuucuucuaacaggugacagaguuaguccucgauaauugcuugugugucaauggggaaaucgaaggccugaaugacaccuuuaaggaacuggaguuucuuagcauggccaacguggaguugaguuccuuggcccggcuucccagcuugaauaaacuccggaaggugagcugggauuggcuguggggacaccguggucuucacggccaggcugauggaguucuugguuaagugaaaagaccauuucaccugccagccagaaagcuucaaguuccuagagaugagaggggaggaagggugcuggaccccggcucaguggcucuucuucuacaggaccuggucaguuccucgccacaacucaugugacuccagugccaggggauccagcauccucauaaagacaugcauacaggcaaaacaccagcgcacauaaaacaaaauaaguaaaucauuaauacugggagguggcucacacauuugggaggcagaggcaggcggaucucuugaguuccaggccagccugcagauggaguuccaggacagccagggcuacaaagagguccuguuucaaagaaaaugaaaaaacagaaacaacaaaaaaagggaacuguaggauuuuggaaucaguaauaccuagaauuuuaaauuagaauuguuuuauggcauaauauugaauuuaauaucuaccacugcccccuucagaaaauccaaaugaacacaauuggagccaugccacagauaagccacugugugggguucugaucgguuugcagauagaugggaauuggggaagcuggagagaauaaggaguguuguuuuguugaugggcaagguccucuggcuucaucagucuuuguuuuucucuccauguugaauauguaguuggaacuuagugacaauauaauuucuggaggcuuggaaguccuggcagagaaauguccaaaucuuaccuaccucaaucugaguggaaacaaaauaaaagaucucaguacaguagaagcgcugguaaguggaggguguugucacugggcuugauuuaaucugauuuguucauauucucacuaauuaagucugggauuuccuauaauaucucuugugguccagauagcuauguuucuuuaacuaaacuguccagcugggcuuggcacucagcccugagguaggggaaggaaggauggccccaaguuggcgccugggcuguagaguugagacuccuuucuuaaaauuacacgccuuuaaucccaggucuugggagguagaggcagguggauuacugugaguuugaggucaaguuggucuacauagugaguuuuaggucagccaggguuauguagagagacccugugucaaacaaaggccucaaaccaguucauuucaaaaggcacuuaaccaccaggcuugacggccugacuugauucucggaacccacgugguacauggaaagaacccacaacugaaaguuacucucugucacacacaugaaugcuuauggaauaugcgugcaucucccugcucaauauaauuaaaauguauaauaaauaaaaaauaaaaguccccgggccgugguggcgcaugccuuuaaucccagcgcucgggagacagaggcaggcggauuucugaguuugaggccaaccuggucuacaaagugaguuccaggacagccagggcuauacagagaaacccugucucgaagaaagaagaagaagaaaaaaaaaaggcaaaaagaaaaacaaaacccgggcuggugagauggcucagugaguaagagcacccaacugcucuuccgaagguccagaguucaaaucccagcaaccacauggcagcucacaaccauccguaacaagaucugacucccucuucuggagugucugaagacagcuacaguguacuuacauauauuaauaaaauaaaucuuuaaaaaaaaaaaaaggaaaaacaaaacccaaaaacaaaaacaacaaaacaaaacaaaaaaaagaaauaaaaguccaggcgauauuugaaucagugacaaauauauuuaaugauuggcuuuuauuuucuucagggcuuuauucugguuucaaguuuucaguauuuuuuuuaaagauuuauuuauuauauguaaguacauuguagcuguccucagacacuccagaagagggcaucagauuucguuauggaugguugugagccaccaugugguugcugggauuugaacuggggacguucggaagagcagucggugcucuuaaccacugagccaucucgccagcccucaguauuuuuuuaacaccuuuuuuuuucccuauauuuugagguagucugucuccuuuuuuucuuuuucuuuucuuuuuuuuuuuuuuuuuucgaaacaaaguuucucuguauagccccuggcuguccuggaacucacucuguagaccaggcuggccucgaacucagaaaaucccccugccucugucucccgagugcugggauuaaaggcaugcaccaccucgcccagcuuauuuucugauaggaaggaaaagauaaauaauacaaaacugaaaauggauauucagguuuacaguuuguuuuauuagugcguccgugcgucugugcguguugguuuucuggggcccagggauugaaucuacauugccaggcauggccaggccuuguccgugggcuuauuguggugguaccugccuguaaucucagcacucuagaggcuaaagcaacugagaauucaaggccagcuugggcuauguaaugggacguuacccugucuuuaagaagaaaaagaugggagacuaagucuugguagcccaggcuggccucccacucggaccuuccugcccuggcuggguuauggugugugcuggcacacuuggggugcuguugccuaucugcccagcuucugucagcaaaaaugccuggggugucugcaagaaacuaaguuguaagacauuugcuggggacacagcggugaccaaccaaaguuucuccacgggugcugcugccugugccugggagaguggccuuacaaacccuaaaagugcauaaacuuguucuuuagcuucaagaauauguuuuucagcucuuucauuaaaacucaagaacacaguguuuaaaaucuugauuguaaccuuuaacuuuacuuuuucagcaaaaucuuaaaaauuugaaaagucucgacuuguuuaacugugagaucacaaaccuggaagauuauagagaaaguauuuuugaacugcugcagcagaucaccuaccuggacggauucgaccaggaggacaacgaagcucccgacucggaggaggaggaugacgacgacgagggugaggcucuuaguuuacuauuuacuuguuuggagauagggugucucuguagcucuggcugugcuggaauucacuguguagaccaggcugaccccaaacagagagccaccugccucugcccacuucgugcugggaucaaagguguucaccaccaugccuggcaaccagcagguuuugaagugaccgcaaaguaaagccaacuucaguguguauaauguuugaaaauguauuuuggaaggguccuuugcagugcugggauggggucauccuugcacaugcucgguacgugcugaccuggauccccaguccuaguaaaguacuucugggucacagguaacagugcuguaaaauggguggguuugcuuuguuuccuuuuaucgagacagggucucccuguguagcccugguuguccuggaacucuguagaccaggcugaccucaaacucagucccacccccccaacuccaagccucccccucugccccucugccucccagugcugggauuaaaggcacgcacugcuauugucuggccagaauuuguucuuuuaagccaaguguaggggcacuugccaugguugguuuaagaugaaugggggccacgugccagaaggacgcagucccuaugaguaccaggaggaagcgguugccgggaugcuugcucaccuuugacaauguuuucuaaagauggagaugaagaugaggaagaugaggacgaagaugaagcuggcccaccggaaggcuaugaagaggaggaagaugacgaugaggaugaagcuggcucagaagugggagagggagaagaggaggugggccucucauacuuaaugaaagacgaaauucaggugaauggaaacuuguuguucgcccugaagacgguuggcccagggcuaagugcuguaugaguaggauggguugugagugguuuccugaugccuggaugagcauggauaagcaucugucuuuuuuucucccuccuacugggugcuccauauuauguccagacagcuguaaauacuugcugauuuucuuucuuuuuuuuguuuuaaagcccaaggacaguuuuauuuaaaaacucucagggcaggugaucuguaagucucaguagcuccuaagaggagaacagaggggagaacggaaaaacccagugccgcguaaacuggccuugaggugagaccaguggucacaggguagggagcucgcggucuagagaggagguguggaaggccacagugguagaaaagcuguaucugggcucuggccggcauccaaaaagaaugagacgacaggaaaaguugccuuuuuugacuugggucucagaaaggugggcagacucagccgaaucucauggccacucauggggacugccauugcuugcucuuuuucuccugaauuucugaauugacucugccuucaguggcacaggauggaggaagccuuuucugaaugucugagccucuuucugcaucuguauaagcaaacuccuggaguugcuuuaacaaggugaugcacauaaagccccugguucugguuggugacagugcagacacucagagacugugaucuuuucccuucaguuagcucgugacuccugcaguagcuuuucuaccuuuuuaaauuaaaaguugugugugcucagcugggugugguggcgcacgccuuuaaucccagcacucgggagacagaggcaggcagauuucugaguucgaggccagccuggucuaccuagugaguuccaggacagccagggccaugcagagaaauccugucucaaaaaaacaacaugccugugaauguguggcgugugaauguaguugcccgugggugccagaagagggugcucuggagcuguacuuacaggcgggcaccaguuuuggaagcugaaauccagguccuccgaaacagucuugaccacgggcucgugugccagccaccaccugcauucgcuuccuaagcaguguccgccuagguggacucugcucagggauuucuuccaccaagcgcccguguggugugcagauagaucauugcucuccucgugugcugugaugucucccucuugccaccaaagcauacaaggcuguccuucauucucugcugccuuaaaccuugauuagacuuccguugccuagagaugcucucauaaaaacuucucugcccuuuauugaguggugaguucuuuaaaugagaggcuguuauguuagucuuugcaucuaagagccagugcauugagugggaaauagaauauccuuagccccugggaguuuagagaaguuacucucucuucauguuaaagugagcuuuauuuucauauucuaaaauaauuguuucuuuugaaaauaccucaaugcuagggauguagcucagugauagaacacuugcugacguguguaaggccuggguugagucuucaggaccacauacacagauacacagagcuccucgagacggugucuuuugcuuuccugcugacuuuugcaaugguuagguugacuaucugauugauggguuuauuuuccugcuacuuuuguuuuguuuuaaagauuuauuuauuuguuauauguaaguacacuguugcugucuucagacacaccagaagagggugucagaucucauuacgggugguugugagccaccaugcaguugcugggauuugaacucaggaccuuuggaagagcagucagugcucuuacccacugagccaucucgccagcccccuuuuguuuugcuuuuuaagauuuauuuugcguguaucaguaaauguuuuacccacauguaugucuauauaccaugggugugauugguucuugcgucuccuaggacuggaguuacagacgguugugagcugucacgcggguggugggaacugaaccuggguccugugcaagaacagccagugucuuacucauugagccauguguccacccacuucugacaauauuuuaaauuuaaaauaaauaaacaagaauaaggcguuagguuucuuuguaucuuugugagucauaaaccauacaguggagagaaaaccuugggaugcucuuaguguuuauagggaaagccuguuuaguuuacagcagcauuuagcaugaaugguucucuuuuauguuugauucauuuauuuuaugauuugauuucucccuaaguguaaguugugugcugagguguguaguggguguugaggguuuuucugugccucccaggcugccguggagugugucugccuccugagugcugccuaaaacgucacugucaaaccaccugcgaugauugacauuagguauaauuguucggcugaauguuuggggauauuaucucaaaaugccauggccaagcacaggucagaaaucucuggauacacacagcauuguuagugcagggccgggaagccuuuuuauucuggaugggauaguuuggauguucaaaaugaagucugagugcaguugcgguagcucaggaccauacuccuggcucuccaggaggcagucggacugcaggaguuggugagugcguaggcugcuuagugugcucuaggauagucuaggcuacagggaaaccuugucucacaacaaaccgggcaaccccagagugccugcuuuuaggagcuaaguucuaggcaagcuucagagaccauugcugcuuaaaggugaaagaggcagaaauggcagauuucaguaugcguuguacuuacuccuaaagagguuugguuuuuauuauauaugugugguuaucuugucugagugucugucucuauaucgccugugugaauggugacugcaaaugccagaagaggcauaggacggcguggagcuagaauuacagaccugugugggccacgauguaacugacugcugggaggaaaucccucugguuauguuugccucuucaaaaugggaucucaccgugcagcucaggcugcccuugaacucagacucacgguccugccuaaguuuuguaagugccgggacucuguagacagggcuggcaccacugcuacaacuacaucugguuuuacguagcgcuggggagcuacaaccccuagaccucugauuugcugguuuuuuuuuguuguuguuguuguuauauuucuucucauuuuagucguucuucaggggcaaggaauugcuguguauaaaggacuuuaggacuauugggaaguaugcccuguacuauucauaccuaugucaggaaacacuucucacuaauagggcaaaggccauggucgucacugagcaaacugagugacuuucugguaaacgcugcggcuuuauugugagauguuguccucaggauggucuuuacaugccuuggaaugucaguucaauuacauuuuaauuaaaacaaaacucagagagugcuugauagcugugauuuuucuaaauuaucaacaaaugugucuaguucgucaaguguuuuauuuaaaauuauaaaugacuauuugcaucuuugagauguuucagauaccuccuccccuuccuuucuucuccccuuuuauuucaugugcauugauguuugucugcaugcaugucuuuguaagggugucagaucuauaguuacagacaguuguaggcugccgugugggugcugggaauugaaccugaguccuggaagaacagccagugcuuuuuuuuuucccuucuguuuuuucaagucagggucucucuguguagcccugauguccuggaacucacucuguaaaccaagcuagcuuugaacucagagauccccuugccccugucuccaccaccaugcccagcauagcaggcauuccuaaccacuaauuauucacugcuuacauuuggugcucaacuuggaacacacaaauguaguaaggcuagguggcuagcaagccgcagggaucuguuucugcuuugccugggccaagaguguaagcauucaacaccagggcgccuuuaauguaugugguuggcaguuugagcucaggucagauuguacaaccaucuucccagcccauugaaugauugggagacagucuugcuagguuggcuuugaacuuggaguccucccaccucugccuggggaauuacaugcuuaauagaguaugcuugaguaaacuguggugagaucgagagacccuugacugcuuguuuuucagauguacaguaguuaguaccaagcuugucuggacucggucauuuguagcacggcugggaucagagcagugaguguaaggggcuccgggcagucagaaugugagugguaagggucucccagccccagcgguauuagcguucucaggguuggaagucggucuguugucucuggcuuauguaguucugauaagcuuguugcucuucugauucgauggagcauaaaguugaaaaaguaauugacuguaaaugagaagguguauaaacaaaaagagaacacccaacuggagaccagaguuauuuuaaggugagaaugggccagagaagcggguaaaggcgcuugcagugugucuuaguuaggguuucuauugcugugaagggacaccaugacagcauuuaauaggggcuggcuuacaguuuuagagguuuaguccauugucguucuggcgggaaguguggcaugaaauggugcuggaggagccgagaggucuacaucuuuauccacaggcagcaggagacugugucacacugggugcaacuugaccucaaaaccaccuuccacagugacacacuuccuccagcaagaccacaccuacuccaaugagaccacuccuccuaauagagccucucuguguggucaagcauucaaaggcgugagucaguaguuaaacccuccacacagugcagaccugguggccagaguucaaucccuccaagccauggaaaaguguagagagcugacucugcaaaauugucagaagagcuccccguguuccaugcaugccccucgugcaugagcgcacagcaacaguaaugacaugcacauguacaguaacaguuguuuggaagggagaaaauccucagaggagagcagcauguacuaauggguggaccguucauggucagagucaucacgaugaucaaggggcugccuagcaaggcuggcaaggaccuugggucaaguccaaagucuguaaaaaaaaaaagcuggggggugggggugggugugggggucugaucacagccaguggucccagucuugagaagcaacacagaagcugcauaauggcacgugaucuuaagcccauccacggaggaggggaggaggggacgagacugccuggaugcugggauaagccugugcgucauggcacccuuguuacaauguugcaagcagggucacguggcauuuucuacuuuugguggaauguugauguucaagaaacugaagaguuguggaacauuuuggauuucagauuuuugguuugucgcuugcucuuauugguuggaaaacagaucuagagaaauacguuuuuauaguccgcauacaaccauaaccguguuugacauuaggguucagaucaucugugccucagucuguaaaguagcauggcuuauuuuaaagcaguaaaguccugucucugcuagugggcaguuguggcuuuuuuuuuuuuuuuuuuuuaauuaugguuuuucgagacaggguuucucuguauagcccuggcuguccuggaacuuacuuuguagaccaggcuggccucgaacucagaaauccgccugccucugccucccgagugcugggauuaaaggcgugcgccaccacugccuggcuagauguggccauuuuuaagcuggauagagugguacauuccuguaaucguugcacuugggaggcagaaccaguugagucaggaguuugcuugagacccugucucaagcagacaaguaauuguacaaacagugaccgcagcgugcauuuccauugcuuacuagcccuccguaccacccagcacagagagaaucugcacugugggagaauguucuccugaaccaugguaggcuaaggcacagacuguguuuauaaaagucugaaugcuuaguuagcuucaaagcaaaggaggcagaaacuguccuuugaggcacagcugaccuguaacgucauugcucuugugaaacaguagaaguccgugucgugguuuacucauucucacauugacuuugaaggaugaagaggacgaugaugacuacguugaugaaggggaggaggaggaagaagagggugaguugcuuggccagaagaacauugugaaucuuagcagauguugagucuguggugggaucgcccuggcccuggagccuuuaauuuuguuguuuaguauaaugcgccuagacacauagucaagugauuugaaagacuaguuuaauucugccaaaacaacaacaaaaacaauuuauaaucuguacuuaaagacagaaaugaggggcuggagagauggcuaagcgguuuagagcacuagcugcucuuccagaggaccuagauuuaauucccagcaaccacauggaaagccaggcauggugguaauucaugccuuugaucucagcauuugggaggcagaggcaggggcgucucugauuuugaggauagccaggguuacacagagaaaccgucucuugaaauacacacacacacacacacacacacacacacacagagagagagagagagagagagagagagagagagagagagagagagagagaugaaguaaacgcuuauuuguauuuccuugcacucuggaaucucauuuguaaagcguaaagccucugugcagagaggaccuuuagaauaguguuuaccuaagagucacguugucacgcacuuggucuguugauugaccagcgaguugugguuuguccgugagcaugucucuucuguagagucugguucucugaaguccuuuauauucucgaacaaauuucagaguggaaacaacuuauauuuucucuugauacucauuuucuacuaagauuaaaagcuuuguaaaauaagaaaaacucaguuguuaaagucaaguaucuuacauccuuccauuuuagaggaagagggucuucggggagagaagagaaagcgagaugcugaggaugacggggaggaagacgacgauuagaccuccaggaccaggccaccugacacuccugggcgcuggagagcgaucacauugucuuuguuucuuuauguaugauagcugucccaguaggagaugauguguaacuuuuuauaggaaaagugugguuuuacuauuuuggccuuaccauuccgguuaagauuugcuagucuguuaaucauaauguucuuagaaaagaauucucauucaucuucccauagugaaauucucuagcacuguauuuagauucuggauuuuuauaauucaugcuuaauguauuagacauuuuuagcccauaauuaaaacauuguugcuuuuacacagguguaguuuggugcauuucauucauaguguuuuaaaguuauuuauaaauuaaccaauuacacucagcuguaauaugaaauggcaguagucuuuugaaugauaaagcugguuuuuuuguuuuugguugauuuagagacgauccggcugucauuagcuugaaggcauuuuugggggugggguuaggguaucugaaggcuuuccuaucaugguuugggaaguagaagcagagcgagaggguucucuucagaggcaggucauggacucaguucugcucagugacaguucagggcccuuuaaggagccugucccuuucuaaggccagacuugccguggagcggucucuggguggccgugccagcaggcugucggucgggucagcuguguguccccucccagcugcuccagaagguucugucaccuucauugcuucauuccuguucccauccaaaagaaagcuggcaaaagcuguaaugccccagagacuucaucugcaccucagccaucugucucgguuucaaacaaguggcauggaagagauggagcauucaaguuacaguaccgagggcuucgugucagaggcaggcguugcugacggcccgagucugcuaggauaagcagcagcguccucucgcagaggucagacugauugccagcugagaacugaugagacguucagggcuaguuucuaaguuuuccuagugauuuggauaccaacucugugaaguauuuauuauguuucugagagcaaccuuuaauucuuccuguaguuuugaaagcgugaucaguuguagccuuugauuggaacauaguggcaauaggagacuguuugaaaaucaaucuugaaguguugguauuuauuucaaaugaaugucugaaaaauagaaaaaacauuugggguacggguauguguuuucucguggcuucaaacaugagcggacaggccccucucucucucucccuuugucccggaagcuccaugcacaaggcacuugcuuuuuaagucuugguugccaguuuuuguuuuccuuuuguuuuauauacuucagguggguuuuuguuuuguuuugucuuuuucuuucuuuuuaaacuuagcaucagcauacguauuuugccucucuucugggacacaucgaaauugcaacaguggggcugcugcucuuucaacuucacaugucugaccugguuuuuaacauagcaaguaugaacuuauuuguagagaagcuaauaaaaguugcaugccugacugagauaaauguguacugaguucagcgcaagugcagggaucgccaaaggauuggcuuuguuuccuuguuucaguaauuggaacuccugcugucagucucuaaagaauucucuuugcaaacuaugccagguucaaaauaaaugcuuauuuuuaaaaaugaaaucuauauauugacuuuuuaucaaucaucuauugugcaaucaaaauuagaguucuugaguuuaaaaacaacgcauagggccuccagauaacuauuaagacuuauuuagcuuagugggugguauuuucaugcaaauaagcaaggguggguuuucuauucuguagaaguucuggguucuguucuaacccucucuguacugugcguguguauaccauaugugaaguccuuagagacuuugagguugauugauacuuuugugcagcugugcuuugacuaacgccaucacaguguuaaacacgaggacgggcagcgcugaucaugggguucugacuauuuuguuuuuuuucccuuacugcuguaacuuaaguuuuugaaacugcauugcuuugaauaaauugaagcguuauuaauaaugacuagcu

SEQ ID NO: 1584 - RNA, 1489 nt, Mus musculus
agagaaugauagccaggcugcaagggcugcagaagggccgcgugccugggaggcuuagagagagacuuccgggaugaaagguuucuagggagaaguggggcacagcuccuguuggcagggggcuuagggcaguagguggggaugggacaugggguauugcccugggaccaccacccuagguuuaccaguuuguuuagggcuggagcagagagggagggucagagacacuugugcucggccccuccccugucuuuucacccuagacaacuuccagcuaugcugugaaaaucauaugcaaauuaacucauuagcuugccuggcuaacaccucagacgucuuccuaauggagggagcgguggacuguacuuucacaggcucccucaaacccuccugaacagcuuaaggagagaaacaggcagagcugaggggcuauuacugaaauaagagccaagcaucccgugcuuaaauguaccugucucuacuuaucaccccuaguugaacuccguguccuggacucccccucuccccauccuggggccucccagaggaguuucccucuucuguucuuuuggguaagaagacagagccaggcugucgggagggagggugaaucuaaacauccuggaaaugucugucagcagcuucgcaggagaaagucaccccagugcaaccacggagcguaagaguguggagugguagagaaagaggggccaggaggaagcuagcauggcuugcugugaucccgucgugguggcuagguucaaaacauuuuuacaugaccaaaaaucuugcuggcagccgcccaccacuagcguagaauuuagguugcuuuucuggugugaagcauggcguuguguuaaguucccaaaugguugcagaccaggaaucacgcuuuucccucuuugcagcugucuucagcgcugugccuggagguaccucgaaugcccucuucagaagagagcgacgggcguggcuuguggcccauucaaggaugugaaguagagcggcagcaauggaucgauccaucaaucuaucgaucggcccuguggucugugccucauucaagcugugcucuggccuccugaguagucccagcagccuucgaagccacuguggacaccacuguggaccacgggcugcguuuacagucaacaacucuaguuuacugaggagaaaacaagacuuuuauuaagccaguuuugcccagggccucuuaaccaagaagugagaguuggaacuugaauccagaucccugugguuucaaagccaggcucauuuaucacucgcaaaggcuggugcugggacaccugccggggagcuggucugcuggcugagggguccagcaucggcuuuucuuggucucucuagagcccugagcuuuaauucuguaguucaccugucguguuccuccaaugucugcugcacauaucccuucccuggagauguuuggcauguuaggacacaugugucauuauuguugucuuuuacu

SEQ ID NO: 1585 - RNA, 8191 nt, Mus musculus
guugaggcggcagcaaaagcaaugaauuugauuuuuuuuuuuuuuggauugagguaaauaaaaaagcuuuauccugcaacauuuggagauaaagagucugugcccccccaaauuucagaccugcccccccuuucacaucaggcucuuccgguauugacugugcugggaggucugucugaggugggaguccggggucugcagguccaucugccuguacaggucucucagcucccggacuuccugcagcacucucuuugccuggcuccaguuggaggaagccucucccagcagccucucugucuccagcagcagcugcuccgacuccgagucggguggagacugugggggguccuuggccuuccgcuugccgucacccagucccugaaccucugccagcagcuccugagucuucuccaguuuccuugcuaccagguccuggauccgggacagcugcccuggcugggcagggacaggggguagggauuccucagcuugaaggugaagggggcgggcuggggcagugucccucugggauaggaucuccuccagggaggcacaucggcucuucucuguacuggggaacuucuucagugcuugugggguguagggggcucccuugucugguuuuucccaaggccgagaaaggcugcuugcccgcugcgaagagggcuggauccugucugaguccgcucuccgucgacugccagccagcugggccacagacuuguccagaucgacccggaagcucucagcacaagaggcuggcuccucaggggaagggucuuccucuuggaucaggucuaauguuagcaucccaucugagguagaggucgaagccugggaaagagaugugaacaaaggcagugaacggauaacgcaagcuguggucccuucccugaaggggacgccuccacuccaaccgagacccucucccccucuccgcuguguuugaccccugugaugacgauuugaguuccucugcuucucuguaacuuauccuuuccugcacauugucuguguucugcuccucuacaagcuucgcagggcauggcuacuucuuaagcaucauaggggcggcccacgugccacaguaagauccacagacagacggacagaggaggaggcuccucugccuacauuuucucagccacacaccuuagcuccgcucugauaucugaacucugaauccuugccuuguaaugaaccuuguugucuucuuuuuuauauuuauuuuuauuuuauguauauugguguuuugccugcagcuaugucuguaugaggguguuggaucuuggaguuacagacaguugguagcugccaagugggugcugggaauugaacccuggaccucuagaagagcagccacugcucccaaccgcugagccaccucuccaaccuguuguucccuuauuucuuaaguacuguaaucgaacagaagugguaaagggaaugcaguauuuucugugcugucacgugugugcuguugugaccauuucccucagaaccgcuuuccuaaaggacucgccacugccccauguuucaggcagcccagagaccauggauguuccucaggucugcucacuccaaggccugugcucuuccaccuccaauggacagccucucccuagacuuggagcaaggcuggacgugagaaaccacuacuucauuugguagaggguuagccgugggguguguggcacuuacugucaccccucagaguggccggccaccacacagcagcacacaucauucugaacacaacacuucugcuuuucacuguccuagggguauuucucauuuccucagaaguuuuugagaacagagaugucugacuugugcuacgugcugacuaaguaauuuugguuuagaggcaucagacagggacgcaggguggagaggucucccgagccuuugaucccaacagugcuccugcucauacacagcugacggaccagcccagaacuggccccugggcagugcuuacucucuugcaguuuuacauaccacagccaugagguguccccggguuggaggacggcgggaguguuggauuuuugcucugucucgaguagggugggcaagauagcuguccuccucaacggugaccugaagagaugcacugugagucacagggcuucuuuaggacuuugucccaacugaguuuggcaaacccuaacucgccuggacugggaagcaggccauuccaccacuugcuucugagcaggguauaggcacaaggauuuacugacccaacugacccaggacuagauuaagcguugugaagugggugugggguucgaaucagcagagaaaaggcuuaagagagaaaaggggugggggugggggaaugacacaacagggccuuuaaagaagcugagaacagucaggacuuaguggcacacuccuauaauuccaacacuugggaggcagaggcaguuggaucugcuagucuggucuacagagugaguuccaggacagccagggcuacacaaagaaacccugucucaaaaaaacugggaaaaaaaaggccaagaaacugaucugggugaaacuaaagggaccccacaaagcaccccuccucaucuagugagccacagccugcuuuccgcccuaguaccccaucgcugccccacagcaagccccugaccucauccaagauacgguuuuuagcucugguaauggcagaacucagggcguugauccaugacuccuucucuucaggacucacggccaggaagaugagguugggugccugugaggggaauguucuugucuuagcuagggcauuacaaauacauuauacccacccccugaaauaauccucucacucccucacaccccgcucccggaagggagacccugcuucugggaugaucagugacggaaggaacccagagucuguuccugcagaacgcacggguuguuuuagcaaagauggguguggagguggggcuaagaaagugacacuggggacaacuaggggaggugugaaugcacuuagaucuuuaaacgucugaggacacggggugugacaaccauggcuucccuugaacuucagacacccaucagggaagaagcaccaauaauguuucucccaagagaauauguacauacacacaguagggaugugugugugugugugugugugugugugugugugugagugggggaggggagaggaagggguggggagagagagacuucuuuauggcuaaauagguuauaggcuggccugcccagaggaagggaaauggucagaauauuuuccaguuaaauaauaaaagccagagggaaaauaauuauggccccugcagcuagggccacagcgagggcgagccuaccguggugcccggcugucugcaccgggccagggugaacuugcugugauuuuucuugcuccugcucuuggauuuccggagcucuucgcacuucucauagucacucaggucaaacaccuccugacuguuuuucucaucuuuuaccuaugagaggguggggugucaugaggauaaaauuacucuuucucuccuccagaagaaaguggagcaagaaggacagcaggaagccagcccaccuaagguguguacuggggggugggacugagaccugagucccuguaugguggucuguuuaacccacuccccccaagcuaccguccccgugccucccucugcccaugacccucugucucugaaggacgcagcuuacaaguccuuaaaggggcauguccuuaaagggacauggugaauggacugcucugaucauuccaaguaaggaagacaagagugaccacuaacguccaggggaaggggaaaggcagccaacaucuggaagggacaaagggcaacaucuggaagggacaaagggcugccucuggccucagggagugaguacgaugguuccgaguguucuuuccaccugcucucuucuaucguaggauguuacaggagacuacuuccugacagcaggcuaucccucucuuccaccugguuggggauaucccaggaaugagcuggucaugucucccugggaaacaguugaaaccaagcgaacguguauaagaaggcucagcccguggccgaucugcccauccuucugaauugcugagcacaugugcugaggaggaacguggggaaaauucaucuauugccauuugccuggcaagguuuggcuccccagggcucuccccuuucuagggcucccugcuuuuugacugggaagagggccuuaaacacucuggagaaucacuccagagagauucacagcaacacagucuggaaugugggaugauacagcaaccuccucuccugugccuuucccagagaaacuaucagcagaggccagaaagcucggagggcaggaggcgagggaagagcugggugugugcagccaggggaagggacucacuuguucuguuuucccaggggaagggaagggaaggggaggggaggggagggaagggaagggaagggaagggaagggaagggaagggaaggggagggaagggaagggagcucuccuggcguggacaaggcugauaaggcacucugggagugggaugcauugacagaggucaggaagggcaagggugggaggcugggugagguaggcagcaggauaaguagaugccagugcccagaaaagacagauacccuggcaccuugcucucuauuguauucugucucuuccucacaccgaauucccaaagucucauuuaugacuacaucuuccaaauuaacccucugucucucggcccacaguuguaccaagcauucaaccuaacuuccucuacugugaagucucccuaagguauggaucaguuccuaccucugguccuugaucaggucagugaagggaugcccuuggagaguuaggaaugacccuacaacauccacggaagggcuucucuagagaaaggaguugugggagaccuugcuuuccccagaaaggaggacugagacagaaugcuuagcaggguucccuuccucuuuuguuuuugcauguaaauugcaaauacacucugcuuuugggucucacaucuucagugcguugcuuugcuacugcuuuuguuuacaggcugaauaaacagugucuuguggcagcuuugcccuuagcccaggcccacuggaccauggaacugguucugaagaagggucaguauaaggugccguucccucuuuuccacugcccuucccagcagggggcaucuggccccaggucuagucagaugcuccugagucagaggacagcggacacucuaggcugaggucauccuaucuucucucugcucugcaucucucccucucacaccagguucugccuuuuagacaaacauaagaaggggaaaaggccuuguuuuguuucuguagcccuucacuguccucugguuuccccucggaccuguaggaagcccuuccugauugcuaacuacauuuccuggcauuaugaaguucggggaagacaggagauaugaggugacacccacugcugcuuuuaaaauaaacaaaaauagaaagcaagagaaucguugggggagcucucuguaggauucgagagcagguagcaguggcccucgagagcacacucggucaaggcuucccuuagcuugcucugaggccucuccaaccguuauguuuuggccccuucaagaggggccugggggcucaacacuaguucucugcuugucucaguagacugcuuugagaugaguacagcucuccagcugcaaguguaucugcuucgacaccauaaaaggcuuuauuuacccaaauacaagggcagaaaacaagugucuagugacaaaagcagaacagguuagagcuaagggagggcuucccacucgguugguuuugggugagggcaggcaagggaggaagggccagucugaaagggacaggaacaggccaccaugaucagacagucacagggaagcaaguucaguuucucagcauucuuguuauugagucaagaguuggggcuucacaaagggggaagggaucuggauuccacgaccuggcuuuauauucugaccccaugugccgggcugugguuuccuguaaaacuacagagccaaagccauggagacacacacacaggcgcucacaguccuaacuccauucccccugucuacaaauaaagaugggcagaauaugaguuccuugaauuuuuuuuuucuuuuuucuuuuuacccuuuaaguggaguggacggugaggaacaagccugguucaggaugcuagcuccuacaagaauccggcauucaccgcugcucuaccccuggucccagagacugccuccaaguuguguuuucuaugauuuagggagacugugcuacucaggggaccuacauaugcccuccucccucccaacccccgcaggaacggagagaguggugggcugggguggggaagacaggaaggaucgagggauacgaauaccaguguguaacaaaaacaaaccccaccaaaacccccaaccguauuuuagggggccagaauagagggagaggcggcggaugucagaacuucugagaaagguguccgcaaaggcacaucaaauaaguaaacuccuaaaccccacucagguucucucacucgggggugacuuuuuucugcagacacaggacuuuugcgaccccugaacuugcagagauggaggcggggcaagccggagaacuagccgccguggggacagggucccgacggcucgcgcaagggcgggcgccuaccuccuucucggagacguagagcuggucgccuuucagcaccacauagcgguuuuuccaaaucucccugaaaaucccuuucccgcagaauuuccggacccagccgaccuucucgggcgccgcagacugaugguuuccauccggaggccccugcccggggcgagacgaggagcggcggcucagacuggucucugcgcccuccccgccccccccgccagccccagccccauuguccgcgcgccgcgcacucacccgcuugccggagccgcucuucuucauggcgggaucgggcggccgcgcccgcugcucgcucggcggcucgugcuagccgcaggccgggcccccgcugcccccgccgcccccgucgcccaugcccgcccccgccgcaccggccccggccaccgccgcugacgucgcgggcuccgaaugaagggcggaccgcggcgccgccgccgugcgcuccccgccccccgccuuuguuuccgacccggcacccggcggaggcgcgagcggauaaccgggaggcgcggcggugggggcgggcccgaggcguggcgagcgggauggagcggaggcgccgugggagagcggccgccucggacccgcagacuccggcuggcggagccccgggagucuccacucucgaccuacugccgggcggacgugagcgccccgcgaggccugcgguaaacacgcgugcagcggcggggaggcccggaggacgcucggaccgcgagcucuucugaguccuguguuucugauguggcuuggagggagcccaaguuugagcgcggcuuuccucaccacuccugggucucuguuccccuaccugguaaaaggaggaucagcugacccaugaaagcccgcgaggacccaacugugucuuuuagguucaauuacuaccagacaguaagcuaauaaaccugguguaugguaaacacaaccaccacgaaugaguaaagcccagagcaggggaauuauuuuuucccagagacguccaagaugaaguguugguaaguuugugguuugaggaguggaggauguuugggcuuuuugggagagaauuuaucaagaaagauaccucuucuuagacccaccgugcuucccaguccugcaaucucacuagccauauaauugacuucuauuucagguggauacagaacuuuaugcuuucaaaaugcucuuauauuggcacuuuagaaugucgaguaccauuuuguaaggcauauaagagugaggauauuaucccuugggaaaagaucaguccagcacagggaaccauuugucaugcucaaacugacacacugcuguuacaugaguuagcauagagguuuucuaacccgggucugccuuuuagacuuuguacacguguacacagcacacuuugcagacuacccccuacacacacagcacacuuuacagacuaucuccuccucaucucuguuugguacuggccuguuuaaagggca

SEQ ID NO: 1586 - RNA, 441 nt, Mus musculus
cuuugcacuuugcaaacuacggcgcuuagacggccgaggaaccacgcaaagggcugaggccugagaacuuugaguggggcuuggagacaggaaaacggaagggccagagccgagugacguggacucuggacgcuggaggcuaggguuggaaacaggcagcuacaaugaagcugaaucagaacaccaugcuagugggcaagaaggugguccugguacccuacaccuccgagcacgugcccagguaccacgagcggaugaagucagaagaauugcagcaucugacagccucagagcagaugacccuacagcaggaguaugagaugcaguguagcuggugugaagaugaagacagugaggaggcccccaccccaggcagccuccacccucccuuucucucacuccucagcugcugccccuccgggggcaucacuaagcuaugau

SEQ ID NO: 1587 - RNA, 441 nt, Mus musculus
aucauagcuuagugaugcccccggaggggcagcagcugaggagugagagaaagggaggguggaggcugccuggggugggggccuccucacugucuucaucuucacaccagcuacacugcaucucauacuccugcuguagggucaucugcucugaggcugucagaugcugcaauucuucugacuucauccgcucgugguaccugggcacgugcucggagguguaggguaccaggaccaccuucuugcccacuagcaugguguucugauucagcuucauuguagcugccuguuuccaacccuagccuccagcguccagaguccacgucacucggcucuggcccuuccguuuuccugucuccaagccccacucaaaguucucaggccucagcccuuugcgugguuccucggccgucuaagcgccguaguuugcaaagugcaaag

SEQ ID NO: 1588 - RNA, 2437 nt, Mus musculus
cgcgggacaccuccuccuccuagacauuccccaaggaccggacgagagcgcggcugacugcgacuuaugucuagauuggccuagacguccuaguugagucuuaguccugggaagggucaggcggguggacgcugagugagggacaguguuguguaggacaagggugugggcagauaggggcuaaaugcuugggacggucagcgagaaccgcguauccgcuccgccgaggcagggcaugaaccaaagagcgacaacagacuaacuaccagggggaaccacgggcaggaugggcaaggaagcagaggacacgacacucuuacuuuuggggcagggccaggaaaggccaccaagaccggcuaccgugacacaacucuuuaucugauucaguggguggcucugaaaagagccuuuuuaggagcucgcggggguuauaucacagagacgcgggccgacgcgagcaguggccucacuugcccuucgccuuaugguggcucuccgucuucuugggcagcagcacggccuggauguugggcaggacgccgcccugcgcgaucgucacuuugcccagcagcuuguugagcuccucgucguugcggauggccagcugcagguggcgcgggaugaugcgcgucuucuuguugucgcgggccgcguugcccgccagcuccaggaucucggccguuagguacuccagcaccgccgccauguauaccggcgcgccggcacccacacgcuccgcguaguugcccuugcgcagcagccggugcacacgccccaccgggaacuguagcccggcccgggaagaccgcgacuuggccuuggcgcgggccuugccuccuugcuugccacgaccggacaucacgaaagcgcaaacagacgaacggccacaaccaggaaacgguacuccggcgccgacgccucacccuuuuauagacgcagacccgauuguccgcccgacgcucucauuggcucacacgcguccugacgccguggccaauaggagcgcgcggacagaagccucucauuuacauaagaccggcucccucgccccggcgccgcccuggaacgcgcgaaucacgacgcgcgugcucgguggcuucauuugcgugcggccgucguugcgacacuccgcgggucgccgggcggcugggcuugcucgcuguuucuccugcucuggaagcuggcaaagugugcccugcauccaagagggccugaguuaaucacuuacuuaaguguagguuuuccuucgaggaauacuggaaauuuaguuuuuuauaccuaaggaguagcggauaauucucauagccucuuuauuuuucuacuugaaacaguguaaaaccuacuuguuucauuuuaagcguuuaucgcugggagccuuacuuuaaaaucguuaaauuuaaagguuauuuucuuaauccauacacaucugagagugcuugaaaagaccaaguacaguucgccugggguuuacuaaaauuauuuuuuugccacucagauuuguacauaaggaaucgaaauaacuuaaaaaguaaaccuuacgcugcugcuuuugucuaucauuuguccugauggcucucagaagcuccuuuuaggagccuuccaggcugucuggggcuagagugacucggaguaccauauccggacugccauuauuuuagcaucgcaucaguuaugcucgguaaaauacagccagcauuuuucaaucucugaaauuuguaauaagguucguuaucgaugcauuagaaucacugauuaggcauauugaguguaagcuuagcucuaguaacagguauauuguuacauaguaacauaguuacaaucuuuauauuuuacauuguuacauauuguggagauggaauucuagucuuguggaggaaucggcaagaguguagcacuaggauuuuggguugaagcuagguaggcaguggauuuuuuuggauuuugguggguuuuuuuguuuguuuguuuguuuuuuuuuugguuuuuucgagacaggguuucucuguauagcccuggcuauccuggaacucagucuguagaccaggcuggccucgaacuaagaaaucugcuugcuucugccucccaaguacugggauuaaaggugugugccaccaccgccaggcuuagguaggcaguguuauuaggauggcuagcugaaaagcauuuuaaguugagaaguugaagguuuaucaaggauucugauuaaauuugauauugauauuuaugugcauauguggacucacaaauuugagagguggaucaaggguucagcaaagacuacacaacccugcauuuauggacugacugcagaucacgagaaugacauccuaugaccuuagaauauacuuuugauccuuaaguauuugucuugaaauauaauuugguacguguuauuccugauauguguuauuccuauaaaggauguuauaacauugac

SEQ ID NO: 1589 - RNA, 2833 nt, Mus musculus
ugacugcgacuuaugucuagauuggccuagacguccuaguugagucuuaguccugggaagggucaggcggguggacgcugagugagggacaguguuguguaggacaagggugugggcagauaggggcuaaaugcuugggacggucagcgagaaccgcguauccgcuccgccgaggcagggcaugaaccaaagagcgacaacaaacuaccagggggaaccacgggcaggaugggcaaggaagcagaggacacgacacucuuacuuuuggggcagggccaggaaaggccaccaagaccggcuaccgugacacaacucuuuaucugauucaguggguggcucugaaaagagccuuuuuaggagcucgcggggguuauaucacagagacgcgggccgacgcgagcaguggccucacuugcccuucgccuuaugguggcucuccgucuucuugggcagcagcacggccuggauguugggcaggacgccgcccugcgcgaucgucacuuugcccagcagcuuguugagcuccucgucguugcggauggccagcugcagguggcgcgggaugaugcgcgucuucuuguugucgcgggccgcguugcccgccagcuccaggaucucggccguuagguacuccagcaccgccgccauguauaccggcgcgccggcacccacacgcuccgcguaguugcccuugcgcagcagccggugcacacgccccaccgggaacuguagcccggcccgggaagaccgcgacuuggccuuggcgcgggccuugccuccuugcuugccacgaccggacaucacgaaagcgcaaacagacgaacggccacaaccaggaaacgguacuccggcgccgacgccucacucuuuuauagacgcagacccgauuguccgcccgacgcucucauuggcucacacgcguccugacgccguggccaauaggagcgcgcggacagaagccucucauuuacauaagaccggcucccucgccccggcgccgcccuggaacgcgcgaaucacgacgcgcgugcucgguggcuucauuugcgugcggccgucguugcgacacuccgcgggucgccgggcggcugggccugcucgcuguuucuccugcugaggaagcuaacaggaauagagccgguagcacgcguaaacuuggccacagggcaugguguaccagguguaggugacuggcacaggcugugaguucuuuccucagcuccaucuuugugcccaaacuggcgagucgucccggcagagccaggcagccuuacccuguuuccuguaugaaaccacccacggugucucugcugcuuccuggguuuuuuguuuuuuuguuuuuuucucuucuaccucccauugacauuagaaaucauuucuacucaaguuacaugugcccuugaaugaggaguauuaaguguagggguaucuuucgacuuugcaggggaguuacauaaaauuaguguuaauauauugucagaauguaggaaagcauuaggcaguccauuuauuaaaguaucagcaucggaggcgucugugaaguaacuugucuuuugggucagaaauugcuuaacuuggaucuuguuauuuuuuagugcaguuuucaguuuacauacggugacuaaauuuccuguuucaggucacaagauuuaagagggauuuacguacagcuuguuaaagauugaagucuuaauggcacuuuguauguuauuucauuguaguuuggcauauucugggauguaggucaauggcacaguacuuuccuaguuauauacgaggucuuaagcaccacaccagaaauucaaucagaauuguuuagccacacagacauuguugcuuguuuucuguuugccuuaguuucacuccccccacccccuguuucccugagugucucccaccugccuuugcugcucuucagucagcucugccucuccuuuggcccugucacauugcuauucccauagugucaaugcucuucucucaucccugcagauugggucccaggcuaccuuggguauuucugcuccaaguuaccacaugcuucuaaaaacagaaagagauacacuugagccagacucuuguauaauuaacucccagggaacguccuaaacaaguaucuacccaaggguauggaagugguuuggcuccacacugagcugcuucgggaacauugucccuaaagaagcaggcucuucugaaaaacauaaauagguuagcugaaagcugacuguaaguguggugucucugucuucgcuugaugucugucuccuuuggcuaaaggcagagugaaguuacuguuuuaccuuucacuugcaucauagcaaaugagggccguuacccacgaggucagggccacucccuagaguacaagugagagucagagugauaucuucccgaaucuugcagguucaaaccguagcacugaccagagaaccaugcaucugccuccuaggauuccuuaauuuugcuaacaucuugccugcccagguuccuccucuacuuaaggcuucaagcucauucaugucaauaucuguagauagacagauuuucggggggugggguuugcugggccuauauucuucucaauauagcuucuugacuaaaucucugauuuuucuuuuagacacgugguugagccuugccuuagggugucuacagcccaauccuuuacccucaaaccuuuggcuacuuguucauuuuguugcauaucaugaggacacuggcauugguuuacaacuucaggcuuuguggacaggcugaagugaaagcuauguugguugacaguacugauuuuguuacccuacuaggugaaggaauaaaccuuggaacuaag

SEQ ID NO: 1590 - RNA, 3055 nt, Mus musculus
cuagcaguguguuaaauuuuuauugggauuaaaaaauaauuaaaauggcugaagagauggcucagcaaauagcaucuuuggugaggaucagguuucaauucccagaacccacauggcaucuauaacuccaguuccaggggauccaucagccucuuuuggccuccucagguaccagguagccauaugauacauacauauauacauaugugcaaaaugcauucauacauauaaaucuaaauuuuuuaaaauuuaaauggauuuucaagauucuccuucuagauuguuacuuagugacagugagaaaccuugcuaaacauguaaucuuagaccaggguuguugaggguguuaacuaaggcaagaaagagucuggacagaagaauaguguuauacaacucaaaagcauuuguaaaguauuuggugauuugugaguuuugagcaaaggacaaggaacuucuaauagaugagaggggggaaaggaaaguuaucuaucaguaaaguggauaaucugaaauuaggacaauuagaauggaaccaaaggaacguuguuuguaggucagccuuuuacuaugugguaccucuaacacacacacacgacuuacauaccaucaucauaguaauuaaauuugaauggaguaacucaccugauagcaggcagauaagauacucaaugcuaaaacuuaaaaccuguaauguaaugaacacgaggaucucccaaguaaacuaucaaaacauuggaagguggcuguaaacaucuacuccaaaaacauagaaaagcaacgcauguuagcaauaaaguauacuaauuuguaaagggcaauauaaguagccuugcaaggccugacacuuggcuucaaugagccaggugcucauuuuaaaaaaagaaaaagcucuaucaugucaaauuacauuagaagggaacgaaaaagauaaaagaaaaacgaauuaagacugauguuagaagaggaaugcagagguugagcaccuggauaagauauuuuagucacugcgcucgcaauugcccccgaaauuagcacauucuuaagcgacuauaggcaacuauuaaaagaggcucgguggacaguaagcaccagccacugcagaaaccuagaagaaugcaaaggcaauuuaagacaaaaagcugaauagcucuuuccgggaagcugugguggcucugaaaagagccuuuguggggaauggaugggagacagggcgcuuaagcgcgcuccccacggaugcggcgggccaacuggauguccuugggcaugauggugacgcguuuggcguggauggcgcacagguugguguccucgaacagccccaccagguaggccucgcucgccuccugcagcgccaugacggccgagcucuggaagcgcagguccgucuugaaguccugcgcgaucucgcgcaccaggcgcuggaacggcagcuugcggaucagcagcucggucgacuucugguagcgccggaucucccgcagcgccacggugccgggccgguagcggugcggcuucuucacgccgcccguggccggggcgcucuugcgggcggccuugguggccagcugcuugcgcggggccuugccgccgguggacuugcgggcagucugcuucguacgggccauggcgaagacggaagacacccaaacgaggagcacucggggaccugauaccggcccgagccggccgccuuuauaggcgcagucuuccccgcggcggggcggagacagcgacuugaaacucccgcgcugccgcgccauuggccguggcgucaccggccccgaccucgcccauuggcucgggcccgccacgccaccugacccgcccccccccgccccccacguccagccccgcgcccgguccacuugccaacguucugcgaggguggagccacgucuggcagcugcccguagagggcgggucccggcucugcccaagaggagcucgcgcgcccccgcccgccgcccaaagucccagggcagaacuaaucuaguguuugugcagcaccgcccagccacagccacagucccagccccagucccccaugaucccuagagccggccgcguccaguccucgcgggacaccuccuccuccuagacauuccccaaggaccggacgagagcgcggcugacugcgacuuaugucuagauuggccuagacguccuaguugagucuuaguccugggaagggucaggcggguggacgcugagugagggacaguguuguguaggacaagggugugggcagauaggggcuaaaugcuugggacggucagcgagaaccgcguauccgcuccgccgaggcagggcaugaaccaaagagcgacaacaaacuaccagggggaaccacgggcaggaugggcaaggaagcagaggacacgacacucuuacuuuuggggcagggccaggaaaggccaccaagaccggcuaccgugacacaacucuuuaucugauucaguggguggcucugaaaagagccuuuuuaggagcucgcggggguuauaucacagagacgcgggccgacgcgagcaguggccucacuugcccuucgccuuaugguggcucuccgucuucuugggcagcagcacggccuggauguugggcaggacgccgcccugcgcgaucgucacuuugcccagcagcuuguugagcuccucgucguugcggauggccagcugcagguggcgcgggaugaugcgcgucuucuuguugucgcgggccgcguugcccgccagcuccaggaucucggccguuagguacuccagcaccgccgccauguauaccggcgcgccggcacccacacgcuccgcguaguugcccuugcgcagcagccggugcacacgccccaccgggaacuguagcccggcccgggaagaccgcgacuuggccuuggcgcgggccuugccuccuugcuugccacgaccggacaucacgaaagcgcaaacagacgaacggccacaaccaggaaacgguacuccggcgccgacgccucacucuuuuauagacgcagacccgauuguccgcccgacgcucucauuggcucacacgcguccug

SEQ ID NO: 1591 - RNA, 867 nt, Mus musculus
ugagaucccgcugucacuuggggaucgguggccaccaggggcaccacucuggcgagggcgcggccuggacgcccagaaggacuacgauaaggaaccuauuacgcuuuaggguacgguccuucgcagacccuaagcagguaccgacgagggacuggucaccccaggugugugcuggagccacugagcggucccgguuuggaccugggagaugaguguaggaaaggcguucauuggaaagggaagacaauggggaaaagggagaggaggacaaggugggagccacccuuuugggagcugagacuagcggagacccgcgagugugcagguuuuuggucuuucgaagcaguuuacacgguuauugccgauggccauuuucgacaggucuggcucugaagaggauucgaggagucugcagcuuacucagcaguuuuuuucucuaagggagcaaaacuuaauucucuggggcuggcgaaaaaagaagaaaucacacacagaguuguuugaugaagaaagaauccaacaacguuauauuuuuuuuuaagacucuuuauaccaccuaaggaaaaaaauucucuacgaaagagagccacaaguuauauauuccccaaaaccaacuaccacauguucuucaaaagauuaaaauuauuacacaaaagaaaauuacaacaugacuauugauuaaauguuauuuuuuugaaacccacacuuaacaucccaucuuucuuuccacaaaucauccuaacccaaaccaauaauucuuuugucauugaucaacaaaguucaagcaagccaaguccauaguagcuagguuuuccaugugcuagcuaguuuguauuuaccaagaaauaaaucauuuauuauaugucu

SEQ ID NO: 1592 - RNA, 4034 nt, Mus musculus
uggcucucugaccugagugagacugcagccauuccggggcaaucauggagaaagagaugggggacccccuggcuggagcagaccaacagaauaggcaacuauggcucgagaacccaguaucagaguaaugcuugaccucgggaaacaguaaguccagaugaaaugucgaucacuuugauaagcuuuugggucaaggccagaacuucauaaaguuacagacaucuguucugaaaacuaagaucuccccuuagcaacuaccccagucuucacuuuuccucuugccuagauguuuucuaauccauggccauuugauguuuaaugcugccucucucuggcuuuccuauuuuccucuccaucuuauuacaccaagaccuugggagagggggagggggcagugcuaaggacugggcccagggccuugagcaugguaaacacucagcuaccaucgaguuacacucccaucccuaccucaagaccucucugaccuccugcucauaugcuuaucccaaaguaggguuuugacaggagaaaaggagacagacccucccccauaucuguucuccucaaaagaccaggagugucuggauugggcuuuucagcugggucuggaaaaacacaugaacuguuagacagaaacauauauuaauuugaaugcuugauuuguaccccauccugugagagggaucguacugucagcccucuggagaggcugagagaccggcucuccuuucacugggaaggugauaucguagacagggcgucugccuaccauguuacccuuugugcccuucuaacacagugaagaaaaugaaacggcaggugguuucuggugggaaggauccauaagaaguauguucuuaaagcgugaucagauccuggugcuacuggggacccacugacauggucagaaccucacuuucucuagggguccuccauuuuuggcacaucugcuauuugguagucaggauggggcaguacacuggacucugcacacugaggucacucaaccuucccuccaccaccaccccgcccccguaggcauauugcacaagggaccugaagguggccgcaggggcagggcacagaggcucaccagccacgcucacccucuggaagccuccuucuucccaagauccagucugucucauuuuuguuuuggucucuucagaugcucucucuacccaccaucuugacuggucuccaacccuucucuuuccccacacucagccaaauuucuucuuccagucacagaaguacccagagaaauucacuagguaggaggcucaucaucugggaagaaccggugccuggggggaccuggcuggauagguaugggccaguccccuaguccccgguccccccacggcagcccuccaacucuaagcacccucacucuccugcugcuccucuguggacaggguaaggaagggccagggaaggguuggacauauccagagguuaggaugcuggguaggaaugagcgcgcgggggugggggugggugggggugugggggugugggggguggggggagagugaggagggaugugugcugagucccagcaccucccaacucugaaagaggccugucuuguuucccauuuaacuugaagaaggacacagauggcguccuuagaccccagggaaaagaagucugacugcuuuacacguuuuuaguagaggaaaggagggaaggaggcaaggauugggagaaugaagguugagauugggaaagcggccacgcugagugguaggaacggugggauggcggaugguuuuuggcaguuaggugcauacuggacuuggauagaaccugugucucauuucacugcccucucccuuccguccccagcucacucccagugcaagauccuccgcugcaaugccgaguaugucucguccacucugagucuucggggagguggcucaccggacacgccgcguggaggcggccguggugggcuggccucagguggcuugugucgcgcccugcgcuccuacgcucucugcacgcggcgcacggcccgcaccugccgcggggaccuugcuuuccacucugcggugcauggcauagaggaccugaugauccagcacaacugcucacgccagggucccacggccccgcccccggcccggggccccgcccugcccggggccgggccagcgccccugaccccagaucccugugacuaugaggcccgguuuuccaggcugcacggucgagccccgggcuucuugcauugcgcauccuuuggagauccccaugugcgcaguuuccacaaccaauuucacacaugccguguccaaggagcuuggcccuugcuagauaacgacuuccucuuuguccaggccaccagcuccccgguuucgucgggagccaacgcuaccaccauccggaaggucagagauucgauuuucaucccaacacaauuucuugagcccucucacggucuguccgccauaccacuccuucuucuucccacuauucagccacccagcucccuguucuugucuuucccaaacauucccuuccauccugaauggcuuccuuccaucaaacauuugcucuuguaaauguaauucaggaauuucuuucaaagcaaguaacuugggaguugcugagacugagacaaaaaggagagagagagagggagggagagggagagaggcagauagagagaggcauagggagagagauauuaggagguugagugggggucaggcacuauuaauggaacacaguaggggauaggaucaaggacugaggacccggaagaaacucgcauuucugcugggaucggaucccugacucucuaugcagcuugauuggcgugaggaugcuuugggcccuaaugaaguauuuucucucuuguccucauagaucacuaucauauuuaaaaacaugcaggaaugcauugaccagaaagucuaccaggcugagguggacaaucuuccugcagccuuugaagaugguucuaucaaugggggcgaccgaccugggggcucgaguuuguccauucaaacugcuaaccuugggagucacguggagauucgagcugccuacauuggaacaacuaucaucauucgacagacagcugggcagcucuccuucuccaucaggguagcagaggauguggcgcgggccuucuccgcagagcaggaccuacagcuguguguugggggaugcccuccgagccagcgacucucucgcucagagcgcaaccgccguggggcuauagccauagauacugccagaaggcuguguaaggaagggcuuccgguugaagaugccuacuuccaauccugcgucuuugauguuucagucuccggugaccccaacuuuacuguggcagcucagacagcucuggacgaugcccgaaucuucuugacggauuuagagaacuuacaucucuuucccucagaugcggggccuccccucucuccugccaucugccuagucccgcuucuuucggcccucuuuguucuguggcuuugcuucaguaaguaggccagcaacccaugacugguuuggaaacgauuugaggauagagguuggugugagaaaccacaaagaugugccaaaggaaacagcggggacaggagacaacacuuacucaaucagaugagguugcaguccagggcugaaaugacccuagaauaaagauucugggccaggguuuugcacuccagaccuuggugugggcuauucaccauggauuucccaguuagugauuucccacuuguaaugaaauuccacucuccauacaccugauaccacuccuacaagccuagagauugugagagugcuaaugaccagugaaacauuaaaggacugagauaucguaaaggcaaaaacaugauucucuuugagaaagucaaaagaggagaagcuaauuaggaaaagcuuuugguucagaaacgaagugggcauugucuggcagaggaagucagcuuuuggagacuggcaccaacucagaaacgggcauuuccaucccuuccuaaucuguuauuaaagcgauuaguucuccauccugu

SEQ ID NO: 1593 - RNA, 38419 nt, Mus musculus
uuuuacauuuaaauuuuuuauuuugggugucucuggagugacuacuggagaggggaaggagaggggagggggagaggggaggucagaguugguucuuuugcuacuguguggguucugcuauugaacucagguuggcaggccuggcaccaucucucugguucuccugaagucuuauguagcuggggcugaagagauggcuuggugguugauaguaucagaggaaacgaguucgagucccagaaccaaaaaacggcagcucacaacucuuaacuccacuucuaaggcaucggcggacaccugcagcaagcacacaggugguagaagaaaauaacagccauauacuuacaaaauuuuuaaaucuuauguugcuacauaccacacuauuuaacaacaucgauauaugaacuuucgguauauuuugauauuucauaccaucaagcuaagguuuucucagaugccugcuacaggcacugagaaacugaaguuagugagcgaccuaccucccuuacaguauucauaaauacuguuuaucguuggaaaacaccugacgccuaguuaguuaacuuucuggaacaaacacacccuaaggaucaagguguuccuaggccuugguguuguguauauguuuuugaaccgugugauguucaucucugugcuugcuuaagguucaguuguaacuuguuagccuuagggugucaacccaguuagggcgcgcgggggugggggcuggggguguuguuuaugaacagcggugaacaggcaugcaaucgcuuuuuacuucuccaucuuaaucucagggcuauaucaucuuuauuuuccugcgcaaggaaggagauagauagucuccuaauaauucugcccaaauauggaaggaguuuaggacucaaugacaaggcuccggcgcggggugggggugggggugggaguggguggguggguggggaauagaguagggggcgaagggggaggggguugcagguaauccuucacacaagaguuucuuugcacacuuaagaguuauuucucuagucagcuccugaggcaucucucagcaagguuugccagauaacuaagugaaacuaacacagcuccagcgccggugaaauugaaacaggcuuagggacaugcauuucauuuagugaauuuggagagaggacagaggggggaaaagaaugacaggaacucgaaaacaaaguaaggagugagguucuuuuucuuccuuuuucuuucuuucuuuuauuuuauuuuuuugguuuguccaccucuuguuuccuggagaaacaaggacgggggagccaucagugugaaaguaaacaccucacaaagcugcagugaggaacaagggaacauauacaaaauguuccccaacuucacagguacacugaagagaugaggggauaagcaacaggauguggacacucccuuacugcuuccgcuccagagaacagaauagaauguaaugggcgaggaacaguagcagcacauaggggcaugaaaugagggggaaaugaggggaacccaccagagcauucaccagaaaggacugaaagccagacuuuaaaauaucugacaaguucucgucuggagagaccgcagccuuuuauucuucaauagaagugcaauaggagcauaucgggugggcucuuucucacuaacacgacugcacucucgcccuccgcuccauccuggaguauccucggugcgaugggauuguuuuucacaagacuugcgaacuugugagccaggaauaaauggucaccucgaaaugaauugcgcuggcucaggcgagucaugaaauccucuccuaagcacauuuuucuuucaccuaaaaaaagaagggggaaaaaaaaaacaaagcacacacccaaauaacccagcucccaagaggaguccccuggaugagguucagggucccggggucccagccucccggggggagggagggcacccgucgccccgggccccgccccuccugcuggcaaggcugcgcacccgaacaacaaccauuuuccccgcuaggagcacaccguguccacgcgccccggcggccucgcugauugguuggaggccugguaaacaagggccaaguagccaaugggagaacugugcacgagggcugcacgagccuccaggccagcacucgcguggagcgccaagccaggcggcuauauaagccguuuccggcagccgcuugacacucuccuccucuggucucgggguuuccagaguuucuccaguugcggaagacagcuguuauuuuucuccugaaagcuuuuggcacagccggcaggcugaaacuuccaggcaccuuuuggaaaaguuguuaggguuuguuugaagcuuucuuuacauuuucguuuggguuuucaagcccugacuuuacggaggcgagcucuucguuugcuuugaaggguucuuaaagauuuuuuuccucuccggcuuucguuuuucuugaacccacucggcucaaucauggugauguucaagaagaucaagucuuuugagguggucuucaacgaccccgagaagguguacggcagcggggagaagguggccggacggguaauaguggaagugugugaaguuacccgagucaaagccgucaggauccuggcuugcggcguggccaagguccuguggaugcaagggucucagcagugcaaacagacuuuggacuacuugcgcuaugaagacacacuucuccuagaagagcagccuacagguacugcucccagcaggacugauggugacuugggaggucugugggucggggagggcaccacuaaauguuucgaguuguucguuugaaugguuugaacuguuggucccuauauuuuuuuacuuuguaauuagcaaguuuuucacuacccuucaccccccuagagugauuugaacacuuucugagguacuguuuccugaaaguguugucuuagcuacuacuuaaagauuaauguauuuguggauuucgcaacuuucuguccaagaaagugcucugggaucuuuucuuccauaguguaagagaugaaaguggaagugaaguaagguagucuacugcccaggcacuccucauugacgcuuucaaaauguaacaagaagccuaauggccccuugucuuuguuucccagcaggugagaacgagauggugaucaugaggccuggaaacaaauaugaguacaaguucggcuucgagcuuccucaaggguaggcauccaccgugugcaccuugcacucuuauuucuaagucuucccccuccauugaucucuuacaguucuuagccuuaauuuugguucauuguuuugacacaggccccugggaacauccuuuaaaggaaaauaugguugcguagacuacugggugaaggcuuuucucgaucgccccagccagccaacucaagaggcaaagaaaaacuucgaagugauggaucuaguggaugucaauaccccugaccuaauggugaggauuuuuuguuuuuguuuuuaaaaagguuuuaaaauucuucuuggucagggauaauaaauuagaugcauggggguugaaauaucucaaaacauuauuuccuuuuacacaggcaccagugucugccaaaaaggagaagaaaguuuccugcauguucauuccugauggacgugugucagucucugcucgaauugacagaaaaggauucugugaagguaaaaacauacugcuucaaaugcuagacaggauagccagaacuggggguggggggguugggggugguacggagagggucguaggguagaggcagaggaagugcuguuaacuugcauggcuauucauacuuccucauuuuauuuuaacucuaggugaugacaucuccauccaugcugacuuugagaacacguguucccgaaucgugguccccaaagcggcuauuguggcccgacacacuuaccuugccaauggccagaccaaaguguucacucagaagcuguccucagucagaggcaaucacauuaucucagggacuugcgcaucguggcguggcaagagccucagagugcagaagaucagaccauccauccugggcugcaacauccucaaagucgaauacuccuugcuggugagugggugagaagagagacaauuaccugguuacaaauucagugcuuucuguacucaacccaucuaacaaacugccauccuccucucuagaucuacgucagugucccuggcuccaagaaagucauccuugaucugccccuagugauuggcagcaggucuggucugagcagccggacauccagcauggccagccggacgagcucugagaugagcuggauagaccuaaacaucccagauaccccagaagguaagcugcagccggauagguucgaguuauuuugaucugcuugggcuuguggaguuggggugaccuggcauuuauuucuuagucggacuucugacaccguuuucucucuucagcuccuccuugcuauauggacaucauuccugaagaucacagacuagagagccccaccaccccucugcuggacgauguggacgacucucaagacagcccuaucuuuauguacgccccugaguuccaguucaugcccccacccacuuacacugaggugagaacugcuauucucacagggucaacauuuuguccuaggccuuuugaaggaaggguuaauguggguuuucuacuuaacuaaaaaaccugaaaauuuccucucuauuccccuuccagguggauccgugcguccuuaacaacaacaacaacaacaacaacgugcagugagccugcaggaaaugaagcaucuguauuagcgcauuucuuucugccucucugcuugaacuccaguguuucagagacucagucucuacagcggggaacggguacaccccagccgcugacuccucaagauggguggcaaucaguaggcgggucuccggcuucaaguggugcagaccagugcccgcacuguggcauaggaguguuugcuggguggaugucagaacacucuuagaaaaauugagaccugaccacuuucucggauguuggaaaugaagaacuuguuuguguugacugagucagggcacugcugaccuucuggcguugucuuuccaagguuuuuguuuuaaagggacuuuuaaauugucuaaaauaucaguagaccaucaucugugccaugggggacagagccaauuucaagucauggccaaaauuuuguaagaggaguguuuuuguguguuuuuuaaagucaguguuccuuuuuuauaucuuuacaaagaaaagaccuuccacggcuggugagcacgcagccugugaaauucggggcagcugcuccaaguugacuucacccugggagcaguaguagcugugcccacugacggccauaaaagccauuuuacagccaguugcacuguguucucuuguaagcauaaucagaugggagaaucuguuauuucccuguaaccccuuggaauugauucuaaggugauguucuuagcacuuuagcuugucaauuuuguuuuagucuccguuauagauguaagcuccaccagucucuuaaggauuaagcccagugacuuggaggguggggguuagggucucuaucccugaacauuguagacccaggcuggccugagagauccaccugccucugccuccugagugcugcgaucaaaggcccagcuugguuauugcuuuugaggcuuucucccaacgcacagacuuguguaauucuaacacuaauccugugaaggguugugguugacagcuggagccugggugacauucuacauugagaugccccagcacugaucggggcacagaagcccccagaccccauuuccuguccaguguugggagaaagugcugcuuucacuguggccucagcccuggcucggaagcucacuaagccuuagcacuuuguccugugucagcuccaccugagaacugugcagccagaaugucugcgagcugauggagguuucgguuuuguuguuuuuguauuuuguguaucuuuuuguaugauuaaaaacuauauuuucuacuuauccaaauauauuuucaccccaaagugggguuauccuuuguaaaaaaaaauaaaguuuuuuaaugacaaaaauaaauguucuuuucuugucuaugagauacuggagaaguuacuagaaaguguuccccugucucaauacugaaagcccguggagagagaagucucuugacgcugagugacauaacggcugguuuggccucuguucagacggaggaauccguagggucugguaguagaagcuaauuaaccacguccauagucagaaaacuccuucaggaucaggcuugcuccugggacugaggauagccuugaaccucuggugcagccaucaagagcacgcagugucaugcucagguuuucauaguuugugugugugaaugcaggugggaauguggugcuuagaacccaccuugcaaaagucagcuccacuuugugggacccugagaccaggaccucaggcuucgcagaaagcgucuuuuacugcugagccaucucugagcccaguucucugcccuguuuaugaauucuuuaaaaauaacuaaggggauuuggaagggacagggugagauuuuuauuuuuguuaaauccaaaugagcagcuuuuguuuacacaaacgcagggaggauguggggaaaagggacugggagauuaaugugagggaaauuaaauggguguuugcucagaugggaggcaggaagcaguccuggugugcuccgguggaucugauguucccuaaagcucagcagacaguccagagugagaauggguucugacuggcagaggccucagcccacccuaccccaaaacaggaugacugguggcaauggaguuuuugguuugguuugagacaaguucaggcuagccuuaaccuggaagcaaucuggcucagccucccgagcacugggguuagaagaccacggucucauucaucacuugguuuuuauugagaauucccccaauauaaacuugguuuauaagcugcaaagaggaacuauuucagacuugguuuuaguuacagggauuaaauguuuuagaagcagcuacaguuuucugucuuuauagauuauuguguuuuuugagacaggguuucucuguaguccugcucuguagaucaggcuaaccccaaacucagagauccacuuuccucugucccccgaaugcugggauuagcguuuaccaccacagccugacucuuuacaguucucaacguauaauuagaauucagugucuacccugauuccuugggaccuguuuuggaauuuucuauuucuuagaaggguauugaugacugauaaaccauuucacugcuaacugaaguuauuuuguucaggaaaaagcuacacacaugagaaacaaagauggcagaauacaucacaccauucuuucugguuuuugguucaucuaaauguuuuucgucaaaauggguuuuccauagcucuccacacaccaguacacucucugaagcacuguauuagaaaccaaggggaggcucgcuguggucaugcacaccuaaaacccagcauuugagaggcaaaagcaggaggauugccaagaauucaagacagccuuggccacagguaccgccaggucugcuagggcuacagagcaagcacuuuuaucccccaaacaaaccacaaaaccacacaucacacaaaaaaagcugugaacacagaacugaacagaaauugaaaaaaaaagaaauccuuuucugcgcuaguaauugaucuuuaucauucauucgcuauagcgcaccugucacuuuccugccucacuggcgcacgccuuuaaucccagcacucgggaggcagaggcaggcagauuucuaaggucaaggccagccuggucuacaaagugaguuccaggacagccagggcuacacagagaaacccugucucaaaaaaacaaaaacaaacaaacaaaaaauaaaauaaacaauaaaacauaaauaaauaaaaagaacaaucauuugugucuguauaccacagugcccaggaggucagaggacuucuguagacacaggucaccaagcucacagccugugccuuuauccaagccaggugacauuuuuccuucuuugucuuuugauacuggguuucauuuagucuaggcugugucuucagggugaccuugaauuucuggcccucuggccccaccuuccuagcacuggauucauaggcauucgaguguuuccacgcucacuuuaugcacugcuggaggcugaaaucgggcucggucuacacugggcaaacacuuugccaacugaucugcaucuuagauucaugagauccuuuugucuguuuacagugugcugguaccuaccucuccccauugcugugaaaacucucaccugaaguccucccccauuucucaccuguucaaacauuuaguagccccuccccuuuaaugcugcgaucaggaaacuaggucaaaguugacggaaaaguuuuuuaugcagcuggguuuccagggacuugaggguuggagcagggacaagaaugagaaagagggccaggcuaagggauggagagaccaggaaggucugcaucuuuguguacacagacuuguuaugagaacugaguggccagggaaggacagauaacaacacccaaggccacucaagagauuugauccugcaagaggcagaacauaugcccccucuccugguaucccagccccagccccagcccuaccacaucuagcacuaucgacaagauuuuauuuccuuuccgagacuggucucucucugucacccaagcuggccuggaccucacucugcacggggggccccaagcucugagcacuggguuuauaggugucacucagcacaccuggacuaaggcguuuucugugacaacagacauucugugugaaccuugugcuguggagccaucaaacugugacugaaaaauggcauuuuuaguucuguuuaauuaaucuagacuuauacagcacugugucacgagucaucgccauaucgugccucgcagcuaacucugaggaaggaaguugccggaucugcuccccaaaaggaaacccaucccuccugagggcacagcaggcugcccuccacuuccuuuugccuucucugcacaaucugucucacccugggacauuuccugccugaaggcucauuuugugccacuuccccguugcugggcagcucuuuccccauuuaacacugggucucauuuucccgugcucuucucaaauggcuuucaauuuuuaaagaacaacaacccccacguaccaccgccuuuaguagagaucuaguucugaguauuauuuauuuauucauuagguccagucuaguacgggaagagcugagaaaagucaaaaagaaauagugagaaguggcggggggggggggggggagaaagcuggggggaacacccuaaagaaaauuaaguuaagagaagggccugguggccugucaccccauauaugggagacugaggcaaacaggucaagaguucaagccagcuugggguacacagaaagcuuuuguuauuaagacuagagguggagcccggcagcaguggcgcaugccuuuaaucccagcacuccagaggcagaggcaggagaauuucugugaguuagaggcuggccuggucuacacagugaguucuaggacagccagagauacaaagaaaaacugucuugaaacaaacaaacaacaacaaccaaaacaaaacaaaaagacuagagacacagcuccguugggagagugucuaaaaugcauaaagccaaagccuugaauuugaaccuuagcagcauauuaaaaaaaaaaaaaugccuggugguaaacaccaguaauccccaaauuuaggaggcagaggcaggaagaucacagaaguucaaacguucaagccauauauaucuauguagugagucuaggccagccugggauacaugagacccugccucaaaaaagcagacaguagaucaggaaauccaggccauccucagggucacaguagugacuuugaggccaaggugggcuccaaaaacagcagcuacagguaguuacuuaaaaacaaacacgcaaacaaaaagccaaggggcuucucuaaacguaaagaaaaugaaaggauccaacuagaguugggacauugagagagaaaauuguggagagaagaugaaacuaagcauauggccagcaggaacuaaucacacaugaagaccuuugacucucugacucucucucucuuucucucucucugucucguguguguguguguguguguguguguguguguguguguguguguguguacacgcacucucacuuuggguguuguugcuuugacuucgugcacauuuuguuuguuuguuuuugagauaggauaucucagaguucgaaguucccuaguggggcuacauugucuggccaggcauccccagcgcccccccccccuugucugcucuucuccaccacugggauuauaaacauuagcuacuauguucugcauuuuaaauagguuugggcuccuacucagacccuuguucuuguguggcaaacauguuacugagugagccagcucccagccuuccuuugacuaauuuuuuuugagcaguccacagaguccugcuagaguauuuuuuucuugaaucaccucuaagugagaacacagaagggagauaaagcgcacguuuaacugacucuccuguucuaagcacccugacaggagaagaccuccuauccacaguacuuuggagguugaaacaaccuuucagagacagccacagauucaggguugcaggccuuggcucacuaggugauggcucuagagccuggaaaagcgccgugauuagccuucccguagaguucugccuugcuuucucuauuuugcugugauaagcaccaugaccaaaagcaacucagggagaaaaggguuuuauucggcuuacauguccggaucacaguccaucagugagggaaggcaagggcaggaaccuggaggcaggagcugaugcagaggccauggaggggugcugcuuaucggcuugcuccccauagcuuguucagccugcuuucuuauauggcucaggaacaccugcccagaaauggccccaccuaccucuggcugggcccuccuacaucaaucauuaaucaaaaugccccacagacuagucugauggaggcaucuccucaauuaaagcucucucuucccagaugacuuuaguugggguuaacaaaacacucaccaccacagguacuuaggagagcuaguuauugagaaugcaggcccugaaaccaaacuaaauucuacaccuccugugacaccugccagcaugugauacuggcuugcuuauuuaaacucuccacaccguaggcgguucauucaauacugcuuugauguaaaguuuuauguaguuuauuuugugugcaugucuguguuugcaggucugucugucugugcucuaugugccuuccuggugccuuugggagcuagaggggagcacgugcauugcacauacacacacacacacacucucucucucucucucucacacacacacacacacaaacaggaaguuuaguaaaacauguguaugcacagagaacgaagucggucagaugucuuccucuuacaauuuccaucuuacuuuugagacaaggucuuucacugaaaguugggaacucucagacuggcuagcaagccucggggcccuccuguuagccuuccugcaguggaacugcagucagacaccagcccaccuggcuuuuuaugugggugcuucagcuuaaauagcaaguacuuuaccaaccccccugauuuacuuguuauuuguuucuuuaucuuugagucagaaugucacuguguaaaccagacuggccucacacuuaacucaauccuccugccucagguuccugagcacugggaucacagguguaaacuacauuuccaggguguauguguguguguguguguguguguguguguguguguguguguauuauuuaggagaaagagucucuagauaacccauaccgaccucauacucacaaucuucuugccucucaaauguugggauuguagacagacauguacugccacuuguaauugcgauuguucauuuguaaaaugaaagccagggauagaacugcccccauagguguuaugaagauuagaaaugcauagugaggaguggguaaagauauuugccaccaaaccucuccccacuacucacauggaaggagagaaccaacuccccaaaacuuacccucugacuauaggcaugccauagugccuaugcacacaugcgcacaugcauacacauacauacacaugcaugugugcaugcacacacacacacugaugcaggggcuggagaaauggcucaguggcuaagaauacuugcugcuuuucagaggacuggguuuaguuccuagcacacuuaucaggcagcucauaaaccccagcuccaagagcucugaagccccuuucuggucucgcggagcacccauagacaugugguauucacucacagagacacagacccauaaacuaaaagaaaaaaaaaaggaacaaaucuuuuuuuguuuguuuuguuuuuuuguguuuuuugucuuucgagagaggguuuuucuguguagcccuggcuguccuggaacucacuuuguagaccaggcuggccucgaacucagaaaucugccugccucugccucccaagugcugggauuaaaggugugcgucaccacgccuggcucuuuuuuguuuuuugaguuuuuguuuuuguuuguucaugguuugaaggcauuuauuguagaaaggcagagagagagagagagagagagaggagagaagagagagaagagaagucaagggcagccauggccacguggagagaagggagaggggaagggaagaaggagagagagagguaagagacaaggagagagcaagggcuuaagagcggaacaaaucuuuuuaaaaagaugaaguguaguaagggaagggugcaugugggcgcugcuagcacagggcgcgcuuguuauucaaagcaggagcagcugagcaggcggaggcccacucuguccagaagagagccuacuuccacaaauuguucuuugaccucugcaaguggauuguaaugggaucuucuaaauucuucaguuuacacaauuaugggaaagcguucuaccauuuaguguggcaaaucaagggccaaagaacauagacauacaacauaauaaacgagucucuuauuucucuuuccuuccuuccucccuuccuuucuuuccuuccucccuugcgucuuucuuuuuuacauuuuuuacauuccuuugaaauuuuuaugugcauaaguguuugccugcauguauguacguaugugcacuacuugcauggcuggugccugcaggggucaaaaagggccuggaacuggaguuccagaugguugugagucaccucaugagugcugagaccagaaccugguccucuguaagacgcaagagaagauacaaugaagcccauuugagaauucccauaauuuuucucuuccccgcccauuuccaugccuguauccaggacccuccucccaaaaucaacaggcucuccuaagcgcucuguuaauugagugcuccccaccccccuccaucucuucccgugagcccucacuccaguccuaagguauuuugcucuuuuaccagagcgggccuagcuggguagaacaagggucagagucaugagccuauccuccgggcccaggucaguuguucuuguccugcccugaccgugcccggggcuugauccuucucuagucuuucuuuagccuguuacauaaagaggaaagaaugaacgaacucagugcacugcgguguuucuguguucccgcugcuuggucaucuccaggcaacagcgugacggaaggagagagacagagccauggggacagcauugugaaucucaugugaccugcaucucaggaugucaagugagggccauucucucuuuuugcgugauggaacugcugagcggacaucuucgaguccaccaagcggucaguaagcagguucguggaaacgucugguuaggugcuugucaaggguauuuuuaacuuccugaacagauggagagaggaagaguuccaggugcagggagaggauggcaagugaaggggcgcccuuuaaauggcucuacagaaguacgaaaacuccucccgccgagauccuccuccugccgcccagacucacagcuauugcuuugcgucccgcucuuucucucugcacccauggucuuucauacuugccgcaccuucuagagcagaagcuuagcuucuuguuccacacucaaaauuuucccuuccaaaccuccauagaccagugggcguguccuuuucuccucauggagaaagaggugguccugccggcagcggcaccugagcucucuaugcugccuccuugacuggccuguaggagggcucuaaacucuucugagaccucauggacccuacugucccuacuccugagaacagaaucuaagacugagaaacccaggguugggcuuuauacaccuugggaacgcagaagagauguuugcuuguggaggucagagauugaaaaugguggcauguugacacggccgccuagauaucuaggucacuggagagauggagggggguggggagcagucaauuaacagagagcuuaggagagccuguugacuaugggaggaggguccuggauacaggcauggaaaugggcggggaagagaaaaauuaugggaauucucaaaugggcuucauuguaucuucucuugacugcccccuaccccuuuuuuuuuccuuugguguguaugugugugcugagacaggguuccuccuggguaggccugccuguccuggaacucacucuauagaccaggcuggccuggaccucagagacacagccucugcuucccaagugcugugauuacaggcaugugccaccacuacccugcaucuuggccuucuuuuaaaaccacagaccaaagacuucacccuccucucccuuugucucuuucugugucucagcaccucuucugauacuuuauauccuguuuuguggcaaaggaaggaguccucagcacaggaagcccgagggcugggaagacggaucuuuggcuugccauagagccccagcuuaacugugcuaugguucucgggucucuucuuguaugcugacuuuagcugacguugacaaaacagggcacaacagaggaaaugcuaagcccgaggcagaacacacgccaaagccacuugccgauguuuagaagccuguacuauuucuuccucagagucugaauuggcugggaacauuuagaagcuauaguaccacauuuuagggccuguguggcauugcauuccugaaaucccagcauuuggaagccugaggcaggaggguuaacaguuaccaggacaaaauugauacuguaacaggcugcucccagacacuguuggaagaaagagagagagaggaagaaagaaagaagcaagaaaggaaagaggaaagagagagagggagagagaggaagaagaaggagaggaggaggagagaggaagggaggaagggagggaggaagggagggagggagggaggaaggaaaaaaggugagacaauuuagaaguaaaagcacuugccaccugagucuggugccaugaguucaaucccuguaacccaggaaaagaugggaggagucaacagagugcacaguuguccccugagcuccacgugcacaccauagcacaaaugugcuugcauuuacaccacaccccaaaauccaagggggguaggaauuccagcacuagggaagcugaggcgggaggaucaggaguucaaggcuauucucagcugcauagcaaguuccaggucagccuggguuacauaagaccuugucugcacauacauacaugcauacauacacacacauacaauacauacauacauacauacauacauacauacauacauacauacauacaagaggaaauuaugugacgcacccuaaggacuucaaggauaagucuaaagaucucuuguguacagccgccucuccuggccaggcccgcaaacauccccugggagguuugaggagccaccaacacccuggacaggugagagugguggcuugggcuggaaaacaagacucaaaacaggauccaggccaaguaagggagaggugaggggccaagagcagccagauccaaguauggucaggcgcgaaaaaguuaucugggugccaggagagaggacugggggaaggagcuuugcgaagggcugcuucucucucucagagaaggaguggcucucccacagaacgcccaucuuugcuuacuuccuuucaccaccauggccuggcaaaagcauucgcuggaggagggaguuuccucucaaaaugguugccuccgaggccacagcagggcaaagggaagaagaacgagaaggcuucuuuccugacuaaggaacugugggaggcaucuccaugauaaaagaaacauccgauuuagacagccuuuuccuguuuuuguuugguugguuuguguguguguguguguguguguguguguguguguguguguguguguguuuugagacagggucucuuacagcucaggcugaccucaaacucacuauguagccuaagagaucuuaaguuccugguugucccuugcccugccucaaccucacaggcuuucguugcuggcugugguagcacaaacauguaauccuaaccccagcacucaggagccagaaggcucucaaauuugagaucaaauuccugucucaaagaaaucguaaagagagccgggcgugguggcgcacaccuuuaaccccagcacucgggaggcagaggcaggcggauuucugaguucgaggccagccuggccuacagagugaguuccaggacagccagggcuacacagagaaacccugucucgaaaaaccaaaaaaaaaaaaaaaaucguaaagaagauuuggagguggcucagucagcaaggugcuugcuggggagguggcucagucagcaaggugcuugcugugugcaaguuugaggaccuaugaagucccugcaauccuaggacuggggacauggacacaggcggguugcugagaucaauguccagccauccuacuucaaaugcauacaagguagaccauacacaaggaauagcacuuuaggcugcuuucuguccuuuauacuuauagacaugcaugagcacacauaugcacacggacaaacggaaaaacucacaucaagauaggaauaaaccaaguguggugguacacaccuauaauuauagcacuuuaauuugguuuuauuuggguuuuuuuuugggggggaggggagggguuggugguuguuuuuguugauugguuuguuuguuuuuccaacaaaggcucucacuauguagcucuagugguccuggaaucuacucuguagaccagacuggccucuaacucacucagagauccaccugccucugucucccaaguacugggauuaaaggcaugagccacugugccuggcaauccgagcacuuugaaagcugaggcagacagauuauuacaugucugagauuagccugcaauccacaaugaauucccugucuuaaauaaaauaaaaacaaaagcaaaccggaaguaguggugugugcccggaaucgcagcacuugggagauggaggcagaaggauuaggaguuuaaguguuacaugaucaaguuuaaggccagccugggcuccccaagacccuguugggaaugaacaaagccaaacacacacauggguuuaauccuccuggcaggcacugguaccgcagggugcuggggacagggugaauuuggauguuucucccucuuuaccauaaauccagagagggagaagcauagggcuguguccacuggggcggggggggggggggggucugagcuguaggaagcacagcccauagcugauaguccugggacaugaggcgguuugaauagaaaauagcccagacucuaugaucauggaaaaccuucaccccucuggucuggggugaggucagugcgugccugcuaacucccacugggguagcuauagcuaggcagcagacagaagagacacauuacauccuaaggauuaggcgaaccauuuuugcugauaauacucgaaacuagaauucugcgucgggauuucaaauuucuauguuugugauuuccuuggggggaaugugagucucaguaggggaaaagucaauggagaaaaggucacacuagccugggucagauuacauaacagaacuauuccugucgagcucauuuaucuccucaccucuggccagacguguuuaaggacagauaggaaggaccuguaucugcagccgcuucuuuggucugaaaucucugugguguccuugaugugacuccggacucgcaggucguaaccuugaacucucgguuauaagguuuuccugcuuucuuacuaguugugggaguugcugguccccagcuacccuggcugcaaagguucuuggaaacaacuggcgaugugccugagguaucuuuagcuugccuggccgaaaauaaggugagaagaucaaggagaucgaaugacagcuuggccaaacgggcaugucccgccauuuguaggacaaagguuggagugaccacuggggaucaguugugcugucucaaagacaaaaugucauacaaaucaagucagaugugaacucugcccugccuggacuccugcuuuuacuggcaggugaccuuguuggaccaagcaaacgucuggagucccgguuccauuuguaccuuuacaagugagucuacaccaacccuacuguggaguagggggucucaggagacagcucauguaucagauucguguaccagacaugagacugaggcaugggggggucaugacacaacauuccaaggguacaagacuauggaguaaagacaccaaagcccuggggugauauuuugccuaucugagaugacaauuguuccccuugacuuagcuucuucauuucuuuuuucuuucuuucuuucuuuuuuuuuuuuuuuuuuuuuuuuuuuuuuuuuuuugguuuuucaagacaggguuucucuguauagcccuggcuguccuggaacucacucuguagacccacuucaugcccagcuucuuuuucuuuuauuuccauugagacagugucuccugugccccagcuuggacucaaauuuuccauagaaccaaggguuagaggcauacgcuuuuaugcucaguucuguaguguuagggauaaagucuaggacuuuguguaugcugggcaagugcucugacuacugagcuacacccccaguucacacccugcuuuauucucuaccagcccacacccuucuuuacuuucaaaguucaaacaaccauaaaaguaaguugcagaaaccaacuaccuuucccuuaccaaaccgcggugccuaaucgcuccauccaccugccuucuggccuucaguuuucuuuguucuccacucucaaccuaaauuugcugcauccagaucucuauuugguccucucuuaaaccacaugaguccuugcaccuguucaccgacuccccauuucacggguccuaccuaaggaggugaggccugggaggguagguguggaacauggguuagguuuuccugcuguaaaaucuagucugcaguccaggcauuggagcaauuuagacaauaagaacuguuccuaauggguauuauguaccuggguggcaaacacugacuaggucuauguaaauuaguaggccaggccucaacugcugugcugccugccucuccaggaagagcggcuuugacccugucugcuggacccaggcuccagccucugccuguuugggagugcuugugggaaguuggggaaaggucaguggacaugguuuagcuauugccuggaaccaauuaggaauuuggggaagcugcugugucucgugucacuggcuuuguccaacaaggucaccugccagggaaggcaggaguccaggcagggcagaguccaagaaugacuugauauuuaugacacuuugucuuugagguagcaugacugaucccaaguggucauuccaaccuuuguccuccuuucuccugcgccaggggaaaggcaacgugaagggacggaacuguggaaagauggguggggacuaguguccugcccuccuuuaccaccuuuaguucgggaucuuuggucccaccaccaaguucccagggaugugaguuggcucauucggugcuugccuccaagccuugcaugugagcccccagacccauauggcagcaggagaguacugacuccagcaggcuguccucugggcuccccacacacgccauuuuguacacccuuggccaaauaaaugaaauguuaaaaaaaaaaaaaaaaaaaaaagaggagcaucaggugggcuagccuguggcagugucucucaacauagaccuggacuuaaguaaugaggguuaggauggugucuccccuccacugugugugcacgggacaacguaggaaaagacaacagguaaacaaaacagaaccaaaccguucaggaucuuuguuuucggcuguuuccucccuagcuacagucgcuggcuguagaacugugggaaaccccagggacaagucuccuggccccgcccuucccucaccucggagagcuagaaaaggaaacacaucaaucaccacaaauugcucaauaacucuggaauguucgcuucuauuccuguucccggcucugcuuucuuggcugggcuucuaucccaacacuugcuaccacauuuaaacgaggccuugaaggcgcuucuccuccauggagucuaagccccucuuugcccuguacaauggggucagaaauaccugaccuuggauuucgguucucuaacccacgaugcuguaggaaauucggucggccugucuaaaagcgauugggaagcuuauuggacgcuucucacacaguccauccuuagacuaugaaaugcucaguggggccucccgugguagcacggcagaugucucugcaggucuccuuacucuguuucuauacuggacacgcaacuuacucguggcuguggcauggcaagugcaugcaaccaaucagcucgaggaagccuuccuuagaagccaaucagaggccagggaagugaccucacccaagggagcgcugugugggcgaggaagccucucuuagagcugagugucccuaaaucacucccuuccuccccacccuccuuacuuccuggaagauaacaccgccuacccccuccccaaaguggagugagaaaggcuaacuuaauuccacaaaggaaagaacaacaaaaaagaaggagcugcaagccacaccccggcugucuguagagaacaguauauuuagggagauccuaaauaugccuuucaaagugggcucuccagguccuggaagacgguaagcugaaagcagugagucacuccucucucccggccccuggcuuucuggacucccugcacaaaaauagcugcaaucacucuuuguaaauaaggacaccaucaaggucaagugugagaaaggagagggcugguguccugguaaaugugccugacuaugcaggcucaugucccugugcugcuggaggccaaaggcuaggguagucugugggcgagccuaugcuuuccccagcgcugcuuucagacagcauugcagaugaguuccugaauguccuccaagggagagcugagaaguaaaggucaagggucaaggcggucacacacacacacacacacacccgugucacacuggacacgcagagauuugacacugguggcacagaccugggaccacagcuagggaggcugagacaguuucaggccuguuugggcuacaggguuaaguucaaagccaacuuaggcaacuuagcaaaagcucugccuaaaaauucuaaagcaaauauauaaaaagagaugggggcauggcugagugauggaacacccguuuagcauuugcauggcuguaaauucaguccucugaaagggggcguggcagggguaagaauggcuugacuggacacccccucagccuugccuccggcccuuucccaguacacaucacucuguuagacauguuagacagauacaaacauuuuauuuaaaaguacaaaacaggccuuacuccucuugacuguucccaccccaagucuccccuaaacugucaacggcugcgcaucacagcccccagggaucacacaggucaccuggauucuaaccaauuuuuucucaacagaaguaaaugcuaguaagucugcugugguggcgcgucccuguaaucccaaggcuuggggggguggggggggguccaaaauucaaggccagccucagcuacauaccgaguuccaggccagcuugagcuacaugagaucuucucucaaaaaacaauaacaaagcugggcaugguggcgaaugccuuuaaucccagcacuugggaggcagaggcagaggcagaggcaggcggauuucugaguuugaggccagccuggucuacagagugaguuccaggacagccagggcuacacagagaaaccugucuggaaaaaacaaaccaagccaaccaaccaaaacaaaacaaaacaaauaacaaaaauaggaaaaccccuaaguacauagggauauuuaguuccuguaucucaaaucaagaaugauauaugggcccagguuuucagucuauggcccagguuuucagucuaugcccagguuuuucaguauauggccucauccauauugucaucgcuguccccuccaaaguccucuccauugucaaaauaugacaugauguaaucaguuuccugaaauguaaaaagaagcaaagaucaggggugaugucagaguuuucuucucuuugucuccaggcucuuucuucucacacacaccuuuccaggucugggacaccucuaccugcuguuacauucauuccuuuucaugcguauaggugcuuugacugcauguauguguauacugcuuucgugcuagaacccucggaggccagacaauggcgucagaugcccgggaacuggagucaccgguuguugugagccaccauguggaugcugagaguggagcucgaguccuauggaagagcagcaugcgcucuuaaccaagagucgucacuccugcuccauguuauacaaguuaaaguauuuguuugccuguauauguauguuauauguguguguccaagugugcccuggugcacauguggaagucaggggacaacuugcaggggucaguccuuccacucuguggguucuggggacugcacucaggucaucaggcuugguagcaagccccuuugcccucugagccauaucacccgccauguuccguguuuugaggauaggucagggauagaugaacuggagaaaggcuuuugguggcacugcaacucucugagaaugucucccguguaaggguugagagcccaggguuagugagauggcucaguacaaaaggccuuuguuguuaagccagaggaccuguggucaauaaccagaccccacacgggaaaagagagagccaacucuugcaaguugucuucugaccuccacacauuucacacacacacacacacacacacacucaugcacacauguaauaaaagauggcuuggauguuaaaggccuuuguugcucuuucggaguucagauaacuugggcagcucacaccugcuuguaacgcccagcuucagggguuuggagacccucuucaggccuccucaggcaccagaacacgcuugguaugcaaucauacagagucuuguaugcuaagucuggaggcagacucauauguaaccccaacagcaggaaauagaagcaggggggcuucuggggaguuccuggccagccuggcuugcauaauggagacccugucucaaaaccaaaaccaaaaauaaaacaacaacaagaaaucuugaaaagaaaaaaaaaaaaagaguugugagccuacaacuuguaagggagaaaggaggggugggguggggaggagcaaagcccccucaccuccucaugcuccucuucaucguauuccucuuccucccccucuuccuucuccuccucuucuucuuucucuucauccuccuccgaagucacuuccuccuccuucuucucuagcgucucaugugaggaugaauaggaagagaaacucacucacagaaugcagggagagcuggggcuccaagggaccgggaggccagcugucuaucgcacuuccuccucaccucuaguuucuguaucgucuccuccuuaucgucugugcucuuagggggccucuugggaaggauaaugguggucccuguuuggaggaucaaaaagugagaggccuuaguacaucuacuagcuuucuuucgggguuuuaaauuuggggugugugugugucuguguguguguguacgugugugugugacacacacgcggaaguuagaaugaguucuuccuuccaacaguggguccuguggauugguggcuggcaucucuuaucagcugagccaucucucccuccauccuagcugagccuacuccacccucuugcagcaaacacggcacucugcugcccucguguggucuccggcagcaaaauguggcggucugcugcccuccugugguccccguggcaccggcugacaagcccucauccuccugcagauccacucacgcuccuucuguacuuuccgcacucgaaucuugagcucacuggggagucgccgccaaucugggaagagugggagugaaaaucagcaggacccuggccggcuggaggcuucugggagugauggcuggcgcuaagggggaggggaguguuuaaaaggaaggacggaauggggguugguuugaagauuuuucagaauaaaauuguagguuugacgcuucuggagaggugggcacuguuguuacaaauaggguuuccacguagaacgcgagaguguugcagagcacaucuaagacucuagauuuagauguacaggaaaggaaggugacaguuugagguaccuaaagaaucugaaaggagggcauucggagaggaggggccagucacuuaccaggguuccaaucgauggcguugucaauaggcccagacaucugauacuugucugaguaacguuccacaucuggggggcgggugggggggggguagagcccgugaguuagaguuuuaaccuuagaacaucuguccuaagggucugccccucuuaucuaucaaucuccuuacucuaagcccagagcccagagcugucaguuggggucagccuugccucuccuucagccugccuuguugcuauucuuaucuuugcccagaauccucuucugagaagcagugagcuucacuggacaggacacccugggauaaaaaccaggguucagucuucugucucccucucacuaacugguuagcuugguaagucuucuuccaguguugagcccucagcucccaggggcucaguagaaaagcaucaacugucaauacuucucaccgagggcaaguaaccauucucccaagccugccagcagccccgcccgccgucuccagucuccugcucucgcuaggugaaagcuuugcacagguggggugcucagaggcccagcaucaaggucucuccaguuaaugaauuggaaauucauuuguacccccccuauuugaacuaagaugcugaugcuuuaaugucccaccagccccaagauugagguucaauuaaaaucucgaguaaggugauacauuucagacacagagggacauuuaaugcucuuuccauuagacaggaaacuucuaagccucucuggcccugagcgugcuagcaugggcacugcccacagaaggaggcccgaauccuuaugcuagcuuucuacugaccucucuuggggacggcuggccggaugaaguaggggagcugccucauggccccgcgcagcucuugcuucagugccaggacauacucccccuccucuccugccggcagaggcacuggguggaacuccaagggcugagggguacagugguuagucuggagcgcugcaauaaaaccuuaaaaggccuuucccccaaguaaaauccaguguucucaguaagauugggaaggccagaagauggaggagggcauucugagagcuggagaguggacgguaugaagagugaagauaaacacuuccuugccgggaaaacaccgcccguggggcaggugcgacuauagacggaaucaaggugcagauggcucgagaugggccaggaggauucugugcucauauggcucagugggggcucacaugggaggcuugggaagggaagggagacacucacaggaaagaguggagagggcuggagagugggugggggcaaagcaucacccuucccaaugcccacagccuccauguugaaggucaacuggccccggccacgaccccggcccccaccccggcuggccaugguggagggggccuggauaugcagagauccagugagaaaaaccuaauaaagacaaaaacagagagauaaagaaguguacuagaagagauaugacgccaagaagccgcacagcacaucaugugauguucuaugggaggugacguuuuccucugugccccgguucaaacccagggcuuuucucaugcuaggcaaguacucuacuuugggcuacauuccaaucccuuuuucugugacaguuagaaauuugaugugccaggcaguggagggacacaccuuuaguuucagcacuugagaggcaaaggaaggcauuacuuugaguuugaggccagccuggucuacagaaugaguuuugggacagccaagguuaugcagagaaaccugucucaaaaaaaaaaaaaaaaaaaaaaaaaaaccaagcaaaauaaauacaaaauauaacuacuuaauuaauuaaaaaauaaauaaaacauuaaguuaggagugauaccacaaaccuguaauccgagcccuguacuugacgagaggauuaucaguuugaggcuagccuggucuacauagaguuccaggccacugagggauaaauagcaagaucaugucucaagauaaacaaagcuggagagacuguucagugguuaagaugugcauugcuuucgaagaggaauggaguuuuguuccaguacuugugucuggugucucacaccgucuguaaacccagcuccagggaaucuaacacccuuauuucgccuccauggacaucugcacucacaugcacacacuuuuaaaauauguuuuaaaacaugagagauggcucugugguuaaaaguaucccaugcucuugcagaggaccugggucugguuccucugcucacaucaggugguucccacugccugugacucuacuucccggagaauccacgccugccacagccuccaugcacauuuacauaagugguacacauacaaauaaguaaaaguaaauaauauuuuaaaguacuaaaacaauucagcuagagagaugucucaguggugggguacugcucuuccagaugacacgacucugacucccaucacucacauggggggcuuacuauaacuccagcuccaggaagggggguccggugccuuuggccuuuauggacaccugaauucauguguauacacagugauacacacagacccauaauuaaaacagacauaucuguuuauuuuuugagaucuuuauuuuuauuuuauggguauggguguuuugcaggcagacagacaaaaagauagacaggcaggcagagugcgcgcacacacacacacacacacacacacacacacacacacacacacacacaccauuugaaugcagugcccaugaagaccagaagagggcacgguuucuccugagacuggaguuacagaugguuguuagcagccguaugugggugcugggaccaaaccuggguccccuagaugagcaaucagugcucucagucacagaaccaucacuucagcucccaacaaaauaaaauaaauuaauauuagauuauaaucccaaaguacaaaguaaaugccuacgaguccaucauaauaugaaugacuaggaaaagacacaugucucaugcagaauucuaaauaaaccguguagauagccgaagcuaaaacauaaacaaagcauguagacaguccauguaacagcaaaggagcauaauuccugauucauaagagugggaauuuuguuccucguguuuuugacaaguuggaguguagggguaccuucuaagggacaucaguguagccagugaccaacaucagcaugaauagcagagacucacaaggacaauuggaguggguuuucuuuguuuguuuguuuuugagacaggcuuucucucuguaguccuggcuguccuggaacucacucuggacaauauguauucuuaaugagcacugacacauuuguuucugcucuuguuuuguugauucggggucucaaguaacccaguagaccugaaacuaacugugcagcagacaacgagcgugaccuuuuaaucugucgucucuggucuggacgugcugagacugcagaggcaugugccuccuucccucuuucucccuuccuuucauccuuccuugacaaggucucauggagcccaggcuauccuugaacacuuauuucuacugucucaguuuccaagugcugaccuccaugccugucccagauccaaaaugaugccuguaccucugugaucaucauagccaagcuccugaguccacauuagucacugaagaaacagcuuccaacaaagggauagccuacagcacaccugaucaguucacuucaaaaaaaauaagaaacagagaaacuguccaagcccagaggagcccaaggagaugaggcaaaugugcugugguauuuuggauaggaucaugacacaugaaaaggccauuauauaaaaagugaagaaaucugaguggaaaaugagccuugagauauaacaauauaucacuagugguucacuaauuauaggaaacaaauuauaguaauauaaagcauuaauaaaagggaacuaugugccagggauaugugggaauucuggggauuaucugcucagauuuucuguaaaccuauuuuuuaaaaauguuguuucauuauuuuggucaucaaacuacaugcccagccuugucacauacuuuucuuccaggugauaggccuucaugguugucuccuuucuuccuguuuguguauuaauuuuuccuauaauauaucaauacuuuuuuauuauaagagaaaauuauuagguaggcauugugccuuuagccuguaaucccagcacucauggugcugaggaaagagaacggccaagccaaggaaucuagggcuagccugggcuacacacaaaguucuaaacuugugaucccccugccucuaccucccaaguucuaagauuacagauacaugccaacaugacuagccaauaaauaaaauuauugacuuaaaauuuuaacuaggggguccaaugacaugucucagcaagcauagucccuuuggcaugcaagcugacaaccuguguuugauccauagaacugauggaaaacagagaacagagaaucacugggaguuuagaggcuaacuagccugacauucacugcucagggguuagagacccuugccucaauaaggugggggaggggacagaugaggucagaggacuuagaggauuuucucucugucucucugucucucauaaaguaaaaguuuaaaaauugaacuaaauguaaauauauuauauaucucauauacaaaaucauauauaagauuaauaaucuauagcaggaagaagauuguaucugaggaguuaggagucuaacuacuauuauaaaaauauaauagaaggggaaaauugccauugagagugaaaauguuggguuggagaaauggcucagguguuaagaguacuaacuguucuuccaaagguccugaguucaauucccagcaaccacaugguaacucacaaccaucuguaaugggacccaaugcccucuucuggugugucugaagacagcaacaguguacucacauauauaaaaaagacagcuggcuuagguuucuuucccacagcuccaacugugcagaagccagaugcucugacacagagcaaccaggagcuaagaaaaaaggccaugaguuuggagcuuagccgacucuaaccaacaucacagacucccacaucacacaacugaccaccagagaugcagaccgagagauggugaacccuaucuaacucaggcauuagggggcgggcagacacuagacggcacuggucuucccuucucagcuugagaaucuguaaugaauccauuuuccauuauaacaaaugacacuguauacucaaaagcuccuggcuacagagaucaaaggaccaaggaccaaggaccaaggcgggaagcuacugcuguaacucuguaagaggccuucuaaauaaacacaggguucuaacuucugggcgggugcugcugucagcuuuggucagcaaagcuuccuuuuguuacaggcagcagugacucugaagacuggucaagauauagagaauacaucacuguugguugucaagcuguacauaggauaucuuucucacccacuccacaggaggauggaaagggcugaacccuugaacucacagcaccugugaugaacugcacucaaucagucuaagacugggcgugaucccacaguaugugugugugaccacacauuaugugugugauguugugcaugcgugagagagagagagagagaggcaguggugacacaugcuuuuuaucccagcacccaagaggcaaaaguagguagagcucugugaguuugaggccagccugcucuacagagcuaguucuagggcuacacagagaagccgugucuugaaacacaaaacaaaaugaaaacaaaaacaaaaaagaaauacacuuaacauagaugauuggcauccaucuaugaaaaugucauaaugaaaucugcugcuauguaauuaacauacacucauaaaaacaguaagaggagauccuggaaggcaucugaagucucccauaacgugagccugaucugcuccuguuaccaucacuccuccccagggcucaccugugcacugugaucugcccacacuccagugcucacaggacagacgugccuacuuaugccuccuuugcacuguagaagaagcuacuaacgggcauguuucaacacaacaugcaaaaaaccaccaacagauuccugaagcuuaaggaaggcggagcuaggagagggagcacaaccugccugugaucacgugagaggugaaagcuggcugaccugggucaggaucaggaggggcuacauagugaguuccaggccaucuugggcaacauagguuccuggcucaaaacaccaaaaccaagcagccaaccaaccagccagccagccagccagccagccagccccaguucugucauuuccuagcuacauaaacuuugguuucuucuuuguuuuuagaaugggaguaauaauaaaccuauugccuuaguuacuuuuaaauuccuucccaaagaccccaugaccagggcaacuccuagaagaguuuauugggagcuuacaguuucggagggugaaucuaugacuaucauggcagggacgcagcaguaggcacugcacaaaagcauagcuaagagcucacaccucauccacaggcaugaggcagagaaagcacuagcuaaccaggaacaaugagcccaccccccaguggcacaccuccugcaacaaggccacaccucccuauccuucccaaacaguuccaucaacuggggaaaaagccucaaauuuaugagucucuggggaaccgugcucauucaaaugaccacaccaaugcugaaugcuguugauaaagcugagaguaaaaugggcaaaacuaaacaauaacgaaacuccugugcaccccuggugccuccugcauggaauuuauauucuggcagaccugugagcuuauaacuaagaguggaugaggccccucgaggaggugauggagugaccgguugugggcacucugguccucuauuucuaauaaguuaagaagucaguucugugucagaacucuuggagaucuaaaugggaaaaaaccauccucuccccccaggagagaugauagcuggagauguggcuccaugacagagcucuuccccaagaggagcaagcccccaggaccaauccccagcacuagagggaaaaacagcaaguaagaggggcauguggaacaugccuguaauuccagcuccagaaaaacugagacagggguauugcaaacucuagacaagccuaggcuuuaaauaaauaaauaaauaaauaaauaaauaaauaaauaaauaaaacaaaaagaacaaaugcuggacacggcaucuauugccuuuaauccuagcacuuguggcaaaggcaggcagaucucugugaguucaaagccagccuguucugcauauggguacauaggaagacugacucaaaacagauagacaacaacaaaaaaugacaaaaaauaugaacagaaaauugacaaaagaaugguugauaaagccacauuuauuuauuuauuuauuuauuuauuuauuuauuuauuugagacaggcucucuacauagugcuggcuguccuagaacucacuauguagaccaggcuggccucagacucagaggucugccugccucugccauccaagugcuagaguuaaaaccauacuuggucucuuuccuucuuucaaauuuuauauuuauuuuaauuacaaaucauguguauuguguguuuguggguguugcaugugaguugcaaauggaggccuaagguccccugcagcugcaguugcagaugggugcugggaaauagaaauggagaacaguacacccuccaaucauugagccucugcuuuaaaaaauauaauuguauauaugcauguauguguguauguauuguauauauguuacaggcuuuugaaccuguuuccaguuaggggguggcucagcccuuauacaccucuaaccccuccggcuggaauacacagccacaacuuuagaacucaccuuuaauuccaaacagugacgguaagguuaguuuguagaaggaagcacccauguuugagagugaugucuaauugaguggcagacaaggcgaugaauuagagaaagauuugacagaauaggauauucccaacugagaagagaggaaagggaagcuacuuaagggagagacagacgguucagaagagagugcagcgcaggaauacagcagaguccggggagagcagugcaguagcauugagagggagaguggagcagcagagagggaggaggaaccaggagaguuuuacagagacagauugaagagagaacaagcuggacacaggugaaggcaggaugagcaagagaaugagaaggagccagauuagaaaagauugcuggaguuaguuagaagccaagcggagcaauucagaggcagagaagaagccaguuugaauaagccagcuuggagaggaguuuuaaccagaacagcugaguugaaacagccagccagagcucagaaagagcuagaaagaaugagauuaucccuugggaggcugagguaggcagauuucugaguucgaggccagccuggucuacacagagaaacccugucucgaaaaacaaaacaagacaaaaaacaaaacaaaacaaaaaaauaaauaaaaggaugagauuauucaguaacaggccuaaggcugaaaaaagucuagaccuaaauaaggugguuacuucuaauaauaaagaaaucuuuaaaacaacaacaacaacaaaaaccaaaaaagauucuacagaggcuagaagcuuccaggacuaguccuagagagcagagagaggcaguacaccucugagacaacaauuauucaggugaauaaaaguuacuuuuaccuguguauguguguguauaauucacccaugugugaguguuugacguuuguggaggucagagggcaacuuugaguguuggucuucaccuccugguugguuuuacaggccagcucuuucuugcuugccacagcuggccugagagcuucuccaguauaucccccccacccccaacaccaagucuccaccucccaucucaacauaggagugcuggaaugacagcucaggccaccacaucugcccugcuuuaacauagguuccauggaaaugaauccagguuuuauggauugagcaaucucccuggccugauaaaaccauuuuucuaccuaauaaggaacuaacagaaaguuaaacaauuauaaucagacuguggugagauuuccuucagauggacauuggcugugcuggauagcuuucugucaaauugaugcaagcaagggccauuugggaagaaggaaccuuaauugggaaaaugacuccaucagaugggccugugggcaaguuuguggggcauuuucuugauggaugauuggugugggagggcacagucugcugugaggggugccaccacugagcagauggucuugcucugucuggaaaagaaguugagaaagcucuagagagcagucaaucagcagcucuccuccaucuccuccauggccucugcuucaguuccugccuucagguuccugccucugcuucccuuaucaaagacugagugggaaguguaaaccaaauaaacacuuccucccuuaacaaaggcuuuccucguguuuuaccauaacaauaggaagccaacuaaaacagaagcacaccuccaaggaagacuaaacaaucucuugaguuguuuguuguuguuguuauuuguuuguuuuguuugguuugguuguuuuuuguuuuuguuuuuguuuuuguuuuccugagacaggguuucucuguguagcccuggcuguccuagaacucacucuguagaccaggcuggccucaaacucagaaaucagccugccucugccucccaagugcugggauuaaaggcgcgcaccaccacuagcaggcuguguuuuuauucuuaaucuagaaauccuacuguuaaaaucuguccuaaauagucacauauucggcaauaaaaguaucacaauguuugcuaaagagcuauuuauggcagcaaaaguucugaaauaaacuagacauggugauucucaccucaccucaagaaggcuaaggcagggcuggugagauggcucaguggguaagagcacccaacugcucuuccaaaggucaggaguucaaaucccagccaccacaugggaccaugggaccauuugaaccaugugguggcucacaaccaucuguaacaagaucugacgcccucuucuggagugucugaagacagcuacaguguacuuacauauaauaaauaaauaaaucuuuaaaaaaaaagaagaaaaagaaggcuaaggcagaaaguggucagucugagguaucuauggaguuccaggucagccugggcuacuacauagugaaaccuuguuucaaacaacaaauucugaaaugauauaaguggucuaauaauagaugauaaaaaccacaaaccaaaaacagccugguuuuaaucccagcacucaggaggcagaagcaggcagaaaucuagaguuugaggccagccuggucuacagagugaguuccaggacagccaaggcuacacagagaaacagacugucuagaaaaaccaaaaaccaaaccaaaacaaagguggagagaugccucagugguuaagagcacugacugcucuuccagagguccugaguucaacucccagcaaccacaugguggcucacaaccaucuguaaugggaucugaugcccucuucgggugucugaaaaacagcuacagugagcucacauaaauauaauaagugcaucuuuaaaaaacaaaacaaaaaagcaaaacccaacaacaacaacaacauccagaacaaauaacaaaaacccccaaacaagccauuuucaagggaggagguuaauaauauggaguguuuaggggugaaggagacuacaauauaaagucauauuuaucuguuguuguuguuuuuuuaauguuuucauucuugauacaaaauugaauuuauaguguggcucuauuuacuuauaaaacaaaaaguuuugcauauauacagaauaaacugagaguacauaugucuaaauacuaguaucaggggcaggcaagauggcucagcagauaaagucagugccaguccaagaaccugagucccaucccuggaaccaacuaaggugcaagggagacauaaccuuacaaagcuguccucugacgcugacaugcaugcgguggcaccagugugcaaguacauaaaauaacaauaaaguuuaaaguuguaaaauacuaauuaccaucauuauuaccuuagggcuaugaaauaaugcacacucuuauauuacuauguguuugaaaguuguguggaauaaauguauauccuacaaucaacaaguaaaaaggaugcuucguuuucaagaaugcaggggaaaucuggagaaugguucaguggcucagagcacuggcugcucucccagaggacuugggauucgauuccccgggacccacacagggacucacagcugucuguaacccgucccagggaacccaacacccuuuucugccuucugaggguuucaagcacacaagugguacaaagacucacaugcagaccaaacgcccacccacacacaagaauucagaggacgagugggugcuauagcucagugguggaacccuacuuagcaaaucacuagggccucaauucaauccccaguuaaagaaaauaagcaaacccucacaacaacaacaacagcaacaacacacucgcuuagcagaaagccuugggccaagccugucauucagaaauuucaauucaucuuugguuccauggugaguuuggggccagccugaccuccacauaugcaccaugguacacacuccacccaggcccacuaauaauaaguaaguuuaaguugaauaaauucaaaggaaaaagugaaagaguggaccgaccugaaaagagcuagugaguucucuuccuaaagaugcuguuucagagcuagggguguaguucaggggcagaaugaaugcuuagcauuuguaagaccggacucacauuucucaauuuaaaagaaaaaagcuuauuuggggugcagugguacaagccuguuaucccagaaagggugaggcaggagggucauaaguuggaggucagccuguuugcccugcauagaaagaacugguuucgaaaauauuuucccacauacuaaauaacaauuuauugaauagauguuaucagaggguucauugugaucccgguugucuagcacugugucugcuauguaguagguucucaguaaauaucugucuuuugaacaugugucuacagacucugugagucacaaagacucccuucugguucuuuuuguuguuuuccuucucuggucugagaauaacuauaaaacauuaaugcaauaaaccaccaguucaaagaccccuaauuauauaauguugucuuuuauuguucccuaauuauaucaggaguuuaaauuuguccuccuugacaagagcacugguucccacaaaucaauuccacucgauuaacgcuuacugaacacaauguauuaaguaccccaaucugucccaucaaaccuuccguucauagaauagaaacagugaaagagaacauauaauccuaacaccggggguacuguggcagggggaaugcaaacuggaggccaguaugggcuacauagcaagagucugccgauaaaagcaugggagggauggaaaaagucagccucgugagaugguaaauacucguguugccaaguggccaggaaacaggcugacuagcucaaguuguccucugaccuccuugcguaagccauggcuuguacguaccccccccacacacacacaaauaauguaauuuuaaaaauuaaagagauuccaauagugauaaucggacuuugucaggucggggaucaauaaauucuucacgguggucuaggaaagugguggguagaggguagcgguucaguugacuugauagguaauaagaaucugucaggcucuugacagggggcuaauguuacguuaaugggugcgggagaagcugguaccauagaagagucugagcuacaagaaugaaccuuccucuccugcuuuaauaucuguccccaggcgcgacagcaagcugucuccggcguacagucaagacagcagugagagcccggggaaaaaggggagggauuuagaagggggcugauccaacaggcugacagaaagcguuaucuacgucgcugucggcgccgagggacuaauucgggaaguaccgaaccaaaccgggucagagccaccaggucgaagccuuaccugccgucccucccccacucagggcccacgcagccgccaacuugaaauuugcuuuucuucuuccagcccucguucuaggcccgccuccccgagcucucc

SEQ ID NO: 1594 - RNA, 3932 nt, Mus musculus
ugacacucuccuccucuggucucgggguuuccagaguuucuccaguugcggaagacagcuguuauuuuucuccugaaagcuuuuggcacagccggcaggcugaaacuuccaggcaccuuuuggaaaaguuguuaggguuuguuugaagcuuucuuuacauuuucguuuggguuuucaagcccugacuuuacggaggcgagcucuucguuugcuuugaaggguucuuaaagauuuuuuuccucuccggcuuucguuuuucuugaacccacucggcucaaucauggugauguucaagaagaucaagucuuuugagguggucuucaacgaccccgagaagguguacggcagcggggagaagguggccggacggguaauaguggaagugugugaaguuacccgagucaaagccgucaggauccuggcuugcggcguggccaagguccuguggaugcaagggucucagcagugcaaacagacuuuggacuacuugcgcuaugaagacacacuucuccuagaagagcagccuacagguacugcucccagcaggacugauggugacuugggaggucugugggucggggagggcaccacuaaauguuucgaguuguucguuugaaugguuugaacuguuggucccuauauuuuuuuacuuuguaauuagcaaguuuuucacuacccuucaccccccuagagugauuugaacacuuucugagguacuguuuccugaaaguguugucuuagcuacuacuuaaagauuaauguauuuguggauuucgcaacuuucuguccaagaaagugcucugggaucuuuucuuccauaguguaagagaugaaaguggaagugaaguaagguagucuacugcccaggcacuccucauugacgcuuucaaaauguaacaagaagccuaauggccccuugucuuuguuucccagcaggugagaacgagauggugaucaugaggccuggaaacaaauaugaguacaaguucggcuucgagcuuccucaaggguaggcauccaccgugugcaccuugcacucuuauuucuaagucuucccccuccauugaucucuuacaguucuuagccuuaauuuugguucauuguuuugacacaggccccugggaacauccuuuaaaggaaaauaugguugcguagacuacugggugaaggcuuuucucgaucgccccagccagccaacucaagaggcaaagaaaaacuucgaagugauggaucuaguggaugucaauaccccugaccuaauggugaggauuuuuuguuuuuguuuuuaaaaagguuuuaaaauucuucuuggucagggauaauaaauuagaugcauggggguugaaauaucucaaaacauuauuuccuuuuacacaggcaccagugucugccaaaaaggagaagaaaguuuccugcauguucauuccugauggacgugugucagucucugcucgaauugacagaaaaggauucugugaagguaaaaacauacugcuucaaaugcuagacaggauagccagaacuggggguggggggguugggggugguacggagagggucguaggguagaggcagaggaagugcuguuaacuugcauggcuauucauacuuccucauuuuauuuuaacucuaggugaugacaucuccauccaugcugacuuugagaacacguguucccgaaucgugguccccaaagcggcuauuguggcccgacacacuuaccuugccaauggccagaccaaaguguucacucagaagcuguccucagucagaggcaaucacauuaucucagggacuugcgcaucguggcguggcaagagccucagagugcagaagaucagaccauccauccugggcugcaacauccucaaagucgaauacuccuugcuggugagugggugagaagagagacaauuaccugguuacaaauucagugcuuucuguacucaacccaucuaacaaacugccauccuccucucuagaucuacgucagugucccuggcuccaagaaagucauccuugaucugccccuagugauuggcagcaggucuggucugagcagccggacauccagcauggccagccggacgagcucugagaugagcuggauagaccuaaacaucccagauaccccagaagguaagcugcagccggauagguucgaguuauuuugaucugcuugggcuuguggaguuggggugaccuggcauuuauuucuuagucggacuucugacaccguuuucucucuucagcuccuccuugcuauauggacaucauuccugaagaucacagacuagagagccccaccaccccucugcuggacgauguggacgacucucaagacagcccuaucuuuauguacgccccugaguuccaguucaugcccccacccacuuacacugaggugagaacugcuauucucacagggucaacauuuuguccuaggccuuuugaaggaaggguuaauguggguuuucuacuuaacuaaaaaaccugaaaauuuccucucuauuccccuuccagguggauccgugcguccuuaacaacaacaacaacaacaacaacgugcagugagccugcaggaaaugaagcaucuguauuagcgcauuucuuucugccucucugcuugaacuccaguguuucagagacucagucucuacagcggggaacggguacaccccagccgcugacuccucaagauggguggcaaucaguaggcgggucuccggcuucaaguggugcagaccagugcccgcacuguggcauaggaguguuugcuggguggaugucagaacacucuuagaaaaauugagaccugaccacuuucucggauguuggaaaugaagaacuuguuuguguugacugagucagggcacugcugaccuucuggcguugucuuuccaagguuuuuguuuuaaagggacuuuuaaauugucuaaaauaucaguagaccaucaucugugccaugggggacagagccaauuucaagucauggccaaaauuuuguaagaggaguguuuuuguguguuuuuuaaagucaguguuccuuuuuuauaucuuuacaaagaaaagaccuuccacggcuggugagcacgcagccugugaaauucggggcagcugcuccaaguugacuucacccugggagcaguaguagcugugcccacugacggccauaaaagccauuuuacagccaguugcacuguguucucuuguaagcauaaucagaugggagaaucuguuauuucccuguaaccccuuggaauugauucuaaggugauguucuuagcacuuuagcuugucaauuuuguuuuagucuccguuauagauguaagcuccaccagucucuuaaggauuaagcccagugacuuggaggguggggguuagggucucuaucccugaacauuguagacccaggcuggccugagagauccaccugccucugccuccugagugcugcgaucaaaggcccagcuugguuauugcuuuugaggcuuucucccaacgcacagacuuguguaauucuaacacuaauccugugaaggguugugguugacagcuggagccugggugacauucuacauugagaugccccagcacugaucggggcacagaagcccccagaccccauuuccuguccaguguugggagaaagugcugcuuucacuguggccucagcccuggcucggaagcucacuaagccuuagcacuuuguccugugucagcuccaccugagaacugugcagccagaaugucugcgagcugauggagguuucgguuuuguuguuuuuguauuuuguguaucuuuuuguaugauuaaaaacuauauuuucuacuuauccaaauauauuuucaccccaaagugggguuauccuuuguaaaaaaaaauaaaguuuuuuaaugacaaaaauaaauguucuuuucuugucuaugag

SEQ ID NO: 1595 - RNA, 3932 nt, Mus musculus
cucauagacaagaaaagaacauuuauuuuugucauuaaaaaacuuuauuuuuuuuuacaaaggauaaccccacuuuggggugaaaauauauuuggauaaguagaaaauauaguuuuuaaucauacaaaaagauacacaaaauacaaaaacaacaaaaccgaaaccuccaucagcucgcagacauucuggcugcacaguucucagguggagcugacacaggacaaagugcuaaggcuuagugagcuuccgagccagggcugaggccacagugaaagcagcacuuucucccaacacuggacaggaaauggggucugggggcuucugugccccgaucagugcuggggcaucucaauguagaaugucacccaggcuccagcugucaaccacaacccuucacaggauuaguguuagaauuacacaagucugugcguugggagaaagccucaaaagcaauaaccaagcugggccuuugaucgcagcacucaggaggcagaggcagguggaucucucaggccagccugggucuacaauguucagggauagagacccuaacccccacccuccaagucacugggcuuaauccuuaagagacugguggagcuuacaucuauaacggagacuaaaacaaaauugacaagcuaaagugcuaagaacaucaccuuagaaucaauuccaagggguuacagggaaauaacagauucucccaucugauuaugcuuacaagagaacacagugcaacuggcuguaaaauggcuuuuauggccgucagugggcacagcuacuacugcucccagggugaagucaacuuggagcagcugccccgaauuucacaggcugcgugcucaccagccguggaaggucuuuucuuuguaaagauauaaaaaaggaacacugacuuuaaaaaacacacaaaaacacuccucuuacaaaauuuuggccaugacuugaaauuggcucugucccccauggcacagaugauggucuacugauauuuuagacaauuuaaaagucccuuuaaaacaaaaaccuuggaaagacaacgccagaaggucagcagugcccugacucagucaacacaaacaaguucuucauuuccaacauccgagaaaguggucaggucucaauuuuucuaagaguguucugacauccacccagcaaacacuccuaugccacagugcgggcacuggucugcaccacuugaagccggagacccgccuacugauugccacccaucuugaggagucagcggcugggguguacccguuccccgcuguagagacugagucucugaaacacuggaguucaagcagagaggcagaaagaaaugcgcuaauacagaugcuucauuuccugcaggcucacugcacguuguuguuguuguuguuguuguuaaggacgcacggauccaccuggaaggggaauagagaggaaauuuucagguuuuuuaguuaaguagaaaacccacauuaacccuuccuucaaaaggccuaggacaaaauguugacccugugagaauagcaguucucaccucaguguaagugggugggggcaugaacuggaacucaggggcguacauaaagauagggcugucuugagagucguccacaucguccagcagaggggugguggggcucucuagucugugaucuucaggaaugauguccauauagcaaggaggagcugaagagagaaaacggugucagaaguccgacuaagaaauaaaugccaggucaccccaacuccacaagcccaagcagaucaaaauaacucgaaccuauccggcugcagcuuaccuucugggguaucugggauguuuaggucuauccagcucaucucagagcucguccggcuggccaugcuggauguccggcugcucagaccagaccugcugccaaucacuaggggcagaucaaggaugacuuucuuggagccagggacacugacguagaucuagagaggaggauggcaguuuguuagauggguugaguacagaaagcacugaauuuguaaccagguaauugucucucuucucacccacucaccagcaaggaguauucgacuuugaggauguugcagcccaggauggauggucugaucuucugcacucugaggcucuugccacgccacgaugcgcaagucccugagauaaugugauugccucugacugaggacagcuucugagugaacacuuuggucuggccauuggcaagguaagugugucgggccacaauagccgcuuuggggaccacgauucgggaacacguguucucaaagucagcauggauggagaugucaucaccuagaguuaaaauaaaaugaggaaguaugaauagccaugcaaguuaacagcacuuccucugccucuacccuacgacccucuccguaccacccccaacccccccacccccaguucuggcuauccugucuagcauuugaagcaguauguuuuuaccuucacagaauccuuuucugucaauucgagcagagacugacacacguccaucaggaaugaacaugcaggaaacuuucuucuccuuuuuggcagacacuggugccuguguaaaaggaaauaauguuuugagauauuucaacccccaugcaucuaauuuauuaucccugaccaagaagaauuuuaaaaccuuuuuaaaaacaaaaacaaaaaauccucaccauuaggucagggguauugacauccacuagauccaucacuucgaaguuuuucuuugccucuugaguuggcuggcuggggcgaucgagaaaagccuucacccaguagucuacgcaaccauauuuuccuuuaaaggauguucccaggggccugugucaaaacaaugaaccaaaauuaaggcuaagaacuguaagagaucaauggagggggaagacuuagaaauaagagugcaaggugcacacgguggaugccuacccuugaggaagcucgaagccgaacuuguacucauauuuguuuccaggccucaugaucaccaucucguucucaccugcugggaaacaaagacaaggggccauuaggcuucuuguuacauuuugaaagcgucaaugaggagugccugggcaguagacuaccuuacuucacuuccacuuucaucucuuacacuauggaagaaaagaucccagagcacuuucuuggacagaaaguugcgaaauccacaaauacauuaaucuuuaaguaguagcuaagacaacacuuucaggaaacaguaccucagaaaguguucaaaucacucuaggggggugaaggguagugaaaaacuugcuaauuacaaaguaaaaaaauauagggaccaacaguucaaaccauucaaacgaacaacucgaaacauuuaguggugcccuccccgacccacagaccucccaagucaccaucaguccugcugggagcaguaccuguaggcugcucuucuaggagaagugugucuucauagcgcaaguaguccaaagucuguuugcacugcugagacccuugcauccacaggaccuuggccacgccgcaagccaggauccugacggcuuugacucggguaacuucacacacuuccacuauuacccguccggccaccuucuccccgcugccguacaccuucucggggucguugaagaccaccucaaaagacuugaucuucuugaacaucaccaugauugagccgaguggguucaagaaaaacgaaagccggagaggaaaaaaaucuuuaagaacccuucaaagcaaacgaagagcucgccuccguaaagucagggcuugaaaacccaaacgaaaauguaaagaaagcuucaaacaaacccuaacaacuuuuccaaaaggugccuggaaguuucagccugccggcugugccaaaagcuuucaggagaaaaauaacagcugucuuccgcaacuggagaaacucuggaaaccccgagaccagaggaggagaguguca

SEQ ID NO: 1596 - RNA, 3682 nt, Mus musculus
cacucccuuccuccccacccuccuuacuuccuggaagauaacaccgccuacccccuccccaaaguggagugagaaaggcuaacuuaauuccacaaaggaaagaacaacaaaaaagaaggagcugcaagccacaccccggcugucuguagagaacaguauauuuagggagauccuaaauaugccuuucaaagugggcucuccagguccuggaagacgguaagcugaaagcagugagucacuccucucucccggccccuggcuuucuggacucccugcacaaaaauagcugcaaucacucuuuguaaauaaggacaccaucaaggucaagugugagaaaggagagggcugguguccugguaaaugugccugacuaugcaggcucaugucccugugcugcuggaggccaaaggcuaggguagucugugggcgagccuaugcuuuccccagcgcugcuuucagacagcauugcagaugaguuccugaauguccuccaagggagagcugagaaguaaaggucaagggucaaggcggucacacacacacacacacacacccgugucacacuggacacgcagagauuugacacugguggcacagaccugggaccacagcuagggaggcugagacaguuucaggccuguuugggcuacaggguuaaguucaaagccaacuuaggcaacuuagcaaaagcucugccuaaaaauucuaaagcaaauauauaaaaagagaugggggcauggcugagugauggaacacccguuuagcauuugcauggcuguaaauucaguccucugaaagggggcguggcagggguaagaauggcuugacuggacacccccucagccuugccuccggcccuuucccaguacacaucacucuguuagacauguuagacagauacaaacauuuuauuuaaaaguacaaaacaggccuuacuccucuugacuguucccaccccaagucuccccuaaacugucaacggcugcgcaucacagcccccagggaucacacaggucaccuggauucuaaccaauuuuuucucaacagaaguaaaugcuaguaagucugcugugguggcgcgucccuguaaucccaaggcuuggggggguggggggggguccaaaauucaaggccagccucagcuacauaccgaguuccaggccagcuugagcuacaugagaucuucucucaaaaaacaauaacaaagcugggcaugguggcgaaugccuuuaaucccagcacuugggaggcagaggcagaggcagaggcaggcggauuucugaguuugaggccagccuggucuacagagugaguuccaggacagccagggcuacacagagaaaccugucuggaaaaaacaaaccaagccaaccaaccaaaacaaaacaaaacaaauaacaaaaauaggaaaaccccuaaguacauagggauauuuaguuccuguaucucaaaucaagaaugauauaugggcccagguuuucagucuauggcccagguuuucagucuaugcccagguuuuucaguauauggccucauccauauugucaucgcuguccccuccaaaguccucuccauugucaaaauaugacaugauguaaucaguuuccugaaauguaaaaagaagcaaagaucaggggugaugucagaguuuucuucucuuugucuccaggcucuuucuucucacacacaccuuuccaggucugggacaccucuaccugcuguuacauucauuccuuuucaugcguauaggugcuuugacugcauguauguguauacugcuuucgugcuagaacccucggaggccagacaauggcgucagaugcccgggaacuggagucaccgguuguugugagccaccauguggaugcugagaguggagcucgaguccuauggaagagcagcaugcgcucuuaaccaagagucgucacuccugcuccauguuauacaaguuaaaguauuuguuugccuguauauguauguuauauguguguguccaagugugcccuggugcacauguggaagucaggggacaacuugcaggggucaguccuuccacucuguggguucuggggacugcacucaggucaucaggcuugguagcaagccccuuugcccucugagccauaucacccgccauguuccguguuuugaggauaggucagggauagaugaacuggagaaaggcuuuugguggcacugcaacucucugagaaugucucccguguaaggguugagagcccaggguuagugagauggcucaguacaaaaggccuuuguuguuaagccagaggaccuguggucaauaaccagaccccacacgggaaaagagagagccaacucuugcaaguugucuucugaccuccacacauuucacacacacacacacacacacacacucaugcacacauguaauaaaagauggcuuggauguuaaaggccuuuguugcucuuucggaguucagauaacuugggcagcucacaccugcuuguaacgcccagcuucagggguuuggagacccucuucaggccuccucaggcaccagaacacgcuugguaugcaaucauacagagucuuguaugcuaagucuggaggcagacucauauguaaccccaacagcaggaaauagaagcaggggggcuucuggggaguuccuggccagccuggcuugcauaauggagacccugucucaaaaccaaaaccaaaaauaaaacaacaacaagaaaucuugaaaagaaaaaaaaaaaaagaguugugagccuacaacuuguaagggagaaaggaggggugggguggggaggagcaaagcccccucaccuccucaugcuccucuucaucguauuccucuuccucccccucuuccuucuccuccucuucuucuuucucuucauccuccuccgaagucacuuccuccuccuucuucucuagcgucucaugugaggaugaauaggaagagaaacucacucacagaaugcagggagagcuggggcuccaagggaccgggaggccagcugucuaucgcacuuccuccucaccucuaguuucuguaucgucuccuccuuaucgucugugcucuuagggggccucuugggaaggauaaugguggucccuguuuggaggaucaaaaagugagaggccuuaguacaucuacuagcuuucuuucgggguuuuaaauuuggggugugugugugucuguguguguguguacgugugugugugacacacacgcggaaguuagaaugaguucuuccuuccaacaguggguccuguggauugguggcuggcaucucuuaucagcugagccaucucucccuccauccuagcugagccuacuccacccucuugcagcaaacacggcacucugcugcccucguguggucuccggcagcaaaauguggcggucugcugcccuccugugguccccguggcaccggcugacaagcccucauccuccugcagauccacucacgcuccuucuguacuuuccgcacucgaaucuugagcucacuggggagucgccgccaaucugggaagagugggagugaaaaucagcaggacccuggccggcuggaggcuucugggagugauggcuggcgcuaagggggaggggaguguuuaaaaggaaggacggaauggggguugguuugaagauuuuucagaauaaaauuguagguuugacgcuuc

SEQ ID NO: 1597 - RNA, 3682 nt, Mus musculus
gaagcgucaaaccuacaauuuuauucugaaaaaucuucaaaccaacccccauuccguccuuccuuuuaaacacuccccucccccuuagcgccagccaucacucccagaagccuccagccggccaggguccugcugauuuucacucccacucuucccagauuggcggcgacuccccagugagcucaagauucgagugcggaaaguacagaaggagcgugaguggaucugcaggaggaugagggcuugucagccggugccacggggaccacaggagggcagcagaccgccacauuuugcugccggagaccacacgagggcagcagagugccguguuugcugcaagaggguggaguaggcucagcuaggauggagggagagauggcucagcugauaagagaugccagccaccaauccacaggacccacuguuggaaggaagaacucauucuaacuuccgcgugugugucacacacacacguacacacacacacagacacacacacaccccaaauuuaaaaccccgaaagaaagcuaguagauguacuaaggccucucacuuuuugauccuccaaacagggaccaccauuauccuucccaagaggcccccuaagagcacagacgauaaggaggagacgauacagaaacuagaggugaggaggaagugcgauagacagcuggccucccggucccuuggagccccagcucucccugcauucugugagugaguuucucuuccuauucauccucacaugagacgcuagagaagaaggaggaggaagugacuucggaggaggaugaagagaaagaagaagaggaggagaaggaagagggggaggaagaggaauacgaugaagaggagcaugaggaggugagggggcuuugcuccuccccaccccaccccuccuuucucccuuacaaguuguaggcucacaacucuuuuuuuuuuuuucuuuucaagauuucuuguuguuguuuuauuuuugguuuugguuuugagacagggucuccauuaugcaagccaggcuggccaggaacuccccagaagccccccugcuucuauuuccugcuguugggguuacauaugagucugccuccagacuuagcauacaagacucuguaugauugcauaccaagcguguucuggugccugaggaggccugaagagggucuccaaaccccugaagcugggcguuacaagcaggugugagcugcccaaguuaucugaacuccgaaagagcaacaaaggccuuuaacauccaagccaucuuuuauuacaugugugcaugagugugugugugugugugugugugugaaauguguggaggucagaagacaacuugcaagaguuggcucucucuuuucccguguggggucugguuauugaccacagguccucuggcuuaacaacaaaggccuuuuguacugagccaucucacuaacccugggcucucaacccuuacacgggagacauucucagagaguugcagugccaccaaaagccuuucuccaguucaucuaucccugaccuauccucaaaacacggaacauggcgggugauauggcucagagggcaaaggggcuugcuaccaagccugaugaccugagugcaguccccagaacccacagaguggaaggacugaccccugcaaguuguccccugacuuccacaugugcaccagggcacacuuggacacacacauauaacauacauauacaggcaaacaaauacuuuaacuuguauaacauggagcaggagugacgacucuugguuaagagcgcaugcugcucuuccauaggacucgagcuccacucucagcauccacaugguggcucacaacaaccggugacuccaguucccgggcaucugacgccauugucuggccuccgaggguucuagcacgaaagcaguauacacauacaugcagucaaagcaccuauacgcaugaaaaggaaugaauguaacagcagguagaggugucccagaccuggaaaggugugugugagaagaaagagccuggagacaaagagaagaaaacucugacaucaccccugaucuuugcuucuuuuuacauuucaggaaacugauuacaucaugucauauuuugacaauggagaggacuuuggaggggacagcgaugacaauauggaugaggccauauacugaaaaaccugggcauagacugaaaaccugggccauagacugaaaaccugggcccauauaucauucuugauuugagauacaggaacuaaauaucccuauguacuuagggguuuuccuauuuuuguuauuuguuuuguuuuguuuugguugguuggcuugguuuguuuuuuccagacagguuucucuguguagcccuggcuguccuggaacucacucuguagaccaggcuggccucaaacucagaaauccgccugccucugccucugccucugccucccaagugcugggauuaaaggcauucgccaccaugcccagcuuuguuauuguuuuuugagagaagaucucauguagcucaagcuggccuggaacucgguauguagcugaggcuggccuugaauuuuggacccccccccacccccccaagccuugggauuacagggacgcgccaccacagcagacuuacuagcauuuacuucuguugagaaaaaauugguuagaauccaggugaccugugugaucccugggggcugugaugcgcagccguugacaguuuaggggagacuuggggugggaacagucaagaggaguaaggccuguuuuguacuuuuaaauaaaauguuuguaucugucuaacaugucuaacagagugauguguacugggaaagggccggaggcaaggcugaggggguguccagucaagccauucuuaccccugccacgcccccuuucagaggacugaauuuacagccaugcaaaugcuaaacggguguuccaucacucagccaugcccccaucucuuuuuauauauuugcuuuagaauuuuuaggcagagcuuuugcuaaguugccuaaguuggcuuugaacuuaacccuguagcccaaacaggccugaaacugucucagccucccuagcuguggucccaggucugugccaccagugucaaaucucugcguguccagugugacacgggugugugugugugugugugugaccgccuugacccuugaccuuuacuucucagcucucccuuggaggacauucaggaacucaucugcaaugcugucugaaagcagcgcuggggaaagcauaggcucgcccacagacuacccuagccuuuggccuccagcagcacagggacaugagccugcauagucaggcacauuuaccaggacaccagcccucuccuuucucacacuugaccuugaugguguccuuauuuacaaagagugauugcagcuauuuuugugcagggaguccagaaagccaggggccgggagagaggagugacucacugcuuucagcuuaccgucuuccaggaccuggagagcccacuuugaaaggcauauuuaggaucucccuaaauauacuguucucuacagacagccgggguguggcuugcagcuccuucuuuuuuguuguucuuuccuuuguggaauuaaguuagccuuucucacuccacuuuggggaggggguaggcgguguuaucuuccaggaaguaaggaggguggggaggaagggagug

SEQ ID NO: 1598 - RNA, 4574 nt, Mus musculus
agaaauugccuuuuuuuaaagauuuauuuauuauuauauguaaguacacuguagcagacguuagacacaccagaagagggcaucagaucucauuccaggugguugugagcuaccauguaguugcuggauuuggacuuaggaccucuggaagaggugguucuuacccacccgcuaagccaucucaccagccccaagaaauugcuuacuucuuuaagcucaaguuuuaaagucauaguauguuaaagaggguuucuacuguacaugguuaaguucuguauaaagaaggggaguuagaaggucacacaguaaauugaugagguuuccccccuuuccauccccuuucacccaggacaagaucucauaggcuaauccuccaccuggcuaugcagcuggggaugacuucaacuuaugauucuuuagccuucaccuccccaguaagugccaggaucaaaggcaggagugucguacccauuugguccuguuauaaagccuggggcugugcauacuaggcagucauucuaccaacugagccacaucucuaaucccuaugagcuauucuuauuucucagaguaaagccagaagagcaucuucccaacuacgugaccauacccuuccuauccaggcagcucaccuacugguucucuggcugauacuguuuaccagcccucaggaccucaugcuuacucaacucacucuuccaaauaccuuacaacagcuagaaaucugagaaccaggcguaucuuccacaaaaccaauacuuauuuaaucuaccuucucagaaaccaccaaggcauccuaaacccugcaaaucucaacuaagauauauucuuaaccaauucaauucaaaccccaagcaauuuaucaaaaggaagagaagggccaauagcaucugaaaaaacguuaaguuuaauauuugccauuaugcacuggggagagagagacaggaacaucagucugaggccagugugggucacauagggaccuacacaaacaacaaaccagcugcuacagacauaccaaaaaauaauuucaacuaaaaacuaugauaaaagccgggcagugguggugcacgccuuuaauccuagcaccugggaggcacaggggagacagucagggcuacacagagaaacccugucucagaaaaauuaaaaaaaaaaacaaaacccccccccaaaaaaaaaaacaaccaaaacccuaugauaaagggauagcaaugucuuuuuuucuugagacaggaucucucugugcagcccuggcuauccuaaaacucuccuguagaccagguuggccuuaaaccaaaagauccaccugcuucccaagugcugggauuaaaggugugcauauuguuacauaguacccaagcuggguuuuuuuucuuaaaaaaaaaaauuauuuauaugaguauguuguagcuaucuucagagggcaugggaucccauggugagccaccaugugggugcugggaauugaacucaggaccucuggaaggacagucagugcccuuaacuacugagccaucucuccagcccaucaagcuggguuucuuuuacauuguaagaacuaauaaacuucacaguucagcaccauauucaacauagaguaggcuaagcaucacaaagccccugaaguucaaggccagcugcacaggcucugacagagaagcaagagacacuaauauaacaucugcucacaagaguuaugcaaaauacauuccuuaauuccacaagaaaaaucucauuaucccuacccuuaucuucuaagacaaagaaaugcugaacagucuccaugagccuuucuagaaacuuagaaugccacgccagacagaaggaucuucacaaucauucacaaugccccacuguaguuguucaguuuccagaacaguaaaguaauaaacauagaaaacaaaauggaacauuuauuuuuuucuaaaacucaaaagcaaugccaaguagauaggguaagaaauuaaauauaaacacaagguccgcccuagcccuguuuauccaaggcagcauaaccaaauggacuuguagagagaccacccagucgacagaggauuuaucaacggcgucuccggucuggacuccugcuucgucuucggccuccucuaagaaaaugaaaaaacagaaggggaauaucagagaucuaauacugaauccuuauuuaucuugcucauguucccuuuacuaagauaaauaaauguacaacccccaucccuucaucuuaccuccucuugcccuuuggugguccacgaacaaaacaccaguccacacugauuggcugccccaucaaaucuugaccauuuaguccuuccauggcagccugagccucuuuguauguuucauauucaacuagaguauaccccuaggggagcauauaaaaguaucaaagcuuagccaggcgucacacacacacuuuuaauuccagcauuagagaggcagaguccagccuagucuacaaagugagcccaggacagcuagggcucuguuauacagagaaacccugucucaagacaaacaaacaaacaacaaaaaguaucagaauuuuacuucaccaaccaaguacucuuuuccuuaaaccagaaaugcauaguuacaagaaaaauuucgcagcuauacaccacauauccccauuauauacacaaacaugcucauucuguuucugucucuuucauguggguaacaaaaucaauuuccaaugucauuucacuuccuaccugugcuugaucaacucacaaaaacaacauaaucaauguaucuaagaguuguaagugagggaagcaagaaaaucuaccuucaaguaucccgugcgccuguccaaauuaaggugaauauuuuuuauuuccccauauucagcgaauuugucauggauaucuucuucaguggcuucuucguggacuccagugacaaagagaauccaaccuucaacagcuguuggguagggaaaguguuguaugaacauguaagcuaaaaagcccaguauucaggaggcagaggcaggcagauuugugaguuugaggccaaccuggucuacaaaaagaguuucaggacagccagggcuuaacagagaaacccuguauccaaaacaacaacaacaaaaaaacccaaaaccaaacaaacuaaaaaagaaaaauucugaaaagaaccuacaauaagcaauuuucugagacugguuaaacaacucuuuacuuugcauuugagugccagugcacacagacuccccauagguccuauuuacuuacagcgcugugguccagguucaucgccguccugcuccacacugucguaauccucccgcauccgcgcucgggaccccucuucuaaaagaauucauaccagaucaccgaaaacuguccuccaaaugugucccccucacacucccaaauucgcgggcuucugccucuuagaccacucuacccuauuccccacacucaccggagccaaagccgcggcccuuccguuucuuugcuuuuucuuuuaguuuguggaugcuuucuagaguuccaggugagaaaauaagaagcaacaaaaauaagagucauuugaaaaaaaaaacaaaaaaaaccugucgcguuuccuagacuaucuggaagcuucgacacagacuccagcuucagucccuucccaguuccgccccuaauuccuuucccaagggggaggagucuaucuuuucagacccaguucguggggugacgucccaggaaaauuucuacugcauuccccucucgcaccuuccccucuucccgcagucgccuccacucuccucaccguccccauccucauccauggcgaaaucuucgccccccgccucgugaagauccagcacguccgccaucuugcuucucucggcgcuuucugagucucuagaagcuaagcaccucgggaagcugucgcagaagaaaaacgucacgaguuaggcugaccaauuaaagguugccuccaagucccgcccucggcgcggugaaaauucgccaauguaggcggccccacuaugaagcgcuagaaacguccagcacucugggaccccgauggagcucugcgaguaugaggccguaggcuacaugguuugugauuguguuuuguuuucuuuucuuuugaggcagggucucucuauauagcccuagcugggcucgaaguuacagauauccaacuauauuccccuuccacaugcugcugggauuaaaagccugugcuaccacgccgggcuccaaggcuacagaaugagacccuuucucaaaaacauaaaaaguaaaauaaagugguuucggaaguucuacagccaaguugaucagguagauugaagguccggagcgcagccgcguuggggcaaauuuaaagggugagugaagucagugacuuucucauaaaacuuucaacuagcaagaaauccuuugauacauaucuacauauauggguuuauugaaaugacuuacgggcugcaguccagcuaauuggagaauaacuagauguguccagaaagucgaagaaucuaguauuugcuuaguuccacaaggcuggaugucucagcuggucuagaauccagaaaaaguaggcuccagugccggugaagaaac

SEQ ID NO: 1599 - RNA, 10454 nt, Mus musculus
cagcagcaacgcuuggccgggcggagcucaggcccgggcggugcugcggcugcagcguccagcugcccgacugaacuccagccgugcagcagacugccggagcugcgcgagcccuuucugcaccggggcucacccccgcaacucugcggguaaguccugcuuuccgcacccaacuuuguugccugucaagccuugagucguauggcgcuagcaggaccuaagcuuguaauugcuguguucgggggaggugaagaauucggaacagccgucuccaacaguucgcaaguccccaacuucccccaaaaaggacaggagagcaucacuuucagaguuggcgggacucugggauuucgcuaacuaaacuugcggcggagaucuccgggggacaggggcuccaacuucgccgccccucccccaucccucggagcuccggcaguuccggauacuuucccuccaucuuucaaguauccuuggcugccuaaaagcccaucccuucggguccgccuucucgucguuacccgcagggccccgagauccccgggcugcacacucccugcggggccaccgugucucccgccgccgggagacuugccccggccauccggcugcaggagaaggggcgaggccggcggcgguccggagcccggcgggcggggccgggaaggggagguguagggggccggacggggcggagcaggcggccuuugcggccggcgcuggggcggagaguuugcgccggucccugggccugagcuccggcucgggcuggggcgccugcgaugucucaagauggcggagcugggcgaguuaaagguaccggcccccucccccagccccagcaggacucgcucggcugcccgcugaggcggggaggcgaccaggcugggcgcagcgggauggggugggugcgggcgacguggcagggacuggcuacagggaugcgcgggcagcggccgcgaaaaggggcugcgguggcgccccgggggcggggccgcagggcagaugcagggguggggcggaggggggaauugucgccccggagggccgaggcacaaggggcggggacgcggggccguagccgcuuuuaguaguagguaguugcaggguacaggcgggcgagggaaagcuccucuagaggcguaggggugaguccaucaggccaagaggugugacagugagggggagccguagggaugggacccgaggaccagauguuaucaagcucccggggaccugaagcuuaggcuuggggcugcugugggcauccgagccuugggcaguaccgauaggggggcugagacguaagggggcggggcuguacaggagcguaccuuaagagaugaggcaggagcauccuggaggcuuagaguaaggaacuguccuaaugagguccugugguuggagagguagagaagugugaaccacuggauagaaaaaaaguuauugagccaguggagaaauaaaaacaaguaggaggagccaaggauggaaagguagagagaaggacaagguuuucaucacauuccugaaaaggagaccaggaggaaaagaacuugggagagcuaaugguccacccgugacuaggucuucuagacauucacagaagggagcccuagaaggagagagaucuugccccaccacaacacagucuccaaggaaccacaccagaagauauccuacagaaccuuagaccuucauucccccaucuucuggcuucgccccauccuugucccgaguaagccugaguucuagccauugggccauccacguuuaagagcugacuucugugcuuugguucacagaccccauucucauucucuuggggucucuguugagaaguuugccuugguucccacccugguggcuaucuaugaauauaccauguaugagagaaagaaggaagaugguaguucuggacuguuugguuucagaccccaggacaagggggcugaggugcauauuuuacaucucaaagcagcccuggccuccagguucucccagcaucccucagucccuaccuggcauucuaaggccucaacccuaaacuuuccagcccaggggcugggcugcccuucccccaagguucuucccuauauaauccagacauuuugugcguucccccccccuuuccuccacccuauggcgauucccuuaggacagcuuccuaauaaacuuaacuuuuuuuuuguuuuuguuuuuuuuuguuuuuuuguuuuuuucgagacaggguuucucuguguagccuuggcuguccuggaacucacuuuguagaccaggcuagccuggaacccagaaauccgccuaccucugccuuccgagugcugggauuaaaggcgugcgccaccacgcccggcaaauuuaccuuuaaucuaaucuaauuuggcuugaauuggcucauuucacuggcagagaaauuagcgaucacugacagauggaguaagucuggccaauuacugagacuuggggacuucuccccuacacauuuugguagcuaucuucuaguaaacaagacuaaaggaguaugggcauguaggcaaugaaaagguguggaugaugaugaugaugguggugaugaugaugaugauggaguguugaacucuggcuuaaagcccugacuuuaaaaaguuucaauucagaagcacggggagaacaggauggaucaggugauagggagguggccgugggauacaauccucuugucaccuggccacucucucaugggcugucugcccugaauccucuccuuccuuguguccuaucuuuuucccaggaggcuagggcucugagagucugagcccugagagacaauaaucagcuuaagggaaucucuggauuagggguagggaugggggcuagguggugcuuguggguucagcuugucaggucagagguacucagaggugguacacuagcuuuagagcacuuuucaacacuggggaccgagaggagcggcacugccgcccaguagcucagcuuccaugucaccagcaggacaggcccuuuugaagccggaucguuucugugcucuuccccgcagcacauggugaugaguuuccgagugucugagcuccaggugcuccucggcuucgcuggcaggaacaagagugggcggaaacacgagcugcuggccaaggcccugcaccuccucaagucuagcugcgcccccagcguccagaugaagaucaaagaacuuuaucgcaggcgcuuuccccggaagacccuggggccuucugaucucuccuugcuuucuuugcccccuggcaccucuccuguaggcucccccggcccccuugcucccaucccucccacccuucugaccccuggcaccuugcuaggcccuaagcgugagguggacaugcauccuccucugccgcagccugugcaccccgaugucaccaugaagccacugcccuucuaugaagucuauggggagcucauccgacccaccacccuugguauggcugacuaugcucccucaggcuuucuggauucuggcucaggcuggaguguuuccucuuagguuuuacccuuguaggaucggcacuacgggauggaagccggaagcuucucaggcgcgggcuugggauuaacugugucuuuguguucgcagcguccaccuccagccagagguucgaggaagcccacuucaccuucgcgcucacuccccagcagcugcagcagauucucacguccagguacaucucucauccucugccuugucccuggggacuguccucucuguccuguguugucucguucuuuugccugucuccucucugugcccuggacagcuucugcucacccucugaacugacaucgcucuucuuuguugcagggagguucugccaggagccaagugugauuacaccauacaagugcagcucaggugaauugcgucuuauuaagggcgggugcuggacaaggggggggggcauccuccuccuccccagccccaguccacucuggcccgagacuuuucuggaugcugauggcuacaaauaacuaugacugauuuucuuuuuuccuuuuuuucuggaguuuucuuuagugcuagauucaccucagaaaacugccacuuaccccacucaucuguccuuucucgccagauucugucucugugagaccagcugcccucaggaggacuauuuccccccuaaccucuuuguuaagguuaaugggaaacucugcccccugccgguagguaaagagucuuucccuuuggcagcggauaaauguuaaguaaaaaccucuuaugaaaagaacugcuuagaguagugccuggcacguaguaguugcucaguuuauugaggaaaucaguauaaucuagagauuauuaaaauagggcugacgaguaggucgaccgugcuccugugauaggccaccuaucuaagaguauauagauaauacaaacuguacuugauauguuaauaagagggaggcggcucaaaguugggugcauggaaaagagagguggcucugggaugaauugaggaccgggugaauaggaucaaaacacacuguaugauacucucaaagaauaaaaaaauaugagugaaauaaaauaggacugaauaauuuuugucagaacccaggagagggacaccaguuuaauacaaagguuuagaaaagaccucuaaaaggugacagcagaugaaguggacccaugggacucagugacuggguuccuaguuccuuggucaauaaacucccccuuuuaccccucaagugaaccccuuacacagccuggccccaugagggccuuguugugcagcagauuccuauucauuugcuagugugugagcugaccucccccccagagaguaaucugagaccagaauucuguuguuagaguugaaccccucccagugcucccucuccacuaacaaaucccuccuuuccucaggguuaccucccuccaaccaagaauggagcugagcccaagaggcccagccguccgaucaacaucacacccuuggcucgacucucagccacuguccccaacaccaucguaguuaauuggucaucugaguuuggacgggugagcauaucugaggcuguaaggcccgcagagaggcuacagggagccaucuaguuuuggguuggggauucaucuugcucuucguaggccucucugauaaaggcuaccaucucuggucucugcgagacaaaggcuauggggaaagaggcggcuugggaagcagaagcuaauggucccucucccuuccccaaguagaauuacuccuuguccguguaccuggugaggcaauugacugcagggacccuucuacaaaaacucagagccaaggggauccggaauccagaccauucccgggcacugagugaguuaccguucuuuccuccuuccgcuugggcucagggcuuccugccguccuccaggcuuuaucaggaacagcucuuucauauggucucccugguuuucuccucagucucagcugaggagugggaagagcuugcauugccaaucacacaacagcuuuguaucucaaaggcucuaaucccacccuacuaagaucugaguucucuguacugaaaagcccugauguucauuccaucugaucuucccaugaugcuucccucccaucuagaucaucccuaauguagcccaugguuuaccuugcauugucuaagcaucuucagggacgcagacaucucuucuccacuccugugauauaccaugaguccccgccucuacccagcugcugucagcuggggcugucugcugccaggcugcugcuggccuugcugaccccuagcccugcucuuguuuuagucaaggagaaacugacugcugaccccgacagugaaguggcuacuacaagucuccgggugucacucaugugcccgguggguacgaggcgggauaggaagugggagggggguuggguuacauucugaagaggguuucucuggauacuagagcaagguuugcuagcgugaacucuccucuccucagcuagggaagaugcgccugacugucccgugucgugcccucaccugugcccaucugcagaguuucgaugcugcccuuuaucuacagaugaaugagaagaagccgacauggacguguccugugugugacaagaaggcucccuaugagucgcugauuauugauggguagggcucuucagcuucccucucuccuaggacggucacuaaggccucccuccccucuuuauggcuuacuucccauaaaucacagcuuucacccccuccaucuccucuaccauccaccaugugugugacauuaaggacuucagcacccugaaugcauuuucucaucaguccucaugauagccccacgacauaggugccgucacgaucgaugaggaaaggaaccuagggcagaaggucacaugaguaggugacagagcagugcauugaauuguuccacggcauugcugacaacuacccgaccuucccacagagcauaguggcugggcuccucuucauuuuuccuauuacaaaagcauuuauuagauugaugaaauaaggauuuuuuuuuuuguuguuuuguuuuugagguccuggauguacuuauauagcuagacuuucacccuagccuaauaagcaagugauauucuugguccuaagugaccuuaguucccuuccccuuccucuacuaggguucacacauucucucuuaggaagguuuaacccugggccugagcuugcuugcuuuuucuuuuucuuuucuucuucuucuuuuuuuuuuuuuuuuuuuuuuuuuuuuugguugguuuuguuuuuucgaaacagaguuucucuguguagcccuggcuguccuggaacucacucuguagaccaggcuggccucgaacucagaaauuugccugccucugccucccaagugcugggauuaaaggcggggccugagcuuucugaagcucucuuacauccuuucucccccacagugcuagggaucagacucagccugcaggcuaagcaggugcucuguuacugagcuacagucccagcuguauucuaucccagcagcagcucagggagguccaggagggugggugaugcagaugaggugacuaaagcauaggaagugagugucagaacaccguggguggcuccagccgcguccagccucgugaauccacauguccuccucccuaguuuauucauggaaauucuuaauuccuguucggauugugaugagauccaguucauggaagauggauccugguguccgaugaaacccaagaaggaggcaucagagguuugccccccgccaggguaugggcuggauggugagugacccccugcuccccaauugagcuaagucauggcuggcccuuucucugagacagccuucuuaaccacccacaggucuccaguacagcgcaguccaggagggaauucagccagagaguaagaagagggucgaagucauugacuugaccaucgaaagcucaucagaugaggaggauuugccccccaccaagaagcacugcccugucaccucagcggccauuccagcccuuccuggaagcaaaggguaugagaaagguugcucccauagcagagggacagaagucagaacugccuucuggccacaggucgagcuuugggacagggaagagcaggcggagugggacguggggcaucugcgcuuggcuagcucuccggcucuuucucuccacucacagagcccugaccucuggucaccagccauccucggugcugcggagcccugcaaugggcacacugggcagugacuuccugucuagucucccgcuacaugaguacccaccugccuucccacugggggcugacauccaagguagaacacugacccuaagguggaggggagggucguucccugucacccucuccagaccuguuucuuugccgagccccagggacagggggauuuuuuuuuccccuuguggugaaggagucagaagggaguugauuuugauuuuucuuuuccuaccagguuuagauuuauuuucuuuccuucagacugagagucagguaaguggccauguuuaggaagauccaagaucucggaagaguccauucuagacacaugaugugcucuuccccugcccagugucccuagggauuuaaaaaugcuuuccugugaggggagaacaugguccuuucccugcccccgucacuccauagucacaccugugauuucguagccccacucuuccugcucacucacccccacacggacucagaaccuucccuaguggauguuccacacauuucagacacccacaaggccaagaacuggaugucugaaggggcugucucaaggcaaggcacaggagaagggucugggggaguaggguggaggcagagguucccagcuuuucuucucaagaaugcuguaugaucccugagggcugguaccccacgaggugguucugaggugagugaggugcugagucaagacaacacgucaagcugugcccuucaucucuccagcacuacggcccuucaguuaucacuucgcuagaugaacaggacacccuuggccacuucuuccaguaccggggaaccccuucccacuuccugggcccacuggcccccacacuggggagcucucaccgcagcuccacuccagcgcccccuccuggucgugucagcagcauuguggcuccugggagcuccuugagggaagggcauggaggaccccugccuucaggucccucuuugacuggcugucggucagacgucauuuccuuggacugagcuuuuuggauuaugaaaucaaucuccauuggccccagcacugagcagaucacguuguggguuccgaaccccuggcugcucugaucccucaggggucauuggccaaaggccaggccagagcuucauggauaccugcuuuuggccuuaucgcugccuaacaggccaguacucacaggguuaacauuuaaccuuuuuaugguggcacauuccucuggguaugguaaccuaggcagugggaggcagaugggauagggacugagggaugaggggguccuuagccuuuaccagaucuucagccucuuggggaaaggcacuuuccugccuccucucccaagacucuccguucccuacccaaacccaaauaucuggucuuugacauccauuccguucucuuugaccauacagucgggcgacaggucagagauggacagagaacucuauuuuggauugcagauuucuuuuuuguacauaaauaagaaaacuccaaagcauccaaagaugaaaucccuugccuuucacuccccagugugacucgaggaggaaacaaggccuuaguugugauucccaggggcuggggagcaaggcguggccugucugcugccugggucucuauuuauauauuuaaguucacaauguuuuuaugcuaaacagccaaggggcgaagcgucuaguggccuguguucaggccuggauuacucuugcaccuuuugugggacaugggggcucuguguucuccuccccaauacucaggccccuuccuucagggccaaggcccugugaugugauuuuacuuuuauucccaaaguuguagcagaguucucgccuacaauaaagguugugaauguucugugagcgucauggaggggaagggauguuguaccucgcuuuccagacccaggguuuguggggcagaggguccauguuccauccuuucacuuaaaaaaaaaaaaagaacauuuaaaguguuuauuacuguguaugcgggcacgugcaccaugguuuugcacguggaagucagagggcagcuuuauggaguagggccucuccuuccaucucgaaggacaucccaggucuuggguugacaggcuuccuuugcuggucuguggucuguguggacgucacuuuuaccugggagggagugugggcauucgcacaagcauagccaagagcaguugcuuucucuuuguuucuuugaugucccuaaaaacaucaucugguaccaagacuaugcuacccgcaagucgguccuuaccucaucugcccagauguugcaaccagagcuggagggcaaacuugguuccagcgccgauccucucuuuguccuccucugcugugguugggguuguccgcaugagugugggcaugggcaggaccagagguuggguuccuccaucguccuucaguucgguugcacuggauuauaacaguuucugucuggguugugccuuguagcuuacaacgaacuuuaguauauugagccguuuaauccucccaaguauugcagaaggcaagugaguguuaaccucacuugacagaaaggaaacacauucaaggagguuuaagcgacucuguccuaugggagaguaagggcuuaaaccaaggucuucaaugcuagcuaguagucggagcacaaacccuuaacauuuagucuuugaucucagauggucuuuugauuuaucaguagacaaacucauucccuaaaucucuuucacaacacgaaa

SEQ ID NO: 1600 - RNA, 2673 nt, Mus musculus
ugugaugugauuuuacuuuuauucccaaaguuguagcagaguucucgccuacaauaaagguugugaauguucugugagcgucauggaggggaagggauguuguaccucgcuuuccagacccaggguuuguggggcagaggguccauguuccauccuuucacuuaaaaaaaaaaaaagaacauuuaaaguguuuauuacuguguaugcgggcacgugcaccaugguuuugcacguggaagucagagggcagcuuuauggaguagggccucuccuuccaucucgaaggacaucccaggucuuggguugacaggcuuccuuugcuggucuguggucuguguggacgucacuuuuaccugggagggagugugggcauucgcacaagcauagccaagagcaguugcuuucucuuuguuucuuugaugucccuaaaaacaucaucugguaccaagacuaugcuacccgcaagucgguccuuaccucaucugcccagauguugcaaccagagcuggagggcaaacuugguuccagcgccgauccucucuuuguccuccucugcugugguugggguuguccgcaugagugugggcaugggcaggaccagagguuggguuccuccaucguccuucaguucgguugcacuggauuauaacaguuucugucuggguugugccuuguagcuuacaacgaacuuuaguauauugagccguuuaauccucccaaguauugcagaaggcaagugaguguuaaccucacuugacagaaaggaaacacauucaaggagguuuaagcgacucuguccuaugggagaguaagggcuuaaaccaaggucuucaaugcuagcuaguagucggagcacaaacccuuaacauuuagucuuugaucucagauggucuuuugauuuaucaguagacaaacucauucccuaaaucucuuucacaacacgaaacucuaaacugcacccucccacgcaugcuuauguauguaugucauaugcugauagcuaaaggaaaaguucucaccagacagagagugguagguccugggagaaaaguccggguguccuugucccauccucuguggcaaccacagcugccgcuacaucuggucccagccacauaaaagcauucaccucauuuggguuuacuuggauccuggccuggggucagacauguugauucuucacuuaagggagaggccacagguggggaggaggcaggcgcagggcagggcagcuuggugcuugauucccuccccuucuacucacagucacagccaggccagaugucccgucuucccuaccgccaagccuaccuggagcugcuccugggacuccugggagaucacgaguacguagagaaugaggugaugguauuuggggaagccccagcucagccuaggaggguaggcagacugaagaagaaaaagaucaacaagagcagacaaagccaauauagcauauugagaaaccgacuaucuuugagacuuuguuaagaggcuuuaggaagacaaaaugcugguccaaagccaaagcagugggugguaggugacagguaagggggacaugagugagagcuaugacuuggggacuccaguccauccacacuuuuucccagugcccaaggcaggcaaggauuauucaaugggcuuugggggucguucugucucaccucccauaaccccagaaggacacaagaaaacugguucuugggcagcuguaguccacacucuucccagagcucucgaaauccacacuccaguaucuggaagucaaagggagccggucagaguauccaaagcucaaccuaccaaguccuuuucuuugucccucccucccucagcccacacccaaggugacuccacucagguuucuugguugggucggcaggccgguaccuccucaucagguuccaugugcccaccugcaagaggagugggcccaaugugaacgguuguugucuuccaccagggaccccauucuccagugggcagaggaagucuguuauggacacagacguugggucaccacuguaugaaacugcccaauaacauuguggagggaaagggcaccugucucccauagacccuguucguaggugcucaccuggagggacccacagauugggggaaaugcggagagugcauguccuucgggucaacaguacagucuggucacuggacugaagaaugaccgccacacccagauccacaccucuauuugugagcggcucugucuuggagaccucaggcugcugguccagagccgcaaaagggcagaaaagaggucucugacaagagggguuuggccgggcuaagacuucggaagcaggauggcacuuccauaaauuaagggugcccacggugggagcuggccugucgccacucgccccgucccauccccaaacugccuucacguucccugcugguucccugucccaaccuggauuggaagccucuccgaagcgccggggaauggauugcuagagaggacaagcuguccucgcuccaagcugcaaugcgugugccacggcccgggucucugccccgcacccaggaguccacacacgcucugugugaagcucacugacuccaggcgcccggcgaggcgcaacagcaaccgugcggcagccaucgcgcagcucuggucaccgcgcagcucuggccaccgcuugccug

SEQ ID NO: 1601 - RNA, 18527 nt, Mus musculus
uaguuuuuccuuuauuguauguuggcuguaagucugucauacgcagccuuuauuguguugagguauguuucuucuauucccaguuucuucagggcuuuaaucaugaagggauguuggacuuugccagaaggcuuuucuguuuacugagaugaccaugugauucccguccuuaagucuauauacauucuggauuguauuuauucaugaaugcugaauucaacccuaacuacuacuccagugucaacuuugaccacuuagcuugucuguguaaccccuacuagaaggagcaggucuguucccauguucagaacacugcacauaauauacuguccuagcuuaagacacugcccuauaagccaccaauuacuuauguuucucuccacugaacugcaauaacuugaagguagaaccuaccaccuuucugauaaccaggacuuaacagagccugaguaacacaagaagaaaaguucuuagagucccaaagugucacaauucccuaggcucacaccaaugcuuugaccuuugucaugaggcuggagaaguggcucagugguuaccagcacuggcuauuguuccaggggaaguuuggcuuccagcauccacaaagcagcucacuaccaucucuaacuaauuccuguuccaggguaucuaauacccucuucuggauucuguagggcaccagucauguaagcaguacacagauuuuacacacaggcaaaacauucagacauaaaauaaaaaucauguagagaccuccccccuuugaucucaacaugaugcucuuuuauauaaaggcacuuuauuuaaaaaucaacuugucuguguaaacaagucacucuccaaguucuacuauucguguuuuggagcagaguguucgguauuuuucugggcuuacagaguaaacugacaugguguucaagaacuuguccaguggacagagcuugucggggcagccccuugguaccugcuccuggaaaagaaacagaagucagcaggucuguagagagcuccacccucugcccuuaguugagcccagaggcucagccacacaguauggaugagcacacauguaacagccaggaagacccaaguuuccagacuaaaaagcauugcauccugacugacuagaugagaggccuuagcagaguucuggccuugagcugaaagagcuaauagucccaccccugcagaguacacaguuccucuccuagacaucaauaaugcuggguuagccagggcaccaagacaccucugugacuuccuaaaacaggccucacagugagaagguacagccuggcagacacacucaggagagcuggagaauagcccuauuucuaagagaucuauaauagaacugagauguggccauguuguacuuugcuaccacaggccgacacugcccuacgcucauagaauucagacagucaaagcuaccacucagaacucuauugggcuugagaagagacaucugacacuaaaccacccacucccgccucagagaucuuaccuucccauuguaaaagaguugcacaaaccacuccuuagauucuuggugcugguagaguuccauggucaggucaacagcaaaugggggccauuuuuggucaaaaauccccaaggccaacagcauaggcaggaggguuacaucauguguugcauagagguacaucuuucugcaagaaggaaaugauucucuacaauugcuggccuugggaucaggauaccaggaggccaaggcauugccugucuccucugagagaauaacagcagaagcaaggggcagcuagcagucagcugagcugguuuaaaacuccucuggagcagauggugaacagccuguucccacucucacgucucacggagaagaacgaccccuggaacaacucucuucgcuucugccuuccugcccacucacuuauuccuccccuggugagaaacguguggccuaccucucuacuuccucuggguccugccaucccaugacugauguucuuccuacucuuggcuacgugaguguaggagggucacucccgcuccuugcagguuuggaaauuuuaauuaguuucaaacauauauuaagcugcuuggucuuuaacacaugucucaggcagccuuagccaguaauuuaagaagccauuuuaugguaucuguuugaugccaacauuucucuccucagcaugguccagcacuuuacugacucucaagcuaggagaccagcacaagggggagagcggcaaggagcaaaagguguaggagaugccaugcaggcgugugugauggccagagacggacaggcacggcuucacuguuagaaaugcugggguuggaaagaugacuccguggguaagagcacugacugcucuuccagagguucugaguucaauucccagcaaccacaugguaguuugcaacuaucuauaaugggaucugaugcccucuucuggugugucugaagacagcuacaguguacucacaugcacaaaauaaauaaauaaauauucuuuuuuaaaaaaggaaaaaaggaaaugcugcuccaaguuccaggccuguuuuaccccuaggaacucagcucccugcaccucucgcacccacugcaggcuuuuagcuguauuaucucgagcccuccccucucuucacguccuggcaguacugaauauuaaggaacaucuaauuaaaauguaggcucugcuugaacaugacagagaggagccuaagacuuaaacaagucuccagguuacgacacuguuggcaaaccacaauuugugaagcuaguucccaggacacaugacauuccaaauccaggucccuagccugugaaaguggggauacaagcccauaagcuguuuccaauguuuuaaaagguacagugaucauacuuucuguacaccaaaugaaagauucaaaccaagucaucauuguuuuggacuaucaaaauaucagaccagugugauacuaauguacuuggcauacauccaguuaaguuuuuuuuuuuuuuuaagauucauuucauuuauuuauuauauguaaguacacuguagcugucuucagacacuccagaagagggcaucagauuuuguuacagaugguugugagccaccaugugguugcugggauuugaacucgggaccuuuggaagagcagucggugcucuuaaccacugagccaucucaccagccccaguuaguuuuuuaaaaagaaaagaaaaauaauuuugagacauuaaaauaaaaacauucaagcaaagccacagcaggaagaaagguaaaagguugugaccugcuugggaguauauggccuuguaagcaccagccacccacagccuuguucuugacgcuuacccuuggucccucccugcagccagaggcccccacagcucucauaagcauucacugugcuggguaccuggucuugcugggugcggugguaggguccacaguuuugagcagguuuccuuccaggauguguaggaaugggcccacugccaucuggauacuuucccugugaagcgggaauaacauucaaguacccagcaggaacucagugcucaggagaggggucagcucugccuccuaggaccucaggagcccagucagaggaggcgaagaaaagacaagugacgcagggggcacagcaagggcagggggagaaaugguaucaaguuugaggguucucuguaaacaaagacuuccaacaaaaacaucaggauauauauauauauauauauauauauaccccuaccaugaaugcagccgagauggagacacucagggaguuacaaggaagugggcccugggcuggagauauggcccagagaguaaagucacuuacuucuaagccuguuagaaauggggaaucuacguaguggaaggaagcccauccacaucuguauacaucauaugcaugcaugugcacacauccuacacaugcaugugaacaugcacaauaaauaaauguaaacaaacaaacaaacuacaccuugaggaaucaaaaggcagagcugggaaggguagagggaacaagauucagaagucuacaaaggcaaagcagugggaaggaggcgcacccgcugccugggccuccagccaccucuaacuucuggagcugagccguaaggacucuucuuuaguccuguucagcucccaucccuuuucaucugggucaucucgucgcagugacgguaacucaacucucagggugaggagcacagcagagaaaggcugccaagugacaaaagacguacuguagcugugccucacacuucuacugggggaggaagacccccccaacuaaaacacaaccuacuacucuuaggauucuaaauacuuaauuguacaagggagaggaggcuggcaugauuggugugagucuguuguggaaauugccaccuucauagcugaaggaaugguaagcaauggccgaagggggcaggggcagccacugcauguggccugugcuugccagguacacaggccagacaacccaggcugcacugugacguuguaccauuuguccuugaagaacacaucaguuuugugaaacugauauaaguagaacgaccagcggagcagaaagagugcugcaguggcuagauacaagcugccugccuguucucaugaaguuuuacuagaacauacacuugccaguucgugugcauauuacccauagcugcuucacgaugcauaagaaugaagcugcgacagaccaggcacggcccacagagccugagguauuuacugagcacguuuauguguggacuggcaggagggaggacagugagugguuuggcuggagcacuucugcaugcccaagacuagcacacaggcaggcaugcugacugacuccaagccaacucgaccaggggcucuuuucuuacacaaccgacccuguuaauucuugaaacauuaacuguuccccucccgccaauagucccggauuaucccuucacuuuggccugacuguuuccaccuauucuuagugcaaacuggauguucuuaaucauuaaaagaaaagcaaugggcguuccagaauggaaucacaaggaccagcaagaugcagcaaacuggucagaggaucugggaccaagucuucgcucuggcaccugccaaaugagcccaggaaaaguagccagucucucucagcccagugcuucucucugucaagcagugacagggauuaaaggagggcucuguaaacccugcacagcagcaaaagaugccucccaggcagugagaacagggaauuauuuguaaacugaaccaagaccaacaagacuguagcauggcuccuccugcuuccacucccuccaccucugucuuuugaaagguaaaacaagagucugacacucugacacucuggacucuguguaacagggacagagauacagguuccuaccccaguaagagcagaggccugaggguaggcuagcagaaaggguuuuccccucuucacacagaggugccagcugagagcugauacugcccggccccaaggcaugcaagcacaaaagcaugcaccucugccacagacugagcacgaccugaccugaccugaccccucaccugucuucuuguuccaccacauacagggccauguccacagcccucugcucaaucagcugggcgaaucucuccagggccgggcaguuuagaaggcuguguaccuguaagagucacuggugaugucacaagacaacacuucuugccuacuaagggcgccaauuagcuucuauuaaaccauaggggcggguuuuuuccugggaagccuauguccucaggcccuccagaacuguuucuacagaucuauaggcacagaauugcuccuuguuuuuaaagauuucuuuacuuuuauuucacauacauugguguuuugccuacauauaugucuauguaagaauaucauauccccuggaauuggaguuauagacauugugugugcugggaauugaaccugguccuccggaagagcagcuagugcucuuaauagcugaaccaucucucuagcucuauauaggcacagaauuguaaaaacuguuccauaccccaugauggcucccaugcacuccaagucuuaaaaaacuaacaauuuuuaacuuuuaaugaagaauaaaauauaagucaaggaauugacaaaucucauuugauuuuuauuuuucuuaaaaugauuuuagcaacugcaugccauauaaauacuuuucacgaacccuugccauauaagcccacauuuacuaauaaacaugagcacuaggcacacugaggcuugggggcaccguccuuucuguaagagaaggaaaaggcccacauacugucuuuggacaucagcacuucagcccacagaagcccucccacagugugaugcuauuacugcaugggauguaauacacauuucacugcauuuuaauaacauguuuauauuacauaaaauguuauaugcauucauaaaauguaaaauguauaauauauuuuuaguacauaggaggauuuuauggauaaaucauauaggaacaugaaaggcaaccucgucucuggcugagcuaagguuugaaaccccggugacccuguaggggauaacccuacaagggacgguaggcguuuugccacccuccuggacaccaggcuccuggcacuaggccacagcucuccauaguuuguggucaucagucacauaagggcaaugccccaagcccuuccauagguagcagacgugaggacaggucacauagccucaagauagaucuccauuuuaaugagguaccuaaaggccuggaggcuuagccaauaaacucuccuucccagacacuccucccugcaaaagguauuuaccucaggcccgcccugagaagugggguacgguuuuacucaucgccacucuccgccaugacaauaaaugucuuaaccauggacugucucuuuucaucgggauccuccguggggagcaauggagaagaucuucguuuaaagagccccgacuaaucucccacaggaggccucucagcacucccagccaaggccuccaccaagccaagccagccaccgacaaaccaagggcgauccuucccgccggacccagccagagcuuucuucucuuucccccuucagccuagacccaagccagcucuggcugcccccaggaaccucagacuguacucccccaccccagagcgggguccugaggcuucacauagucugaaacccacaacagcauggucaaacuucacacaucccaccuccugagcggcuggagccccaaguauacacggggcaccucauaacccaaaaaaaucaaauugaggaaaauagucuaaaggauuaaccagauuacagauaucucaaaaauuuauauuaauugguuguucaauugugugugcauaugcacacauguguauauaugugcauauacauguguguacauacauguaaguguguauacauguaagcaugugugugcauguguauaagcauguaacuguauauauacauguaaguggguauauacaugugugcacaagcauguaacuguguauauauguauguguguauacauguaagcauguguaugugcaugcauguauguacauguguaagcauauaacuguguguauacauguaagagcacauguguguauacauggaagcgugugcaaguguaggagguagaagaugcaccgccccagugagcaugugacagucagaggacaacucaugaccaucaguucucuccuaccaugugggcucuggggaucaaacacagguuguccagcuuggaggugagcaucuuauccaaugagccauggcaucaguccaauauuuaaauauaaacauguuaauauaguuauuugaggaagaaucucacuguggaggccaggcuagcuuccaacuuuugaugcucuugcaucgcauguuaaaugcagggauuacaggccuguggaccccacccagcacagaguuuuaaaauaugcuagcacucaugcagacucucuaaaauaugacacaauaaagaggggccccaaagguucugaacccugaaaaaugcuaaauuugcaaggagagcaugggggugucccacacuuguaacccccgcacuugggagucugaagcagagaucugaggcaguucugagcugcagagcuagauccugucuugaagaaagcaaaacuuagcuugggaagauagaucacucaguaaacugcuugcugcacaggcucaagagccugcauuuggaccccagcugugguggcaccagcucacaauuccaguugugggguacagggacaggcagaucccugaagcuuacuggccagacagucgaacaugcuugcuaaucuagcccaguuagagacugucucaaaaaccaagguggauguauccugcagaaagacuucugagguuguccucuggcuucuaaacacacaugcacauauacacauagaaaaacgguauggguauacuuuaacauacucucuacucauaaccaagcccuaccuauccccacucccccaaacacacaggccaggcaaugugggaaaugaacuuccagaaacugaucuagaacugucuggguccugugugaggguccguugaucugggcccuucagccuucacaugcaccccauuuacaaaccccauuacagcagccugcagaccagaagggcuuccagucaguuccaaguuaggagccagcccauccccauggcucccaaaacccaggaccccggggaaacaguucuccuaccugcucagcagccacguuguccaggagaacaaagaaguccacgucaucaccguuguugaugcccaccccggucuucaccuuuuccaaauccucugagaugccuggcugcgaaauggcagccuucuuccggccccugcccaaacccacagguucuuguguuauuauugcacagcgaucaguaauuuacacaauguaauuuuguucaguguuuacgaccucguguaauccuuacaacaaucugguaugguuagcaauauuauuccuaccuuauagaugaacacauuaagaagcuaaaugacuuguaauguaaguuaucaagagcuagggugcuggaacaaaaggcuaacauuuccaaauccuaacccucggcggagauuucuaccugcuuuacggaaccaaugcauagcucagaccugucuggaaaccguauccuuucuggucuggauuacauucuucgcacagcccgggaggccugagugccccgcaaugcuugaguuaccuagucuucucuuucaggacccagcagcucugauaguugggguacaggacuucagagcuugccucaucaguauggaugacggcagacccugcaaggaaagaggaagcacaggugguagggggcucagcucacuuuuccaagacccccacuucugccuucuacuucccuuugucuacagagacaacccaggccgaagaugucaaggucaacuuuaccagcaguuccugccccagcucugcccacggcucuccuccaagcacugaagaaaggaacagcuuugcuuugcacacacccuccuacugggccacagaccuggauuagaucggugcucuucugacucguuccaaagauggccuaccccaggcacagccaggacuggcauguggguauccucuaacacuggcugguccccgauucaucagauuuggguuauuugguuguuucccccaauucacuuccauaggucaagacagugacuuaucacaggcuacucucugcucagaggccuccuccugagucaccaacagugucucugggaaggggacauuuguuuuuuugguggugugcccuggaggggguaaggggugugggaacacagagcacucacaaggugagccuggcuggcaguuacauuaucagagggagcugagcuuugcuuugggaggggaggcuacgccugccucaggcucagccuagccugucacaaugugaccacucacugccucccacuccggcaagccacagauggggacugaggagcucagcagguuccugcugcccugcuucugccacagcuuccucuccacagcagccucccuuuacucucgagccaaaauaaaccuuucuucccuugagauguuucagucggguguuuggucucagggaugugauggugacuaacacaggccucccaugggauccaggaaggaaauaaaugcaguccucacuggugaaaaguuuugaaauugacgacgauaacaaucauucccugauuacgugaagacucaaacuugacaccuugcucaauuaagaaaggcugagccgagcaugcugacaccguguagacuaggcuggggguuaucacuaagaucagagcaauggcagcacucucagguucggcugacagugcuccucacccgguuuucaguagugccucacuacuguucacaagagugggcagggccacccucuacagcucgguuagaagcccaaguugggaagaggagggacaucuaacuccucacuguggaggucugguuggcaagggcaacggaaggcuggauggugguacuggcgggauggugaugcugaaggacccucuccaacuggaccaacuagaagccauaagugcaggaggggucaggagaacaggcauggaggaagagaaagggaggcuucggaagugaggagaagcgagcuccccuggcacaggggugacuuucagaacacaacacaaaccuuucugauguuggaaaaguccagccagcaagcaccgaguagauuccagauuccgaaacauguugguggagcgaauacuggagagacaugaacaugcagaggcagagaugcucacacaggaacggagaacagagcagccgggaacagagcagcuguucaccucucaaaaccacacacugggucccaccgggagaaagccuuuccucucuacagacuagcugccccccaaggaccugaaaggcaauggcuauggccuucagugacuaccuguucacagaagauuaugacccaaggguaaucgcucaguagugaucuggcacccccaaaucuuggaugagaguagggggggucaagacgaguuacucauggcuaagacccuaaaugaauaagugugcccuugucuaugacucacaagaccucuuggggguuguagacuggugaaaggaagggaauauccuccacguaauucuuccucaguuucucucccagggcaaacaucuguugcaugcccaccuuggucagcugcccagcaagcacgccacccuaaaguggggcaaagagaagauuggacacucacucgguggcucaacucagcccagaggagaaucccugaagcucugccgugggcuucccagugccacucacccucaagguggucuugcgguauucagugucguaaugagaaugagguuucgggcccccagcuagauuggugacaguguaaucaaaccgaguuugaggugggaucucuaaaagcuugggguuccacuccaccuguugugaccauaaaaaaaugacauacaguugaauaaaaguucuugacgcucacggugaugacacccuguggccucugggacacaugaacggaagcaucugacaccaggccugcaaucucuccuuggaaaggaaggaaagaaaccugaccucucccuccaacugaaggcagauacaaccauggcuuauuaucccuggugcccuuacucacccuaagacucaguuacagcacuccugucccacuugacuaccaggaagaagaggccaggcugcuuggcaggcagcuacuuagugagggagugaugaaugaaagagugggcaagugaauuaaacccgaucucagggacugccacguuauuaacaguuucuaaggaaucgauguguaguuucuaugccucaaauccacaccuaggacucugcauaaggcucguguuacugccgccuacuuccuguucuuuucucuaguuucugaaacaaguggcuauaaccuacggucgccuuugucucuuuugucucucuuccuaaucuggcuccugccucaaccggaugacuuucaaaacaucacaggucucauaucucaaaugacccaugagacucuuacuccuucagagucagacgcgauguucuaauccagugucucucaagcuuccuacccuuuaauuccguuauguuguggugacccccaaccauaaaauuauuuucauugcuaugucauaauuguaguuuugcuguuaugaauaauacuguaaauauuugcauuucugauggucuuaggcaacuccuguggaaggggucauucgacccccaaagggucacaacccccagguugagaacucccguucuaauccguaaccagcuccucuucccaaccuauuaauucuuucagugugaacacaacuauacauucuaaaaccagccucugacucccuccuguccuggucccugaaggaagcucucauucacagcauauaacuaacucaaggagcuguggccauggcccugggcuuacacagcagguucacuggcucuuuaaaaaccuuaucaaacugcaccaggcaaguaaguuccuuuacucgucuguccuguucaauacacggcuuccacagaguagaaacugagccaucuauugguuuuaggcucagaagaucucccagauucuauagaaggcaccaacugucagauaaccagaucuggccuuuccuggguuuucagcuaagaggagacaagccacgaacuuaaaugauagcacaaauacaguagaaguaggugugccuuccaagacaccagacacagcugccacagcucaaagccagacgcaguucuucuucaggaagucucaaaaggaaugacauuugaugcacuccuuugaugcaaucacagggaugcagauaagcaaacaccugaacuuguaauuggugaacuucaggacaguaacauaaaggcuaaaauaacaguucuuccaggugaaguaggaguaggcguccagggcccagcccccugggcauuugaccaguauugugaaagggccuuggccccacagaauagucuaaaugccaguggcgcaugucacaauuacaauggauauaggagagcugaguuugccaugucagcaagacuuacaagcuuccuuccaaggcuacaggaauagaggaggcagcucuaagacaccccaguaagacgugguaugugaguggacacagcuccaucuggggauggaauugggagguaggcaguaaugaagaaggaugaaaauggcuuugguuuugagcuuguguggcuacugacagggcagcagcaggaaagcuguuguugcuucaggucagguuaggguaagguaccuccaguuuguucucacucuuggcacaguccccuaagucugaucuggaucugucccaucucucuccuucacuguaguguaaauccuuuuagagcuuagaccaaggcuccauucugguuaaagccacagaacccaacacauagguccacagggccacucagacaccguagaugcaaucucuaagcacauuuaccaacagaggaccuauggugcuucccaggggcaacuccugaugaccaggucauguugagucuaagcacaugauucacaguuucaagcauggaugacauauccauucauacacgcuguccagucugugaguaaaggggaacucagaccagacacagugacaggaggcugagggaagaguacucggaguccaauggccaaugcagccacgcgggugcugggaacuuacgcagagucuucuccaagaacagucaaugcucuugacugcugggcacugcuccggcccccugggcaugaauaucaccccagaagaguucaauaccaaggccaggcuucaaaucaagaucuuguuucagaggcugggguuaggggagagacagcuugauaauuuugccucauacagucacauaaauauauacacaucaucuuuaaugagaaaauuaggggggguagggagauggcucggggguuaagagcacuuacugaucuuccagaagacaaggacucaguucccagcaucuacaaggacgcuuacaaccuccugcaacuccaguucuaggggcucuaauggcucucuggccgccaagaucaccaggaccucuuguggugcacagauuuacacaaaggcaaacacacacacaaccaucaacaaaagaaaaauaauaacucuuaaaagaaaauugggugauagcaauacguagaauauaacuuaaugugacugauucgcagcaagggggaaaagacaguaagaagcaaauguaaggacaaaaggaauggaaagcuaacaaaaacuacauacggccaacagcgcaugucuauugugaagggguacagauucuggacuacacucucuggcuuuuagaacuugccuagacaaguucaaagauacaagcaagacaaagcucaagagaaguauaccaccccuaaagugaaaauuuucucccucggggcaucauaaggggauaguggaaugaaguggacagguuuccgguagucagagcaauggguucugugggacuguuugucccuguucauucaauuuaguacaaagaucccaccauaucacaacccuaggaaggcaacgucacagugggauggauugguuacaucccauguuauauguauauauguauauauguauacacacacauacauacauacauacauacacacacacagagagagagagagagagagagagagagagaucuccugaccuuccaggauaaggucucaggaaacaagcaaugaauggccuuguacauaaggcaucacaggaauuuuuaaguugccgaacucugagccucauuccaggcuaaucgcaucugggauuuuauggggugugguguccacuucucagugcuauagugcccagauacuucuaaagcaccagaggagaaguguucuugcaaugcucagauacccuguaccaauuaaaucugaaucucuaggaggaagacccaggcaugauuuuuuuuuaacacguaugaacguuuuggcagcaugcacaucuaucugagcacacaugugucugguggccacagagcccagaguacagcggaaccccuagaacugaagggcuccauucagagaagccaugcaggugcugggaacugaagcagcauccucuacaagagcaguaaaugcucuuaacugcugagccauugcuccaagcccccauacuaucucugaagaauucaauauccugccaggguuuagaacccaguggagugaggaacuggcacauccuucauagauccaccucggcugagcuuugggcaggaauuaagcaacacagcaggcuucccagcucaaccacacugucaaaggcagacaggaacuuaacaagggacugggcuaggcucaacuucauaagaguugaaagaccucccuaccgggggucaccuugccgcugucuggaagaagccugggggaaaguuuaaagucgaguucaaaaguuugcuugaaagugaauugggagcuacucugaaggccagaaacauguucaacuaaguuccaugauuuuauuuccaaagcacagaucaacuguuacccaaaccgauaagaaaacaauucagccaaacuuguauuguuucgaacaaugccucuuuguaaggacccgugagaagacugaccugaugacagcacgccugucuauaaaccagucagaaaucagaaaucguagcaaagguaacuuuagucuuaucauugucgcuguguagucuguucugacaagagcagaauaaggaaggcuagaaaacucaauaaccauggauuuugaaaagaaaccuugagagacaauauccagaaacagguucagauauauauauauacauacacacacacacacacacacacauauauauauacauauauauauacacauauauauacauauauauacacacacauauauacauauauauacauacauauauauacauauauauacauacauacauauauauauauauacauauauauauacacacacacaugauauauaacauauauucauauauccuauuauauuagagucagucacaggaggcugauggcauuuccucacaaccagagcuggcuccaucccaggcuuuuauucacagaacuuuauccaagaaaaccagacgugcuuucugccuagggcuggcgagagaacucgcagcuaagcgugcuugcucuggggacagcagccaaagcaccgccacgaggagcagaaccaccuguaacuccagucccaggagagccaacggccucuuccagcuucucuggccuacacacccacacaccccuaagucuuuuuuaaauuuaaaguagcagccuacagucugccguguaugagugggacguuaaagcaacgguccugcucauucuacaaagcaaggccauggaacuacauucuccacaguuuggagcuacaggaagaaaagcuaacgaagcugggauuauugggagcuuccaccauaaagguguaagauucccaucacacaccaacugguucacacacguacacacacacucccuggaaggauuuaaaccuuuuuuuuuuuuuuuuuuuuccaauucaaagaggcaggaguaauguaaugaauaucuucccaguaaugaacugagugggguugguuuucuucccaguccccucaacaaagaauggggauaauuugucagugaagccaguccuauacuggaauccaccaguucuauacuggaauccaccaguucuauacuggaauccaccaguucuauacuggaauccaccaguacaggcugguauugauagguauuugcacugucuauauacacugggucuagauccagacaaacuuuuauucucugcuauuacugcuaacuuugucuaaaacauaaauauaucucucuaacacucuuuaauaagaauagagagagaggaggggugcaaagaggugggcauguguagacaaaaugauaagacaaccugagagaucuaauguuaaaggcguagaguggguugcagugccagacagaaaguaguacagccauaggaacaggcuaacuggagaccugguaaacaaacaccugcuaaaagauauuuauuuaugugagagcugcccugguugcuuggcuuuuucauguguaacccucuuuaaagaccagaucuuggguugaaacuauaacucacagcccuucaggaaaacagaaaugaccauuaagaguauuugcaacugaacaaauacagacuccauggguaaauucaacccgggguguuagggacuucuggugcccuuuucuuguauacuguuagggguuauuuuuuaaacaaaaagcuaauuauuugugcuuuaaucauaauuauccugacuuauagccacaaaauuaguuaauuaacuuucccuccuucuuaccacaaauccuuuccagauuucuaaaccugaccuuaaagaaccccaagauacaguccuuguccgcaauaagacuucacaagaucucaaauggucucuggcaagcccacaagaaaaaucuguauuaagaucugguuccaaaggugccagcuugcucuguacugcggaagcacuaaagguaucuccugguacaaugaucucuguuauuaacaaccaggcacuuacaagguccuugaacucaaguucaaccacagaacuacgaaacgugacccaacuccacauccgcagaaucagaaucugcauuuaaauaagaacccccgccugggacauucuuaugcaucuuugaaaaguuucacuacaccaagcaacugaaaguuuggggggcaggggcugcccuagccaggaaggcuuacacaccacaccggugguuugggaugagcaugggaugaugacuccaggccacagccugagggccagucuacuguuguuucccucuggucuggacccagcccgagccccgacgggggacgcuaaaguguguccccaagaaccccucugugggccgccucucaccugcuccuccagcgggagaggcuugagcggacuccgugccccgugucgaaacaccaccugcaccauuuucagcuccaguagguugcgguccaccggacgcuggccauuaggagcccgcugcucggccagggccacccgccgcugguggaagcaguaagccagcgaggucaggacacccacggggacccacacgcgcaugauggaggcuguggaagcugagggcuccgcaggcaacgcggcucagcagcuacucagaaguucgcgggaacuggagggcaagugcauccaagcucucagaacaagcgacucuagcggggcgacccagcgacagucaggccggagguggagagaaaggggugggagcagaaagauugucuaguaguuuaagccuagcgucugccggccgccccuacugcaugcaggcucagucagggcaguuacuuggaccugaaacuugcacuucaaaccgugugaaggggaggccgcaaaagcagaaguuccucggacacccgggauucggguccacauuuuauaaccaagcuccccacgcaaucuccugaccucccacggaccugcuccaauuaagucugcg

SEQ ID NO: 1602 - RNA, 1125 nt, Mus musculus
caugccagucuuuccucucuccacagauggaacugucugcccugcaguccaugauggccaugcaagaggaagagcugcaggugcaggcugcugacuuggagucccugaccaggaaugugcagauaaaagaagaucucauaaagguccuucagagcuuuuuaaaaaccauuggaucagcuuguaguucagcugucuacagggcagcuucacacaagaugggaauacauugaauccuuuaaccuugaagucgagcagaaagaucugucccucacuccucugcggaguaaucuuacuacaguucuuacauucgcuuauguuucuucuaggaccugcagaugcaacuggucgacccugaagauauaccagccauggagcgucuuacccaagaggucuuacuucuucgggaaaaaguugcuuccguggaaccccagggucaggaaguaucagggaacaagagacagcagguaaguuacuggaacagcaguuccucuguagcuuccaccccaugucuaccuucucagugccagguucuccaggaagucaccucggcugcgccuggcagacugucucuauugagucaccccaugccagucuggugcuaacagcucucugcuuguuacacguuccugcagcuagucuuuggcauggcuuauggcucacaguggcgccugucucugggcggugaaugucuuuccuaagcuuuucccaaaacuagaacagugcaugugaugguguagggaugcucaauaaauacugaguucucacugcuucccuccugcucgucugugccuuccuucaccugcagcuuaccuccuuccagguguuucuguauccccccucuuccucacucauguuugaaauuggccaauaguuuuuaagauauaaaacgauacuggguauaauauugcugcugaaguaauaacaaugacaguuggucacagugugcgccaacgugucucucgggacucaccguggcuucagguccuguuuagcuguuuccacauugcugccugucuuccuucccuaguugcugcugauguuagaaggacuaguggaugaacggagucggcucaacgaggcccugcaagcugagaggcaacucuacagcagccuggucaaguucca

SEQ ID NO: 1603 - RNA, 21131 nt, Mus musculus
cgguaguggaaagcucugaagucguuuccggccaccucagcgggaagcggagacgccagcggcuagcuguuggggaccucagccggagguguaacuggccgccgccggagaagaagggacagugacugaggcggccuggucuccguagccagggaagauggugcugcugacgaugaucgcccguguggcggacggccuuccgcuggccgccucgaugcaggaggacgagcagguaagcugcugccggagccccgagcucgcccugcucccggcuagugagacccuagcgaccucacagacuccuucccccucuucucgagagcucuuuuaccguuugcucgugaaaagacuaccugugagaagaaauccuuguggaaggaguuagaguuauggugguaacuguuccucucuacacagaagccccggagaaagcuuauccagguuuaauuugaucacccaguuugugaugacuuuuuagggaccuucuuagaauuuaggacuuuucuuuugggcugcuguuaaggcugcugacuaauauaucuggggaagaccaacccuugguuucuucaccucgcuuuccuguagcucuugauccuugaccuagcucgaugacauauuuugauagaggaugagguaauauugccacuuacaaaguugucaagguucaguaaagugccuacuuucacggcuaugccugauuuucuccugcucucauaaaguauauuauucagaugagcccaagaauaugauccggacaaaggagauugggggcugggagucuuagagaacacuuccuuugaaaaauauuuuccccgugagggguaucagugggguagagaugggcagaaucugaucaguugcacugaagucuaauggaggagagggaccaaagugggucugaaaugcuacucaauaucagugggccccuacucucugcuuugaaauuuuucugaaaaaaauucauggauucuuucuuaauuuuaaacuugguauuuauuugauauuggucugccaauauugguuuguuucauugaugagaaguucuccacagaaguguuuuguuuuguuuuucugguugugauuuaucauuucccuuuauuaauuuugauuuuaaauaauaagccuuucugaaccuucaaugucugcagaagcaucggucucagacucuuguuuuaccaucaugauaguagacagaacgucacacacagccucauauagaacagcacuguccugagagugcuaggggugcuauuucucuggcccuccucauaccacccaugucagagugugugcucuuauugcccuucacaggggcucuuaggcuuaaagucacacugcuaacaaguaggguaauggaaugugcccaggguuguugguggugcuggugcugguauggugcuuugcuuugcuuuggggguuggucuguuuuuaucagggacuguucccauuuggagcugguugauacuuuguugggagagacuguccugugccuuguagggcgucuauccuuggccucuacuuccagacggcaguagcaaaaguuccuuuagggacaaaaucaggccugguugagaauugccaguuucaguaaucaguauuuuauuaaguaagcuauuguuuuuaaaaucaguaucaguuuggcucuagaccagaaccuucguuccuaaucauuauucuguacugucuuguuuaagacuuuucaaccacguagucacuucuuacuaauggagaaauaacuuuuuuuuuuagaaaauugggacaauuucuagauagagcuugccuugaacugaccccacugucuuagccuuuugaaugcuagaguuacagguguagaccaccacaccaaacucagaaauugcauuuaagacauagauuaucuugaccaaauagucguauauuaaguacucuaauugucuaagccaaaguaaugcauauacuuuuaacuauuuguacugauacaacuugaguuauuuuuagauauuuacuaggagccagccccuguguaagcucuuaacugccuuauuacugaagaugacugguauucagcuaagacaggaaggagaguaacauucacauauaauauagacaguguuuuauacaguguugacugcuuaccuaguaauuuaggcuuaggacagguagagaaacaaccuucucuuugaaaucccagacuugcuaacugauaaucuugucccuuuccuacucuuucuuuucuuuuuuucuuuucccuauaaugacguuuuuccuuugcacuuucuucuaucuaccucucuguucugucugaaaaguauuguauuugcgcugugcagccgagccgccuugcacccuuaucacgucagggcgguuacuauaauucccuguagaggaaaauggcugccucuugauucuugguccaacuggccuuugaccggcugaguccaucaaggauuuaucaaugauaagaccuagcuaaacauucuuggaaaaugcuagugaucuuuggcaauauugagguaagaagugggcaauaauggaaaggggacucugaugcaccuucaugaggucauccaucauccaugauguccaugaugggguggaacuuggcugucuaaucucucacccgugccuguuaaguaaacuugguauacucauugguuuguaaaacaaaaacaaaacugaaacauucuuagaaaggugaagggugauauuugauagcacuaguuguccacuaggccuaggcaagaugggaaaaguccugagguucugaggaaagcauugucuuguaccuuuuguaauauagagguggauaaucuuguuugccucauggccaauccagcuguucucccucucuucguuauuggaucacuaacauauccuguggaguggaccgagguuugcucucugugugaaguggaaagcacaagcagggcaucuaaguauuuuugcugagcuaagggacugugagcccuuugugacuuugacauugaaagcugugucugucuguaaagcacugguuagguuguuuuugucggaucuuccuuaguucucacacagcuccgugagcuuuuccugugaauuacaugauugacaagacuuuguuuagaagguggaucuacuguugaaacacuuuuaaucauggaaguggaaugucacagugcuugaagaggggcuauauguggucagauuaucuaggccaaauccuagcucuucccuuucuagccccauaguguccuuggcaaaauuugguuucuaaaauagaauauuggcauaauaauucuaagcaccuccuagaguaaguauaaugauugugagcuaaaguauguaaaguguugaaauuagucccugcacagaaaaugaguauuaacuuuguuuauuuuugaaguguuuuucugaauucuagccugucuuuaaauuuacaaaccagaauugcacguaguacucuuugugcagagauggagugagcaggggugggugaaugauuuuauacuacaggauuuacccaugccauuuagaaagguuggaaacuuacauaaccgaaaguccaagaugcuaaucaugcuuauuuucaguaaaucuuuacucaagauauucucauaaucuuccccucccccucucucccccucccuguguguguguaaaauuaauguguuauauuuaagaccaacuuaauuuuuccauuuaacaguuguauauguugaacauugucucacaccauuaaauauuuuaauggcugccuaauagucuauuaugugaauaugccaaaaaaaucauuauuuagccaagacgguuuuguucuuaggaaugauaaugccugcugaaccagcauuaguguuggcugucauacuauaaucuauguagauuugucccagugcaugccauuaccuuucuuccuuagcacauucugaaauuguagcaugcuuccaaccauuuuaucuuauaauugauaugacuuaguuuuguucucucaggcuguaguaauacuuacauuauaccuugugagguuggaaggguuguguuaaucuugauuugauuggcaagguugugguuuuguuuuuguuuguuuguggauugcguuuucuucagcuuuaccuuugagguaagguauucaucugcuuuuagcaauugaaaacaguuguuuuauugauuuaggaauggagauugcacguaaguauuuuuuaagaucccuacaugauuccagugugaagccaggguugacaaucauauauauugaucuucauuaucacuuuauaacacuuccagcauuaguugggcacaugugcuguuguggguucagaucucuucauaccauauaauggcauggugaagcaacuagauugauaaauaucauucacaugucaaaauaggauauugugcauuacuucuuagugacugaaagcaugugacaauauuuacaaacauguacuuacugaccagucauggguagaugcaugcaugcaugcauacugcuuaauauaauaaugccaauauaauguuauaagguaauaguuauuauaagguaauguuuaauguaugaauugauauaauauccacauacauacauacauacauugacacaaaaacauuuucucaaaugaauaacauuauaacagaucauugccauaacaacaaugcuaaacaagauaaaugguccacaguuauucauugaguguacucugccugacucucuuggcuuacauuacuucauuacuucauuucuuuuugaauuucagguugucauuuuucugucucuguaccuuugcauaccugccauguucuaacugccuccuccuuugugcugucagcucaguagugucuugucuagaaguuuaauauuucauggugugcuuccacaaaguuagaccccagacccagacucugggaaaacuauuauaagcacuuuuacuucgguguaaagagaucucugccaaaggaaggcuagucuaucuuucaauacaaaauaaauaauucuauaaauggaauaauuugggcuuucuguuaaauggcaguguguguaaacugggugacuuacaaacaacaaaaaacacugagaaguccaagaugacaagguuagcggauuuggugucugcuucucauucauagauagcaacucugugagucuuugugagguacaggggccaaucuaacuuucuggaauuucauacagggacaucacccucaaccauuagcacuccaucaucaugacugagcaucucccaaaggcugcacuuccuuccaucagcuugguggugaaaugccauaagcuuacaggucugggcaguagagaccuucaggccaucgcuagcagggcguccuccucucuuucucagggacaggguggauuagcaauguguguuguuucucagucucauguacugccuuucuccuuugaaucuaguagguuaguaagguaugguguuuauccuuuuaaaaugaugcgacuauagaauacccccuccucuucuuuuuaauaaauuguucagggaaauacauccuaaccauuugaguguuggccuuuuuguccagaucccucuuuauuccagcuugcuaccuacacuggagaacuggauagagugauguaauaaaggauagcugcccauuuugccucacuagcugcagggccagcguucaugggguuuucaagcacaggcacgcacauacagucuuaguuaaaugcucuuccacuuuguggaagguucuguugauaauccagcauuuaaaaagaaugaguucucagaacucucucuggagugugugcaggauggugcuaugagauaucuaaugguaaaaagcacaccaaauacuuugcauauaguugacaugcacagguuuucuucuuggcacuuacauauugggaucuuggaaauacuaagaguuaggguuucucauuuguucuaaaaguaagacguuuuauuuuucuuuauugaaaugaaucuuaauaacugcuaaauaaaggaccuuauuuaccuaauauucuugugauaucaugauccuucuaacugauauagcuuugugugauguguguuaaauuuuccaaugaagcuaucuuuuuucagucaggccgggaccuucaacaguaucagagucaggcuaagcaacucuuucgaaaguugaaugagcaguccccuacccgauguaccuuggaagcaggagccaugacuuuucagugaguauagcucugauuuuguguguguguguguguguucauuuaaauuuguacuacauuuauguaauaccuuguaagaauaucacaguaggggcuggaaagauggcuuacuuacucuucuuguagcggaccuccgguucaguucccggaaccuauacaaucacuuguauuucuagcuuuaaggcaucugauacccucuucuagccuucaagguuaccucaacucauaaauauaacgccccucccauauagacacauauacucuauuuuuaaauguguguuuaaaaauaaaugaacauacccauaguuuuuaaauccuuaaaaaaaaaaaaaaaguaguguguuguuuccuugugugauacuggggggauggggggaagugccagaagacaaccucagaugucauccucaggcaacauccaccuuucucuuuuuucuuuucacagccgucucucucucacacuggccuggaacuugaaaguaggcuaagcuagcuggccagugagccccggggaucccugccugucuccuucuccagugcugggauuauaaaugugugucauuacacaugaaacuuuuuuuuaauauuuauauauaugucuguuuguuuauuuuaugugagcacgcugucccugucuucagacacaccagaggagggcaucugaucccauugcagaugguugugagccaccaugugguuguuaggaauugaacucaggaccucuggaagagcagucagugcucuaaaccaccaagccaucucuccagcucccccuggaaucucuuaaaaacacauucuagggcuuaaacaugggccuucaagcucgcaaggcauguaguuuacugauuaagugaucucuccagcccaggauaguaacaguuucuuaaacguaaauauagcuuuaaaacuacaauuuguucauagaaacacuuuuucugccucuauuucuagaacaccaaaauuuuaauuuuuuuuuuaaguuaacaugccuacaguaauuuaacuuguuaaccugugcccauucuauaccuguuaugcaguaaucgauaacuucaugcuuuaggaacauccuggaggcagacacaaauaggcuauuacuccugcucaaaggcuuacuaacagugguacagaccaagucauauaacaucuccaagcugugguuuucucuucaaaggauuucucaacaaggauuuuaaggcgauacauacguauuuagcaucuugcuuuauacauuggggauagacaauaaguauuuaaaacuguaagaggauuuuaaagcaucuaagucaguggcuauagaagugguggguuucuguuugguuuucauuacuggggauugaacccagugccuucaugcaagugcccuagcgcugaaugauauccucagacacucauggcgauggacugugcacaaagguaauagagggauggaaggcacaguacugcuugucucagggcuguaccagaagaccuucaggugcaaauuaaggguggaaggacaguccaucacagcaggagaguggauggacaguccaucacaggagagucaugcugggaagggcuugagcuagcugguccuguuguaucuguggucgggagcagaaaggaauagugcugcucagcucgccucaucaguccuggaugucaguccaucucagucaacucagugcagagacucccucaaagaugugcucagggacucuccugggcaguucuagguccugccaaauugccagucaguauugaccaucacaggaacuuuauuggacuuuuaauuaucuacagaugauuguuguuaaauaauagcaugccaaguugaaucuuuaaaaacagaaaaggcugaaaaggaaagauguuauaggaaaaccacagcaaaagaaaacaggaccaacuaagcaagcuucgcugugucagcagccuggugaugaggccugugaggaccaagaggagccgcuuguuuuaacugaaaaccaaaaaaccaauagcacuguaaaacaaaagugcuucagcuuaucagcaaguauccuuuaaaaagaaaaugguagacacguuuuguaagguaguuacauacuaucuaaggcauguuuuuuuagguacuuugauuuaaacaccaaaaaauauaaccauucggccauaugagguagugugcaccuguagucuaagcucuucuggaggcuaaggcaggagauccucgagaacuuagccaaaagaguguguguguguguguguguguguguguguguguguguguguguguguguuuaguuauaugauacaguuaucuuccauacccacagguucugccuuuguggaaaccaugucuguaaccaagaaccaugcacugagaauauuuuuuaaaauuuaaaaaguaucuacaugaaacacaugucggguuucugggacuuuuuuucuaaucauuauucccuaaacaauauaacagcuauuuauaaaccauuuauauuuuauuagguauugaagaugauuugauaucuacagaaagaucuguauggguuuuaugcaaauauuccaccuuauauaagggacuuagacacuuuccaauuuuaguaacuguggguuuccuggaagugauccacuguagauacugugggagggcuguaucuccacaauggauagagaaugaaagaccugggaagaaaguuccuucugauuccuguaggacucuacagucuuugguuuuuccuaccaaagcuaguaaaggcuucuuugccagaccuugguugucuucaugaaugcacagccuuucuaacgagccaguauucuucccaacggaggcauucagacaagcacaaugcuuuagaguagggcuuguuaaacuuuccacuugcuguacuuccugugcacaggauucuuauaugacacugaguguguagguacauaaaaugguugugcaaacuaaacauuuacugaucauaaauuguuaaaauuuuauuuuuaaauaguucuuugguauacaaauaaauuuuauauuuaacacauaagcaaauuugcaugcucgugagaugaauguguuuuauuuuuacauaaaggguugucuggacugaguauuugauucuauggaauguagaacaucuucaguauuuuucagaguuugucuucauuugauuuuauaaucuugauugguaaggacagugcuuugcauaacuguauagugcagaauggcagaaguguggcuaaagucauuucagaaacugguggaaauucuguucagaucucguggcaaaauucauuuaaugaaauuugcaauaaaaauuuuaaugcaacucaagucagcaacucaaacaguacauuuuaaaaucaaacgugcuaauaaaacguauacuucuuugauaguuaugugguggggaauggugccaggaaaaugucuuugcagggcacagugcauguaugucagaaagcaggcugcaguaaagcacacuggcaucacuggaaagcccuacuggaaggaaacaccuugggcucauaguuuuguucauucugaaacaagcuaguguugccagaucuccugcaguuccugcauucagcugugcagugcuguagggggucacaacccucagguuaacgaaacauagaugagguacuuugaagaaacaauaaauuccuauuuggguguuugaagaaagggacuagaagaaaagggaauacaaauuucacagaaaaaagcaauuacagaagugugaacauaugagaacaaauggaauuucuccugguguaugaaagcaccacaaugagaaagaacagcauacgcaggugugggggaucugguuuguuagagacaucaugccauuuggcuauaugguaaaaugugacuuaacauuucaucugaaaggcuauaaauacugugccagaauaagauuuuacuugaaugauauugugugucccugaagcuguaaguagggcaguaaguccuguuuacuucucugggagugagaccagcguuauaaaugacagugcagauuaacaucaaagagauccuuuaauccagugcucaagcaagugguaggacaccagugguagguuuuuaaauguuacucugugccugggagagugcguacgacuuuaguuucuccuuugugcggcucuaggaugucucaagagucaggaacagaaggcaggcaugcgagaucguaccagagugucugcuuuuaaaccaccuaaaccaaagaacuucugauuuuauccacuguacauauaagcccuguuaguauauguguuguuagaagaacgagagcuguggcuaaccucgcagugcuggcacaccuuucaucccagcacucaggaagcagaggcaagcugaucucugugaguucgaggucagccuggucuacagagcgaguuccagaauuccaggauagcuaggacuacacagagaaacccugucuugaaaaacaaacaacaaaagaguucuguggcuaaaggguuugagaggcucuuaguaaauuccuuuuccccaagaauaccccagucacaaagcccuuucuuucccagaaugcuagcgagcucauugucccaaaaaagaguuccacaaaacauucccuuaguaaaugauuuccgguugauuagaauucugcuagccagaaauaggcaacaugacuaucuuugagauguuucuuuuucugugccaguaaacguuuuuuucauuaacuuuuuuuucuauaaauuuuuaguuuuguuuuauguuauggaaagaaggacuuuaauaucuguucauuaguauguuuguuguacagguuaaaaggguggauggauucuucacaccuguagcuuucaaaaauaaccucuuagauauuaauauauauuaauugaaaauguacgaugaauaaacaaugccuacacucuuuuggauuuuuuucuauuuacuuuuauguuuaugaguguuuugccuguguguguguguguguguguguguguguguguguaugugcaugccuggugcccacagauccucaggaacuggagcuauagauggugugggcagagugcuggggaggaacucagguccucugcaggaacaagacguguucuuacugcugagcugcccuugcccacccagggcuuuggguauuguuuaacagugggagcugguugcuuucuucuaacaguuugugaucugaaaugaacauucugacuuaaguggaaucuuuuccaaaguugauauagugcugaaagucagcuucaaccugaagcacuauuaccacauaaacaccuugucuugcuuuuuucccuccagcuacauuauugagcaggggguguguuacuugguuuugugugaagcugccuucccuaagaaguuggccuuugccuaccuagaagauuugcacucggaauuugaugaacagcaugggaagaaggugcccacugugucuaggcccuauuccuucaucgaguuugguaagauuggagccgaauuucucuauucagggaguagcacuguggaaaaacuuauaauauugacauguuucccccuggaaugccugggaagguuugauucguuccccucuccaaauuuaccuuuuuuuuuccuuuugaauggagaaagcuucauucuuaguaguaaauucaucgagucuuguccuuuucccuguagcgcaugugccuuuuguugucuaguuugacuccuuauuaggguuauuuguaacaaaugaacauuuguuacaugaaguaagucuacuugauuaucuuauaacugaggucuauuuuccaaucuguagacugucacaggaagacuaauuuuauggaaaucagaauuuggaaaucaggaaaaaugaugauuguuuauuucaauagaauaagaaccucuaauuuaaaaauauaugauauuggaaaacccucuuuacuacauucagaaguggcaagcaucagaguucuaaguagcaggcacguauuugcacaggaguuacgggaagguucagugccagucaaaccuguaagaggccgugcuggcaggagggcacgggaaauggccugugcacgguaagcaccgggagugaggacagguaggcagaauacacugcaugaaaucuuagucaaaagagaaacauuuuuaugccuuagauuuucuaaaguuuucaaguuuguuaggugugucaccuugcuuuauuauaauagagaaaaauuggcuacaugcuaauuuauaugauguauaugguuuuuuaauguuauuuuucuggauaauaaguuuaguaaauccaagugacuaauaagacacaugugucaaggucacaaaggaaauacguggcucacccaaguuagcuucaggggaauaaagaugggaauggacuacaacaccaggcauggugacuugggacauaaauguaguuguuaccacccucaagcugacgauguaaagggaaggcgcaguuucugaauugaaggagaauauuuagggggaagaccaacuugagaggggcagaugccuuaguggggguacugcuaguccacagugagugcucaggaaagugggagugguguaaaugcccugccaacacuaccugcccccuccugcugggcuucguggccagagccugacuagaaacgggagcgucaggggcccacugauguccuccauccagguuagcuucccagcgugcaggggaacggagucagcauucaaauaagucaaagguuugggcacacaauauuucuauggcaggucauuccugcaguguugagaaaucgcacguguaggcuacagauggaugaggcugcagcucuguauugguaguuuuggaaguuuuucuaucauguuugauuugaaguggaagcacgggguaaguuuggaaaguaggcuguugguugaucacuaacucuuuuaauaaugccaucauuauuuuagggguugcguagaacuaaguaaugaagcccaaaugguccucuaaguacagauugaaaucuuucugucuucaggaaguuuacuagaaugggucugguuaucucuaaggauucugaugguaaauccuuaggcucagagauucaagggacaguucuccugaauggucaucuuaaccuuuuacaaacgaagaggucagagccaacagcaggcagauguaggaauaaacuggagaccguggacagugacugauuaggaguagacucaaguucuucagugaaggaacaggaaaguugguaaugguuaccuguccucauucuagauaccuucauucagaaaaccaagaaacucuacauugauagccgugcucggagaaaucuaggcuccauuaacacugaauugcaggaugugcagaggaucaugguggccaauauugaagaaguccuacagcggggagaagcacucucagguaucugaaaaccauggcagagaucaguuugucagacucuaguggggcucucaagaaaucgcugacgagggauuaguuacacagcaaagcuccugguguaaaggggauuugugccuugcgugauuagucuuugugcacuagaacaguguaaaggacucgcccagaagcagugacuguuucuaagaacuuacaaaaccaagcccagugaacacugaacauuugugcaaguuacagaaauuacaaagaagauugagaggcgguugccaaggaugugcuucaugcuagcugucccugggggaggccuuccugcugcuaggucaagggcauacaaugccauuuucaucgaggcagcccucuugagaaacauuuaaaucugagacuaugaagaaagaucuagucugcuuucagcguccuucagucagucaauugagugucugcuguauugaaggugugcugcucuauaacuacaugucauucucacagguuuccaggcacgguaucucagccgggccuuuguuuucuccuauuuuuuuuaaagauacuccucugacucacaauguuguccuuuaaaaaaaaaaaaaagauuuauuuauuaaauacauagcguucugccugcguguaugucugcauaccagaagagggcaccagaucucauuauagauggugauaagccaucauguaguugcugggaaaugaacucagaaccucuggaagagcagccagugcucuuaacugcugagccccuccuugccauucuucacagugcauugacuccauagcaccuguccuuucaggaacugaagaugacugcccugauccuuguagcucaggucacacuggucuccuaccuuggacucuuaaaauacuucauuauacaaucuuuagcauauacuguguaguaugucgguuuauuuguauguauguguuuuuauguguacacaugaaaauggaagcaaagucagcucucagugcuguccucaggugccauuccccuugguguuuugaggcagucugucccuggucugugguuuucaauuaugcuaggcuggcagacucagggguccacauauuugucucccaguguugcaguuauaaacauauuccuccccaacccccagacuuaguuaugccuggggaccuacucaggucuucgagcuugcccuggcaaacacuguacugucuccucggcccuguuuauuaauagaucuacuugccagauuuuuaaaauggaagucaggaggcaacuucaaguauugauccuugucuucuguguaauugagacuccguggaguuacauguuugcuuguuuaaauucagauaaagucucacuguguagcucagugacuggccuggaacucacuguauagaucagccaggucuugaacucaaagaaaucuaccugcuuuuaccucccuaguucugggacuaaagucaugcgcucccacaccacaagaccaugucucuugucuuuucauaugccaagcuagcuggccugugagcuucugaacacucucaugggaggacacuucagagcuacagcaucuggcuuuaagugaauuuuguggaacugaacuaaggucuucaugccugugugacaagugcuuuauccacugagccuucucccuagccuauaucaaguaccuauaaaaaauguauuuguuacuaaugugucucauauauauuuuauauaaaucuauauuuaacauaaauauuuaaauauauuuuuggcuuuguuuuauguuuuggaaauggucuuuuaacauuuuuuauauucauuuauuuuauuuuaugcuuaugaguguuuugucugcauguauguaugcguaccacauguguguaugugugcacacucacagagaucagaagagggcaucagaucuccuagaccuggaauuaugaauaguugugagccaucacgugggugcugggaacugaaccuauguccuuuacaauagcaguacaugcgucuuacuauccagccuugagucacuguguaucucugacuucccuggaaccauuugcuucugccuccucgaugcugccauuacaaugugccuuacuaugcccagcuuauauagacauaguuaagguaaauuaaguaaaaugaaguagagauuucucagugaugaugauuggauuaucuagagagaguuuaaguuauagauagcuggguaaaauuagaucaaauauauaugauaugugauauuaguuaaccauuagauauggacauguaagcucuucauuucugugugcuuauguguuugugugugugugugugguguacauguuuguggguauaugcaugcaguuguaugucuguacuuggguguguggaggccagagguugauaucugaucuuuuucuccacugucccucaauauuuauuaagucaggcucucacugaacuggaguucccugagcuaugcuggccagugagcuccugggagcugccugucucugcuccccagaguggauguacagacauacagugcugcaccaggcuucugugugagagauguagaucugaacucagguccucaggucugaguggcagcuucuugcaaacuaagcuaucccuucagccuuaggcucuuugaagauagauuuuuguuguuggugguggugguuuuuguuuguuugguugguugguugguuuuguuuuguuuuaguuugguuugguuuuucgaaacaggguuucucuguaaagccauggcuguccuggaacucauucuguagaccaggcuggccuugaacucagaaauccgccugccucugccuuccaagugcuuggaucaaaggugugcaccaccaccgcccugcuuugaagauagguuuuuaugaauguuguaugucucccauacuuuugugauuuucaucauaaugauuacagguagauuccauaauaaauauuucucauuucaacuuugcuguauauucaucagcagggagcuugccuugguugugcacugcagaauuuaaccuuuaugucaguaucccucaguuaccacagcauacagcaccauagucuuuaaacaucaaauuuugaguguggacuuuauuauuguaauagacuuaagaguuucuaccugagauaaaguagacuaacaaaaaauuuucuuaagcccaaaauuuauauauuuccacuuguccacagguaagaguucucuugcagagcucuuguuugcugcagagcugccagguacacugaucgacaggguauacacuucugccucuaaguagauuugccugcucggggagugaagaggcuaucucagggauucguuaaauauagagugaggggacugagcgucuucugagugcuuucuuguuguaggcgauccacugugggcauuucuguaucauuugcauuaagugcugugaccaaacacaggacaaagcagccuuuggaggaaggauuugguggccucacaguuugaggggauagaguuaaucauggcaaacucacgguauuagggaguguacagcuuugguucuuucccuccucacucaccaguauaauuggaauagcagaccugaaguacaguagggacuuccugcagcuaggucucaucuguaaaaaguuauagucccuaaauagugccacuagccagggcaccaggaauucaaguacuugagugugugggugucauuucacuuccauaacacuuucuuagucuucaucugaaauaagcagaucagaccaguuucauagacauuacuuuaaucgacauuucuguguugguaacauuuaugaucuggaaaagguuccagauguggcucaccaaacauaguauucagcagaagcaguuggucccuggagucaaaaauacccccaaaauccaaaaacaaaaaacaaaccaaaaaaaaaaaaaaaaaaaauaagagcuguaguaauguaugggcaggaaauggcuucugaaagaaguuguuuuaagugagggaaaacauaucugaguaaaguauauuucaggacaguagaagauuagccucuuuaaacaggguuuucuuuuuuuguaacauuggucucaaccugguucucuuuuuaaaugcuuguuuuagagcucauccacuuugcauguuauggaaaucuugugcauuuucaucaaguucaaauuuccuuuuguuauugccuauuaagugaugaguuguuuuucuuuauucaaagguguuaccucuacagaacugugaguuccacagagaccggagucaugggugcuuugauucucacuguccuuuugcacaucccaugguccuguuguguuguagaaucuaccauaugacucuaaggagaaccuugucuuuauauaccauguguuucaaaaggcuccuaugcagagggauucucuuaaauauuacuuauuccagccugggaguguuggugcagccauaccuggcaggaggauugcaagucaagacuaaaggacuaaccguaguucuacaacaguaccccagccuucagcaaacaaaucauugcuuaguccacauugccucguaguuguugcuucacccauuuauucucaacucauguagagucauucagcaauuguuuacagcaaaguuuuaguuuaauaagaaaacuuaauaagcaucgacauggugauuucucucccggaacacuuucuuuugugaucccuaggaccaguugcuaauuuagugacuguugcacuuauguuaaguaauaccguauuucucaaucaaaaccggucuguuaaguaacuccaaauauuccaaagcuguugcguggagcuuuugcuacuccaccuuaauucugagaccggccacgcuaccagcccacacccagcuucccuugaauccaccgauaagagacacucacacaguuguucaauuucaacuugcccuuuugacauaauugcagggcacuacuaucuccugucuggaaaagcaugcccucaucaauaauaaauaucuccgcaucucuccaccugcccuaaacuuugguugugcaguuauaucuagucccagcuaaacauccauaacuacccuccuguaggaguggucuauguggccacuccauuucgagaucucacauggcuggucaacuuuucucuaucagaagcauggacccagaaaucccuaucugucccgccuaucucuuccacccagcaacuggcccauggcuucuuuacugacagaucaagaaccaaucggggaacaggacucuagcaucagaacuaucccuacagaaagcauuguuucuuuuucuuuccuuugagaggguuucacuaagcagcagcggcuggccuuagacuccugguccuugcaucucugcugccaugcuccugggauuuucuauagcagugugccaucauacaucacugauaaagcaaagaccgaggaagaccaggaaacagacuuucaaaacuugggagcagugaaaaguuggaguagaauuccuuggcgucagucggaauguuuguuuucauaguuaagcucugugagggggcagucuucauggaaaugcuaaaggcuuaacuuacuggcauuugugagguuuugguuuucuuaaagaaccugucacuauauuuuaauuacaguuuaacuuuuguauguguguugaaaugcuacaucuaauagcuuugauuuuguaacaaucuuuacucugugaagaaacugggaaguagcaaucaccauggaaguauagcuuaguagucacuuucugauuacuugaacgcuuuugguuauccuagucuucuuacgugugguuuagaccacacguaaauaugauaauuagguaaauaugauaauuaaagauagagagaugguucacagguuaagugcuugcugcucuugcagaggaccaaauuuguuucccagccccacaucuggguagcucacaguugucuguggcuuuaacaccgcaagauccaaggcccucuucucauuuccagggcgucauguaaacaugugcauacacauacacacauaaauaaaaauaaguaaauuuuguuuuguuuuuuuguuuuuucaagacaggguuucucuguguagcccuggcuguccuggaacucacucuguagaccaggcuggccucgaacucagaaauccgccugccucugccucccaagugcugggauuaaaggugugcgccacuacuacccggcuaagcaaaucuuuaaaaaagagaagcaaaacaacuaccaggugcuguggagcacucagcucugcaugcccagcaugcucaggacccucggagccacagcagaagguggguggugggggaaaucugcugcuacuaacugggcguuggucauaugcugaaaccaucacucuaaagcagucugugugccuaucaaauguugauaauacaguuacuauuuuauuguuaaacauaguuuaaacuccaugauuuguuuauucugccagucacuuuuguuauuuuuacaccuuaguguuuuuuugacaaaccacuucaggucuaauuaauguuuucucuuuuuuuucuuuucagcauuggauucaaaggcuaacaauuuguccagucuaucuaagaaauaccgccaggaugcgaaguaccugaacaugcgcuccacuuacgccaagcuugcagcaguagcuguguuuuucaucaugcugauaguguaugugcgguuuugguggcugugagaugugaaccuagucacuaguaagggagaaccuagaaccccgcaguguauguuuucaggaaacugagcucacagggcuguguauuagaauccacguggaacuucugccucuaaagaccuugcaagaaaagaccuguccugaaaaugaaagauggcgccucguuuaaggaagcuugacccauguggaagucucucugggacagacuuucucugggugcugagcuauauguauuagggaacaguagguugucuguuuuguuucucucccucccaguacaugugugaggcagcagaacuggggcauucucucucugauggagccaucagugagauuuaagguagccaacccauucuagcagcauccugaaauucugucaaagaaggcggcccucuggggaguccuaacuuuaaucgacauuccuguguugguagcagugugauugacuuucaagugagacacaguaugugaagguucaugaugcacagauccuauguguuggccauuguaagaaguuaacuuucguuguuucccuuuuauauuuugcuuauugcacaguugcuuuggaauuaaaucaauuauauaauaugccuugaaauuauauaguauugcuugacuaaaaggaugaauuuuuuuuuucugucauuuacucuuuguuguuuguuuuucuuuucuuuuuguuuuuuuuuuuguuuguuugguuaguuuguuuuguuuuguuuuguuuuguugagacagggucucucuagccucaguuguccuggaacucaugaaccaggcuggccuugaaaugacaaagauccaccuuccucuucguuuacucuuuaacucucuugggacauuauuauuugggacuguuuggucucuguagaguugguguagcgcaggguagucagaggcccugcuuuacgagaagaaaggcccagcuuaaagcuccaacucugccugccccuuccucccacuuugucuaugcguucccaauucuugguuuucuuuuuuuuuuuuuuuuuuuauuacauauuuuccucaauuacauuuccaaugcuauccca

SEQ ID NO: 1604 - RNA, 1324 nt, Mus musculus
gacauaauuugcuuaaaucuauagucuccugucccauaaauauccuaucaggauauucacaaauugcaaaugugauguacucaacaauguaguuaguuaaauuuauuaucuuugcagaucagcuacucagacacaaacacucacauaacuuaugaaggacaccucugagagccagucccucauuucuguuucagcuuauguaaauucugcaagaauguuuuagauauaaaugacucacggacagugacuucuguaagcaaugggaguacaucagucuucuuuccccuuuuugcucagggauaauggggauaucuccuuucaccuucugagguagaauuuuauaagugggaagaauaggccuuuugaguauuaucacaaggggcuauaauauaaccuauaaguccugcgcacacugcaaacaucucuuuaaauuguacuggaaaacgagccagugucuuauuucuuagcaucuuugaagagacuuuugguaagcgguuuuauaacccuagggaucaucacugcugcccuauuccuggcggaggacaacagucucacuuccuuaugagaagccugguagggaugcuuauuguauuccuaguaaguucagaacuagaauaaauguucuucuauuaugaacauaucugccaauuagaguuuuaugcaugaaauacaaaaugacuuuuuauagagaauaagugcuuuuaagucuuuaaaaggcuuaccccauaaauaaugauauuggcaauaaaaaccuuuggaagacugaaaacccuaaguagucgcaccauagugcuuggugcuuaccuaagaauggaggguggcagcucacuguugggaguugcaugcugcaacuuaauggucagaaugaaauaaauacuuguagaauguuaccuccagugugaaguucugucgucggguuaaccuucauacacauacgcucauuuugcuguguucuaccccaucucagggggagggguaauugaugaacagaggaacaagaaugugguaaaggccagggcaauggacaaugggaagacaggacgcggccucugguguguguucuaaguagcugguaguaggaaaaucugagcaggcagaacaggucagugagcaagcaggaucccaaguagaaaguauagcaaugguauggccuuagugaaggcacauuacauggcagguaacuuguugcuagagaaguagaauaagcauucuagacagagaugauggcaugugaaagacauguaguaaaagcgaggcacaucugguucaucuuagcucaggauaagcagacaggagaacuagacuagggcuacuuugccuacug

SEQ ID NO: 1605 - RNA, 26837 nt, Mus musculus
guggaguuaagaauucuuuacuagguauuaguucaggcagaugcccugguucugcgauccccucucccuauaggucacaguugagcggguuucuucagaagagccuguggggcugagagugcugaaccccagggucagaagcagaacuggaaagccuccaauacaugcugcuuccauguuuccaggcugggcagcagggaggacaggcccaugacgugccagggcucuccgucagacaccauggagguuugguaggacagcagcuguacacccgccucugccaggaggccugggaggaaggaaaggaaagcccugguuagguugagggaaggggugagagggcagggcccagagcaggcuuccauggccaacgaugcaugggggauggagagggaaggagggggagggagcuuaaauggcaggacaggugaauuucuucugcuacgggacucucucagcacugccugagcaucaggugagguggagggaggacagcaggagaagcagagaaccucccucugggcagcugacaagugggauaagaugacucccccuaccucccaaagucuggggacacacccucugccaagacccagaaccuucggcagcccaggucucaggggagacuggggccacaccacagaagagguacucugacacacuuugcuguggcuaagcuggccacuaggaucuauagaaaggcaguccauaaaggacuccugggacacagacuguguguguacauggcaaacuugugccauggccggggauaguagcaggcacucugcccauaccgcugugaucucagauaagccacuuccccgcuguagaaacaguucaggaacccucugugagggacauauagacaugccugaggcagaaaaaggcccagaggaagcaucucuccagggccagggcccaauucuagggauuccccccccccccccccaucucuacuucagaagccuggccagccucccugacaaaaagccuucucaccaaucauagugggcagcaucccagggucggagggcugagcccggaauacgagcagggguuggccccugcguaguggcaccucuggucugaagacagcuccguugagcaucugcagcauugguguggugcccuggaccaagcccacggcuugguagggagcaccugccagggccacagucaggaggcauuccccgcuacccugcuccccuggaaccccaggguugugggagguggugaccuguagagagaagacagagacacagccuaauuacccauguguaucucucucucuuucucucucucucucucucugugugugugugugugugugugugugagagagagagagagagagagagagagagagaaagagagagagagaucuagccuggcccaccaguucaguccuggcucacuaguucggugauuuggggcuagggacaaauggcaugagcauuaugcccccagacauuagcuuauugggacagucaauaugccccauaaagggaggaaggacccccccaccccugccugcuucagagcauuuuugcacuauacauacaguauuuuugugaguaugagcucacuucgaaaugcucagacauaugcuuuuucccuuuacagaugaaguaauuaagacuagcucucaucaguagacagggugaauggcaagaagcaagcccaagugaaacugugaacaggcuucuaagaugaggggugaagcgaggcucaggggcaugugccuauaauccuggcacuggggaguuaauagcaggaggaucaggaguucaaggacaaccuggguucugugagaaugucucaaagaaacaaauuuaaaaaaaaaaaaaaaaaaaaaagggauggcagagcagugcucagaguaacgacggggcgcacauugaggccagccucuuucaccaguagcuuagcguucaccaaguucacgucugccugcuuagaugcuucucucagaaggccgacaaugacugcagggcucaggcaggucccagcauucuucagagauguuccuggggacacagaagguugcccugaagaucauuguuuacuggguaccacaggagggggaagggagccacaggcacuuaacccucagcuacaaggcccuuguuggccugggaaccccaacugcacccugcacugggcacugcgacugcuuccaagugcugaaagccagcugggacagaucugguuccaaggccagaaaccuaagaagcuuuaaccaauuggaggcacuccccuccaaaaugcaguccaacucauggcaggccuccauggccugccugucuucccagaagauacuugaaaacuugugaugccaccaguggcuggaacucgagacccuugcaaacacugaaguaacugcaugcccucagcccccuggcaugcuucuucagggucuggguacucaggccaguggacaugguaccccuggcugugccugucccugguaauuccaguguuugggauuuaacuguccugcccaacuucacauuuucuccccaagagucaggugccaaauaggugacaggguaagacagccuuguacaggaagaagggaccaccggacuccaucugcagaaugguggacccacuaccaagaagaaagcagaguugcaugcaacuacagguucauaaucagacccaaacaauuuuguugcauaauuuaaaaucucucuacagaucccaaugucuuuuaacaugaaacuaucugguugggcuggugacaggguucagugguuaggagcacugacugcucuuccagagguccugaguucaaaucccagcaaccacaugaugguuuacaaccaucccuagcaagaucugacacccucgucuggaguguauuuacauauaauaaauaaauaaauaaauaaauaaauaaauaaauaaaucuuuuuuuaaaaaaagaaagaaaagagaaacucccuggucucucuugcauggaaaacaugcauauccuaaaaacauugcauaacuguuaucugugacaauuaaauaaguuuucccagggaauuuguaucccacuuacacacuuccuuuguccaccuccauagugggugaguuacacccagagcaggauccaaguccccugaaucugccacuagaucugccaugagcauugggcauacccagcagagauaaguccacauccccacuucccugucccuaggcagugccccuagcuccugcuguggaccugaccagaccucugcucaccuuguguaaccaccuggauggucccuuuaggggagccagcccaggcgugcaucagcgugcccauugcuucugccagaccaauccaaggcuugguguguggagagaaggcacuggugagggccugggcguucaccugcagagagaugaggauuaaaucagggcacacuugcucgaaugaacagcugaaccaguguuguguggccaagggucagcuuggcauggauaggcaacuaagguuguggaugaugaugaccaccaaccaucaagcagggaacagggacuugucccuguaggugagaaguacuaaauagcccuaagaggacacagaaaguuucaaccacgcuacauggccagaacagggguaagaagccuggcuaccuucauugagcagcauugguacuggcucucucugugagagguuggcuucuugugugacagagaggggacagcacaguaaaacauggaagucacugauggugggggggcggaauggugcaucucggggauggugaucgaauuugccgguuuccguuuugagacaggaucucacuucauagucuagccuggugaaacuccagccuuaccuaacuccugagugcuaggauuacaggagugagccaccacaucuacaucgggcucauuuuauuaucuauuuugauuauuuuaagugacugcucacauuugucgcugaacacuaugcucaguugccaugacuuauaaacacauucaggcaggucugauuauacuguauuaugcuucaaacauucaccagugccaagaugcugaggcaugcugggaaauugagcaucuagggacaaguagaacaucccuggacaucccaaguauagagucucaaggcacacaccuccccccacccacucccagggaccucuaauaacagagcuucuuuguucugagguaaaauuccuacuccuuuuugugguuacagaugcucuggcuuccagccagguguuaacaauuucuuugcggcuccuuagaaagaauccauccaagaaggaguuuaacuaggaaccugggcuuuaaaucuggguuugguggcuccugcguaugaucucuagcaguaagaaggccaagggaggagguucucucugugucccgggccagcuguagauucagaguaaaaccccaucucuaaacacaagccaaacccccgccccacuggcaaacguacaagaacucggguuugaugaagaaaaucaaauaaguggcuaugagaugagaaaaaaaaacaaugcuucuauucuugcuuucaguuaucauuagacacgacuuuagcgcuacuuguaaaaacugcaggagaggaaggaaggaaagucagaggacgaggaggaggaagagggcucagacagagcagaugugcucagcucagaagccgcagcacaucucauuguuguccagugagcggggcccacagagcccaaccuggggaugugcucgcugacugucgguccaugacaaagauaaaaggaugugcaguggucagacuugaaaauaaauaggaagaugccaggguagagucaggcgccucuggaaaccaaacugguccuaaugcucgucugugcuauggucagagaacuggagaagaugcaggcauaauuagggagagauguccucuuguaauaaaaacaucucuuuccaaagacuaucaguagcuuggggugguucguucaacuugcuaauguuuauggugacugagagauuucauaguuuauguaagaugguaacacucugucuuuguacuccauggaguuugugugaagaaguuccugucagaaagucaugggaucucaccaccaccucagggcagguggcuaccucaaagggaucgcaaggagggggcagaagccugccuuugaaaaagcugagcagguccucugucagauugcccaaaaugugggacguucauuagcagggcaucagcugaggcaggagaggggcuguuucauuuaggcuuccauucucugguuggacaacucagccaggagcccaaucaaggucaccugcucaaaaacucacugggaggccagaugaacaggaaaaugugcucuggucucagggagccaauacagugugcagaggacggaggacaaacaggucaaugccauacggucaccacaggcucuguaggcucuuacaccacaaguggcucucaaagaggcuaaucaccacagaccaaauggcauccugacugucuugagacagagaacugagcugucuaaauggaggaaggagggcugcgcggaauccagcuagugacuauuuccaggcugugagucaguuagaaaggccauggguccucucgcacauccaguuggauccaccgauuuuugcagaguauuaaguacuugcuugguggucauucacagaggcugcagagaaacuuagacagccuuucagucuucagggaacuuagaauucagcuuuaacaaguuaauagaccuguuaugucguauaagguguggacagugagugugacagggcacacuuuuaacuccagcacucaggagguagagcugggucugaggccagggcuacauagugagacccugccucacaaaaacaccaaaccaaaccaaaaccaaucaaccaaacaaacacaaucauaaguagaaaaaaaaaaaaaaaaacccugaggcacagcuccaaugauucagaaagcauugaaagaggaagcaagcccccaggaaggauuagggccagaaugugggggcaucugguauuccccagacuaagcaaggggccaacuaacagggaagguucacagagaaagcggggugaguucugacugaggacaugauguaaagaaugccuagcacacccaccuccuccaucuuacacacacacacacacacacacacacacugagccucucucugucacccuagcaacaccaccccacucccaaggcauguggacaacaaaggagccuuuuuuuucugguggcugagccugggaagggucaaaucucugcagcaaggcuacaauauaacagcucaaaaacagacucccagcuccaaggucuuagcuaucaagacuacagaagggcugcuccauccaucuaucccaagugccaacacaaguacagauuccaacucuucaguucccagggcugagccuguccaccccuagcugcuucgucugugccuuuucucuucccagacuccaggccccagucucauguugcaauacuuacaacgccuguuagagauuuccccuucaccauguccacaaacuggacugcgauuuccuccccacagcggcucugggcuuccuuggugcuggcacccagguggggacagcugaugacauucucgugguccacuaaggcccggucccgugguggcuccuacccagagagauaucucuaaguugguuaugaacuggcuauacacccucugcuguuguucccacugaacuuugagaauugcaaccaugcggaucccagcagacaaugcaauguuacucauggcagaagaugcuacugcauaauuagaagacgguccuacacaguggagcuugugacagaguugagagacccagaaacacaaaccaaaacacugugcaccuuuggcugggaacaucccagugcuguggggcuucagagggggccagugacuugccacggccucauagcuagaacccgcauucaagccaagguccacacucuuuccucuggggccacaccaaggaacccagaugcugagauaacaucucugaggagagaggccaauaggacuggugcaagugcguacucagcacucuguaugcugaggcuaaaccuuugaacaugcugggacaagaaagaguacacucuggggacuuugggagaauacugucaucauuccugggcuucugagccucccugggaagggaagaggaaaagaggaaagcuaauggguaccaggcaggccaucuucuuggccauauggcugacuuaaguaucgggaguggcacacaaacuccccuugucuucuccaagucaucaauacggcaacagccugaccaggaacggguacuguuuaacaguuuaaccaggaauggguucuauuuaggaccuuaguuuugcagaaggcagcacagccucuucaaaaccgcagguguguucuuggcacacagugagcucuugggcuucaagauggcgcacugucuugcccaaggccuuugugcuccccccucaccuuuacccucugaccccgacacagaggcugcaagcacuuacuucuguaaacacauccagugcagccccagcacacugaccagacugcagggcacgcagcagggcaccuucauccacaaugccuccucgagcacaguucacuacucgcacaccuuucuugcacugagcaaaggugcugucauucagcaagccuggaagaaagaggagacuauuaugauggcucuugacccucucacuuaacaggucccauaacucacaucuccccaaaggccucuuucuccuggauagcuaccuuguucucacuucugucuuccuagaugcucugggauaauagaccuuguacuagauguggguuagagucaagaaguuuaggaaauggugcuuggugguccaacaaaaugcccugcagggucccaugaagccucuacccgggaugccaguuguacuaccucagucuauuuagacaccuggcuuuuccagagagcucaccccuccuccaucugaggcaaggacuugugacaaaguaucaucaugcucagcaggccccaggcagcucccucccuacaccugcuugaugaugucugcagaaaacccacacugagagccuaccugugguagagggcaggagugggguauggacaguuauaaagucacagagaggccagaucuccuccagcggcagcugcugaacaccaaaggaggcggcgacuucaggagagaugauggggucauagccuacagucuggucagaagugagagaaggcagaggcaucuuaauaucaauagcaucauuaucaguaacugcaccaucaguaacuggugccacacgaaaccuaacugaauucccuacuguaauucucagaacaguacaggaggcuuggggcuacgcuccugacgggaaggaggcuugcagaaccagcagggugcacagccagcauagaggggaagaggcugccucucaccaaccuccaaaccccccagcaggugcaggagcaacuucgguguggcuggaccaagugggucuuggaagcccugagacaggagcacuggugagggagggcacucccauggggaaugugccacaggaaacagaagacaggcugguagaugcagcuguaaggcccaggacagacuggagagaaggacagcuucuaaucagaagauaaaccaagacgugccauuagaaagaagguuaauucauauuguuguuccaccuauaggguugcaguucccuuuagcuccuuggguaauuucucuagcuccuccauuaggggccgugugacccauccaauagcugacugugaucauccacuucuguguuugcuaggccccggcauagucucacaagagagagcuauaacuggguccuuucagcgaaaucuugcuaguguaugcaauggugucagcauuuggaagcugaucauuugucuuuagcugcauauguaucaaaagauggccuagucggccaucacugcaaagagaggcccauuggacuugcaaacuuuauaugccccaguacaggggaacgccagggccaaaaagggggaguggguggguaugggauuggggggguggguaugggggaccuuugggauagcauugaaaauaaaugaggaaaauaccuaauuaaaaaaaaaaaaaagguuaagauacuauguagggcugaagaagggguaagagcccucucucugaauucgauuuagugagacuuaaaaugccccugguuuugaaauaacccagauuacacaauaugcagagcuuaaagucucaauucauacuaacguuccagugaccaaaggcaaaguuuucagccucaugaaacugguucagugucaucaccgaagcggauggggcacacagaugcuuaccgcuaaggcaagcugauaacagcaauacuauguaacauuuacugugucuggugcuuuguuguuguuucuaaagccuaggcuugcuugccuuacaguugaaauccuccuaccucagccuuugaagugcuaggauuacaggccugugcccucaggccuggccgugauagcacaucuacaucguaccugauggauuagguauuaauucccuguguuagcccggagaaaccaaggcagcggucacuccuggcauuauacucuggccucggggccugcucgucuagugccuacacuccucccgggaaggcagaaaggugggauaagagcaggggcaggucagcaugggggcaaucaugggcgagggcagcacuguccaacagagacaacugacucugagcaaaaagacggcauggagaauccaugcuacacacacacacccacaugcaaaccuucccuaccccucaugcccccuagacacagacacacagacacacagacacagacacagacacacacacacaccuugugagagaaaggaguugaaugagaugaaacccagcauuggagacaaucucaaggaagaaucauucaagucucaggaggagccauggccucaguuacauuauuccccauaagcagccaggcagauucagaaagcaggcagguggguuuugcaauaacgaagaccuaaguacccuugccugaucuaccagcaggccucccuaccaagcucaacuuuugucugagauugacuauggagaaagggccauaggaaccauaugucaugaaggcccugauguccuugaggaggaaggguauagucaauccauugaggcaggugugccugcuguaaccaagagauguggcuggagccauggagccaggcguccuuccucagcugcuguccucuagaugggugaggacccugacacuaagaauucugagugagaugaccgccacacacacugcccuagcauucuaucacaaauauauuccaagaaaaacaagaaaguccccuuaacccuuuaaggaugcauuuggaguggacucgguuauuagaacagggagggaaugaggccucauccuugagcaguugcuucuucccucugcagagaggagugguacccaccccuuuccugugcuucuauauagagagaucaucuuguauauuguauggaugccucaccugucaauuaaaaagccuauggccuguggcuuaggcgagaaauagaggugagagaaagaauucuggagagaaagaauucuggggggcaggggagggguugggaggagggaaggccaaugguaccacagcuacagaacacagguaaccagucacauggcaaaauguagguuaaaauaaaugggugucuuuaguuauaagcuagucagaguagaaccuagcuauauggccaagauaguuguaagauaugacuugggucugagucuuauuucugggagccuagggcugggagacagaacuuguaguccucuacuauauggugcgcgaaucacuuaaaauuaggacuacaagcucugccuuacaauaauagacuucuuuuuaauacauagagcuucuggggggggggcacuaauggugaauaaguuaguacugugggccacagugugcaucauuagccuuguucauaagucaagccaaggagcucccuuccccccauccaucccagccaccagcgaggguuagagaaaaaggcacugccucuuguggcccuguaaggaccagagcacagagcaugaagggcuguggguuccgagggccuagucagacauuauuagcauccucugauggagccugcucaucucuguaccgagaaggaaacacucaaggggagagauaaaaucccgggccucacccucacaauucgucuuugucugcgggugccaacgcugaccagaacaauggccccguucaucucuaguccagauguauuuguuuucucacacgcagugaggagugcaaaagaacaccagagaccacaaagccauguguaacugaggagcacccagugguguguuccacucucggggacccaggcagacagagcucagggcugacagccaggccacugucccugcugugucagcugguaccuggggugaggggaggaggcugggaaaggagaggucagagaguaggggcucagcuucuuccucacagagagauaagaguuuccucuucacuuaccugcaggcgacugccaggaccgagucuagcugggagaggccuggcucaugcuuuucacuaagcaaucacuaggcauaaaggagaugaacugggccgcaguucucacacuaggggacugugcuggcaaaagcagacagaauaacaucaggcugccugauaugccugccuggcuccuacauguccagaaaaggcucggauguccuaguguacagaagcuggggagugugcugauuggugugugugugugcgugugcgugcaugugugugugugugugugugugugugucuccacuugauacaaaccuagagacauccugaaagagggugucuuaacugagaaaaaucccuccauaagauuggucuugggccagaggcaggcggauuucugaauuggaggccagccuggucuacagagugaguuccaggacagccagggcuacacagagaaacccugucucgaaaaacaaaacaaaacaaaaagauuggucuuagacaauauuguaggauauugucuugauuaaugacgcuaugggagaggccaguucacugugggugugccaaaccugggcaggugguccugggugguauaagaaaguagccugagcaagccaauaagcuguacuccuggguugccuccacaucaguuccugccuugggauucugcuaccagguuccugccccgacuucccuguuaaauguccgcccccucaaguugcuuuuggccaugguguuuuaucagagcaguagaaagguaacuaagacacauuuucucaagggucccagugccaccuugaugguguuacagaggcagagcugagaggcuccucuucuagcuccagggcccuacuggcucaacaagggauggagaaaugaggccuugaagaugaaggggcuccaaggcagagcugaucagaacaugucuuuccccuuccucauagcugugcuucgagcauuggaacgccuucugccaaccucaauggcuuuuacacacaaacuuaacaaaauaucaccucaaagcugcuuaggugaaggcccacccccagcucuccccagcccccuccucccuccugccugugucuaucccauugcaccugugcugaaccuggggcuggguaugaaggucacuguuccugggugguuaagaauucuaggugcugagggcuguaagauggugugguggcaaagguugcucgcugccauguucagaccgccagaguuugauccccggcacccacaugguggagagacauggugucuguaaucucagcacuuagaagccaagaaaaaagggucauaagcucaaggcuacccuggguaacucaaccagacccugucucaagacgaaacaaugagaggggugaugauguaguucaguggucuaacgacucaucggcuugugugcagcuuuggguucaagacucagcaccccaaaacaaaucaaacaaaacucccacauuuaaaaggucuaaagguaaagagauguuuauaaauuuccaugcucuaccagauuaauuauuauuucucaagggaacaagacuaguuuggaaaugagcuuaauaagaauuaaucacagggcuagugagauggcccagcaggcacaagcacuuacuacuaaggugccugaguuggaucccugggacucacacaauggaaggagagaaccaagucucacaaucuuucugaccuccauaaaugugcauuccugugcacacuugugcguacacaaccccaaucuagauacuuagaacuauguuaucuugcuguugguggcuuuaaggacaaaggcgggagcuuagaugauggagaaucucuguauccuaggaugacauucacuaaaccccaggaacauugcagggaggucagaugagcuggagaucacugaagaggcuuggccagggagggcauuacaagccacguucuaggaguucacaaagauuguucccaaaccguagcagguaggaguggccaaaagcaaccccaaguaaaggcaaaaauauccccaaacccugguagaaguuaaacacggcuaccuaugcugugcauuccuaucaucccaggacucaggagguugaggcagggggauuauaaguuugaggcuagccuacauaguuaaauuuuauccuaaacacauucaagcauguugcguaugacccacucaaagcuacagaucagcucugagaugagcagguacuacauaucucucugacacaaacacaugucugagaaguauccuaucacuucuucacauugaugcucaaagcugcacauaggcuugcugggcaggcuucccucucaccaucauuacucuggaagcaaagcgcagcucuuuggcuggauucaguaacggcgaaggcguccuaguguuaguguucaaaagcuagaagaaucuaaguaucaaugucacagggacaaugggaaccauggggugacugagcgccuuacugucuguccugagccacuguacgucaacgaaaugcucagccaaauugguuccauguacuuaggauugccgaagcacagaccucagcuuuuagaucagaauucaucaugggaugaucugauuauugucaaaacaauuugcucauuauguuuaacuaaagccuucuggcugcugugugaccauaaucccuguaauucccucaacaaucacauuaaauauggaauguccauuggcauccacucagcugccuucagcucucauggcagacgagcauuggucacauuuguccgucauccagccaggaccuuccugaucccacaguuggaaaaagagaggguugaagugacuucugagauaugaagcugucuaguaauuucucauaucagggcaugcaaacaagcauguauuuuacagaaagaaucuuguuauguaacccaggcuggguuugaacucaugaaccaccugccaaagccucccaaauauugagauaauaaacacaggacaacuaugcccaucuaucggcaccuuuaaacuuugcugggauagugagggaaauagagaagacagaaagcauuucuuggcuauaaaucuguuuuugaaucaucagagagaggagacacagaauaacuagaagucccuuguaacaccacaagaaaggauguguguuauggaagaacauuugcuggcccauugagacacagggcuauugacacccaggaguugagggaccugcaucaagaauucucagcuuuugaguuccaauguccugauagggagaucaaaguuccuuuuucucucugacuuuacugucuguucaguaauaggcucuagagauccauguacaacaaagccuucagcgucuuccaugcuuagccaucucuuccaauacugcuucagaaagaaugugcccaaaguguccggaaaccucuuaccuucauuccaaaggauugcauucggguggccaccucucuuccaauucugccgaggccaagaauucccagugucuucccguucaguucuguccccaugaacugcaaccagaaaggcaaaaggcaaagaugaccaagucagguccaagaguaaggguugggaguugagcccgcaugggcaaggcaaggcaaggcaaggcaaggcaaggcaaggcaaggcaaggcaaagcaaggcaagagcucaccuucuuccggucccauuugccaucuuucaucgaagcuguugccuggggaaucugccuguaagaacacagcagguucagugggucacccuacagcccaggaagaagguacaccgauaucucagugcagccacuaucuaucucugccauuuuccugagaaccacacaacguggguggguggggggcucagguucagggccacuguguauaagggaaggcugggacagugagaacauugguaggacaugacuugggaaccauagaacaucugucucuagccaggaggcugggggaagaaucugaugugcucuaacaccaagguaccaagaagagugaguggguuuggcaaguuuucuccuauaagcagcaccagccuucgaaagcuuauagggacugaugcuucaaagacuccuguuugguucuucuucuggaccaaccacucuugauagcuucucuuguuaucaaggggcaggugauuaaccuuucuucuuaaaccccaagagagcuaaucugaagcaaguggguaccauagcaacacagcccagaccuuucuacucaguccugaaugauccuaauacuucugacacguccaccaccuguccuaccuauuuuugacccacccucgcccacacaccacagacugucucuuucuauugacuccugugcaaguccaaguugccauguuuuguuuucuggauccaggagagagucagugaggacaaaguuaggauuuaaggguaagacacagauugugggacauggcuccacgaucaccucugggaacaaugaggaauggcuuugugcugugcaccuucuccaugcuggacucugagaagagcucgggcccacaccacucaucuccugagggaaggaguucauucgugcacgcuguaggcacuuaggccuggauugcugccuugagagcagaacacccacuagcguucugagucaggcacuuccuuccccauaagguacacacgaagugguuuacacccaucuuggaugaggaguuucagcaagggauuuugggagagggggacccucuucaaauuacaguacucugacugcuccuuucgauaaauugacccuggcauuggagggaaaccuccucccucucaaaccuuuuccucacccucagggaugggggaaaucagaaagcuguguugagggagacuucguauacucugacaggcaaagguaucacuugggagaccucggggaaccuuccagcugaggcucuucugcugcauaugcugggcuuggucaccuccccuccccuccccucacugaccagugcaauguugcacugcuaggcaggaaucuugggagaagguagagcaaagguuaacucacccagcaggaaggagaagauaggaaagagauaacuuuuuaaucaccgcagguuucaggccccaggcaagagugcuggcugucuggaucuuuaaaagggauucagaacagcuucagcccccccuuuacuagaaagccuguaucacagagacacaacacacacaaaugccuauuaaguguguuauaucugccaaacaacaacuguccggcuuguuaggaugcauucauauauauauauauaugcgccauuagacauuagacuguccccaaggaggcucacacaucccagaaccccgccagaagagcucucuuagauaagaauccacagguaggcacaugaaugaugauaagaguuuaucccaugcauuacaauacaggccuagagagugagugggucucaaccuuccuaauguuucaauccuucaguucaguuccucaugaaguggugaccucuaaccauaaaauuucuguugcuacuucauaacuguaauugugcuacugcuaugaauuguacugcaaauauuauuggagacagagauuugucaaaggcgugaccaccgacagguuaagaaccgcuggccuagaaggguagugucagguagacgcuggagaccauggcuuagcugccccaaccagagucaaggguuaaaacagaaaaucucaaugcuuaacaaguuagagauaccugacacauaugguacuugagguugcaggguacagagagcauccucaaagguuuggggauuaaagaaggagccgggcgugguggcacacgccuuuaaucccagcacucgggaggcagaggcagguggaucucugaguucgaggccagccuggucuacaaagugaguuccaggacagccagggcuacacagagaaacccuaucucgaaaaaccaaaaaaaaaaaaaaaagaaggcacagcacccaugggugugaggagagagaguguguaggaggguguguacacucucugugagcuugcuguuaccaucugugaugguuugcauaugcuugguccacagaguggcacuuuuagguauggcccuguuggaguaggugugucacuguggguguggaacucucaaccuaacugcuuagaagucagucuuccacuagcagccuucagaugaagauguagaacucucagcuccuccuguaccaugccugccuagaugcugccaugcucccaccuugaugauaauggacugaaccucugaaccuauaagccagccccaauuaaauguuauccuuuauaagacuugccuuggucauggugucuguucacagcaguaaaacucaaaguaagacagaaguugguaccagggaauggaguauugcugugauaggccugaccaugcuuuuguuuggaagaauguggauuuugggacuuuggauuuggaaagcaauggaauggauguuuuaaguggguuuuaaugagccauccuaguggggauauggaagacuguugcugugagugauuaacugugaagaccuggcccaagaggcuucaaaagagaggaauuucaguaugugguguacagacuguuuuuguaguauuuuggugaagaauguggcugcuuuuugcccuugucugaagagucugaggcuaaggcaaagagauucauauuaauugcauugacaaagaagucucaaaaaagccuagcagagacuuuguuuucugguuaagucuuaugguaagcauuuugaacaaacauagcaaccuuaggaaggaaaaauauaaaauauaugauuugaguauuaaagagacaccaggaagugaaauggugaugaauccuguguucuaagagauaacaguuuaagagaguggggcuuuggggcaagagccgacccagcuaaauuuagauccagguauggugguacacaccuuuaaucccaggagauaaaaccuggcagaguucaaggccagccugagacagagcaaguucccaaaagucuaggaguggugguacacacauuuaauucuaggagacaggcaugcagauuucugaguccaagaucaaucuacagagccagcuccaggacagccaagcuuaggcagugaaggaguuggaaaacagaaagcuagugauaauguaauagaacauggggccauguuccagcuccugcaagcagaacaccucagcagcuucagccauauggcucuggcuuuagagugaaaaauagaagggacuacuggaacaauugaugcugguuaacuggagcuaagaaauuagcggugauuuagaaaagacccaaaucacugaggugaaaucuucugggaaggguuuucugagagcgcaaagaagcuguguuauagagacagccaagguuauaccuugugcugcagcuguacuugauaauguauaagagucaugcaggugguacugauuuugaaggcaugaaggggucaugaagagcagcugaggcuuggcacugugagaggccauggaaggccauuggugaaggugcagccucaguuguaguugauagcccaggacuaaaggggucauguaaagaaaggcuuugaggcuuggcaccaugaagagagcuuuaugagaggcuacuugugaagccuauuugcagcagaagaccccaguguauuggagaugccaguaccaugggaugaucaccaaaaacagcagcagcauuggggaggaucaaccugagcuuagaguacuacagagcgcagagcuggagaagugacaccagcccuuuggaggagcccagaagaucauguguggaucccagacucugaaacaagaagcuguaauauugaaguugccuuggagaccccaauauuuuucgagaugccagagccauaggauaucugcugagaaaugcuguuaacaggucguggaacgagcccagggaaagaaguuuguugcagucaacaaagauaaaaaagagaucugaaggcugcuuugacaucagacguggagaugcagaguuuggaguuugcccagcugguuuccuguacuuuggacguuuaacauuguugaaacuacuauagacuauggggacuguggaaguugggcuaaauguacuuuuuaauugugcuaugcauagauacggccccuacagaauaauguuuuugaccaagcuuaugggagccagggaguggaaugugaugguuuguauaugcuugguccagggaguggcacuauuaggagguguggccuuguuggaguaggugugucacugugggcuuaggaccaucauucuaguuagucuuccccuagcagccuucagaugaagauguagaacucucagcucugccuguacuaugacugccuagaugcugccaugcucccaccuugauguuuguucaugaacugaaccucugaaccuguaagccagccucaguuaaauguuauucuuuauaagacuugcucauagcaguaaaacccuaagacaacauccauccucccaugcaaacuuucaagccaccagagaagguacauuguguccgugugcuuagcauccugcagaacuccagacugaggcgccuggaccucuucuagguccguuugcuugcugagugguaaucacugaccucgcggaacgaggcugggucgucugagaagucaggggcuuaccuggccaggcacaugaucaucccacaggugagcuccgcagcacugaggcuguucccguugggggugcuaaagacccaaaagaagaaugucagugggcccaggcaaacccagcacucaacacuuccagccccgggcucccauucuggcuucucugacauucugcugcccuaagaaccaggcuaccuuggccuccuguuccaaggcagaggcccucccucaggcaggcacaaggcagggaaacaccugauggaaagauggaagaguaguuuggcccaguucucucucauuucagggccuauccaucuacacucuccucugauccuuccuugcccgagccccugagccaaguuuacaacagucaggucagccugcugcugaguaacccuccuggggucccaucagcuggcucguauuaggaaugaagcuccuguuuuuaucucuguuugguuucuucuuuuuacucaacaaauuucgaacugagaaaaagcccaacuccccaaaacacaacaacaaacaaaacaaaugaacaagcaaacaaacaacaacccaaaaaaaaaacaaaaaacaaaaaaaaaaaaaaaaaaaaaccaaaccaaaccaaaccaacaacaaaaaaacccaggggaucauguugacaacuccaaagccuaacacacauuuauuuaaaacuucugcuuccucuacagguuaagcucaucuguagaagguuacaaagaguuaugaggcucucugaaaaacaaaaggacuguaagaguuugucuuugugcaagacaagagaacuuccaguucuucccucagcaagcaguuaagguguaggcagaagugaggcuggcggccccugugucaggaccacaaaguagguaggauggguuauccuuuaacauuuccaucaucagguacugaccucugucagucauucuguccauuaaccccuacccuccuggggggaggggaagagggaagagucagcaaaguagacugggaacaacuauaccaccagguuccuaacucacggcagugcagcaauagccugcuggccaugaucuuugccccugggcuucuauaaacacagugcugacagggaccccucuccucuggggccuagagugcuaggaagaaacugggaucuuugcuucagacuggugcagggaaauauaggaagagacaagaugggaggucaccccaccaagaaagugugugcaucuauacagggugcaagaccacugagcuagcaaaaaaacacaagagccacccucagcucccagaacuuacuucaugacuaggaugcccuuccucguggcagccuccagauccacauuguccacaccugugccagcccugcccaccaccuggagcuucucugcugcauugaugacaucagcagugaccuuaguagcagaccggacaaugaggccuucacaguccugggcagaggaagacaauaccaggguucauacaauuuuucuguaauguaccugaggacucugguggguuccggugggcacaaaugcccacucacaggcacaucaggcuucuuugcauacuguaggguaauguggacauuugagagcaguuguaagacacgaguaccuggucaguacacuacagcuauaacaucggcuugcuggcucuaggcaucugauuaaucuuuccauagauggcgcccccauaaggaccucgagccagagaauaacccauccugacaguauaccucagugugaccagacacaugccccagucaacucuguacacacugacauuccuugccucauggguaaauuccaaagaaagaacagcaacuccuguauacucaucguccgucuggccugcauccucuaagcugcaucccuuaucucagagagauuuagguucgggccucagguaugggagaaggaaagaggauaggcagguauggauagcacuuggcccuguuccacaucacuucuuccauuggacacugagcugcucaagagcagaggugagauccaaucucacuccuugagccccucgccaggcacguggaaggaagauggcuguaaacgcuggcuggcggaguaaguaagcgaaauggaaggaagugccugcugaaaggaaaaugguucuugagaccacacaggaagggagagggaagagcugugaaccuaaagagucuuggcccuaggaugaggcccacacugccuuuacaagccugggguagaggaaggagcaguggaggaguuacaaggugagagaacagagcuauuuuaucucugcugggaaaggagaagugaaugaagcuugggcugcugcucaaaggguauuuaggcugggggagggguggcugaaauacugcaauggacugacuugcugaggagcaguuguagaaccugcagcaaugacagaauucaaggccaggccaggccaggccaagagaccuugccuaaaaaaaaaaaaaaaaaaaaaaaaaaaaggaaggaaagaaagacagacagaccaacaagaaugguucuagaauuaguucucuggagcuguucaggcuggaggcauccucccugggcggggcugugccugcagggagggcuccaggcaggccccugaaggaggaggcuguuguagacagaaccgaggaaggaaaaacugacauuugaagguuguuuugugcccugccucuccccugcacccccaaucuuucacacgcagggaaauagggagaggggacccauuuucucuuuuuucugauccuaagcccagguccugcccugcccugcccuguauaguuccagguaacuugcccaaucauugcuuugggggauuccccauaggaaacugcagcugcagagaggacgcggggacuucaaccgucugcuucucugacagccccuaagcgcuaccgcagucacagugcuguuuuucucccuggcugagucugcuuuaaggagcccacacccuggaacuauacuuucuacccaccugcccuagccagcuuuugacacugaaccuuuagugccuccaguaagacuggcacagacaugcuuccaaaacugguauguccuaaaggcucgggaccuacauuagagccaacaccagucagaguuugcugguuuccaaggccuucuuauaacaucaauuacaugccauuucuucagcuuauuucccuacaaacuuacugaggccaccggccaccccacccugugccgagcccucaguccccggcacgccuaaacaccauucgucccuucucuaggaccauagcucaucccucaaagacuccuucagggugcuccuccccugcucuacagcccaaaugcucacaccuaaccaaacuccuaguauaguucugggauuagaacacucucugucaugcaugaugaauaccuguaaucccaggauucuaccccagugcuccaacacuggggaagaggcagaauuaaguucaaggcucucaaaaucgaaucccucaccccuccacccuuaccccagcgccugcucuuucuucucuugcgcucaccaacugggaauaucaagcaagcgccuugauaaaagcaccuccaugggucuucgccuugaauuucaucuggaacacacacucuccacauuagccuacagacguugcuaggaaacaguaugccauuggcauguuugauuuacggcuguuccagaaaaaacugugcuaacucaguggaaaccuauccccgcucuuguucuucaaguucacacaugcuuucuuucccaggaggauggccuuggccuuguggguaauucaauuauuguuaacacuuagugcauagggcacguuagagaagcucuccgaaugauuccccuggccugggacucagagaucugucuaccugccuuggccuuucuucugagugcugggauuaaaagcaugaggcaacaucuucugccugccugccucccucccucuccuacucucucuuuagguuuuugaaaugauguugcaauguggcaaucccgauguuccagugucccaaguaauaggauuuuacaugggcauguuucaucacauccagagcauguuguguuguguguguuugugugugugcucgcgcgcagaauccuugucucaaauaauaaugguugugauauaagaaaaaggagcccucuaacuugcucuaauuugugucuuugugcucauacacucacacauccacgugcccucacacccauuccaguacagggaacugaaaccccacacacgaaacaagacucuaucaauauuauugcgucucuacuguuuuccauaacaccgaucaugacuuacaaaacucagugccccagugugcuccgucuuggugauuggcggucuaucacuacggaagagagugaaugguaacaucucccugggcuuagggcgaacagcaugaccagaauaugaagcagcagaggccaguuccagcaagggggaacccuugccucuuacugcaaagauuaaaauggggccuggcaggagacacuuugccaggcuacucucagaaggagauaaaaugaggagagacgauggaaauguggguccuucuacagguaauccaagauuagaauuggcauucugaacuggguauuuugccaaggcacacuaaaggcugagaccagccagccaagucagcggcacccacccuccucuucuuuccugccaagugucucugcugcuugaaagcacccugcauuucuagcacuggacucccaccccuacccuucaggccuggccugcuccucacccuccucacacccccuccucccgccccucuauuggauauaacauuucucacugccccuagaaagcagcaaagccugcugccacugguggccugaaagccacucuacagccuuccugcucagcccacugcuuagauuuuagaaucaaggucacugucacaggacaugugaaggacgcauggcuccauggguacuauccacucuaagagucacagccugagccacccauaaagaccauaacaacaaucccuucccuggacuuuccauucccacaggcuccacuguuuguugucucagaacugucaccugacuagcugucucagaguugggccuuauuccccaagaaaccuacaacuccccccccccuuuccuuuucuugucaugcuuuauagauagggucucauucuguagcucgggcuggucuugaacucggagauaaucaaacucagccuccuucauacuaggcaugagccagccagcucauuuucacuuuucuuguucuuucugagacagagaaaagacuacucuguguaguccuggcuguccucgaacucacggagauccaccugccucugccuccugagugcuggaauuaaagguaugugccaucuccaccuagcucuuucaagcuucuuaaagaccaggccuagaaaaagucugcgaauaagggcugcugggcacguggcuauuagcucgguagaggaaaagggauugggggcggggaagggucuugggagaaauagacaagcgagcucagagaguuuccaggguugcaagaacaaccccgcuuggucucugcgguuugaggccucagccugagcaggaagacugguacauuccuccuggcugcaggcccuaagcgagcacguggaacuuuggggguggggcaguacagcugggacgagacagcauaccuggauggauuagaucuacaggaagggcaggaacugaagugcucacaaagcagaaaccccuuccuuacgucugaacaaagucacccgauuuacacaagcuuuucaaauaagugaaagacuuuuaaguuuuauaacgauuagagguuugcuccgaagacuucguagaaguaaccugucccaacugcgcuuggaacaggauucugauguagugaagucgggccugaucggcaaugaagccaaugguggagguugacucccggcggcggccgcgugggcggcgcggggcuccggcugcacccccgggccgcccggaauccugcgagcgcuccccggggcgggggaaagagcgccaaggucuugcaucagacaaaaggcggugcgaguccgcugccacaaaugccacgggacccgcaggagcagagccagcgccccgcgcccccugcccccaccccaggagucugcacugagcagggauggugugcguguagcaccccgagccgggagcucgcagccugggucgccaggcacgaaagcuccagagagguucuggcauucgagagagguucuggcaucccgcaggaccagauggagcagcugcacuuugcagcgccggcaagaaacacgcgguagcaaaaagcacaaaaaguuugcauucugcaccuccaggccauucguuccucucugcuuuuccucccucccacugcuggucccgaaucuccggaggccccgggaccaacugauaagauaggggaggacagcccuggaaccacuggggucagcggguuuggccauaaagaugcccggugauuacgcuuguguccggcucgccuuaccuggaguucagcuaucagcuccuccuugcucaaguucugcuucuccaccaccugcagcccuccaucuugcaggaucuuccggcagcagggguccaggcugucacugaugaguacuuugcgcagauuugcgaaggccauugcuagagucaggccuuagaaucaguugcugugggugggcagaagcacuuaguucaggaaacugcaagcagggcuggcuccggugacugggcaggguucucgaucucccgcucccccuuuauccucccccuccucgcgccaacagucuccuuuugauuggucagaaaugcuua

SEQ ID NO: 1606 - RNA, 2594 nt, Mus musculus
guuuuuuauguuuuuuaauuauugugguuuuuguacaaaggugguauauuauuuuucauugaaaacacagggguuaggaugcaaacaacaaaggagaaggauuuuuuuaaaauaacauuauuuuucuuguauagaaagaaacaaaauuuccacugccauugcaaggguauugagaaguaggaaugccuucauuuucucuaaaguaacgaauggcccugccuuucccacaucuccuguguucagauuaacugugcuguuacuugguggccuaggaguucacuauuauagcgagaucagcuugcaauucugggcagauggccuaaacagaaagaaauagagaacuaaaaaccuuuucccauagauaaguaggucaaacacuucccugagccagcaggagagacaggugcagcaguguccccacccaaagcagagaccugcagagccuccauguccccuucugcuuccauucccuuccuuuaagauuggggaaaguauaaaaagccaaacuacagaucugugagaaaagugcaacucagauuuacaaguaccaguagagggagaugaggaagaacaaggcuggccacugagacuaacuaccacaaggugacacacagggucuguuuacuuuagaaaaggacuacuugauuaggcauuuggguuaccuauggauuuauaaaccauggcccaggguccaauucaaacuaucaagccacuuaaagaccuauacacaaugugauggugccuuagaauccuguaguugggaaauuucacauuuuuccccuguccuaaucccacacaagggacaaucaggugacugauuccaggcucaaagcaaaugggaguauuuggguuacagccagguaagcacugcagaacaacuugaggcaaccaaagguacaaguaaucuuugcuuuuuaaauuagaguauccaguguuucaacuuauaaaaauguuuacagcaagggcucauggcuuucugccuauuuagcuguccuugcucuuccuggggugcaggagucugccccacaggcccuaugucugucugccuuccacucuacuuguacagaggagaaacaauaggaaggagcaaagaggcagguuagggucaaaucaaaagccaacuggaaagcaagaauauuaacagcaaggugagagaugggagaccggcuugagaagucuggcugaguaugcuuugguuuggguacugaagagguggcuagacauuaaagugcaaucacauugguagcagaugaucaucccuuucuuccuacucuucccccagcuggucaucccccacuccacgauaugcugcaggcacauugcgggguuuggaacggcacacaaagucacaaccaucagcuacuagguugccaagauccugccagaaggccagaugaggaaacugcuccauucccuuggcccccacuaccaaucgcuaguauaagaaacccccaaugauauagacagcaaccaacgaugcaaauaugacaaguaagaucgagcccacacugaggugugagaccucuggugaacaggccagacugcuauccaucucaaagagguagaagcaauccuggacuuugccucguuccucagacacuggguuaaaauuagccgcuagugugugccgauugcagaucaucaccacugcacgcgcugcucuuugccacagugguugucauauucaucacccccuuuaucuaucagcaugauccaauuacuuccauucaagaugugagucucguugguucucccaaccacugucuccuugucauugcuuuuguugaucuggaccaggccugcuccagaggagugguugcuagcuucccggcauacucugaauauguagcuguaugugucugagcccuggcccacaguacucucaaaacuuuuguuaaacaguggccggaaccucuccaggagagccaccuuguucuuugacuccuuauccuucucuccuaccaggucacacgauuuuucuucugucugccaggauucucucacagccacagccaggaguagcaacaauaacaguucaguccuccagcagccagagaaggggaacauucucaauuacuuaugugccauuucugugucacaggaaaacagagcaaccgcggcucagaagcccccaagaaugugucugagguuggaagacucguccggagaucaggggugcgggggcacagaccccagucccucgauuccucucugaagccagcgcuccccuaggcgccucaaugagccccgcuccagaagccugaaacaggaagcagcgagagccugcagagcaacugcuccucccacuagacuccccggcuuaugaccacagaaccuugguucccuggucucucuucuggacgcugauuggucagcagccuaguucgcuguucccuggucccaucaacuccaaucuugagauugucaagaucaguuucuucuuuucgggucgccuuucuaccaaugagguucgagcuccaccuccagggacucugggcaggcgcuccccauccaugcggggucaugugccagguguccuaauaggucccacugaagacauuacgugagggcgauuugucgaauuauaaaucuuu

SEQ ID NO: 1607 - RNA, 24230 nt, Mus musculus
caaucggaccggaaguggcgggucucguaggcagcgcugucugcuggagccucguggagagugaggugaguguugcuggcucuuuagggaucgcggggcgcgguuccccgcacagugguguucacggugagccgacgcggcgagggacuccgcgcuaagggcacuagggaggccggggagaagcccuuugccgcggccgucugcaucgcagaacccagaggccgcgcgcugcccccgggccggagugcgaggcugcuggaacugcccgauuuccuuggauuauuucggggaugaugugcaauagaaacuuaggugcgggggauaguuugagagugaccaggucgcaggaaggaaaacaagcgaaguuauuugagaaauaagcuuuaaagcccucggguagguacagugcaugugaaaacgauaaacaagcguguuacuaugacuugaagcgaaaaucguggacguggaagugcuagauagaaaaccagugcagcagcucguugaagacaaacuggagaugaaagugcagggaagagaaaacuggguagaaaaggcagacacaugaacacacaugcauaaaagcugagaucgguuggucugagcuuuuggauagaggaacugcagcagccccauaagcucugcgagcuuauuauauacaguugaaaaugaagaggggauuauugcuuacaacugaacaaggagacagggugauuguauagagauaauaucuaauugcaauagggacagucuguggggagcagucuucagucaguacacauggugguguggugggagggaagaaggcuauggugaacauuuucuggaacacuguaaacaucccacuugaaccaaaggaccaugaugccucuccuauuggucuggggcauugaaguccuugacauggcuacauucaugucagcaggacccauucacucugggcuuccucugaucuacacacagggucucuucgaaucccaggaaucucucucucugccuucccugugcuggggucauagaccugcauuuuucugugccuggccuuaugugugggugcggguacuacagcagguacuuuaccaucugugccaaguuacaugcuuuugaucauguaaaaaaaaaagguuccuguuuguuagcugugcagagucauuguauugcaaaaacugaauuuuguuuauuuacacagauugccuucccggugucaucagacagcccagcauggggcuuacuaaacaguaucugcgcuauguggcuagugcugucuuuggcuugauuggcagccaaaaagguaacauuguuuuugugacacuccguggugagaaaggacgcuauguggcaguacccgccugugaacacguuuuuaucugggacuuaaggaaaggcgagaagguaagucagaaauaagaaauggacaccguuaaaugacaccgacucuuggaagggugaagugggagagccuugacugaccugccugcacucauuugugugugagucccccaagagaucacuucccuuuuauuuuucuagacggcuagcaccagauucuguuguguucugaaagucacagccaagcaggaguuugcuuaaauggguguguucguuuucauggguuauuauucuuagccauuauuaacuucuacuuuugucgaccgguucugcuuuucauguucugcuuguucucacagccagcuguaaagcaguagaauuucaaaggacugucauucugcuguguugugcaguccuucucuuaaccauaacugaugagauucauugguugcuucacucugcuuugacugugacagaagcuauuccuuucuugcuaagcacaaagagauaaauuaucccucuuuacugugugacucccaggaggugagaugaguuacauauagauuuauagauguaaauauauagaagccuguugcuacccagagcuucuucuugggaugaaacuguuaguacuguagguugaguuacaacaaggaugaguuuauagcucuguaucagaaaucacugggauacaaaguugcuaacuuagcucauugccuggaucauuugcauacacaccagcaccaagcuugagaggacgugaugaccucuugaggagcuuauggucuuugcuugucaaguuuuauccucguguaucagugacuggaaauuguugauauguguauguguuauauguugauauguguauguguuauauguugauauguguacuauguguuauauguugauauguguauguguuauauguugauauguguauguguuauauguugauauguguaauauguguuauauguugauauguguuauguguugauauguguauguguuauguguugauauguguauguacugaggucauuccugugcugcugucuuguuacaugccucacgcuucugaguugguuuucaucuuuaugauuucagauccuuauccuucaggggaauaaacaagaagucacuugcuuguguccuuccccagaugggcugcaucuagcuguuggcuaugaggauggagccauccgaaucuucagccuccucaguggugaaggaaacauaaccuucaauggacacaaagcagcugucaccagcuuaaaguacgaucagcuaggaggcaggcuggcuucugggucuaaggugagccucagacaggugcccaggguuguuucucacacuuaauauaggagcagauuauucucauaaacugugcuaugagauggguuggauucuccguguccaagcuacuauacauuugggagaaagagugaggaggaugggugcguaugagggaguguucuacuuguuuccuguucuguucucugauaaaagucuguggcaugaaagaauaacacagagguacucuggaaucuaucacuguggaagagggaccccaaacuauauaaccaggaagauuagaaaagaagaugguuauaguuugccaaugaaucuguuuuacagguugaugaguuaaagccaggugugcuggugcacaccuuuaaucccagcacucaagauucagggcaccugcauugcucugaaguagaggccagucagccaagcuuugucucuggggauacacagugagacccucucucaaagaaggcaaagaaaagaucauuguuuucccagcacagaggaggaaaugcacuauuugcaauuguagccacugggagaggaaaaucaguuuucuucaguggagugacacuggcuguaucagccaggcuccgggcagacccugugcuggggugguuggccaacacauaucaggcucugguuugcuguugcugcucuuuauguuguugguuuguuuuuaaaaggagaaagagaaugaagcuggguggcucagaauguucaggggaagaauauaaaaaauauaugaaauucucaaaagauaaaaacacgccaggcagugguggcgcacgccuuuuuuuuuuuuuuuuuuuaaauauuuauuuauuuguuauauguaaauacacuguagcugucuucagacacuccagaagaggacaucagauuuuuguuacggaugguugugagcuaccaugugguugcugggauuugaacucaggaccuuuggaagagcagucggcacucuuaaccucugagccaucucaccagcccggugcacgccuuuaaucccagcacuugggaggcagaggcaggcagauuucugaguuugaggccagccuggucuacagagugaguagggcuacacagagaaacccugucucaaaaaaccaaaaaccaaccaaacaaacaaaaaaaccaaaacccacagugaagaaaagauugauuuuagaucuucuuuuagauuugaaucauaaauuuaagacauuaaacuucuuucauuuaaaaaaguauaaaaagaaaagcagaaaauauuuaauaaaaacuaucaucuaccucuuagacuuguaaauuaagauguuaaaaaauaacauguagaagauaacauugaugaaaaauaaacaggguaaagugucacuguuuaauacagauaaugagaagaauuagcauugguugguagaaugcuugcuucgcauauagaaacuccuggguuuggucccugguaccacauaaacuuguccugugcuuguauaucuaauacuuggagaugguggcuggaggugaaguucagggucagccucagcugcaucgugaaaucaaggccagccugggcuauaucagaccccaucucagugucaggaaaacaaguuggauaugaagagcaagcauuguucauggaaggaagagaauuggcaggcaguuuuagaaaggugauacuacucagaguacacagaugggaagcuggucuucucauacagaucuuugguaguucuauagauagauguaaucugaggauuauuaugauagugugacucuaaaauuguaaaaauagccccauccucuaaccaagaacaucaaacuguagcaucuauuuguaguaagauaaaugcacaaagauuuaugcaugugaauuuucaacuuugcauauuuuauaguaacaaaauuggagaugacucauuuauguaaaauaugaaauuuaaauaguaauacuagaaacuagaguacagcuuaauuaacuaccaaagugcauuaaauaaaaagaugguuucaagcugaauccuggcaugggcucuuuuccucuuuguuguguuuugugguuuugauguggagucuuacugagcuguccagcuuuccuccuaaguggcugguacaccauaucuagagcgcucuguuuucucaugcagaaguagccuggagaucucaugcauauguaauuagagcaauguaaaaccaagucucugcucaguacuccuggaugaaggguggacugccgucuaaccccaagcuguauugggcaguauagcaccuucauggugacugagccccaucucuugucauuuagccucuugugguaagaauuuuuguuuucuuguguguuacuuugucccucaaggauacagaugucauuauuugggaugugaucaaugaaaguggccucuaccgucuaaagggacacaaggaugcugucacacaagcuuuguuucuccgagaaaggaaucugcugguuacaagguaaaggcuugaugacuuccgaguuagaagaggagucggccuccuugcucgugcuccccuuguccucauggcugugagccagugugcuuuagcugccagcuuucugccucucagaugcuagucuuauacacugaguuacagcauuuugcaaaaugcuaaccuguguguuuggaagcauaccuuuugaggaaaaaagcgugcuuuagaggccuaauggacaucuguuagguugauacauuugaaaauuuuauuuuuguuaugucaaaaguggucaacuauuaccaguuucauaugguucagucuaauacaacccaggcauucacuuaaugagggagacuaagaucguaggguuuguugggcaguaauuagaaaaaccgugguaguucucaggaaguuaccucaguguugguaacacugaggagccagcaaugggccaagaggccauaugcgaagcuucugaauaaugaggucagaggacguguccaggguuuuacagccguggauggggaguugggcuguagaggccacagagagcacguuuucaguauggaaaaccuaagcuggggauguggaugacugcagcugagagcucugagauguuccugguuagcagucagaauggcagugcuuuaaggugaaguggugagaggaaggcaggugacuaaauuguguguugugugcagaaaugaagcuucuugguugagcggccacauggagaguuagaauucuuugcuuauuaugauaaacaguaagguagaauagcuuccaacauuaccguuauucuaaaacaacaaacgaguuacucucauaccuguuaguuagcaauucuuccuaguaaaaaaucucuuucugguuuuucuuguagugggaaagacacuaugguaaaguggugggaccuggauaaccagcacugcuucaaaacaaugguuggccaccgaacugagguauguauugcaucaugggcuccagagaagaaugaaaaagcaaaggaugguuucuacuucagccuucuugggcucuuuuuacugcuuacugaucugugcucugucuugagagacacugagguuggcugggaggaaguaguggcagccauugaaacaguuguugcuuuuuuggucuaauacacacuagccuuggauggcuuuauaaccucugcucagguucaucuuuuuaguuagacucaccuaugacuguuauauuacucaagaguucuuuagaggaaaggacuguauagagugaauguugacauccauguagacagggggauuauuacaauaauuuacaggcuguaguccagcuagucuaaaaguggcugucugccaauggaaaguccaagaauccauuaguuauucaguccacaagccugaaugucucagcugaucguccaugaguaacagaauccugaagaagugggcucuaaugccagugaagaaauggauuugcuagugagagggagaguaagcgggcacagaaagagcuagcuuccuucuuucguguccuuuauguaggcugccagcagaagguauggccagauuaaacauugcaucuuuucaccccaaaagaucuguauuaaaggugucaucaucccacuucaaagauucaugguagaaguuggucuuuccacuucaaaugauuuaauuaagaagaaaauacuucacacaugugugcccaaucauuuaaguuuuaguuaauuccagaugucaaguugacuaccaagaauagccaucacaacucuagggauguuuaaugauguuguguguacagugccuuccccaguaacuuacauucagcaaaaggauaguuucauaccuggaaaauaccuauucagccagauccagagaauauuuuaaauauuccugccuuccugaagaugaggcuuucaaaaacagacuuguaauaaugaaguggaaagugaauugacuggcagcaguauugcugugucucugcugucuaaaucuuggaugcuaaaggcugagaauuaugcaguaggcauuaauaagguaucuauuauuugccagacauuucuguaaacaaguaugagacccagagucauggauugugcugugguuuugugaugaguagcuuuuaucugaacagggcaguaaggacauagagaaauucuuaguaccacacgaacaguaucaccacaggccaccuccccuccccucaggaagagugguucucuuagucaguuuugaaagaauugccuuaauacacuuuuucuaagauuugaaaugucagagaaacuucauugugucacuuggaguauuaaaaaguaauucuauuaaaccuuuuuuauucuuagguguggggcuugguucugguuucagaagaaaagcgacuaaucacuggggcugcagacagugagcugagagccugggacaucgacuaucugcaagagguaauuauuguguuuggaucauggccaauugcauguuuucacaguucagcaucuuauugacuuagaaucugauuuguuuuuuguuuguuuguuuuguuuuuaaauuagguauuuucuucauuuacauuuccaaugcuaucccaaaaguccccccauacccuccccccacuccccccccccuuagaaucugauuuguaauaggaguucuuacacuggugucccacaacacuucuaaacaaagacuucccuccucgagcacucauugcccugguuuauuugagcuggaaggagaagauuuaggcuuacagcuuuugguaauaguguuguucagguuauugcacuuuagccuguauuccuggcccuuuggccauaugugggugaauuuuagaggccuuucucuuuggacaacaucuauguaggauacaugcauuuuuguaugcagauaaauucccaggagacauauacacauauaacuuacguguauauguguguauggggugauuguaacuuuaggcuuaguuggaguuaguuuauagccauagagccaguagccauuaugauggcuuuuuccgcauuuaaggagaaacuguaauauaccuuagugugccucugccauuacuaguaccaguggcagucuuucuuucuagaauaucuuuuauccuacaaauuuugaaguuaaggaagaguugagccauuaguuuuugcacucuuaucuacuuguauaugguuuucauucuauggaaagucagugagauaguauaaugaacaaugcuuuguugaauauaugccaguuucuaauaaauucuuaccuuucccgacauugaagaaguuuaucagaggugacuagucaagauguaagugguuaaaggagagaauucuaggucuuugggguuaaaggucaucuccugagacauuugaccuuucauucuuccaucuuuauaaaauagauugaugacccagaagaaccagagcccaagaaaaucaaagaguguccuggaauacaggacacaccugaaucagaggacagcacccuugaggcggaugaugaaaaaucugaagauguaauccacuuugugucuuccuugggcuaaguaauagggcagggaagaacagaaucucagaugggcaucucuagagaucagugugugugugugugugugugugugugugugugugugugugugugugugugugugugugggugucaccugcauauauuagcuuuuuagagguuuaacaggacagacauuuaaccuccauguucuuuugcuguagcgcauacuuucguguaguaaagcuggcuccauaaugcgggaaggaagggacagaguugugaaccucgccguggacaagacaggcaggauucuugcuugccacgugaguacuggcuuagaaacaguaagaguguuccuucucaguacucauucucucaugauuagcugugggccuggacuuuuauuuugauugugguaauaauucagaauaugagucuggacugauagcuuaaugguaagaccaagcauugcucuuacagaggaccugugcuucaaucccaucauucacguugggcaguucacagccaccuuucacuucaacuuuagcaggugugauccauacugguguggccugugcacacaccuacccacacaaauacacagauguagacacacagaugcacaugcacgccugcgugcacacagacacgauuuaaaauguaguauauauuccuaugagugucugauguccuagcacaacaaucauaacaucaugaaaguaacuacacuuacuauuacuagccauuuacuaaaugcuggcuuuuccauuaguguaaaggugcauguucuguuuggccuucaaagaauguugagcaggaaauaguauacuaauuucuagaccauaaacccagagauuagcuguuccaggugauccagccaguaugggaagacaaauauauguugcuguucaguucuuaccugguauaggcuaaauuauaaacugccugccucuugccuuucuagggaacugauucuguguuagaaguauuuuguauucuuuccaaagcagaaguucagaagaaaauggauaagaagcuaaagaaagcuagaaagaaagcaagguauguauuguuuuguuuuuuaaaauaagcuuaauaguaguaaaacauccuggguagccauguauuacagaaaagcaguaacuuaaaggaauguuuacuagcuuaccuguuugggcuaaaagcuagaggacuugugggguaccaguaccccacaaaguuugaauuucuaauucauacuucuugauuccuaacacauuucugagcugcacuaagacccacacagaaguauacugcaaauuuuuaaagccaggcacccugggauuguguuuuugccagugcuagggacccagggacaggagacuccgaggcuugcuaugagacacuguuucagauuagagcaugguuaaagacagacauccugcaugggugucugacugccacacacguaaacacacaaaugcaaaagaaagaaauccuuuaaugggugauuuaccaaauuuaaaagugauuuuaaagucaucugguggcaaaugcuuugaguuguauuugcucacaugccaggaucaggcuaacuguagcuuagacuuguuugagaaaguucuggaguuagagaagucccucgggaaugcuucagugcagugacuuauugcaggggauguuaugggccuguuacguucugaaucuguuaucaaagguaacacuuucaguggacuguagucuguucauucaguucuaaugacccugugaccaggccacucccugagaaucacuccacuuguuugucccaggaccaguaagagcaaggcuguuccggaaaaagcaauugguaaagcguugguuguguccuuuucuagguugaacucugccaaugaggaggaggacccugaaacgagugucucgaugacacugcaggacgagauccuucgaguagccaagaucaagacuucugccaagaucaagugagugaagaguuagugucaaagugcuauagaguaauaagcuaucacguaccccugcguuguccccguguuugccagccuguguguggauuacaggugaagguggggaucuugucacagucacagcccguguccauuuuuauuauuaucuuuguugauuccuucagucugccaauuaagaaaacuguguggucuuuguucagaaaguauuuuaaaucacacacaacacaacacagaaacaaggcacaugucaaaacuaagagcugagcccaaaguuuuuuuuuuuuuccuuuuucuuuguuuacuuuaaaaggagccuguguguguggaucucugagaugcuucagcagguguacaggaaggugcuuguugccaguccuggcagccugacuuuggucccugggacccacauuguagaaggaaagaacugacuccucuaaguugugcucugacuuccacacucaugcucugguccauacacuguacacacauacacagccugugccccacugcugcuccauacucagagcacuauuaaagaaaaauuaaauauacgugugugugugugugugugugugugugugugugugugugugcuuaaacuguaggcuuagaacacuaagcuuuucauccagaaaauguuggcuucaugagccaagauaguagcuccccauaaauaaaaugagcaacaauugugcuuucucauccaugcagaucuuuugaccugauucacucgccucaaggagaguuaaaggccgucuucuugcugcagaacaaucugguggaguuguauucgcucaaugcguccuugccagccccucagccugugaggacaagccggaucaccauuggaggccaccgcagcgacgugcgcacuuuguccuucagcucggauaauauagcugugcuuucagcagcagccgauuccauuaagaucuggaacaggucugugaauuggugcuuucugaaccucuauccaguagggcugucuuuccuuugaagcacuuuugauauuucucauuuuuggcucuuauccucaagaaucuaaauacaauucagucagaagauacaguuggugcguuuggccauugguuuacagagcugauguuagaauuuugguguagggcuggugagacuacucagcagauaaagguacuugccacuaaagaccucaguugaucccuggagcccagacaguggaaagagaacauucacucuggcaagaccaugugugccuacuucuccccauaaauaaaaugaaaagauaaaaauuaaauuuuggaguagaauaagucaagcuuuucuuucaucuguagcuuuggcugcauuuggcuagaagaaaacauacagucauugccccuuguuauucgugcagugccuucagaauguacauuauuucucauucuucccauucccuuagaccucaaauaauucaggugcuuuaaagcugaugacguugccucccuguguaccgaaaagacuggagccaucuagacgauucuauguguucucagguccaggggaucugacacucucuuaugaucucugccaguacuuuaguaugugguacacagauauacauguaggcuaaauacccauacacauaaaauaauuauaaugaaauuaacuuucagauguugguaaagguacaccauuucaaccugaaacucuuuaugcucuccuaggccuuggagacugggcccuguggucagccuggucaacacuuuucuuuacuuugcuuuuuuguaucaucucuuuucuuuauggugaauuuccuuuccaaagaaauccagcuuuggucaauaauauuuuuccucuugacugagauaaaugugagguaaaaguuagacaugucuugugucaugucacuauguggcuccgugcauugaaacacuggcuucuaaggugggaagcagguugcuuuagcaugcccuuugucucucauaggucuacccugcaguguauccgcaccaugccuugugaauaugcucucugcuccuucuucguucccggcgauaggcagguggucauaggaacaaagguaaaaaccuggccuuuucugcuuagcaucucaaaagacccuugagaaauuggauuuuuuaacggcauauuggcaauuaauauaauagagcuagauaauaguuuauuggcuuuuuuugauguuuuuaaaguuuuauuuccuuguuuaaaaaaauaucaaaccauaugucaaauuacaaagaaggacauuaauuaaauguacagagguaacugccaucagcauuuugaugaucacccuuacauauaucuuauaaauguauguaauuagauuuaauagaugguaagauauaauaguauuaaauaauauaacauuuccagguuugacccaacauggcaauauaaagccaagcugaccaggucuucagucuuagacugaucaguuuggggacagccauagcagacaagauuuggauucaguuuaucuuucaaaacguagagaaugcugcuucaccugcucagccaugaugagacucguagaguccuccugagggcucugccacguagugaccuugcaaccuucgaaaaucugcuuuagcucugaaccugcuuuccuuggagugcacaauaagcagagagcagucacagcggaagcaaguagugagagcaagcugcaguaagguuuaugggggauggcuuuguccucacacagggacuuucguagcccaggcugccucaaacuuaggauucagccucccaaguguugcgcugugcucggugugucgcuguauucaguugugggggguuuggaggaguauuuugcaaguauauaucauccucaucccuugucaaauaugcaugcauuuuauuaggaaaccaacagaccauaguggcuauuucuuguccaacaagaaguauaaaauguuggaagcuguuccagguccuguuggaaguaacauuucaguuaaaaguuucacugauuuuguauccauccuucaacaaaugugugugugcuguauguuguuaggaaagccuggccgagauggugcaaggcagucagcacuuggcucuugugauccuagugacaucuuucagaugcaaacuccauuuuauaaaaagcaaauuacuggaaaugaauuuucugucagucauagaguuggaaagaggcaagccuggggcuuaggucuccuugcuucuguuaccugucacguggcauggaagcuugugaaguuaguagugucuguuaaaugcugacuccgggguuguggcauauacagacaucuaggcaagagucaugguuggguucuggcucucacugucaguguguugcaaaaagaagaaaccaaaaccagugaggagacuuguuaggcagugacaauagacuugagugguccauguaaagcauagguaaaauuuaaaggcuacuaaguuuccauuugaacuguucagauuugucuguggcugugauauggaaccagcaaaagaggcaggaucaagaucugcaaggcuguacuauccacagcaguguaugaaagcaauuagucccacccucguuuguuaacuagguguuucauugggaacaguaugucuucagauacagaaugcagaaagcauuuaggcaggauuuuuuccugaacaguugacccaaauuacugcuuucuaacuucaggcaugaguaaugaagucuguggaugcgccccuuaaaacuuuguucacuuucccagacaggaaaucugcaacuuuacgaccuggccucaggcacucucuuggagacaauagcugcccaugauggagcccugugguccaugucucuuucuccagaucagguaacugcaccgggcuuuaaagcuaugggcgucugcacucugaguacaucuuagaucugccaaguuuaguugccuaagaaagguuccucucaggguugcauuaaugaaagccccuucuaggucugaucuuuagauuucacaaacauaucaucucacacaccuguaguauacacagcuacuacugcaaacugaguuguucaacugcucauccucagcagcauggcucuguuuuuaaaagauguauuuauuuauguaauaugcaucaguguuuuaccuguauguaugucuaugugaggaugucagaucuccuggaacuggagcuauacauaguugugagcugcuguaugggugcugggaacagaccccagguccucuggaagaacagccagugcucuuaacugcugagcuauugcuccagcacuagcaugacuuauuuuuagacgauguuugugguacuuuacagaggggaacguuuucuuagcaccuuagcagagggugaaauacacauaguuguucccuccauaguccggugaugacuagggaaauucuuuacccgaugugugagucucaugacuucuguaguaagucauugucacucaugugcucauggugccuuacccacuggagagcuacaggggaacugaugcaggcgcugcucugacauugugaguuugcugggguuuuuuuguuuuuguuuuguuuuguuuuugacaguacuuugguuuuauccaaauauucucaauaauagcaauccuuuauccacuggaaguauauauauuuggaaaaaagauauuagaguggcuaaugucgcuuaguauaaaauacacauggauaguuugcuaugagauggggcugaauagacggcaguugauuuucuugauuuugaaaaccauugcaagggcguuugaagcagacacacugcaguaguuuauaccuuccugagaugaccucuagagacaaacuauucuuguuuacaaagcuaaucuuacugcuuuguagcaaauucaagugacuucugcccucuuaggugaaguugaaaaaagaaaggaaggagggaagggaacuccacacucuucccuaaaggcuuuucuucacgaugcuaagaaggaccucggacuucagugaucgugucugucaguguuagucugugcuggcauucucaaaugagauccgugcuagcugaaaaguagucaggggugggcaucguuucuuaaauuguccuacaccauucaguaaaaguuuuaacuguuguauguauguacuuagcaaaguuuuugugcuaaaauguuuuuuaacugaagugucauuugauuuucagcguggcuuugugacagguggcgcugacaaagcugucaaguucugggauuuugaguuggugacagauaaaaauaguacccagaagaggugaggggaaacuuccguggggcuuuagcaugaaguggagaaccguugauuugcaugccuuugugugucagauuuggagcugucugucuggcauucucaucuguguuacuuuuucuugaugcugucugggcagacuuucugugaagcagacucgaaccuugcagcuagaugaggacguccugugugucagcuacucucccaaucaaaagcugcuggcugugucuuugcuggacugcacugugaagguuuucuauguugacacuuuaaagguaugauggguuugucugggaauagucuuucugugugaccuuaagaauguggggugaucccaugugauaguuuuuguuauuaucucuuagaagccuguucuuuuucuaaugagacacagaaagggaguggaucaggaugggagugaacgugggagggaacugggaguaguagagggaaggaagccauaaucaugaucuaucaaugugagaagagaaucuauuuccaauguaaggaaaaaagaauugggaugauagccagaaauauuuuuaaagauaugcuuacuaaaacacugagugugcuugagaaacuaauaguguugcaggguucaucaguuuuauuuaaaacuaaauaaauaugcuaguucauauucugaagaucuauagauagaaaucucuaucccgucguaacaagcagcuuugaaaguguuguucaguacaggcugcugcgaguuauugcucaggacugucuugggccucaggauaaccugugaaacaguuaucccagauagucuguuuaggccuacucugagggguagguuuuggguagccugauguucuuaauugggcuucaggguucuuggcaaguaugcguagggucuccauaguggacacaggaaaucucacuuagcaagcaguccagauauguguuuaguacuauaauuuuauauuuagcuccaugugcaacagauuguauuuuguagacaaacaugaauucauuguauccuuucuuucauguuuaguuuuuucucucacuguauggacacaaacugccuguuuuaugcauggacaucucccauguaaguaaaguaugugagguucuuuucuaauucaugguugggcuccaucguacagcacuugugucauucugcugaguuuauuauagcuuccuccagaaagucacaggucuguauuauagucacagcauacacaugauaauguuuaacaaauaguauuaaaguccuuucaaccaccuacaguggcucuggaagauugcugcucuaaauuccauaacuggcagaacauccugaaguucaugguuuuucagaggugccccuucaugcuucaggauagcacaguugaggauuugaauacuguaguauuuugcuuuguguaaauacucucauucuugggagucaguuauuucguugugucauuaugauuaaaacugcauguuugagaggcagguggauuucuaaguucgaggccagccuggucuacaaagugaguuccaggacagccagggcuauacagagaaacccugucuugaaaaaaccaaaaccaaaccaaaacaaaacugcauauuugaaaagugggggaacgaauagauuccauagcugugagauccuuguaugaacacagcaauuugaagaauuugagggaaugguguguguguuaaacaaguaggucauaaaccuuucaguagguucuuuuuuagccucauuuucucuuuacuuucccuucucuccccacaaaucccauugcagagaacagagaaucggaguagcccuuuucuuauuuaacugagugaacagaucacuugaccuuaaggcauacaacagcacugggcugugauauuguccugugacagggucagaguucguacauucacuuuccaaccuuuaagcagcucuguaagucugagcacagguguuuugaauagaugaauaugguuuugcucuaucauaauauuuuugaagaaaugaauuaaauauucugguuagcuuuagcugucuaguuuaauuaaaugcuaauauuuuguuucuuugccauaggauggagcacuaauagcaacugguucugcugauagaaaugugaaaaucuggggucuggacuuuggggacugccacaggucucucuuugcacaugaugacagguggguguaguccucugaaaggaucuuuuaguuguucucagaagcuucguagaguaggcauuccugaugaguguacgagugcucuagcucacucgccuggaguaucugacauuacucuccacccuuagugugauguaucuacgcuuugugccuaagucucaccucuucuucaccgcugggaaggaccacaagaucaagcagugggaugcagacaaguuugagcacauccaaacgcuggagguaaccccuugcuuguuuggcuugauugguacuugccuuaguuaagguucuuauaccugugaagaggcauugugaacauggcaacucuuauaaaggaaaacauuuaauuugggcuggcuuauaguucagagguagagcccaaugucacggugggaagcaugguggcacgcaggcagguaugaugauggacagguagcugagaguucuacaucuggaaccacaggcagcaggaaaagaacugagagccacuaggccugguuugaucuucugagacuuccaaaucuacccacuagugacauacuuuguucaauaaggccaugcgucuuaguacugccguuuccuaugggucuaugggggacauuuuuauucuaaccaccacaguaacuuuaaaaacuuccuuuaagaauauuuacccuaccacuggcauaaacgagugguaaccaaugaguaaguuagauuuccuugggucauuuuguuuuaucuguguccagggacaccaccaggaaauaugguguuuggcugucagccccaguggagacuacguuguaucagcaucucaugacaagucgcugagacucugggagagaacgagagagccucuuauucucgaggaagaaagggaaaugguaaaaccuuugaguguggcuucacguuuggugggggccacuuacagacugucccugcugagguuuuccacccaguguaguuacagcucacacagaaggcauuuccaaggccagggccacacgguccagguggacucaggugccguuggcaucaugcuuugagagaagcccuuccgcugccucagucgcucugcagagucuguuuccccucauuauaacuuaugugugucucuuggcagcaaagggaagcagaguaugaggagagcguggccaaagaagaccagccggcaguaagugaaucuuuugggauacgggaauuauaugggagaggaauugagacuagaugccagaggcauugcucucuacuguuagccucuauguaguguuuuuauucaguuguguagcuaguucugugauuaacuuaguaugagaauucuaucauuacaucuuuuucuuucuuaaugagacuuuauaaggaauuauaguauuuauucagcaaaacaaaaauuuuaaaaagacucagaaauuugauacauuguaaacauuuucaggauagugcucaugaugauacaaauaaaacauuuaauauuguaccuauccuuaaugggagagagugauaugguauuuuuauaaaauaauaccaucuuguucaggaucucauaugucuggcagguuccaggggagacccaaggugacaacuauuucacugggaagaagacaauugaaacagucaaagcgguaaguuggcucuuguaauggguucugacuuuuucguaaaagccuuacucaguguuagccacauagcucuguguggcacaaaaguugaugaauucuaggaguugaucauugccuuugucugaugcccguggucuugcgucugaccagcaugggacucucagugagggaagcucaugucgguucuucuggaagcugcccuguugugacucuauauaguuucaucugaguccgugguauuuugucuuucuuacaaauuaaaaauaagaaccaugcugacaacuguaaaugcugcauugcacccuagcuggcauguuuuuauuaagccgauucaggcuacauuagccaggccuucccaucuccaugucuugggugugcacugggaugaucucugccuuugucaucugaguaggcugagaggaucauggaggccaucgagcugcaucgagaagaaacugcaaaaaugaaagaacacagagccauuuguaaagcagcggggaaagagguaagcgugucuaucaaguuacacacuuaccugguaaucuacaaaaagaauuccuaaagagaccauuucugaccuaaaugaaaugaggauaggcgauaaaggcaguaaaugauccgugugucagaauaagucagacucugggagucaaaggcuucuuguaaugacuuggcucccuucauaacgucuuuguagguuccucuuccugucaaccccauccugauggcucauggcaauauuucugugaguaggaugucuguuucuccuuggugggucagggguuaacuucagagaugagagggagugaggaggcauuaugauuuggggguauguacuccgggaagucccuuuguuuccaaaagucucagugucuucuaaaacagcuugcaucucaaaaggcugcuggugagacuuccccagaugcgucggggcuagaccagccugccucuuccaccguuagugcuuuugugugcccagcauucacagcucucuguagacucgucuguacgugaccucugauaaaaaucuuuguaggaacaauugacaaaacccgucaugaagaaggaagggguguauuaggagaacaugcuuaucugggaguugcuaauuauuugcauguauuaucauuacaguaaucucagaauaucuucauugcauagauaugaaacaggcccagcuuacaaggaaguguagucauaaaggacauaaauaaggacauagcuuacuuauaacccuguauggcuaacugcaagcccacacagcacugucaucuuagccucuucucucaagacggauggccguaggcccugaggaaagcacucgggagcuucacuaaugcugcuguccuuccuuuguagccuucagcguauguguuagagacuuuuaaagggaucaggucaagguaaguccuagcauacuauuguaacuugacaggacagccguuacuggaugucugagugugaaauacaaguuggaauugauaguuuucuuucuuucaauuuuaauugugaaucuuuugguagauaacaauuauaauacauugaguauaagaaaggaggaggcucuuaaaguaugaaggguguuuugaaggagagcuguuauagguaauaaaaguauagaugucaaucaaauaccagcucucagaagcuguucuguuguauaucuuguuccgcuuauuuuguguguauacacaauuggaaccauugugugaguacuacauacaaacugauugggccacucaagcuccagacucacuggguaggaucucacucauuauuauauauauguauaaucugcucuugaguauuuuauaguauauccauuuaauguauucauuugguuaaaaguuacaggcaaaaaguacgaacaaguuuugguugcuguucuuuguguugugugguagucugacuggaccuuagaauuugauauaaagaaguuuauuuuucuaaauuguaaugugcacagugacccugacaaagggguagagcugccugaggauacugccgagcuuucguuagaaacguaaaggggccuggagaauagaggugcagacacacgggccaagacuggaggguucaguucguaagggugauaacuguuaaacuaaggaagagacuuugauccaaacugaaauccucuugcgucuucuaacuggaagugguggcauuguacuggaacuaguuauagaagaagcaaaaucaaauggugaaagauuggugugagacucaauuacccagucaucaucacagacucgaaagccuugaaauacauaugcacacuugcacauccauauacacaaguauauaguacagucaguauucaugcacacugugcauacgcaauagacagauuagcaguuugugugcauguguguggugagagaaccaucaugaagugggacagaguggaguuuucagcaaggcauagugagcacuuuaucugcaauacuuagguuuucccuuuaugcuagggacuaacauacucuaaacggaugguguugaguguaaaagacauuuagaagaaucauuuugaguguaagugaauauuuaacucugaguggacagaauucacaaaaggaaaagcaagcgguaagggaagccgaguaccugauagcgcuaaggagugugaugguuugcguuuccuccucagugaacuagaagaggcccugcuugugcugccauucuccuaugucccagacguucuuacacuguucaaugaauucauccagacgggcuuggaugucgagcucuugugccggugccucuuuuuucuccucagguaacauguucuuacaaauacugacucuucaccacagugcuccagcugugcaccagcugaggcuggcaguguuuggggauuacaaauuuuguguuucguuuuggagacuguuacaaaauagcucuugccauuagguaaucauuccugccuuuaaaacaaggauccugcuggcuccucuuuucagagucacuguaagcuguaguugaggaugcagucuaaggaggcuagguagauuauccacuagacgccaguuuacuccaccuguuuggcuuuuaaauugcuaagccuaggcuagucagcuuuguucgcaacauuuuaaaaauagccaguuagugucuguagguaucuacgggcacaaaaggaaguggaggggacaaaaggaggggaacuaaggaauacacacguaguuaaacagcuguuugauaaagugacuauuuggugaauuggccuaauuuugcuuguuuucagacaggcuuucacuauuuaucccugucugccaugcaauaucuauauagagagaccaggcugaccucggacuugcccaccuccccauucugcaggcuaggauuucagguguaugccaccacagcuggccuuugguuuuuugagacaggacuucauucuagcccaggcuggccucguacagccugagcugcccaauaacuaguagccuugccuuagugccaggauugcagugaugagccaccaugcucaucuuuuugcauggguccucaugcuuguauggcaagcaccuuacugacugagcucucagcaguccccauggcuggcauuguuuacauucuaucuccagcuucccauugcagucucugguccugugcuagaucucugagggaggauguuacuguauuaccagauauaacguugcauuuuucaagaauggugggacacuugggugauuuuuguucuuguuuuuguuggugguuggguugucaucuguugacuguuuggaggagggacagguagggcagauccucucuuugcagcagcacgacuguuuucuuuuaggauucacuuuggccagaucaccagcaaccagaugcuugugcccgugauagagaaacuaaaggaaacaacuauuucaaaagucagacaaguccagguaagugucuguuguagacacguuaauguaccguaugcugggcaauaccaaacagacuuauaucuguagucaggguaagcuuucuguugucuguugcagagauaggguuuuuauaacacugacaacagaagcacuuagugagcuaaggaaacaagacagugcccacucagacgcugcuacacugacuaaagauuacuuuuuuguauucuucuccaggaugccauuggcuucaauauggcuggucucgauuaucucaagagagagugugaagcaaagagugaagugauguuuuuugcagaagcuacuagucacuuggaagagaagaagaaaaaacgaaaaaacaggaaaaggaugauuuuaacacugacuuagaacuggaaugcaguguuuuuuccugcuucuucucaaaggagcguacacauaaacugagcuguuguggaguuggcaacauaaaaauaccaaaaaaagaucauguuguagaucuugggguacagaugucagccuugguugaagaaaccaacauggcugugacuacugucuuucaucuuuugaaaaggacggauuuaguuuaaaaaucugcauuuuucagaguuggaccuuuaaauugugucaagaagcaaaauaauauuuuuuaauuguguauuugauuccgaagugucucauauuuauggcagauuauuuguauuagagcuuuucuguuuaccgugugugucauuguccucuaaaggaagcgccauggacuggggcugaaagggaugauggccugcuaagagcugccugcuuacaccagugcagguuggugagucugcauguaaggucauaaugcuguuuguacuuuuggaaauacaauagcuuuuucauuaaaaccacuuaaaaugac
